United States Patent 10,858,650 (METHODS FOR MODULATING ATRX-DEPENDENT GENE REPRESSION) - sequence listing, part 2

SEQ ID NO: 2038 - DNA, 1000 bp, mus musculus
tctgagactgatgcagtctcttaactgtattgccctgtaaaatcaaaatgaacacatatacattagtgttccaaaagggagcatagtgaggaaataatggaccaaagcaagaccaaaaatcatttgggaaaactcaaaactctgcatctccatgcctggtgccaaaatgctctacagatctccaagccctttcagctttgttgagcacaacacacttctttctcttgggctggttccactccctgctatcagctttccttggcaggtatcccatggctctgggcctcatgtagggatatccctgctacatgcctagtgtcagctgctttctttagttgcagagggtagactccataaccgctttcttctatccttgtctcgtaagtcagaaccacgtggatgaagtttccaagttcttgctgcagctggaacatggcctctcattcaataacagtttcatcagctttctgttttcgatggtttccttcactgcctaaggttggctgtcctgaaattgctctgtagatcaggctgaccttgaactcagagatctacatgcctccatctcctgtgtgctgggattaaaggcatataccaccatggttggacctgaaccattcgttgatcccccttcccccattggatggaagcttagataggtgggatcttgccctgaggtcaccacttccttaatctctgatatctttaattggtttatctccttgaacacaggatttagctccactctacttcctgatacccctttagttcttgaaccatatactttgtactttttcttgctcaacttgctccttcccatcaaaacgctctctgtaagagtgaacattagttaccacatgacagagtctacactaggctattttgagttttcctttgctagtgcaattagtccaaaactctagccccaggcaaactcttcaggtaagggcaaaaagcagccaaattatttgccaaaatataagaacagtctttaggccac

SEQ ID NO: 2039 - DNA, 1200 bp, mus musculus
aaaggttttgttttgaacttcagtgacttagtatattgctaaatgaacttcctgactgaaggttgagggtccaatcagactaataagcaaaattgtctttttcaagtgaagaaagtagtttatagactaataccttcattgccatttaacgttactgatttctttaacgaattgggtttttttattttcttttttattggttaatatatttatttacctttcaaatgttatctcccttaccagtttcccctccacaatcctcctatcccttcccccttccctccatgagggtactccccacccactcgcccacccactccacctaagcaccctagcattttcctactctgagtcatagagcctccacaggaccaaggggccaccctcccattgatgccagaccaggcaatcctctgctacatatccagctggagccacgggtccccccatgtgtactctttggcttagtccctgggaactttgggggctctggttgattgatactgttgttcttcctatggggttgcaaaccctttcagcttctacagtcttgccctaactccagcattggggttctcacactcagtcaaatgtttcgctgcgaacatctgcctctgtattggtcaggctctggcagagcctctcaagggacagctataccaggctcctgtcagcaagcacttcttggcatcagcaatagtgtctgggtttggtgtctgtagatgggatggacccctaggtggggcagtctctgggtggactttccttcagattgctccactctttgtccctgtatttccttttgacaggaggaattctgaattactatttttgagttgggtgggtggccccatccctcaacctggggagccatgcctagccactggatatggtctctacaggttctatcttgcttttgttgggtatttcagctaatgtcctctctgttgggttctgggaaccccttggatctctggcctctgaaactttctagtgactacccccagtttcctctcccccactgacacaccttccttcaaattcctgaccctttgtacttctctctcatcttctccatatctcaaccgtcccacctccccccccccttctctgatcccactctccttctacctcctgagattattttcttcccccttctgagtaggactgtagcatccaaactgtggtgtggtcttcctt

SEQ ID NO: 2040 - DNA, 1600 bp, mus musculus
ttcattttatttctgtacttacatatttatgatattttgtctaggtatgaatatatgaatatacctgtttcaattcacagaacattttccacaaaatgtctcccctgatccaaatgtcagcagctctggcatagaggccaaataagaatttatatatgagatgtatattcatgtttattttttggacaaactatttcaccatttggccagttgctatattgtcaagtagatttttttccttacatcactgtctcaactccaaattaaatgactataatacacataaatatcacaggagatgctagttcacaaacaaggaatggttatatggctatctctgtcttcatgggttctttttgtatctcaccatgacttcctcttatatgtacattctatgctctctggtatctggtcatttcctgcctccctaccactgtgagtacaggacacatatggatcataaatcctgtaataccccaaagcctcatccaattgtatgattatcaaggcaaagccaagacagacattttgtgttcaagcaaataaatgcactaccaataagccaataaaacctttacagaagtaggacataaactatcaagatatgtgggtcacaatctataagtgcttgcttctttaggttttacaaaccctgtacttgagccctggaagcaaaaccaatcaaagctaataaaaatgccaaggttttatctatcttgttcctgatggattgttccccccacctgttttgtttccagagtgaccacaggctgtctctgctcccaaatggaagaggcacaggccagcatacccaagaactaatttcaaatacatctttaatgacaatgactttccaatttggtgctgaatagtgaaagaaaactaagtcataataagttgatcaggatctagccagtgtcttatgctccaaggagcagaaccccaaacaaagctaaagcctggaacttgaattctccagctgcattttcaggtggtcaactttatatgggagctgcaatagtctgtgctatatggttagaacacacaagtatgtatgacttgtttgataaaattaaaagaaaaacatatcctaaagtggaaggcagagtatattactattagaatgttaatatcttcacatgaaatattttgcctttggacaacaggttttggcaaataataaaacaattaagattgtattctgagccatgaacctgaatattctatgactcaaatgtataatatagaagaataaaaggaaggagatgaagagaaaagtactggagaatcagtcacagagttcaatacacagggatatttgttaacttcagaaaattgacttcaagaaatacccaaatcaagtttcttataaagtgactaaggtacttttgtatactatgcacatcacttcataaattcttgaaatctttcttttgtgtggatgtgttccctacatgtccatatgtgcactatatgtgcacacatttttcatacaccagaagcatgggcatgcttaatctggcataggcctgtagaggatactagctttcctggaattggaattatgtataactgtgagctaccatgtaagtactgggaa

SEQ ID NO: 2041 - DNA, 1000 bp, mus musculus
tcctctctctttccccgctcgctttcaggatgacatcacagacgtccgcgtccctgacaggccacccgcaggctggtctcggctttaaagcagctgtgcccctgtcccctcgaagtccagcgggcagccaccgtgtccacgtctgggagtgtgccgggaccttcctacctcctctcggtgtgaacattgcggtggacagcacagacgaccggagacagacaggtaggtacccacggaggattccaccacagaacatcctccacacccacccagtccccgcgcccacgctctcactctggggcaagggatttcttccacaaggaagcagtgcagaggctttcttcctcggctgcctcaagcctcagtgggtaaaaatctcatttagtgcccccatacccccggatcccttcccccttgtcaagggctcctcttggaagggctgccaacaccaagtctcaactggattcaggaggtcaagtcccaggatgcccgggagggaagggaaaggatctgctcagccacaggtgcgatgtctccctttctccaaactgggggtgggagggagggggtgcgggtggtggcggtggctgggaaagccgttctggagctagcgctgggctctcctgccagctggagtaagagggttgcatgtgagctaagccccgcgctgccgctgggtctctggtgcctttcgcccagactctaggtgtagccgacctgttgcctgcgggaaagcgtcccacaagatctgagagccaggagtccgtgctgaagtcagccgcgatcttacgggcgagcatccccagagtccagcgcccacgggaggaagacgtacacggtgccgggaaaagcagcgggtaaccatcccaggacaaccaaccccttttcttaccctttgtgtcattagttggtggcccaacgaacccggggaaagggagtgtgagggctggggaagtagctgatgaaaaggcgcaaacagggcagataaatcccagtcttg

SEQ ID NO: 2042 - DNA, 1600 bp, mus musculus
gagggtactagtgatgtgtttgtgtgtcaagttgacaaggggtcaattgtattggctagttttgagtcaacttgacacagttggaattatcacagagaaaggagcttcatttgaggaaatgcctccacgagatacaactgtcaggcattttctcaattagtgatcaagggggaaaggccccttgtgggtgggaccatctctgggctggcagtcttggttctataagagagcaggccagtaaagaatatccctccattgcctctgcatcagctcctgctttctgacctgcttgagttccagtcctgacttccttggtgataaacagcagtatggaagtgtaagctgaataaaccctttcctccccaacttgcttcttggtcatgatgtttgtgcaggaatagaaaccctaactaagacaggtaccatggccagacaacagatgctcagagagccaccatggccagctgactgtctcaggcttgatgaggtttctttactcttcagaccgctcagttttcatggagtctgctatttcagaaagggctctccctcacccacatcagcacagcaccactgccactgagggcggctactgcaggggaaggttgtccaaccaccccatctcactgcaggaaggaacacataccttcgtgagctgcagctcggaggagaatcccaaaccgaacacggtgttggctctgctgtcagcccactgcccgaacttctgtgacgttttggtgaaagtcatgttcggggtgatagtgctgtttatgatcacctgcaggagaagccagagggagagtgttaactctgaactagagcctttcagtcctctccagacaaagccagaggctgtgtttgttcctgagttgttctgaccagagtagacaatcaggagaaagggcatttcaggcaattaacaatggaagcgtctaaaacaagatctttcacactatcaataagaaaatacttttcccaagaaaagcatggtctccaaaactgacgttttattaccccaaacataccaagcataaaagtatccttaaaggccagccctgtgcactttcccagaggaaccacccccatagcctcccacttttgaaatccctgccactcagatattcagaaaaaccagttaatacttccaccatcaggtgggcctttgcttcccaaggggaaggagaagacattccaatttggagagtaggtagagggttaattgacacagattagtcatgctggtataacagggggtctgtaaggaagggcacaggagcctagtgctggctgttaactacctatggcctcagaaagaagaaaagaggccacagaccctgggaaaaaagattgtatagaacatgtgttttctaattttgtatttctggttagcagaattgctgccatgaaataaatgtccaataaatgtttttaatacatgaatgaacacatcatacaccagatgacctatgggtcaatcacaaacacaccccaaggggtcctttgaatgttagtagattaaagtctgaccagtttagcacacatctcccagccttgcccctaacaggctgttccaaagttagtcacgatgcaataataagag

SEQ ID NO: 2043 - DNA, 1600 bp, mus musculus; identical to SEQ ID NO: 2042

SEQ ID NO: 2044 - DNA, 1000 bp, mus musculus
ggtataaatagggatcagcggggcgatggagagcgagcttagcttgctggtacagctagctgtgcagcgcttgtgggtctcacttcttcgctgatctttgcttccctgagagaggcacagcggagaacttttcatggtgtccctccaggtccctcctgctgctgactccagcagaggctgagtcctggctgtctctgctaggtcatgtcaccctggtgctaactgaactggactgctggtgtatccatgaagtgtttgccagtggatcgagctcccgctacctgctaacctatgaactgagctgccaatttccagacaacacagacgggagttgctccaaagaacatttctaaataggttcttcccccgtatccattgttttcactacctctggtgggtgggctaaagggaggttaaagcatttaagaaccaccattttaaaaaaggatttgtcctggcggtggtggctcacgcctttaatcccagcacttgggaggcagaagcaggtggatttctgagttcgaggccagcctggtctacaaagtgagctccaggacagccaaggctacacagagaaaccctgtctcaagaaaaaaaaaaaaaaaaggatttgaaaaaatttaaatacacacaggtatcaagggtttttactctttggatcatgtcctttgctatgaattctatagcactgacttttccctatttgggggaattcccgtcatgccagcagatctgggcagatctaaatagccggaataggtctgggcactggaacagcaaaatgtaaaccagcagtcagagagctagcattcagagtcactgaccatctgcaactcatatccctcctggtgtagaggacagggcagcatttgtctgtgtgctgtgtgcaggaaggaagtgccactgtcagaggtcagaagcaggatgaaggaagtgtgagagggttcacttactatgcggttttcctgaagcctggcctcaggaacagagatgaggctat

SEQ ID NO: 2045 - DNA, 1000 bp, mus musculus
tacttgtttactgtttaagggttttcatctgctttcttgtgttttcctgtatttttttccaatgagttatttatatactcatcaaagacctctatcctcttcatgagattggactttttttgtcagaaactggattttcaggtcttttaggtgatcaagagattgctgggtggaagaactgggttctgacagtgctaaattacattggcttccatcacttatgttaggacacatgcctgtctccatttggttatccctggtgttatcttgcccaggttcctctgactagagctggcctctttggaggcagtttatgctcagtttcatgtgtttgagctgttctcctggaagggagtcaattttgtccctggttgaaggtgtggagacctcctgtgtctctggttcttgatgaccttctgtgtacctgtttggggcagacctcatgtgttcctttccatgttaacctctgggagacatgaaggctctgtgctccatagacaggttctgccataatagtagatgggttgatatactaaaatagtgtgaccctggttatagtagatctcctgtgtctctggttatagtaggcttcctgggagtcagaaggctgtatttatggtttctgaagacctcctggtagacccacaatctgagtatggagaagcagaacatgaggaatattgagctcctgagtatgacaggtgggtccagaatcagcttggatatggtgagtgtataagctgagatgaaaatttggaaatgagtctcacatgtgttactgcagacctcctgagagacaggtaggctgttatgacctcaagtgtcttctttgaaactcttcttcattaagaggaaccattttaatttattggtgttctgttcatgaaaatttccccagtgcccatgtgctcaaggatcttcacaactttattttctattagtttcagtgcttcttgttttatgtggtttacttaattcacttggacttgaattttgtaca

SEQ ID NO: 2046 - DNA, 1400 bp, mus musculus
ttatacatttgcctccctttttgttttcaacattgtttctccttccacttttaggtcttggaccacttagttcagttctttcatctgtaggattgtgttttcctacatttctttaaggaaattatttgttttctctttaagggattctgcctctttatctgcattttcttgtatttcttaaaatatattatttatatcctctttaaggtctatattattttcataagactggattttaggtcagcttcttgatttttcagttttgttggtatatctggggattactgtgttgggaaaactgggttctgataataccaaagtatattagcttctgtagtttgtggccttgcacttgcctctccccatctggttaaccatagtttaagatggtctgggtgtctgtgtctgtaacctgcttcttctctccctgggtagctgcaggtctccttggagatctatgacattgtctgtagctaacctattgtgaggtcttcagactgttgaatcttcagaggagcagatcagctgttggcctgtgcatactattatcctgggagactttcacatgatgagctctgttgccatgtctgcagtagaactccagggaggctttcagactgtttggtgagttctgctgcatgcatagaaactcctgagagatcttcagtctttgctctcttcagaggaaaagacaagttagcaatctgccctctcagaaggtacaggccagaaggggagtagaattcagggtgtaggggctttgatggctttgatgagagatggatcctgagtctactgggatccacaggattccatactgcagtacctgtttgtgagactcttgtacctatttgaactgtttccagcagaatacctagaaggccttcagtctgtgatatcttcagaggagcagacaagctggtgatctgaccagtcttaaacttaaggaaaaaaggttacttaagtttcataagtggtatctgtcttgaaaaaaactatacatttcatttagattttccactattatggggtaaagattttgaaataagacctaatgatttttttgtaattacattagtttgttttgttatgtctccctttttatttcttattttgttaatttgcatacagtctacatgccttttagtttattgtctaaatgtctatatttttttctaaaggactatgcttttgtttctgcctctttgtattgtttccccctttttcctaattgcttgatttcaaccttgagtttgagtattttccgctgtcccctcctcttgcaaatgtttgcttcttttgttcaagagctttcaagagtgtcattaagtttctgggtaggatttcgcccatttctctattaacatactttgtgccatgaatttttaactgaatactac

SEQ ID NO: 2047 - DNA, 1000 bp, mus musculus
ctttttagaagttatcatcaccatggcagtgtagttagagagctagaacatccagagattctcagtctttaaagccataacacagtattaccctgtgacctgtttcaacctgctccagtcggagaggcttccagcatggatcattgaagtttggcctcttcccaatacttactgacagaatatccaggaactaaagccatcgagacaactaaagggctgtgaaagaacacaataaagaaaaaatagggcaatatgaccccctcagaacacagctacactactggactactgcagcaagccctatataccctaagacaaacaaagaacaataaaatggccctaaatccagtcttatataatagaggcctttaaagaggaaaataataagtcctttaaagaagttcaggaaatatgtagcccagggaggcctccaactcattatcttcctgactcagcctccttcagtaaatcttaccatcatgcactaccacagctctgccagtgcctgacaaatgcagaagtggatgctcacagccatccattggcctgagcatagcttccccaaagaaatagctaaagaatagacccaagaaggtgaacaggtttgcagccccataggacgaaccacaatatggactaaccagtaccccccccccccgagctcccagggactaaactaccaggcaaagagtacacatggtgggacccatggctccagctgcatatgtagcagaaggtggcctagtcagtcatcaataggaggagaggctcttggtccaatgaacgttctataccctagtgtaggggaacgccatggccaggaagtgggagcgggtgggttggtgagtggagggagtaggaagggataggggtttccacaggggaaccaggaaaggggataacatttgaagtgtaaataaagaaaataagtaataatagtagtagtagtaatgttcaggaaaatacagtaaaaaaatgtagaggcttttataaatgaaac

SEQ ID NO: 2048 - DNA, 1800 bp, mus musculus
cattgtgtcctggatttcctggatgttttgagttaggatctttttgcattttctattttatttgattgttgtgcccatgttctctatggaatcttctgcacctgatattctctcttccatctcttgtattctgttgctgatggttcctgatttctttcctagggtttctagctccagtgttgcctcacttttgggttttctttattgtgtctactttcttttttaggtctttgatggttttattcaattccattacctgtttggtcgtgttttcctgcaattctttaagggatttttgtgcttcctctttaaagtcttccacctgtttagcagtgttctcctgtatttctttaagcgagttattaaagtccttcttgatgtcctctaccatcatcatgagacatgcttttatatccgggtctagcttttcgggtgtgttggggtgccctggaatgagctaggtgggagtgctgggttctggtgatggtgagtggtcttggtttctgttagtaagattcttaagtttacctttcaccatctggtaatctttgtagttagttgatttagttttctctggttagagattgttcctctcgtgattctgttagcctctatcagcagacctgttctagcagactagttctctcctctgagtttcagtggtcagagtactctctgcaggcaagctctcctcttacagggaaggtgcacagatatctggcattgggacctccctcctggccaaagattaaggcccaaaacaggacctgtcccagaagctgtgttgcttcggcctgtcacagaagctattagcttctgtagtccacactctcacctgtgcaaactactctcagcggagtcctggaaccaagatgtctcccacggatgctcagggaaagccctttcgggccgggtggacacaacacctatcctctggtggggaaggtgccaggatgtctgcagccgaaaagtgggctgcctcagaagctttttggctctagcctgtcccagaacctgttagcttctgtagtccacactctcacctgtgcagactactctcagaggagtcctgaaacctcatatttgttcttatgaaatattttagcatgatttcttttgtttttatttaaaattttttataagcatatattttcatataatactattgcacaaagtatcttcataatcttattttaaaagattttacttttcagtaattttgagtatactgttttatttgtctttttctacctttctgtttcagcacattattacataacttatacaggttactatacacagtttgaagacatgtaattggtatcaaattgattgaactaattatattctctagaattttatatgtctcatgtatttttataatatttaattcctttgtttcttcatttttcctgttttttaaatataatacatataaagatatggcttgctttttttaattccttgccattctgtgatgaaagaggatgtgtgttattttttactttgagttcttgtatttgagttctccattaaaactaataatgttactgttttgtgaaaagattgcttttcaaataatttataccattgttttaaaagatgacagaatgttttcgttctttgtaattgtatcttcatgttctgtgaatacttattatttttttaaatgttcgtatctatttctaatttatggagtaactttaaataaaaaatttcatcacctcaattcctttcctctatctactccctaagtattattttgattaacctttccatgtcacttcactctcaagcaat

SEQ ID NO: 2049 - DNA, 1200 bp, mus musculus
ttagttatttatatgtaatgaatacaagtcctttattagacatttaagttttagattcaatttgataacagatgggctatttctttaccctgttgttggcttctttgatattcaaggaatatcaaaagatattagccttagtctgatataataacataccatgcttttagaattgaatatagaacaacctaatggaggattcttgttgtgttttcctgtggcagtttgacagttttgcttctgatataacagactaattcatttgattagtgttttgtcattggcattacatgagattctaactctattatactgaatataaatatcgaatttctcagcataattattttaaaagactgttatattttctttgttaaattttggtgttttacaaaaaaatatctattgactgcatttaattacttattttatttgaaagactttaatggaattatactatttctccattccctttcctccattcaaaccatgacaaatgctcctctttattctcttttaaatgcatgtcaggaagcacttgctgacaggagcttgatatagttgttacctgagaagctctgccaaagtctgacaaatacagatgcagatgctcagagccaactacaagactgagcattgtgacctcaatggaggagttaagggaaggactgaaggagctgaaagggtttgcaaccccagaggacgaacaaaaatatcaaccaaccagaccccccagatctcctagggactaaatcaccaaccaaagagtacacatggaaggacctatggccccagctgcgtatgtagcagagaatggctttatctggtatcaaagggagggggaggattttggtcatgcttgatgctccatctcagagatcctctagggaggtgagtcaggagtgggtgggtggaagacctcccttagagaagcacggtagagggggcatggggtaggtggtttgcaaaagggaaaacaggaagtgggataacatttgaaatgtaaataattaagataaccaaaagaaaaacccaataaaaatatattcaggtcctatttttccattaaatgttacctgcatctatgtttatgcttatatatatttgtgcatggatatatgtatatacctaaggtcatatgtttaacttccttatacataaatacaactagaatattaattgtgtttcgctctttagggt

SEQ ID NO: 2050 - DNA, 1600 bp, mus musculus
gcttcgttttgtgctcattgtgtcttggttctggaaacgatgaattttttttaaagtcggatgtgatctcttcattcatttacatcatcttgcatttccttcagtatctgtctttcctaggaataactatgaaattagattaacttggcatagatatttttcagagtgaggaacagaaaatagcctacagttgccaactgtctttgtcaccctaataggacaaaaatgacagaggtgttgaaatatgacagtgatgaattcaaattctgaatttgtcacttgcatggtgtatgaccccttgtgtatgatttatttccttggatgcaatggcaaaatgtctagctaactccaaaggttcttaggaaaattaaaaagaagtttgggcatgcctttccttcaaggtaagaaaatggtgtgttttattctgttttaaactaggatgcacacgaacgtttccaagccacactactgccatttggaaattattgtttcctcctaacagaaagaacaggtggtgtatgatgcctgattggttgtccagtgtctgaaagatccacgcagcctaggttaattgggactattggtcttcctatagggttgcctttctcctcggcttcttccaacatttccctaattcaaccacaggggtagtagcttttgtacatttgttgggtgtaaatatctgcatctgactccttcagctgctggttggaactattagagagcagtcatgatacgcctctttttgtaagcactttatagcctcaggaataatgttaggccttgaggcctccccttcagctgaattccactttgggcctgtctctggacctccttttcctcaggcttatctccatttttgtcactgcagttctttcagacaggaacaactatgggtcagagtttttgactatggaatagcaatcccatcaatcactcgatgccatctttctgctggaggtgggttctataagttccctctccccactgtaggacatttcatctaaggcccctccctttgagtcctgagagtctcacctaccgagtctgtggtgcattcttgaggttctccccatacttcctacatcctgagattgcctgtttccattatttctgctggccctccatgcttcagtccttttcaccgacccaatacctgatcatgtccctttcttcccctccctttcctctttctcactcatgtacctccctccctgtctccctcctgtgattgcattcttctccctccctagtaggatctagatgtccttacttgggcatgttaacctttttgagttctgtggactgtatcttgggtattctgtactcttttgaactaatatccacttattagtgagtacataccatgcatgtctttttcggtctcagttacctcactaagaaggatatccatttgttctatccatttgtctgcaaaactcatgatggcatcattctttttttttttttcactgatgaacaatttttattggatattttgtttatttccatttcaaatgttatcacctttcccagtttcccccctctgggggacccccatcccatcttccctctcccctgattccatgagtgttcctcc

SEQ ID NO: 2051 - DNA, 1000 bp, mus musculus
ggagttgtgagaaatcttttttccccattctataggtgtccagtatttgaatgaataatgacattgtataaagcacaaccacctccttttttgaaaaaaattatattttttatttttttgagagcaggagctaatctccaatgacagcagaaaaaaatcacaaagtccacctgagtaaacatcctatgcaacacaacctccttatgcacaaccagtaaagctcaatggctggaacaacgtacataaagataacataagacatcctgcagagaatagacaccctgatcatcctacttgtcaggtggttctgctctcaacacaaatcctgcagattacacaagaaatgcagcatttaaaatattaacttgctgatctgtatggaaattccccaagtttgatgtaactacaataaaacccggaacccctagaccaggggctctcactctgattcacagagaaggggatggtggaagatctgagttttacatagatatctgccctttggtggtcgtttggaagctgaaatttgggaataacaatagaaccctctaattatcatgagggaccatttaattgtagatcttagattatatccctattgtgttctgagcctgacaaatacaaatatggaatcttgcaaacaaccattgaaatgagtatagggatccaagtggaagtgttagaaaaaggactgatgaagctgaaggtgtttgcaacaccataggaagaagagtatcaaacgaccagactccccaaagctcccagggactaaaccaccaaagaaagagtacacttggagggaaccatgcttccaactgtatatatagcagagtatggccttatctggcctcaataggaagagagacccttggtcgcttataggttttatgcccagtgtaggggaatgacagggaggagggattgggtatgtagatggtacagcactctcatagaagcagggggagggggattggatagggagtttgtggggaggatatag

SEQ ID NO: 2052 - DNA, 1200 bp, mus musculus
cctcaaactctttggcacaattcttaacagaattccaatggctcaggttctaagatcaagaattgataaataggacttctgggcctgaaaaccttctgtaaggcaaaagatacagtcaataagaccaattggcaatgtacagattgggaaaaagtattcactaaccccacatccaaaagaaagctaatatccaaaatatataaagaactcaagaaactaaccaccaaaaatacccaaacaacccagtcaaaaatgggttataaaactaaacagagaattcataatagaggaatcttgaaatactgagaaccacttacagatatgttcaaagtccttagtgatcaggaaagtgtacattgaaaccaccctgagattccacctcacaccaaccagagtggctaagatcaaatactcatgcaacagtacatgctggtgaagatatggagaaaaaagaacactcttccattgctggtggaattgtaaaatggtgcaaccacactgaaaatcaatctggcagttcctaagaaaactggcaatagatctacctgaagaagcagctataccactcttgggcatatacccaaaagatgctccaccatgccacaggagcacgagttcccctatgttcatagtggccttatttgtgatagccagaacctggaaacaacccagatgtcctgcagtggaaggatggatacagattatgtggttcatgtacacaatagaatactactcagctattagaaatgagaacatcatgagatttgcaggtaaatggagggaaagagaagatatcatcctaagtgaggtaacacagactcaaaaggacatgcatggtatgtactcactaataagtggatattagtcaaaaagtatagatcacctagaatacaattcacaaaacttaagtttaacaagcagaaaggccaagtaaggatgtttccaatcccacttagaaagaggcaagaaataatcatgggaggcagagagagagagggacctgggtgggacagggaagggggactggaaaaggggaacaggtgcaggtactggggacaaggagaggaacccagagagccaggagaatgaatggaaacatgcagcctgaatatttgctctaagccaaatacactttattacttagggagaaagaaatttcttacctacataatgattaaagaaccgtttctctatctgact

SEQ ID NO: 2053 - DNA, 1000 bp, mus musculus
ctattgtgatgccttggtgaggtgcagggccagctctctggaatactgcaacaggggagggacaggaccaactctattgctctgttgtccttgaggccaactctcttgcctgccctaggtgggaaggaattggggaggtggggtctcttctccatctatgtcatctcactgcagacaagtggaggggcctatgttcatgccctctgggctggctatccagtgtgcttcacccccctccccccagggtcagctccactgcaatgtgtaggctactcacccaagtgctgcaggtggtgcatgggcagagccatttctcctgctctcatgaccactgtgtcaggtctccaggttgctgccggtggtaaggcggggtgggagtggggggagaatgaagatgatgactcatctgtgtccataccaccaaacaggagagaagtgatagaaccagttctctcatgttatcctcggggccagctcaccagcagttctttcaatgtgcagggcacactctcctcaagtattgcagctggctagggtgtcagtcagcactactgttttcatatctgtagggccagatctcccacgatgcccaggtgagtggtggtggcagctctgcacagctttcagatatcaacatgtccctgtgcagcagccaaaatctttggtggtaacagaactctgctccagagccatggtcccagacatggctctaaaggcagcacaggccagatccccatcatagtcccaggtggcaccacagtccctcactaccctcaagtctccagttctacctctcttcattctaccctcatccttctgtgtctctttctctctcatttctccaccacttacttgctccccttagtggcacctggatctctgatgggatggtttgaggtcctctcaggagtgttctcagaagtgctattccctgctcatgcatatggcatatggcacttggcagaggtcatcttggccatcatctgcccctcactactag

SEQ ID NO: 2054 - DNA, 1400 bp, mus musculus
caaaaacaaaaacaaaatttagattacaaaagtaggaacttttttttaaaatcccaatggtatattttataataaaaacatcaaacctgaaaatcagaaaatattgttgatatcagtgtctttgtggacagacctagaacaagtgatgtagaaaaaccagaaactgtcatgttgtctttacattgaattgcattatcatttacaaactctgagaagtttaaacaataaaagtttgtttcagccaagttttggaccattttgttaaattccttcacctgcttgattatatttttccttcatttctttaagggatttgtttcccttttaagggcttctacatttttacctgtatttctttaagggggatctttatagcctccttaaatacttctatcatcttcatgagatggtattttacatcattatcttggttttcaggcctgttgggttctctagggcctgctgtggtgtgagaactaggttctcaaggtgccagattgtattgtgttctattgcttatgatctttttgcttgcctctggccatctggttatctctggtgttaagtagcctgggtgtgtctgactagagcagatgtccttggaggcaggcagtgctgtctctggttagagtgggcctcttgtatctccagttacagcactcctcatttgtccttggttactgcatacctcctgggaggcaggcaggctgtgtccctggttaatgtgggcctccttggatatagacaggctgtgggatgtggtaggatatccatctagggtgatctggccagggtggagaaacatactttaggaaggtggagctcggcagggcatgtgggccctgtgtctgctgggctctgtgtctttggttattgtggacctcctaggaggcaagcaggctgttgaatgtaggtaggtatctggctactgatctgatctgggtaggaagcagatgggaaaaaagggtagagctcggggttgtgtggggaaggtcagtcctgagtcagctgtgtcccatgattattccaactggagggggtatttggataagattcttacatgtgtcttctcctgggagacacaaaggctgcaggtgtgggcaggtatggccagaaaaagttggagatcagggtggtggaggtaggaaaagtgggtcccacatcagctgagagattttttgctgttatttagtcaacttttaagcatcatctcaaggccctcttttaaggatgagggaaaaacatgcatgaggtaacaacagatgcaatcattcaaaacatatactctcaaatttatcttgtttcaggacacaaaaagcactgacatttaaaattgctgatatgtattatttgcatatattgaagtaatgttagtcagatctattttagacaacaaaacc

SEQ ID NO: 2055 - DNA, 1000 bp, mus musculus
catgaagatatcacaataaaaatcactttttaaagaagatttaacagacccagaaagacagcaccaaggttttgatcagttgcatactcttgctcataatgtccattcccatatatgtgcaacacaaatcttggaagttgaaaggatgctaagttagaactggtccagggaagcagtgaagggggaaggagggtcaagtgaaggaaatggggtaggtatgaacaaagcacacacatgtgaatctgtgataaagtcattcagtataaagcctattgttttaaaggacaaaagggttatttgacaaaacctagacagtacatccaacaaccttgtaagtacacatgcacagaaagtgattcagccatacacagacagcacatgaaccaaaagtggccaatttccaaacttcttaacttgagaaccttttttaaaagtaaaatcaattacatattacactttgaaagttacatatgagcttgaaacaccctttaatgttatgaagaaacgatgtttcaaatggtttgttgtggaaagcatcgtggcagcttaaacagaaaacatgtgtaaggtgtctgaagggaagttcatggttaggagaaggagcccatcggagccaacttctttctgcctttggctgtggactgagcatgactttgggcgctctggtctccaaaggaaggagcacagctcattctaatcgatccagcagttttctgggaagtggagctggcttgcactagagcacaaagaaaagggcccagaatcagtcattcgactcatataaatagctaagggagagtcttgtttaaatggaatgagtcactacagcttttttaaaaaatatatatagaaacatgctatttatgccttcaatgtatagaggtccctgtgattaacatttgggctctagacactaatttcacatgtgacatggcacagcagcaaatcattgtcaagggggtaatgccaggcttctgtttaaggccttcacttcagccag

SEQ ID NO: 2056 - DNA, 1000 bp, mus musculus
cactattgtggaaggccaagaatcgtttgctgacaggagcctgatatagctgtcacctgagaggctctgttggagcctgacaaatacagaggcagatgctcacagccaaccatagtactgagcatggagaccacaactgaggacttaagaaaaggactgaaggagctaaaggggtttgcaacctcataggaagaaaaacaacaacaagcttccaaatcccccccccccaatcttccagggactaaactgccagccaaagagtacaaatggaaagacccatggctccagctgcgtatgtagtagagcatggcattgtctggcatcaataggcgcagaggcccttggtcctgtgaagactcgatgtgtcagtttaggggaatgccaggacaggggagcaggagtgggtgtgttggtgagcagggggaggaggaatgagataagggattttcggaggggaaacaaggaaaggggataacatttgaaatctaaataaagaaaatgtctaataaaaataaaaataaatagtagttcaaattattatgtcaattaacacctgtagatctatccatctaatttatcactctatccatccatgacatatcacattacatgtaaggagggtattataataattagcaagagggattcagcattgttttgcagtttaggttaccatggaaaatgactgctgtcctgagacatatagagaacataaccaggcgaactggcttatttacagtgtcagctttggttatactatattatctacagtataatatagtatagtaagtttggcatttctagagattagttttctaagcaaggtaatgtacatcatatgccctctccatgaaagcataactaaaaagaaaaacctgacaaaatataaaaaaatgatggaaatgtagacttgagtttgggaaagtaaggctaaaagagaatgtataagagaaatacatgagaagatagagaagctatgtgagggaaagcacagacagaa

SEQ ID NO: 2057 - DNA, 1000 bp, mus musculus
agcccttagatttatttttctatgtgtattgttactgtggttcctaggtagcatgactatgggttgctcccctgactttgaaactttcttggtctttctagtccttatttggtggtggggatggtgctgtttgttttgttggttttcagtatctagtgattaaaataaagctagaaccgagataatgaattttagatgtcatgtagaccagacttgatgccccaaggaacagatgtgctggtgggagtgggttgagagtgggtcagcaggtggggttcacactctcagaggcaggggatgggggaagggatgaagaactcaaggagtgaggaccatgaaggagacaattttggaatgtaaataaataacataatctaataaaaaataaattttaatgatgtgttttattttttgggatatgtatacccttgtatgagcttgtttatatatgcatgtgtataaaggtatctagatagaccagagtagtgtggtagatcttctggagctggagagcattgacctgccttctgttgggatgataaaacattgtcttggtttgagtttttttgatgtgatgagacaggatgaccactgcaactcttaggaaagaaaagacttatttagaggtggcttacagttccgatgtttaatagtgtcacaccttggtgatcaaggattcaaacacatgagtctatgaagggcacttttattcaaatcaccatgaacaccatgagcaacttggggaggaaagaatttatttctacaagagcttacaatccaccatgaagggatgtctgcaaaggatctcaagacatgaacctagaagtgagaaatggagcagggtttacagaggaatgctgcttactggcttacttagttaagggcagttaaaatccttctaatgtggttggtggaatgaagttctggttctctggaggagaaccacatgcccttaactactgctgtgccatcactctggccaccaaatgataaatgattt

SEQ ID NO: 2058 - DNA, 1800 bp, mus musculus
cttaaatcttaaacatggtacaatacccagctgttattttcctgacactgacttctgtgtatgtctcttactcagtcttctaattccccaaaacaacagaatgggatgggtgtgggggggtgttatgtgtctgtctgtcagtctacctattcctgtaggtgtatatgcacagaaacatacaaattaacattttcatataaatgaccatttaaaatattcagggtcgtcagtccttgctgcattcccttcgcagtcgtctggaatcctgttacttggcggcctctgcgtgcatgcgcagacatggcttcaaccaactatacccaataagatactcaaagctacggggcctatcttacccagcctgggcagggctactcccaacaaagtagtcagaccaatggccagcagagttacagtggttatggccaatcagctgacacttcagggatatggccagaacagctatggccttcttatggacagacccaaaccacaggctatggaactcagctccccagggatatggttccactggaggctatggaagcagccaaagttcccaatcttcttatgggcagcagtcctcctaccttgactatggccaacagccaactcctagtagcacctcaggaagttatggtggcagctctcagaacagcagctatgggcagccccagagtggaggttatggttaacagtctggctatggttggacagcagcaaagctacggacagcaaccaagctcctgtaacccacctcaggattatggacaacagaaccactacaacagcagcagtggaggaagtggagggggtggtggaggcaactatggccaagatcagacctctatgagtggcggcggtggtggttatggcaatcacgaccaaagtggtggcagcggtagtggctacgggggaggccagcaggatcgtgggggctatggcagaggtggtggaggtggttacacccgaagcagtggtgaatatgaccccagaggctgtggaggtagccaaggaggcaaaggcggcatgggaggaagtgaccatggtggcttcaataaagttggtcctcgggatcaaggatctcgtcatgattctgagcaggataattcagacgaaaataccatctttgtgcaaggcctaggtgagaatcttacagttaaatctgtggctgactacttcaagcatattggaattaagacaaataagaaaactcgacagtctatgattaatttgtatacagacagggaaactggcaagttgaagggtgaggcaacagtttcatttgatgacccaccttctgctaaagcagctacagactggtttgatggtaaaaaattctctgtaaatcctattaaaatttcatttgctaccctcatagttgacttcaatcagggtggtggaaatggtcgtggaggttgagggcgaggagaaacatgggccgtggaggctatggtggtggccttccccagtgaaggtggtgggggtggaggacagcaacgagctggggactggaagtgtcctaatcctacatgtaagaacatgaagtttttctcttggagaaatgaatgcaaccagtgcaagacacctaagccagatggcggaggagggggaccaggaggctctcctatgggggaaactatagagacgatctacgtggcagaggaagatatgaccagggcagctaccagggccgaggcgggactgtgggggcttcagagggggccggggtgatgggaacagaggaggttctggaactcttactgtacccagttttacccttgttattttgtaaactta

SEQ ID NO: 2059 - DNA, 1400 bp, mus musculus
agagagagagagagagagagagagagagagaaagagagagagagagagagagggagggagggagggagggggagggagggagggagagagagagagagaaagagagagagcgagagagagagagagagagagagagagagagagagagagagagagagagagagagagagagaggcatttagggtctcaagctgaaaggctatgggatgcagaccttctcacaggccctgggagggaatcactcagcacagagagggtgctccactgtgccccctggtgttgagtttcctggaaagctttcaggctcaggcacctggctggaatcccccttggacagcacccaactctgtgtacaactagccttacgggtcaagagtccagggagggtggcactgcccaggccctgtgtgtagtgtgagcaatgtgaaagcgtgtgtgatgaatgtgggaccggcaggagcttttcagatccctgccttagacccccagggctggcttagggaatttctgagcaaccctgatgaaacgtcaaggttgccagggggattctgcgttgcctgagttgggtgaggtgagacccaggcctttttgagtcctgaacttagcaggccctgccgtaggactcctcaagtcttagcttctgatttcacattcagattcagtgaatagagaggccaggaagggatgaaccatccctgtgccccgggaacagtgcatccagagcccagggtgggctacactgctctggccacagcaactcatgctcatagggcaggagagtgctggtcttcccttcttaggcacagtgtgatggtcagccatcccttcagctgggacatctgagcctgattatagtggggagaactctccccttcacaacacctgccgccatcagcattagcctgctgtgcagcctcaggctatgcccttcacctctctgaaccttaagttcctgttcagtgaatagaccttccaacccttctctcaagatgatagagtctgtaggcgtccctgggacggtaacagcaggccactggagaacaaacaacttcctgggtgttagctttactgacattcttcattggatctccctggcaaccagtaaagtgagcaccacttactaccagggaggaaagcagcccagaaaggtttcctggggccacacagtaggtcagtggctggcagaacagctaaagacactggctttctgtcaggcagagggtccaggatagcaggactcctcgctccgtgattcccagtggtttccatggcaaatggatcgtatccactgtatgcattctggggactgtgcctgaccactgcagttcacaggggctggaagctggactcttctcaattctgcccctctcagaggccagcagcttcaaggctggctggat

SEQ ID NO: 2060 - DNA, 1400 bp, mus musculus
tcttaaccactgagccatctttccacccttgtagccactaaatcttgaagccagttgttacccagcccataaaagcccaaggttgagggctactgaagggattctgtggtttgtcctgtgcaataggatgggtagtgtgtacgtacagcattaagcaacaactcacaggctgttcttgtttccatttattagtctaggaatatacaaaagtgtgacatggcacaacaatctcatggagaaaacagaatacacaggagggtagctttctcccaacgcctcataaaggcacacacgtgaggcttggtttggggggggggcctcctgtcctggacccagtgtgctgcacaggaagccaggcacctctgtgaagagaagagaagcccttcctcacaccagacttggggtgtggctcaggaggatatgcgccagagcaacgctgagctgtgtccatggtgccaacctccagagtgaaaccagccaacagcagcgagataacccaagacggcacctgtgggacagccgtgtccctagccaggagacaggaggccagggtaggctcagattggagaagagggctagggtgaggagcagagacccaagccgggcagtccagatgttatctaccctccccaagtggggccagctgtgccctcagcctccccttggtacgaggaacccgacctgcagccacgggtgggacatggcctctgcctctcaagaatccctggagtcactaaggactgcccttgcccagctagccagggccaagtgtctgtcgtctggggaacgctagaaggggtgggtaagaaaccaccaaggcccataaatatcagcctccaccttgagcaggacacactagaagtgagcttaaaatactgactcttcccttcttaaaaaacatctaacattgcaatggtttaacaaattataatttcttttaaataacccacagacacccatgacgcttccaaatttacagaacaaaatgcactcaagaactcggtagaaaaggatctgcagtcgtccctcccaggagctggcacgcgagggctgggtcagttcacctccagcacctcagtctctggaaggccaaatttggtcttgtgattgtcaaagagcttcaccagggcctccatgtacatggcatggtacaggtcgatgtctttctgggtcgggtgctccagcttggggacagtgatgggctcccccactgcagaagagggacagaggatctgtcagtcagcgtcaccgagtggcccattcctgggtgcccagtgggaggtgaccctgtgctacgggcagcatgggaaagaccccacccgagagtgtggcctctgagcccgggtgaagcctagctccacactctgccatgagttcccgagtaaggtgtggaccacaag

SEQ ID NO: 2061 - DNA, 1000 bp, mus musculus
tgactctgaggcagtcctataccagtacagaaacattaagcctgtaagagagtttgctgtgggagtcaggtcacacccaactgtttattgtaatgtggggttgatgattccttaagacctactatttgtcacctggctcaaaaccagggctgctgctagctttgctcctataagacacacacatccccttcaaaccacatttactcttcagtgaccatattggtcccacaaccagagagaagcaatgctctttcataagccttgtccaggcccctgcctcccagccagccttctgcttctcagacctcctggccccacagaaatgagtagcccaaggaccctttgacccccaaagcccagtactcacagagacagggaaataatccttcatgtacttccatatggccaagcgtctgaagaactggatgggccggcctccctgccgcggcttgtcccagtccaggtaccaccaggtggcatacaggacagagaagagccagaaccttgtgaataggaggcctacgaagatgacgatgcagagctgggctgggagagaaacaggaaagttagagctgcaagcaaggcaggtaaaaaccccagcttagctcttccatgactgtgccccccaccccgcatctgcagtgacctccctcctggtgcctgcagcgccccctgtcgggcacacaccactgagtggaaaccaacttccgtgcttcagataccacactggcttggggcccagtctaaagtcatccctcccatcccccactacaccagatgtctcaaccttcactgctcccatccccaggaaggccatacacattcagcaggtgcttgaaaaatggagccatgggttgaatgggttgccttctgattgccatagggaatcccagaggaaaaagaggcactcctctttcctggccactttctatctatccttgggtctctccccatttgctggagcatcgttcccatggaacactacttcaccctcactggt

SEQ ID NO: 2062 - DNA, 1800 bp, mus musculus
acagtcttacccatatgatgtcacggcaactgtctagcctatggaaagccattcggaaaagatgacacattttcatgaaatcctctccctgtccagtcaactcccctgggccatctggacagggtacccaaggctcctggccatgctggtgcacatgagacaccttgcaatcttaggttgggggtgagggataaagaagggtacagaacttagagtcccactcagaatcgctagctgcatcccaccctcatcagaacctgattccaaaatcctctcctgcccaaggatgaccaggccacctccctgtcaccaaacaatgaatggcagtcctatctccatcctccaaggccttcagcctgcgctgcaccttggcttcccttccctaacttaggggttactgaaaaccctgccctgctaaagcccccaggagatccccttgactacagaggacacctcactgcccaccttacagagaaacaaaagagcctcttcaccttctggacactcctgtgcctcacttcttcctctctagtgccttctctgtccagatgaacctctatctcctgcaggcctctttgaaccctcagctccttcccaagtctaaaggtcttcaagccactcacttccttttacagtgtgtgtgtgtgtgtgtgtgtgtgtgtgtgtgtgtgtgtgtgtcacagtacagatgtgaaggtcagagggaaacttgtgagagtcaggtcttccagagcaggagcttgaggcaggaactgaagcagagaccaaggaggaacactccttgctggttcgcctccctgtggcttgctcacatgccttttatgaagcccaggaccacctggctagtatggcacctcccatcacagttgaatcctcttacatcaattagcaattaaaaaaaggaaacaaaaaacacaaaaacccagacatggccacaaaccagttacaaggcaatccttcagttgaggctccttcccaggtgactatgggtttgtgtcaggttaataactggacctatgacggggtcccagagactgaccttaagttatcagatttggcagcttgtgcctttccctgccaagccatctccctgcccccatgatgccctgtctccgctatactgagaagttcattcaggcagcttaccacttcctggagcggaggtcttggttacttttctattcttatgctaaaacatcacaacttggggaggaatgggtttattccattttacatctctcaggtcactgaggtaagtcagggcaggaagtcaaagcaggaaccagaaggcaggaactgaagcagagaccatggaggaacaaggcttactggctggttcctcatggcttgctcagtttgatttcttatacaacccaggaccgcctacccttcccccaacccgagggatgggacgtcccacatcaatcaccgacttagaaaatgagcctcaggcttgtccacaggccacttaggtggagatgttttctcggttaagtgtctctcttccccagtgacttttgcttgtgtcaagttgacataaaattagtcaacacactgggctggcgagatggctcagtggttaagagtgctgactgttcttctgaagggcctgagttcaaatcccagcaaccacatggtggctcacaaccatccgtaatgaagtctgatgccctcttctggagtgtctgaagacagctacagtgtacttacatataataaataaataagtcttaaaaaaaaaaagtcagcacaagctgcgtccactgacaacctcagctggacttgagaatgcacgctctg

SEQ ID NO: 2063 - DNA, 1200 bp, mus musculus
ccctgtgccaacccttgctttggagtccatgcttgaataggggagacagatgtaaaggtacagcacactgggtctggcacaggggccagagcaaggagtagggaggttgaggaagggctaagagatgccctggtgctctaggaaacctctggaaggagctgggacctctctcatcgcctcagttcatctcgtgctctgtgtgttcccttgtctgagtctctctcacctgctggacttgaagacgtgaaagaacttgagctccgtttttctgtggtgccaaccccagaggctccatcccgggttccatagaactttgtagatcaggggagaaggatgataaaccacaagtcttttctacaccagatttctagtcatgtcctggtctctgttctcttgtattacagtcctcctttaaacaagaggcccagggtcagtactataagaaaaaaagtcatagagttaaaagtagcctgggcagagcactaagatcattgccaagatagcccaaagcttttgcctccatttctcatacccacaaaggggccacgagatctgagcaaacccatgataggtctgtcctcctgtggctgagggtacagatgagttggctaaatgagatccgctgagtgggcagggtaaggataggactcacttgaggtattttttttttaaccctaccatacataggcttaagacaaagtaggattctgcagctggggtggaggctggggaaaggaccgcggcagatgggaagcagtggttcttgggaatgaggcctgaccccatgtctctttcagaatggacatgtgaattgttaccgcctccgctgcccaccccttcactgctcacagcctgtgatggagccacagcaatgctgtcccaggtgtgtgggtaagtagcttccttccctcgctggcactgagcccccggctgtccatcttacttatgttgtaagcctctggctgagagaaatctccagaagaggagcagccctgtctgttagatatgtgggaacagacagatgttcatggacacatctgggccctcaagtaggctaaggtagcagcaaacttctggcttcaaaaattgatatacatagcaggagaaaaagggcaggggaagtagagattgggtgggcaagatgcctcagcaggtaggggaacttaccttcaggatgacaatctctgggacccatacagt

SEQ ID NO: 2064 - DNA, 1200 bp, mus musculus
ataagtctgatgctcactttgagaaattacattcagatccaacactctctggtattcatgtctgcttgttactccccaactccttgcccacttgagtaccaggaccctgaattctcccgtgggttgaggaactccaactgagccagccctcggcacccatggtctctggggataatatgagtcatggacattgacagacctccctgaatcccgacatggccctcagtggctacattggcagggacttcaccatggcctcaaggtggctgggatgactacacacaacagactattcttctcctccctcgaatctccagttccatctcccttcacaatgctcaaactgtgctgcttctctttctttccataattgtacttttagtggctcctgctgcaggctggccaagtggttagtgggcctctggtggtggcaaatgtgtccctaggtatctccagtctgcccctgtggcatagagctgggcgggtctctgaacatttccccctcctgcactgtgtggtgagaaggcagactggcctctgtgtgtctatggcctgctggagcccttcagtagaacacaggtctctgggtctctctctctgccagtgacccacagcaatgacgatggactggtcttgggatgtcttactccaactagtctctgttgcatgaaggcaggcagggctctctgtgtgtcctgtgcctgccagctccttgcagttgagggcgggtctctatgagcatctttccccactaagtcaacttggcatggcagtgggcaacaccacagatgtcttcctcttcctccttttgttcagtgtggagacatgcagggctctatgtctatggtctgactgtgctgagcatggaaggctggtctgtgggtgtctttccatacctatgccaggtggcatggcggtgggcagaactctagatgtggctttacttttaaccttcattgcttctgcacagccctgggatgctgcaatggtctccttgtcactgacctcactgactcagcacaacagtcagaggtcccagcccaaggcaagtcagggcagtaacagttcaaaataggtgatttgtgataaatgttgcaatctaaggaaataaaccattcataacgacatcttgctttcttgtgactaggtatttctatagactgtagcctttgtttgagagactcctctaaggctagagtt

SEQ ID NO: 2065 - DNA, 1600 bp, mus musculus
tttatttttaaaaatattttagatgaaataaattattcctttttcaggtatgttctgtcaactattgattcacattttttattaatctctttcacagagatttattatgaatctttttggtctacagtgtggttatctcacatgcctttttcctggtactaagtgtgaaattatggaaacaaaagaaaacatttcatatacttatcagtgcttaatccatacaattgcatctttacacagtaaacaataaacagatttgtaacaggaattaggaagatggtcttttcacaactagaattttttttagtgcttgctgtagcatattttatatttcatacaatttattatatgtttaaacttcattagacttagcctttcctacttagcactctgaacatggctcccctgatgggtttggacttgacactgtagatgatggggttgagcacaggaggcaccacaaggtacacatacgcaaccagggcatgaacaatgtgaggcaggtgctttccaaaacgatggatcatggacacacctatgactggaatgtagaagaccaggacagccaagatatgggaaacacatgtgttgagggtccggacacgctccctgggagaggctagccccatgactgtgtgaagaatcaaggaataggacatgacaataagcaaggagtctatacccactgtggacagaaccacatagagtccatataggatgttgacagtaatgtcagcacaggccagcttcatgacatcagcatggaaacagaatgagtgagacaggaggatcttgccagggcagtagttcagcctcttcagcaagaagggcaatggtaagagggacaaagtagctcgggttgtaatggccaccccaatcctgatgatgacattgttagtgaggacagatgcatagcgcagagggttggagatagccacaaagcggtcaaatgacatggccaagaggactgaggactctaccacagagaagaaatgaagaaagaacatttggatcagacaggcattgaagtcgatgaaacgatagtcaaaccagagcacagccagggtggaaggcaatgtggacaagctgagacccacatcacttagggctagcatggacagaaagtagtacatgggctggtgtaggctatgggtcctcctcacagccaggaggatgaggcagtttccagtgagtgccacagtgtacatggaagagaatgggatggagatccagccatgagcaaactctagtcctggtatgccagtcatcaggaaagattgtggctggaagaaggtgatattgacaaaagcctttgaggagatcattcttggagaaagccaatcattcccaggagatgtgatgtcctcattctggacagatactgaacatatctagagaggagagagtgacatagcattgagtcaaaagtctttacaatcaagtttcattaattcactgtttttttttttaaatcgattctttattcaggtaacaagttggttctgctcactgcatgtgggaaacatcagaatagcatcctggaaagggactatcagtgcagttctcaccaggcgacaggttaacaatgacgcagtggcat

SEQ ID NO: 2066 - DNA, 1200 bp, mus musculus
acttcacaggctcccaagtctcataagcatgcaatgtcatcaggtctagtcttttcctctcagaactttgaacatggctcccctgatgggcttggacttgacactgtagatgatggggttgagcacaggaggcaccacaaggtacacatacgcaaccagggcatgaacaatgtgaggcaggtgctttccaaaacgatggatcatggagacacctatgactggaatgtagaagaccaggacagccaagatatgggaaacacatgtgttgagggtccggacacgctccctgggagaggctagccccatgactgtgtgaagaatcaaggaataggacatgacaataagcaaggagtctacacccactgtggacagaaccacatagagtccatataggatgttgacagtaatgtcagcacaggccagcttcatgacatcagcatggaaacagaatgagtgagacaggaggatcttgccagggcagtagttcagtctcttcagcaagaagggcactgggaatagggacagggtggctcgagctacaatggccaccccaatcctgatgatgacattgttagtgaggacagatgcatagcgcagtgggttggagatagccacaaagcggtcaaatgacatggccaagaggactgaggactctaccacagagaaggagtgtaagaagaacatctggacaagacaggcattgaagtcgatggaacgatagtcaaaccagagcacagccagggtggaaggcaatgtggataaactgagacccacatcacttagggctagcatggacagaaagtagtacatgggctggtgtaggctatgtgtcctcctcacagccaggaggatgaggcagtttccagtgagtgctacagtgtacatgaaggagaaggggatggagatccagccatgggcaaactctagtcctgggatgccaatcatgagaaaagactgtggctggaagaaggagatgttgatgaatggcccagaagggatcatccttggagacagctgaggactctaggaagatatgatgtcttcagtctctgaagaaacgtaagtaaaaagatgaagttatccaaagacatgggctataatatctgttgatatgggtccaaccatgatcatgacagatatgaaccagatttaaaaatttaatgtgtctaaaagaaaaaaaatgtctaaagaagaagcata

SEQ ID NO: 2067 - DNA, 1200 bp, mus musculus
gttaaattatacaactgttaagatttaaatatcatgttttcaagttaataatttatgggtgatagcattcttttaaaaaattcagtggttaaatatagaaaaaagcttctttgtttttcttatgatgacaagaacaggttaagtaaatatgtattatccacaaaaggtttcaaatctctcattctgttaaacttgaaatttattccacttctgtgaatatcttgaagggctgtgagatatcttgtaaatatgtgttggtttgtcaaagtttgttgaatatgtcctttggtcatttacctggagctactgtaatccctggctcaagggtcttttctcctgaatcctcggatgaccctgtccctgatctgtttggttctaactccatagataatagggttgagcatgggaggaacaagcagatagaaattagcaaacatgatatggacaactcgtggcacgtggtggccaaagcggtgggtgaggaaggtaaaaagggctgggatatagaaagccaaaataacacagacatgagaagcacatgtaccaaaagctttgaggcgagcttcacctgagggcaacctcagcacagctctcagaatcatcacataagatacactgatgacaattatgtcaaagccaaccacagagaaagccacaaagagtccatatccacgattgactctggtatcagcacataccaacttgagcacagccatgtgctcacagtaggactggggaatgaccttgttggggcagaagggcatcctggagaccatgaagcagaaggggctcacccacagcagccctctcaccatcacagctgcccctagtttaatgactacagatgtggtcaggatgctggaatgtcggagtgggaagcagatagccacatagcggtccaaggccatggtcatgagcaccccagactccacagaagaaaaggcatgtatgaagaacacctggatgaggcaggcgttgtattcaatctcatgactgtgaaaccatagtatggccagcattttaggttgtgtggaggaggacaggaccaggtcagtgatagccaacaaggccaggaagaggtacatgggctcatgcagggtgtggtcaattcggattatgtataggatggtgatatttccagtcagtgccacaatatacataacacagaaaggaaaggcaatccaaaattgataattctcc

SEQ ID NO: 2068 - DNA, 1200 bp, mus musculus
tctaatattttaaatgttacaaattctaataagtagcatagcatcatttgttttataaaatatttattataaagaatgattttactacaatttaatattgaataaatttgtaaaattacagacatgcaaataaccatccatgccttggctgttatgatcctcagagagcagagtaacttcaccacacaggaaatatgatgcattctctcatgttggcttcaaggaacaactcttcccattctacatttttcatcttgcttggaatcccaggactggagaattaccaattctgggttgcctttccattctgtgtcatgtatattgtggcagtgactggaaacatcaccatccttcacataatccgaattgaccacaccctacatgagcccatgtatctctttctggccatgctggctaccactgaccttgtcctgtcctcctccacacaacccaaaatgctggccatactctggtttcatgatcataagattgaatatcatgcctgcctcatccaggtgttcttcatacatgccttttcttctgtggagtctggggtgctcatggatatggccttggaccgctatgtggctatctgcttcccactcagacattccagcatcctgaccacatctgtagtcatcaaactaggggtagctgtgatggtgagagggctgctgtgggtgagccccttctgcttcatggtctccaggatgcccttctgccccaacaaggtcattccccagtcttactgtgagcacatggctgtgcttaagttggtatgtgctgataccagagtcaatcgtggatatggactctttgtggctttctctgtggctgtctttgacttagctgtcatcagtgtatcttatgcaatgattctgagagctgtgctgaggttgccctcaggtgaagctcgcctcaaggcttttggtacatgtgcttctcatattggtgtcatcttaaccttatatatcccagcccttttcaccttcctcacccaccgctttggtcaccatgtgccccgaattgttcacatcatgtttgccaatgtctatcttctagttcctcccatgctcaatcccatcatatatggagttagaaccaagcagatcagagacagagttacccaagcattttgtggaaaaggctcatgaatcaggaaccacagtatattgtgttttcatttacccacattgacat

SEQ ID NO: 2069 - DNA, 1200 bp, mus musculus
ctatggacctgaggacttagattccattcaaggaaaacagtctctgaattctcactcggatctgctgagtcttgatactgtatataatggggttcatcaagggtgggaaaaggatataaatgttgcccatgaggacctgaaccagaggagagagatgcttcccaaagcggtgaaccatagtcagaccaataatggggatgtagaaaaccaaaacagcagagatgtgagatacacatgtttgcaaagacttgattctctcctccctggatgcaatcgatagaactgtgtgcaggatcatcacgtaggaggcaagaatgagcactgcatccagtaacagggtgcaaatcaccagagacagagcatagaaactgttaaagcggatatctgaacaagccattcgaatcaagtcttggtgcaggcagaaagagtgggagaggaaatgaggcctgcagtaatttaagaacttcaggcggataataactggaggaatgagcatagaactcctacataagatggccactccgattttcaggattctgtcattggttaggatggaggaatagcgtagagggttgcaaatggcaatgtagcgatcaaaggacatggcgaggaggacagaggactccatgaaggacaaaccatggatgaagtaagactgtgcaatgcaggcatcaaggctgatctcttgaagaaatccccaaagaattcccagcaccgtgtgcacagtagacagccccatgcataggtctgtgagggctaacatggccaggaaatagaacatgggctggtgcagacttgactctgttcggattacatgaagtatcatgcagtttcccaggaacaccattgcatagatggttgagaaaggaatggcaaagaagtagtagacttccaggccaggaaatccagtaagaacaaatctagaggtacttaagtttgacattaagaaaactgacttgatagaaagtacaaaatatttctggagggctattctgcagtacacatgctatattctactttctaataataactatctgtttgaaaaaatatcagtttccataaacagtgaaactgagacatgttccttggttgtacatcattgcagaaacctatgcggacacaaacgtattcagacctagtgttataagaaacaggaaagcagggagttttatgtcaaaacaataatgtctatgggctcag

SEQ ID NO: 2070 - DNA, 1400 bp, mus musculus
ggctgattatgggatggatccctggatgtggcagtctctagatggtccatccttttgtctcagttccaaactttgtctctgtaactccttccaggggtgttttcttcccaattctaagaaggggcaaagtgtccacactttggtcttcgttcttcttgaatttcatgtgttttgcaaattgtatcttatatctcgggtacactaagtttctgggctaatatccacttatcagtgagtacatatcatttgagttattttgtgattgtgttactcactcaggatgatgccctccaggttcaaccatttgcctaggcatttcataaattcattctttttaatagctgagtagtactccattgtgtaaatgtaccacgttttttcgtatccattcctctgttgaggggcatctgggttctttccagcttctggctattataaataaggctgctatgaacatagtggagcatgtgtccttcttaccggttggaacatcttctggatatatgcccaggagaggtattgcaggatcctccagtagtactatgtccaattttctgaggaactgccagactgatttccagagtggttgtataagcttgcaatcccaccaacaatggaggagtgttcctctttctccacatcctcaccagcatctgctgtcacctgaattttttatcttagccattctgactggtgtgagatggaatctcagggttgttttgatttgcatttccctgatgattaaggatgctgaacattttttcaggtgtttctcagccattcggtattcctcaggtgagaattctttgtttagctctgagccccattttttaatgaggttatttgattttctggagtccaccttcttgagttctttatatatatttgatattagtcctctatctgatttaggataggtgaagatcctttgccaatctgttggtggcctttttgtcttattgacggtgtcttttgccttacagaagctttgcagtttcatgaggtcccatttgtcaattctcgatcttacagaacaagccattgctttcccctgtgcctatatcttcgaggcttttccccactttctcctctataagtttcagtgtctctggttttatgtggagttccttgatccacttagatttgaccttagtacaaggagataggaatggatcaattcgtattcttctacatgataaccaccagttgtgccagccccatttgttgaaaatactgctgctcaaaatttttaactactattaggcacttcatcaaactttcatagcacttatactatcaatacatgcaaaatgcaatgtcatgactgatattcacttaacagtaagaatggtgtgaacattcaaaaaagactttaaaagtagaacttccaaaaccaagag

SEQ ID NO: 2071 - DNA, 1000 bp, mus musculus
gagagtctataataaggattcaagtcctactgtgtttggacagtagacggagaacactcctctgaatttgcttggtcttgatgctgtaaatgatggggttcataaatggaggaaagagaaagtagacatagctcatggtaatgtgcaccacatggggtgcatgctttccaaacctgtgaatgaaggtcaggccaatcacagtgatgtaaaagaccaggacacagctaatgtgtgaaacacaggtgttgagagacttttttctctcctctccagaggcaatgcccataactgtcttcagaatgaggacataggaaaagataatgatgagcgcatcgaggaagaaagtcaaagcaaccaaaacaactggatatatgaggttaaaagtaatgtcagcacatgccagtttcatgacatcttggtggaggcagaaggcatgagaaagaacatgggaatggcagtatgggaaccaaaagagaggcatgattgggggcacgatggacacaaatcctctgagcagtgctcccagtgccatcttcatcaccctggaattggtaaggatagagttgtaatgcagtggtgtgcagatggcaacaaatcgatcataagacatggcaagcaagacccccgattctacaatggctagtgagtgaatgaagtaggactgaatgaaacaggccccttgtgcaatctccctctggtttagcaccaggacacccagcactgtgggcatcgtggttagtgtcatcccaaggtccatacttgccagcacagccaagaagtagtacatgggctcatgaagactgtggtcactccaaatgatgaagagaagggtaccattccctaaaatgatggagaagtagatgacaaagaaagggatagagatccagtggtgaatcatttccaagcccagaaagcccgtcagtaggaaaggagcatcactgctgttgggccacatggtgggatcgcagttgaagacggtttcagagagggactgtctaag

SEQ ID NO: 2072 - DNA, 1200 bp, mus musculus
aatctgtcatatatacttcttgactctaatgattgagtgaacaatgataccataatgatgctgtgtttaatgtggattgcagattctgtatgttgcatccatcaagtatgtcagaagtaacaaacaccactcatgatcctttctacttcatcctcaccggcatcccaggatttgaggatatccatctctggatctccattcccttattctgcctctacaccatctccatcatgggaaacaccaccatcctaaccgttatccgcacagagccatctctccaccagcccatgtacctcttcctctccatgctggccctcactgacctgggtctaactctcaccacactccctacagtcatgcagctcctttggttcaacatccgagaaatcagctttgaggcctgttttgcccagttcttcttcctccatgggttctctttcatggaatcatctgttctattggccatgtcctttgaccgttatgtggccatctgtcgcccactccactatgcctccatcctcaccagtgaggtcattgctagaatagggttggccatcatttgccgctgtgtcttggctgttcttccctcccttttcctgctcaagcgcctgcccttctgccattcccaccttctttctcactcctactgcctccaccaggatatgattcacctggtctgcgctgacatcagagtcaacagctggtacggatttgctcttgtcctgctcattattgtattggaccctctgctcattgtactctcctatgcacttatcctgaagagtgtcttgaacacagccacttggactgaacgactccgggctctcaacaactgtctgtcccacatgctggctgttctggttctctatgtccctatggttggtgtgtctatgactcaccgctttgccaagcatgcctctccactggtccatgttctcatggccaatatctacctgctagcacctcctgtgatgaaccccatcatttacagtgtaaagacaaagcagatccgtcaaggaattactcgcctcctcttgcagagaaaggtgcactgaagactgaagtttatataaaaagggtacttttataaatgtaacatggagtcaagcatgaatattacttccataaaattggcataccaaggatgtggaatggaacatttgcttaatagatactcttagctaataaaagaaacattgt

SEQ ID NO: 2073 - DNA, 1000 bp, mus musculus
ttagaaacatacaagatgccttttaaaacataatgcggtgtttgattaccaaaacctgtcatcttacaacctcctcctaagaaggttccgtattccctgcttgatctccctggttcttaccccataaacaatgggattcagagctggggggatgaggtgatgcaggatattgagcaggatggggacgtccggaggaatcctctccctggccaggttagtgatgactagcaccagcaagactgtgctgaagaagaggatgaggatgaagtgggaaccacatgtgctcagggctttggccacagctccctctgctttgatcctgagcacagccttcagaatgaatgaataagatagaacaatgaggatgaggtcagaacccagcagggtccaacctataacaaactggtagagtttattaaaagtgatgtcatcacaggagagtttggaaacagacatgttagtgcagatgcagttcctgataattcttgcacaatatctcagttgggaagaaagtatggggatgggcatagtaagaatcccatttctggctgctacaaagatggcagccctaaccacaaactgatcagtgatgatggatgggtactgtagaggcttacagatggccacatagcggtcataagccatgaccatgaaggtgcaggactccatcgtcaggaaactgttcatgacaaacatctggaggaagcaggaagagaagccaatagatttattgtcaaaccagaagatggccaggaccttaggtatgacagtgaggcagagcacaatgtccagcagggacagaaggctgagcaggtagtacatgggctcatgcagagaggcctccatcctgatggtgatgagaagggtggcattggctcccatggccaggaggaagaggaggctgaggggcagggacagccaatgctgccaggtctggtagttggggaagcagatgaggaggaagtcaggggccaggatagaggaagtgttgctttgtgct

SEQ ID NO: 2074 - DNA, 1400 bp, mus musculus
ttacattgacttcatgaaattcacaggcaaatggttagaatttgaaaatatcatcctgagtggggtaactcagtcacaaaaaaaacacacatggtatgtactcactggtaagtggatattaggcaaagagcatggaatacccatgatacaactcatggaccacttgaagttcaagaggaaggaagaccaaagagtggatgcttcagtcctacttggaagggggaacaatataatcaagggaagtagaaggtaggaggcaattggggagaagagaagatggggaggggaaaagagggcagaattaggtatgggaagagatgagggagatgtacagagggtcaggaaattgaacagaagtgtatagcagttgggtatgtggaactgtggcagtcaccagaaagtcccagatgccaggaaggtaagacactccaaggactcccatgggcataacaatagctgagataccccacaaagggaagggagaacctgtcaagaccatatccacaggttaggcatggcccccagttgagggatggggccattcacccatctccaaaattttaacccagaattgctcctgtataaaggaaatacagggacaaagaccagagcagagactgccccacctcgggatccatcccacatgcaggcaccaaacccagacactattgctgatgccaagaagtacttgctgaaaggagcctgatacagctgtctcctgagaggctctgccagatcctgaccaatccagatgctgaggctcaccaccaaacatcagattgagcacagggaccccaatggaggagttaggggaaggactgaaggagctgaaggggccttatctggcatcagtgggagggaaggcccttgttcctatgaaggatggatgcccaagtgtagaggaatactagggtggtgaggcaggagtgggtggatgggggagcaccctcatagaagcagggtaatgagggatgggataggggttttgcagagggaaaacagggaaaggagataatatttttctttttaactttacatagcaattttttctttttccaatttttattaggtattttcttcatttacatttcaaatgctaccccaaaagtcccctataccctccccgaccctgctcccctacccatccactcccacttcttggccctggtgttcccctgtacttgggcatacagaaaatgtggtacatttacacaatgagtactactcagctattaaaaataataaatttataaaattcctaggcaaatggatggatctggagggtatcatcctgagtgcggtaacccaatcacaaaataactcacatgatatacactcactgataagtggatattagcccagaaacttagaatacccaagatacaatttgcaaaacacat

SEQ ID NO: 2075 - DNA, 1200 bp, mus musculus
ggcccttgggccaactgagttaagtacagaagctgtcagaagacagttcagctcatacacacatccttgcctgaaactgggaagaactccttgtttgggagctttgctgagcccacagacatcctcaaagcacagcataaggcctgtcctccacacaagggactgcttacagaatgggtgctggtcttgaacaaaccttgatccctgggttggcattccgttgggacagcttctcttcctcctggggaactggttctgggctggaggcagatgggaacacttgacacagcacctctatttttagagttctcccaatacccgttctacatagacccagtctaaccgtagtctgctgcatctgactcacctgaggctctgagctgggaaggacaatgtcgcctcctcggggtccttcagtcccaactccattggggcctcctcactgggttcatcctttgaaaagggattgaagaatcaggccaaaatgaagccccttctcccacccccgcacccccagagtgaagctggttccttcatttaccttccaaaactctccttcctcaaagccttcttggtgagcaaagccagtccaggtgagctgaaggaggaacagatgtagggtgggagtttcgccctgttctagaagacagacccttccacccctggcatggaacaagccattgagtctcacctgggactcttcttgggggctgctcccctgtgagggggaggcccggcctgggggttcccactgggtggtccctgttgggatgtgccagtagtaggtccctgaggtgtcctgtaccctcatccatccagccggtagatcggaatccgtctcgaaagcgttggggttccagaaggaatctgccaggtaggaggttcagtgagggtcagcccacccaacaagcaatcagatggcccatccccgtcccaagaccccatgaatgagaaggagttggggaagcgacattatagttcctgcttgcttctagagctggcacttgagtcaccatattgggagccaccagtggggagcatggctcaggtctcctcctgggccctgctgctgcctactgtggccacatggagagaaaaagaaagcagagaggaaggaggaggagaggagatagaatgacccaggtcacctcatgtatcatgcatagcctatgtctagctataaaagatacacacactgcc

SEQ ID NO: 2076 - DNA, 1200 bp, mus musculus
gtacaatgtgttctttaaactttagtagagattctttaataaatgtgagtgccttctcatttgggacacagctgtttagaattgagacttcatcgtggttgatttttttgtttcaagagtatgagatgtccttcctcatcttttttgctagcatttttgtaagtccattttatggcatatttataggaccatggaagccagcctggttcctggttgagctaaggctataaattcctgtggcacaaaagggaaggtaagtcttccaccttgttcccaggcaccaggctcctgtcactgactgcatccctccatagattgtggcattcagtcactaaagggcaatgcccctatcctctccacaggtagaggacttgatctgtgttcacataggtaccattttaatgaggtacctaaagacctagaggcttagctaataaatgtcccttctcacacactcctcgatgcaaaagtagttaaccttagccccaccctgagaagttgggtatggttttactcagctattttttccatgacaataagtcccttaaaaccatggactgcctcttttcattgggatctactgtgcgaagctatagagaaggcctttacctaaagagcctccatctaatctctggtagaaggcctctttctgttcccagccaccaagcgaagcctaagccagctgctttcaagccaaggactctcctgtggaaatccagctggagtgcttgagaaccagacagccctgggatccttgcaggcctggggacctccaatccagcttaggtggtcctgtgcctcagactgtgagtcatgttctcagggctgctctctagcatgaaacctgctctacaacagtgtggagtaggtccttcctgtgtcctgcctccagaagcagctgaacctatggaggagcagatatgggactattaaccctacagatattagaatggtaactctcacttgtttcttgagagcatttgtttggaaattgttttccagccttttactttgaggtagtgtttgtctttgtcactgaggtatgcagcaaaatgctgggtcctgtttacatatcgtctcttagtttatgtcgtttttttttttttttttgaattgaatttattgatgttaagagtattaaggatcaatgattcttgcttcctattattttgttgtcagaggtgggattatatttgtgtg

SEQ ID NO: 2077 - DNA, 1000 bp, mus musculus
gaaaagatatcttcagagaaatcttggcagagggccctaaggtccccagtagactctccgcactgcaggcaccctagcacacccgggtccttgagatcactggtgagtggaacacaacatcagtcccaaaaaacctagagagttttgtgctagcaggaacagggacaaaggacagctgccaaaccagtggctggggttctttctagttggcgccacccctgcgccatcttcgttgtgatctcggtgaagagcccccagatccccagaggtctttccacgctgcaggcaccctagcacatccaggaccctgaaatcactggtgagtggaacgcaacatcagttccaaaaaaccagagagtcttgtgctagcagcaacaggatggcagaggcagatggatttctgagttcgatgccagcctggtctacatagtgagttccaggacagccagggatatacagaaaaaccctgtctcaaaaaacaaaaacaaacaaacaaaacaaaacaaaacaaaacaaaagcaacagggtcaaagaacaaaggcaggccctagcacacccagaatcttgggatcactgagaccattctatgcaggagagcacttgggcagcagaagcaacagagcttcttggacagggtcccttcgggccgtcattctcagccaagagacatagctaagacccagacccctggacaccttccctgccaaaggagagttggcctcaagggagagctctgacccaaggacttagaaggtggatcagagctccagacttctggacaccttccctgcaagagagcttgcctacagagagtgttctgaccactgggacacaggagagaggttatctcccaggagtgctgatagaggctaaagaagcacaggaggaacaagctccagccagagacagctagaacatctaacaccagagattaccaggtgacgaaagacaaatgtaagaatctcactatcagaaaccaggaccactgggcatcatcaga

SEQ ID NO: 2078 - DNA, 3400 bp, mus musculus
tcaaattcattctagtcatagttaaaattttttaaaaaactaaaacagtttttgatactgttatataacataataattaaacttactaaattaacaattgttttgagtcattgatcgtatttagattatattgcccaattgtttctaaggcttcatttaatgcatgaactataacttccttttaaaatgtccttatttgtaaatgttaaatatattccaatcatttcattataaataaaaatatgtatattcagattctttcgatattttaaagcttctgttacatacatatttaccaatttcttgccagcaagactgaaataatttgtacctctgcatgtcctagtgaattttgagaggtttagtttctgtatctactaaatccagctataggcttcatacatctatatatgacccaacactatattaatttatgtgtatttatagcaattatatggtagatattgttctactctgtgataacaaaatgtgactttgtctccataatatctataatataatatattatattatattatattatattatattatattatattatattatattataagatattataaaggctgcagtagattaagaaataaactatactcagccactagttcaatggcatcaataaatttggaaatgaagccagaaatcactgtgatccaagagataataagcaacacaataataataaatagaaaaattcatattttgggctggtgatatagatcagttggtagggtgcttgcatagcaaaacaaagctttggttcactccccagggcacatagctgcaatgccaacatttgagagatggagtcaggtgcctcagggcacatagctgcaatgccaacacttgagagatggagtcaggtgccccaggagttcagaagcttctttcattacatagcaaactcaatggcaacacagaatacatgaaaatatgtcttagtttcttgtctcctttctttaaaactcagtccagaatctttactttctgagcctctgttatttcacagaccgttattggcctgtgtcttcttccttcatataatccatgcttcatttaatgagaaatgatctgtgtatacacaatactggtccaagccttactccatatactggatccctatcctgcagaaatccagcctctaccttataatcttttcctcttcctttttctggactaagttgtagaaactagaagcgctgattcttaacttaatcccctaatttagacttcaaaagaaaaagagagaaagaaagaaagaaagaaagaaagaaagaaaggagggagggagggagggagggagggagggagggagggagggagggagggagggagggaggaaagaaagggagggagagagagagaaggaaagaaagagagaaagaaagaaagaaagaaagaaagaaagaaagaaagaaagaaagaaagaaagaaagaaggaagaaggggagggagggaggaagggagggagggaggaaagaaagggagggagagagagagaaggaaagaaagagagaaagaaagaaagaaagaaagaaagaaagaaagaaagaagaaggggagggagggaggaagggagggaaggaggaaagaaagggagggagagagagagaaggaaagaaagagagaaagaaagaaagaaagaaagaaagaaagaaagaaagaaagaaagaaagaaagaaaggaagaagggggagggagggaagaagggagggagggagggagggagggaagaaaggaaggaaagaaagaaagaaagaaagaaagaaagaaagaaagaaagaaagaaagaaagaaagaaagaaagaaggaaggaggggagggagggaggaagggagggagggagggaggaaggaaagaaagaaagaaagaaagaaagaaagaaagaaagaaagaaagaaagaaagaaagaaagaaagaaagaaagaaagaaagaaagagggggagggagggagggaggaaggaaggaaggaaggaaggaaggaaggagagagagagaaagaaagaaagagaaagaaagaaagaaagaaagaaagaaagaaagaaagaaagaaagaaagaaagaaagaaagagggggagggagggagggaggaaggaaggaaggaaggaaggaaggaaggaaaagaaaacaaacccaagttttatattatcaactgctccctacctaaccatctctgctggatttcttggtattggcgtcctggccttgggccaggtgcagagtgcgacgtagggcttttttgacttcttgattgcgcaagcagtagatgatgggattgagcaatggtacaatgacagcgtagagtacagagaccagcttgttggtgtcaaaagctgagagtgccttaggcctggcatagatgaaaatactggctgcatagaagataatcacaacagtgaggtgggaggcacaggttgaaaaggccttatggcggccagcagctgaggggatgcgcatcactgcacctgtgatggccatataggaagccccagtgacagagagtggccccagcagaataaaaatggccaggataaagtctgtaagctctgctgtggacatgtcagtgcatgacaagttgagcaatggagaaacatcacagaaaaagtggttgatggtgttggggccacagtaagacaggcgagaaatgaggaaaactttaaccatggagataccaaaacctccagcccaggatccagctgccatctgcacacatagccggctactgacaatgacaggatagtggagtgggtgacagatggccacatagcggtcataggccatgacagcaagaaggacacactctgtgcaacccaagcctaggaaaaagtagagctgtgtcatgcatgcctcaaaggagatcagctgtccatgattctcctcggaaccaatgaagccagcaagcatcttaggaatcgtaacagtgacataccaaatctccaggaatgacatattagccaagaaaaaatacatgggtttgtggagggtggggtggttcctaattgctgtaatgatgagtatgttttcagtcagcaccaacacgtaggccaacagagaaaggaaaaatagtagtgcccgcagtggggcaggagctgggaaacccagcaacacaaattcactcactctcccagtgtggttccttcgctccatgttttcagtcttgttcaagagatagaccaaggtatcttataaaagcagcagcaagaatctagcttggtgactattctctgcaatgcttgtggtaggtgtgattaatagcagctgttcgatgagctgaatggtgagccaagaaaacagagacgaaaataaatgactatgtttacagacactttaaaagttgcctttagcccttggagaatcatgcactgagaaataacg

SEQ ID NO: 2079 - DNA, 1000 bp, mus musculus
tatcctaaatcagataggggactaatatccaacatatataaagaactcaagaaggtggacttcagaaaatcaaataaccccattaaaaaatggggctcagagacagccggccaccttcctggtgagagcacgggggtctgcccggcctgagaggtttgtgtcacaggcaccggcgggagccttcttggctccgggactccgcggagggcaggctgcacgggtgactgtgtggaatacagaggccagccgtttctggtatgggcgagaatcgcagagcttctggggcggcgccatcttcggccccagacaaccggccaccttcctggcgagagccacagagcttctgaggcggtgacatcttcgactccagacaaccggccaccttcctggccaaagcaacacagcttctgggaaagatcctgttttggtccttcaccttcagccaggaggaggtccaaacaccagataactgtacaccttccccgaaagaggagagcttgcctgcagagactgctctgaccactgaaactcagaggagagagcttgtctcccacgcatgctgattgagggtaacaaaatcaacagaggaagaatctcttaacaaagacaactataacaactaactccagagattgccagatggcgaaaggtaaacgtaagaatcctacttacagaaaccaggaccactcaccatcatcagaacccagaacacccacttagcccagtccagaacaccctaacacacctgaaaaggtagacctggatttaaaagcatatctcatgatgatggtagaggacataaagaaggaattcaataagtcacttaaagagatacaggagaacactgctaaagagttacaagtccttaaagcaaaacaggaaaacactgctaaagagttacaagtccttaaagaaaaacaggaaaacacaaccaaacaggtagaagtccttatagaaaaacaggaaaacacatccaaacatgggatggaaatgaacaaaa

SEQ ID NO: 2080 - DNA, 1000 bp, mus musculus
ctacagggagagcacttagaagaaaggctacttgtgggagtgaaggggggttattaagggtggggagagggtgactaagagcagggtgggatgggttgagacctgaggggcaggacctgtgtggaggaggtgagtgcactggaaacagtgtgctagccttgagcaaatggcagaaagaagcccagagcaagtttgcagaaggggaggcacatactgcttcagacaggaaacacagcactgatggatttgctctagccttgagtctctagactcagaatggagcagagcagccagccccagccagatttccattgccaccgagcaggaccctggacagcactgttgcagtctccctcagttttaaagggcaacttgccacttaagagtgattctacgctttttttttttaacatattttggttaaacactaacctccaaataacaaaacaaccctatcaaataaatgggatatagaactaaaccgaattcacaacagagtgaattgaatggctgagaaacacttaaagaattgttcaaggtcctcagtgatcagggaaatgcaacaatggacagatgccgcacacccctatggctgaattagaaaaaggctggaaaaagctgaggaggagggtgaccccataggaagatcagcagtctcaactaacccagacccctaagatctctgagccaccaaacaggcaacatatactagctgatctgaggcccacaacacctatacggcagaggactgcctgatccagcctcagtgagagatgtgcctaaccttttagagacttgaggcccaggcagtagggagggattgtggggtggggtagggtttgggaggggtgggacatcctcttggagacagaggaagaatgggatgaggaaatttgggagggccggcccccgagtgggctaatgactggattgtaaaaaatttaagaaattttaaaaaacaacaagtctgaagccaccatcaataggccaaaacagtctc

SEQ ID NO: 2081 - DNA, 1200 bp, mus musculus
aatttggtgcctggtatctgtccagacatttatccatttcatccagattttcctgagaggcctgaagaggccgctgaagttcctttggattgggttattctgcattggaggtagcaatggtgagaggggaggggcgtcatcatgacctcctctagggctctgcaacatgactcctgtggtgccaatcaacaaattgttcactgatgaatccacaaggatctctgggcctacaaccaggtcctggtccacatgactgtcgtcttcggagaaggcaccactcgccccggcaggggtatggctgacacctccatgggagaagacgtatccaggcagcagctgcgcggcccttcaagagggcacatcccgtcatctaaaggcacggtgtactgaaggtagtcctgagacatgagtccgattactacaggcacgtgttcctccaggtggaggctcaggtccccgggtgagctggggctgcagcgggactcagggcacggctctggctgcaggtctcgcagctccctgggctgcagctcccgcagatccctgggctgcagctcccgtagatccttgcgcacatcgttgactggtcctgggctggcagcatgcaccagtgctttcactcgcatctccatcttgatgcacgtctcctccgagctggtgggacgcagcggccagggcgtggggctataatggtggcttctcagtgatgtggagcggatgggccgcggagcacgcacatccttgagcccaccaggagctgaagctgaggagaaggtgtcctcatctgtagacgcagtgccgcccttgcccttggtcttctgcttggcggacaaccgcctcttcaaagtgcccatcaggctctcgcttttggatctgttcttccctttctcatcctcactgccaatgtcacaactggccatgtctttgccataacagctcccgaataaagagtcatctttcacgaagtcaccagcaagggactggggctgaaccaccatgaactcagtttcgtctttgcttttactcaggttaaaagatttcctgaaggtcttcagactgattttcttcattttgacaaaagttaactaatccaaatgggtcaatttggttctggagcagttatgcccaaacatgggaggggctgcgatgcctcatgggtgtattctgcctggcttcatttaacctctgaagctattttac

SEQ ID NO: 2082 - DNA, 1000 bp, mus musculus
acataaatgaatgtgacagttccatagaacagagtgactgcagtgaggtaggaggtacaggtggagaaggccttgtgtcgaccctcagtggagcgcatcttcaggatggtgatgaggatgtaggtataggagatggctatgacaaacactgtaataatagtaactgaggcagaaaaaattgtggtaatgactacagaaacattgatatcagaacaagagagttccactaaaggagcaaaatcacagtaaaagtgattgattctatttggcccacagaagagaaaagaaaaaaaagaaattatggcaaaagaagcattaagaatcccccctgtataagatcctacaaccaactggatacaggtttgtgtggacatttttgtggaataaagcagtgggttacagattgctacaaagcgatcataagccatggtggccagaaggaagcactcagctgtcccaaagaaagcagctgagctgagctggatgccacatccaaggtaggcaatggtgtgtttctccaccagaaagttgacaagcatattgggtgtgacagaagatgagtagccaatgtcaacagagcccacgtggctaagaaaaaagtacatagggtgatggagctgggacgatactctgatgagaaggattgtgctgaggttcccagacacagtcaccaggtagatgcacaggatgatggtgaagaggatgactctgaggactgggtcatctgttaatcccaataaaatgaactctgtcactgcagtgtggttcccatcctccaggaaagccatggggcagtgtagctggtgccagatcaaggctgtgatggcgacagaacaggaaggtatttacaaatagttcacttgatttcatttagtacgttcataaagaacatcagaagctaatatatattattcaaaaaaattgtaccaaaatgattattttattcagtgtttccactgtttatatatttgtgtgaagtaagactttcaaaattgtttaa

SEQ ID NO: 2083 - DNA, 1000 bp, mus musculus
tggggtgggacttcctaccagcagttggaagtcacagcctgtggtggactgggcaaagtaaaggcccaaagtagtgtgcctccaagtctcaggcagagagagggaaagaagggaggaaggggctctatcacatgttcgggagagggaaaccaagcccttcactagctagcgtgaactcagtgcacaggtggtcaagtgtgtgggaaagcaagttctaacagagggaacctctggcaggacacaaggacacaaggggcggggaggtagctaagtagcagaaggagactagcagcaagtagggtccctggcaggggcagagccgaacttgctttacaggcaaaccagctgaacaagaccacaaatgagagagagggggaagggggaagtttaagctatagcagactgacccaagggcaagacatatggagggcttccaggctcagtctggaattctcagccttgagaaagagaagagggaaatctcattcaagggaaagcacaggggtagctctgagctcaagaaatcttctctgggaccatgaagatggtcactctgaccagtgggaatgggggcttaccagatctgggctagcgagcatggttgtggctgagatgcgatacaaacctgcagactatctgaatctgagtcatgatgcaccaatattgagatcataaaaagagaaagagctgtaagaatatgttcctgtgaagtttgggggaagggggctcctggggggggcatgccaaggtatcccttccccccgagagaccagccacatgacagtatagtatagaatagagctgaatagagcttatttagggcatggggaggtgaattaagaggatagcagaggcttttttcttggcttcatctctattagaattaagaaagtggcagcattattaaatttgaggtcatcagtgcaagtgtccacattatcttctaccaaaaagtaaacatcaattagcacttgattatgaaaaatacaagcaaatgttc

SEQ ID NO: 2084 - DNA, 1400 bp, mus musculus
ccacctgtgtcctaagtactcagtgaatctctaattgtccaaaagtcactctcctttgtgaaacaatgctttgttagtccttgcagtagacccccaaaagcaagagaaatatggtaccaactcttcataccagaatcagatatgctgtctggccctagacttaaactgaagactactgtaaacttgaaaatagagccagggaaactcatgcatgcctcctaaaagaaatcagctccaactgtttgggtctgtatgaaatgcttaatttttgtcatctgactctagaatggagacacaaggggcttgtgttttttaagcatctgatcatatttaagcatatttcttctcttcacatcaggtaaaagaacaaaatgggaagaggcaatcgcaccacagtaacagaatttgtcctcatgggattcacagatcgccctgagcttcagctccccctctttgtggtgttcctgattctcattaccctggtaggaaaccttggcatgatcttgctcatcaaggcagattccaggcttcacacgccaatgtactatttcctcagccacctggctttcattgatctctgttattcatcttccattgggccaaaaatgctgcaaaatttattggtgaagaaaaaaaccatctccttttcaggctgttttgctcagctgtacttctccagtgcttttgtcactactgaatgcttcctcttggccacaatggcctatgatcgttacatggccatctgtaatcccctaacctacacagccatcatgacacagcgggtctgcaaggaactggtgataggagtctacacctatggcttcctgaactctgtgatacagacagtactgactttccagctgtctttctgcaactccaatgtgatccaccacttctactgtgctgacccccctctccttgcactctcctgctctgacacccacaacaaagagaggcagcttctgatcttctcggcagtgaatctcactggatccctcatgactgtcctcatctcctatatctgcatcctagtgtccattataaaaattgagccttcccagggcaagtgtaaagcattctccacctgtgcctcccacctcactgtggtcaccatcttctatgggacgttatttttcatgtacatgcggcaaccaaaaactgggagttcgtggaagtatagcaaagtgatctctgtgttttatagtcttgtgattcccatgcttaaccctctcatctatagcctgagaaacacagaggtaaaggatactctgaaaaaaatgctggagggcaaaacttcatagtgagcaggatactaggatgcagcactgtagacagcagtatataccacgctaatagaacaaagcaggccaactgctacccagttaggaagtagttaattg

SEQ ID NO: 2085 - DNA, 1400 bp, mus musculus
atgacttacagtcggcagctcaattcccaacaatcgttcagtcacagctgtgaatggaagtccaaggatctagcagttactcagtctcacgcagcaagcaggcgaaggagcaggagcaagagctagactcccttcttccaatgtccttatattgtctccagcagaaggtggagcccagattaaaggtgtgttctaccacacctttaatcccagatgaaaggcgtagcccagattaaaggtgtgttccttaaactcggagattcaatcttctggaatctatagccactatggctcaagatcttcaaaccaagatccagataaggatctccaagcctccagataaggttcactggtgagccttccaattccggattgtagttcattccaaatattgtcaagttgacaaccaggaatagccactacaataactaactagccacacgagagtttgtcctcagatggcaatgagccgacagctagacatcctctggttagtaagcagaggcctcttgccaagcagctagggaacctttgaagcctgctttgcctttctgttggtgtgccatagtggagtgccttctggtggcttccctgggggtcacaactcacatcctcagacttgctagtgtcttaggctagggtggaggctcagagtggagggcagatgcctgtccagagtcaccttgccacactaagagaactgactgccccagtctctgcctccaggggagagtgtccagtcatggacttgagaagccaacagtcatattcagttcagagggctctggatcaggagctggctacctggagagagcatcagctgacccagtagccacccaagctcagctacctggagttctctgctttggctcagtccttggaattggtgtgacttaagctcccccacgtccctaaccatgttctcccatccttccacaggaatcttctcaccagacagggcatcctaggttccagcaagcacatctctgttcccccctggggacaccaggtcctgggaggcctaacatctacaattcacccacagaggttggggtgcggtgactcacaagtcactttcttgactgcaatgtgtggaaagtaatatgtcagtccctgtagtcagtggagctgtcaagaagactaaacaggagggggttctatgttactccatctggcataaccccacactgctggggtgaaccagtggctcagagtggcacaggcgtctccaagcaacggttaactcaggggcaaggaacgtaaggcttcgaacaacatatgttgtgaagtggcaggatatgtgtcacctttcatgggtagaacccaggagaggtccctggaaatttctggggtgcttaaagtattgcctttctgggaaatcctgttgagtgctatggtta

SEQ ID NO: 2086 - DNA, 1800 bp, mus musculus
acccgggagagaatcaacatcagctcttttgcttcttgggaaggtgtattaagggttgtcatgattcaaaactgaagtattccttgtatactcatggtttgggtggcagtttcccagatggcactatttggggaggctgtgaagcctttagttggtaggacctatatggtggaaataagtcattaggttggaagtttgaaggtgatgcctggcctctagttcttgactgtgtgaaccaccacattctcttagtaataccgcatctgctgctgtggtgcgctgaaaccatgggctgaagtgaatgcttcctccttctagttgtttctgccaggcattgtggtcatggtgacacaaaagtcatcaatgcagatgtggaccactggcatagttaatggggaatggggaatcatgtctggagaactctgaagggctagctcctgcggtggaaaataccaaagagacagctattaggctgctccttgcacgtacagcaagtggagacattgggtgtctgtggtcttgactggatgaaacaggatatggggcactgagaagtggagtgtgcttggaccaggcagaggggggagttgtggagatctggatgtcacccagatggggtcaggagcctgaggtgatgcatttggcagctcttaaatgggtgcttcttcctttacacagtttttctccttgcccagacactagcttgcaagcctcggaaggcaaattttggaaacatacaggactgagagagtccagaaaaggacgtaaggacatagactatagtacctcatgctttgaaacccctctgctgctggggatcagcaggggaaagcatcagtaaggcagagtctggttcccacttggcctaagtacacactgggaaggcattggtatctccaacagagcaggtaacatcactctccttccatgtgcccctccacatggggctcacttaggagctaagcattaatgtgcatttcctactagtgaggctggaaggaagacatgctgggacccttcataccacctgccccttggaaagcaaatgaaaggcttctaatatatgtcaggagatgagccttagggactgtgtcttccaggcctcaatagatacagaaaagccaggcagtggtggtgcacacctttaatcccagcatttgggaggcagagacagggagatctctgtaagtttgaggccagcctggtctacagagtgagatccagaatgatcaaggctatacagagaaaccctgactcaaaagggtgacacacacacacacacacaccaaaaacaacaaaacaaagcaaaacaaaacagaaaagcagagccaaatggagttcagagcctaagttagagaccctaaattcaaagaacagatactaggacataagcatatttaaactgaaactaagaatgagagctgaggatgttcctgagtttgtctagcatgcacgaggccctgggttggattcccagtactgcgcaaaccatgtacttggaaggtaaagacaggaggactacaagttcaaggtcatccttgcctacacagtgagtctgaggtcagcctgagctaccccaaactctggtgttttataactacttcctctgaattgaaacatctccttctgcagggagggccataaggttgaggaacctgacaacgctttcaaggcccaggaagctgagaaagtgtcaagcatcacagagttataaaaacaatgaacaactgctgggagggggagacctgttggtgcaggagcccgcccgttgagcagggagttgcaggaatgcagcttttg

SEQ ID NO: 2087 - DNA, 1000 bp, mus musculus
tgccaactcaccctggcatcataagtcactgcaggacggggcacatcttctctcactgaggccagacaagacagcccacttaggcgaacaggatccacaggcaggcaacagagccaggatcactcctactccagttgttgggggaaccaaatgaagaccaagctgcacatctcctatagatgtgctcatgaatgacctctggttggtggttcagtctctaggagccccctagggtccaggttagttggctctgttggtcttcctgtggagtgcctatcccctctgggtaaaactgctaaattttaaacaacccaaaagtctatcatcaaattgattcatccatacaatgaaatactatgcaggattaaatattacaaaatagttttaagcagtatttgtagatatactcaatcaaaatcagtaggaaaaaagtaggttacaaagtcttaagtataagatttatacatagatgataccataagaaaaaacaaatatgtatgtgaataagccacccaaaggacaatatgtaccaaatattaataaattgtttttactttctccctaatgcatttattaatatttcataaaacaatagaaaaagaggagagaaagaggaaaagagagagagagatatgagctggtcttgccagtagttaagtgtggttcagctggaatggcaacacacttaagcaaagaaagagggagacacagtggtgtaagaagaatttaacaaaatgagaatttgaagacagagctgggcttagaagttctaatgcaggttgagaattgcctttctggcaaccttaccacccactactgtttgaaacctggtctcgtgactagtacgtgttgaattcacttctacatcagttaccacagtcaaccactggactcaagtcttgtccctgggtagaccatatggatcagcaaatgtatcataaaggtcttttggagaatcctctttataatgctagtggttagaaatgtatgatgcctagga

SEQ ID NO: 2088 - DNA, 1200 bp, mus musculus
ggcaaatggatggaactagaaaatatcatcctgagggagctaattcagacctacaaggacatgcacgatctatactcactaataagcggatattagccaaaagagtacagaatacccaggacacaagaaggttaacacctgaagtgaggatgcctcaatcccacttgggagggaaaagaaagaagtcatggggggcagagcaaggggggaacttgggtgggagaggggacaggaaaggggaggggggaagatgatcaggcattggtgaggggaacaggactgaagccctgagagccagcagaaagaatgaaaagaggcaacctcaggaggcaggaggtaggggaaccctctagaatgtaccagagacctgggaggtgagacactctcaggactcaaagggagggaccttggataaagtgctctacaatggggagagggaacttacagagtccacctccagtggagggacagggcatcaagtcagaagctctgacccaaaattgttcctgtctaaaggaactgcagggacaaaaatggagaagagtatgagagaaaggaggtccagtgacaggcccaaattgggatccagctcaaggggagacccggagcgctgagactgttacagatgctttggtgtgcttgtagactggaacctagcatggctgcactgcctccagagaggcccaacaagcagctgaaaaattcaaatgcaaatactagcacccaaccaatagacagaagccagagacctctgtgttgaattggggcaaagctgaaagaagctaaggaagagggcagccctaagggaagaccagcagtctcaactgacttggaccccctttccctgagatctctcagacactgagacaccaactagatagctacaccagctaatatgaggcccctgacacatatacaacagaggactgcctggtctggcctcagtgagagaagaaacacctaaccctagagagacatgaggccccacggagtggggaggtctggtggggtagagggctggggagaggaggtatgggatggggggggggtcagactgggagggggatgaaatttggactgtaaaaaagttttaaagaattaaaaaaaaaaaaggcttccttggttactcaaacacccaatttctctgttcatatcacaacaggaattgtgagattaaaaggtccaaaccttaaaataggg

SEQ ID NO: 2089 - DNA, 1000 bp, mus musculus
cagtgcaagtttcaggacagccagggttgttatatagagaaaccctgtctcaaagagcaataacaacaacaacaacaatagtttaaaaagtgttgcttggatacctttgatacgctgacccaagactggctaacaaaatgtgataaggatacctgtggtctatctgtgacctctcagtgacccctaaagtcatgtgacagtagcatcacagaggcctaggatccagcaatgcacaaggagtgctgaccacagctctaaaaaaggaactgtgtcccttgctgtcctggtcacggagcttcacagcttgcctgaaagctgacttttaatccttaaaagaacataagcaattactctggctatatttatccatgttcctggagccacacagggatttggcctcactctaccaaaatcttcagctcatcactcagcccatcagcgaccgtcatgtgtcctcggcacaaaagcaaagggccaattgaggcagactggcccacagctcagggaggctcttcactggccatctgacctttgacctttgaagaagttttaaggcccaggaaaacaaaagctcatcctgggacagagggacgccaagggaggagacatggcttcctgccaagaatgcaaccagccctggggttgattgctggacagcttctctgggagcttgtcctgttaacttagggactcccagaaggctcagcacttagctggccctaagtgaagggacaatgagagaccaactcggtaggcatggcaaccaacaggtgtcattcagtttgggatcacaggccctatgccagacactttgcatacaaggtctaattctgccatcactgcccaaaacacatgttgtgtagcttcccacccctgcgtcctaaatgaaaactccactgtggagagctgagggaccttgccaccatcttgcagtgtgaaaactccatctctgtgactctagcgaacccaagtgaccaaccacagactgcaaatggaagac

SEQ ID NO: 2090 - DNA, 1400 bp, mus musculus
attcttcagagatttcacatcatcttccacccttgtgacctcccctttaatagaaaaaaaaaagcccagtttatgttatctatatgctcactggagaatggacaaactctcagtggccagctccttaaatagagctgagtcctttccctctctcactcctgctggaagccgtctatttggagagcaacacttcagcaccctatcacagtattttaaaaaaattattattattattaattattattatcattgtatattttctttatatacatttcaaatgttatcccctctccaggtctcccctctggaaaccccctataccattctcctcctttgcctctatgagggtgctcctccacccacctgcccactccctgctttcctgccctgacattcccctacactggggcatcaaacccccataagaacaaaggctgctcttctacctgatgtccaacaagatcatcctctgcaacacacttagccagagccgtgggtccctccatgtgtactctttggttggtggtccagtccccgggagctccagggggtctggctggttgacagggttgctccccaccatggagctgcaagctctctcagctcctttagtcctttctctgactccgccattggggatcctgtgctcagtccaatgattggctgagagcatctgcttctgaatttgccaggctctggcagagcctctcaggagacagccataccaggcttccaaaagcaagcacttcccaatagtggctgcgtttggcgactgtatatgggatggatccccaggtgggacagtctctgtatggcctttccttaggtctctgctccacaatttgtcttcatatttcctcctgtgagtattttgttcctcttctaagaagcactgaattattcacactttggtcttcctttttattgagcttcacatggtctgtgaattttatcttggatattctgagcttttaggctaatctccacttatcagtgagtacataccatgtgtgttcttttgtgactgagttaccccactcaggatggtattttcaagttccatccatttgcttgtgaattttatcaagtaattatttttaatagctgagtagtagtccattgtgtaaatgtaccacattttctgtatctattcctttcctatcagtttttaagagtacttttccatggcttcccatttaggctgtcactagtttggcaatggaggttggggtggaggtaagggttgtcaaaaagtcttccatgtctctctttatcaactgtgtatctgtagtcatcagtctcgactgccaagttgaaactggactcacggtcctcagcacagaacctggcagtctaggtgctggattagtgctgtggaggtttgaggtgtgagtcgtaat

SEQ ID NO: 2091 - DNA, 1200 bp, mus musculus
tcctcagcattttctctctttaaaaaatgggtgggattaatattatttggagatacactttgctgtggattagtgttgcttctttgattggtctgtaagcttaaggcccaaactaggagagacaaggtggttattgcccaggcgcttgcaggactagaacatggagcttcccctgatatatggttatctatgcttaggcaataggtcgctggccactcagctcttatatctcacgaggctagactcattgcacgggatagagtgagtgtgcttcagcagcccgagagagttgcacggctaagcactgcaatggaaaggctctgcggcatatatgagcctattctagggagacatgtcatctttcatgaaggttcagtgtcctagttcccttcccccaggcaaaacgacacgggagcaggtcagggttgctctgggtaaaagcctgtgagcctaagagctaatcctgtacatggctcctttacctacacactggggatttgacctctatctccactctcattaatatgggtggcctatttgctcttattaaaaggaaagggggagatgttgggagccgcccccacattcgccgttacaagatggcgccgacagctgtgttctaagtggtaaacaaataatctgcgcatgtgccaagggtatcttatgactacttgtgctctgccttccccgtgacgtcaactcggccgatgggctgcagccaatcaaggagtgacacgtccgaggcgaaggagaattctccttaaaaagggacggggtttcgttttctccctctcttgcttcttgctctcttgcttcttgctctcttgcttcttacactcctgctcctgaagatgtaagcaataaagttttgccgcagaagattctggtctgttgcgtctttcctggccggtcgtgagaacgcgtctaataacagctggagccatggatccttcatatatactctttggttggtagtttagtccctgggagcttttggggggagactttgccagtaagcacttcttggcatcagcaattgtgtcgggtttttaatactgttcctactgtatgttatcactttcaactatgattttcaaatattctctttgcaaggcctcttaaacatttcataatttcttctctccttctctccttctctcctgttttcccattcctcccactttcctccttcctttccct

SEQ ID NO: 2092 - DNA, 1200 bp, mus musculus; identical to SEQ ID NO: 2091

SEQ ID NO: 2093 - DNA, 1000 bp, mus musculus
gtcagtgctcttaaccactgagccatctctctagccccattgtgacgttttcatacataaatataattgcattttatccatgttcacattactcttttacatccccccacctcttactgatccccccttttccatggaagaaactttgtcatatttatatacacacatataaagtatatatttaaatctagattacatatataagcaaaatctttttttatctcctttacacttccattttttatctcccctacttttagactctatagctcccctcctgctttctcataacaggaaaatatgtctctgtacatattttaacatttacatttaacacacacacatatattatgtttatttagatctaggtactgcaatgagagacatgaaatatttgtctttcttacttatgttttattttgcttaaattgatatatagttatatccactttaaaatttaaaatttatttattattgctattttttatttatttaccttatattccactcattgtccccctcctgttcaccacccttcacagtccttccttcatccccctccccttctcctctgagcaggtaggggcctcctgggtaacaccccaccctagcacatcaagtctctgcgacactaggtgcatcctctcccactgaggctagaccaggcagcccaactagaagagcacatcctacgtacaggcaacagcttttgggacggcccctgctccagtttctcagaacccataggaagaccaaactgcacatctgttacacatgtgtgtggaggcctaggtcctgtctgtgtatgctctttggtcctgcctatgtgtgctctatcagagtctgatagctctaagggtccaggttagatgactctgttggtcttcctgtagtattcatgtttccttagggactgcagtccttcctcctattattctgtaagaatccccaagctccatccagtgtttggctatgggtgtctgcatctgtctgggtcaac

SEQ ID NO: 2094 - DNA, 1200 bp, mus musculus
tgtggccttgtgggaggaaggcttggaggactcctctgctcaagctctacccagcgtggaattccactctcctcctggctgcctttggatcacgatgtagaactctcagcaacatctccagtaccatgctggtctttatgttgcctgtttcctgccatgacgacgatggactaaacctttgaaactgtaagccacccccaattaaatgtcctttatatgagccgccttggtcatggggtctcttcacagcaataaaagcctaagacaccctccctctacccacacaatctccagctatcagccaatgcctggacccttctttgcagcaaaacttccaggaaggggctggtgagatggctcagtgggtaagagcacccgactgctcttcggaaggtcaggagttcaaatcccagcaaccacatggtggctcacaaccatccataacgagatctgactccctcttctggagtgtctgaggacagctacagtgtacttacatataataaataaataaatattaaaaaaaaaaaagagaagaattaaaaaaaaaaacttccaggaagatgtactgcccttcctggacaggtgtttcttacccatcttaccatgggtggcagtctcctgttctggaggtccctgtgactacacatcttctcaccttctcagtctgtcctcttaagtttgcctttcctgatctcagccactacccgcccccaggcttagagcattgttctgcttagtttctgtagcctgggaagagggagcctcaactgaagactgtcctgcagtggacatgtctgcggggaattgtcttgactgacgattgatgtgggagggcccagcccactgtggaccattgtatcctacacatgtaagcctaaggaaagtgggctggcaggctagagtgagccaataagcagccttcctccatgacttctgcttcagctcctgctcaacttcctgctctgacttccttcactgatgaactgggatgagaagtataagctgaaacaaacctttgttttccctagtttccctaactatgcatttgctcatggtgcttatgacaacagcaagcaaaccgggacagactttcttggcccacacttgtccttgatgacgtcacctactccctatgacatcacacacaggtatcctcagatgggtctctgcaagcctctctccctctcaaacccaagt

SEQ ID NO: 2095 - DNA, 1000 bp, mus musculus
ttgtttctgttaccatggtgaattcaagtcggcgctatttcttgcctgtacgcgttaaatctttttactaggtaaactttgtcagtcagaacctcctctgtgttctgtcccccacagtgcagagctgtaataaatgctcagtggctcagaagtccatttgttggattcagattttgtggctctcttatcaggttcaagtcgatgaaggagtccccctgaagatttgcttgtcccagttctgtaaatggatccataagctgcagcagcagcagacgatcagctttgctgctggggattcagagccttgtacttccgaagtgaaactgtgtgcttttgttacgtggtcaggtaaagcatgactgatgcctgtcaatcacactgggtggtactggggcctagggggttcctgaacaggcacagtgcttgttgcagaatcacgaggaccagagctggcatcctcagaacccgtgtaaaagccacatgggcatagtggtccctctgtactccaagtacattaggtggatgtgggaagccgttgcagagtggcagttgcagagtggcagttgcagagtggcagttgcagagtggcagttggctaccgctggccaccacacatacataggcagtaaggttcttttgccaagatgaggttttgagaattaaccaaagttaaccaatcagataagagacaagttaaccaatcagatgagagacaagttaaccagtcagatgagagacaagttaaccaatcagatgagagagaacgcctctcctaggcctatataagcagcaccagttctgggcttggggtcacttcgcctctgcaatcaagctctcccaataaacgtgtgcggaaggatactgttgcagcgtcgttcttcctggccagtcgggcgcgtgcaagaggtggagacacggagtcccaagagcaagctggctagccaaactagctaagtcagcaagtcctaggctcagtgaggaactactctcagtagataag

SEQ ID NO: 2096 - DNA, 1400 bp, mus musculus
ctgtatatctgggttaatattatcatactgttctatgttcctcccattttaatttgttctccagtcagtatgtattaacccttattttcccacctgtcctgaagatgaatatgcatatgtgattaactatatcatgtgagctattgccattcaatttctcttatagctccagggcctcagaagcttagcacaccagtgtgttgctctactatgatcaagcatcttaatttctcacttacttttcataagagattagcactggacattcagtcagttttcatttggatctgttggcagctcctctatcttatgaaccttgttttatgctgtgtctcctcgtgacattttgtttgtttgttttcaggttcgcatgtctgttcttcaggtattaaaaattctagttgttttttttgaaatgtaaattatttttgaaaccctttgtctgtcagcagatgctctctatcgttattattatctgtgtaaattggcacgccatagctgtgcctgctcaggggcagaacttgttattctggaaagtgaagagagtgtgcgatgtcaactaagtgcggtcagcacacctgtcactcctttatcagtcgtttgtgttgggtccattctaactcctctcatgtagccatttctgaactatctaacaaagtatcatccattatagtagccacgtgcactcctcccttttcttttttagccatatttattatctcagtagctatgtcaaatgcaagtgtggtgtgtgtgcaagtttgttgtggaaaaaaatttatctggatcactttgagtgggtatatgtttctatttttacatcgttcctcccacgtgctggccattcgatctgttggcattcctcctaactctctattgagccacacagtaaaatggaattatcacagagtagtcatgacgttttgtccttcagagtcttgagccattcctctggtagctgataacatgtagggcagtctccctcatctagtcagaaattttgcttacagagactgtgttacggcctctgtgatcctcagtctcccttttcttcattccccagaaagtacattgaaaaactacccctcagattctctattttcccaccaattcttcatcaagactattttataaagacatttttaaagatttagatctcagattattttttcaccctttagttgactaagaagtagttacctaaagttatttaaataacctaccatattcatagaaattaaaatgtttaaaaatctagcaaaaccccaaatgctaaagtagaaaatataaatagtcttactaattctgagatttgaggatttaaacaaacaagcaagcaaacagaaccttcattccttatactcttggagttttctagttttacatctttctcccaggtt

SEQ ID NO: 2097 - DNA, 1200 bp, mus musculus
ccttttgaagtggtatgacttcagaacatatctgtccatggcagcattaacaaataaacagccagtcatggctcttgacctctgctgagctaccaggattcatcagccaaccaggattctgatagtcataccaaagggacagggatggccttggaggtgaggtctctgagtcacctcaaagtaaggccaaaagcctagaaaggtgacataatctgggaagatcacacagctgatgtgtgggcagactcaggctggcactcaggccagagcttgcttagtcggagcttcctctggcacaaagtaattaccaacactcacatggaaagccaagaacccttttaatgcttttaattacttcaaggaaaagtctcagcttggagtgagaatggcttaatacccttgtaatatttaaaaaatctcccatgctttttttttttttttttttttttttaaaaaggctcagagttcagctgctgttggttgacacatcgaacagggattcaaatagtttccttaagcctctatttagtgcttgcttacagccacagtgcaagggtctgacaaagttgtgcagataaaggaggtttggaaaatctggagagggtatactgaggtcccctgccctccactttcctgcctgcaggagctgtccacggagcagatcgcttccctgggtcctcagaatgcagcctctgtaacccactcccagcgcctgcagctcagctcggcacagctgcagagcctccagagggcactagatggcgccaagactcactcctggcagaccgatcctctgagttccagccctacctggccagcctccactgggtccccaacaggtgaacagagcaacagctgcctcagccccactcccactccccttctctgaaccttggcttgccctgcaaggtggagaggttcccatgattccgggcttgatgtatgttgggtgtctgctctcaaaggtacatcttcagttcccaccaattttcctttaacgtcttttaaagatccctgaggtggttttaagatgcaaacgttgacagtgtttaaattccctgggtatgacccagaattcaccgagtcagaatctctcaggaccaagttcatttcagcgactccttcatccacctccttgctgcccagtattaatcagtcactgtatatctctttgatacctaatatgtagggaccaagaat

SEQ ID NO: 2098 - DNA, 1200 bp, mus musculus
agagaggcatagagagatttacagactataggggcacaagcattttacaactgattcatctccccagctcctcttctacatttgattttcactgctgtggtttaccactcactggaggaccacaacatcaatttagtaagtcaggtacactatgaaaaatcagaataggaaaaactatcagaatgcctcagccttgggaagggtaagtatggcttcatgaatcttttatttcgtgtgttcctatgcaagctcgggtgaactgggtcagacataaatggcgtttctaccgtgggtagacagcatggtttaaaagtcgctctgaagagcatcaagaagcagccttggaggctcatgacattggcccgtggactgtggaggcttaatttatttttagggatacaaatgcattgttttgaattcctcataattagaatttccctctcactctaacacactaccccaagattattttggtcatcttccttgaacattaacatatcacagacaagttccttttttccccaaattgaatgttaagtatagtgtatcacatctttacaattggaatgagtggttttggtagaccagcctggcctgaacttctgctggggttaagtgtcagattgctgtgacaagaggtgtccagagattgcaaagagaaggaactgcttatgggggtaacgtgggctatgaaagaagttttttataagcagaaccttcccggagggaggggaggtgtgtaggggtgcacagagcagtcgggaggggtggtgcacacagtgtgccagcatcaaggtgggtcaggtccctgaggtgggactctgcagaggactgcttccagctggagcttgaattcactgtgtgtttatattctctgtggtccctgggtaggtggcagccccaatgacagctggcctcattctctttcccttctggctttctctgatttggggcccaaggaccacagggggccagaatgctgcagatgggacaaaaagtcaagtccaagaaaaaaaatgaaatcggggttagggaggtggtgatgaaaaagagtggagggagggagagagcagaaagagagaatggaggggggagaggagagaagaagggagggacagagggaggggtagagagaggaagagagaaagagagagagaggatagggagagggagggaggagaaagagaaaatggagagggg

SEQ ID NO: 2099 - DNA, 1000 bp, mus musculus
cccaggcacccaccccatggtggaagaagagagccaattcctacaaattctctgacttccacatgagggttatacaccctaaatgctctgcctacaaaatcaattctttttaaagatttatttagtgtgtatgagtgttttgcctgcatgtttgtgtaccatgtgtgtgccttgtgcccttgagggccagaatagggcactggatcccctcgaattgtagttacagacagttgtgagctgccatgtgggagctgggacttgaacccaggtcctctggaagagcagcctgtgcttttaaccactgagccatctctctagccttgatggttttcttttttaaatcaatgaaatatcctgaggagttagtacacacttgaaatcccagcccttgggaggctgaggcaggaggattcaaggtcagcctgggtgtgtgttgtccctgtaaaatggggaaggggatatttgggcaggatgcctgtgctcagggctgatggtactgtgcgaattcagcgaaggatactgcatcgtactcttaggcggggcggggagggggagagacaggtctcatgtcttgcagatcttacagctccgcgaagctgcacaataaagagaggaaagtaggtgttcagagaagccaggcctgctttcctctcttctcacaggatatttgtgtttgccctggtgctggtctccatcctctggatccccattgtgcaggccagccagggagggcagcttttcatctacattcaatccatcagctcctacctgcagccacctgtggccatggtcttcatcatgggatgtttctggaagcgtaccaatgaaaaggtaactctggactggcaacacaacacccgggtgctgtccacaagcgctgggagaaatggagggggagcggtctggcagggacctgtgtgggctagccttgtcaccagggagtgcgaaccctggatgggaagccacaggccaggaaaagactagataggtattctcggaa

SEQ ID NO: 2100 - DNA, 1200 bp, mus musculus
tgaaccaccctgcatctctgggatagagttgacttgataatggtcaatcttttttaatgcattcttgaattcagttttcaagtattttactcagaatttttgtatgtatgtttatcaaatagagtggcctataatttttcttatgcttttgcctttttttgactgtagtatcagtgtaatgttagcttcataaaaagaatttgtaactaatttttcagcttctagtttgtgatagtctgacaaacattgctttaattccttttaaaataatctggtataaatcttcagtagatctccctgggcctaccttttttgtttgtttgttttgtttgagagttagttgttttattttgtttttagttgctttattcatcttattgcttatgaagagattgtttatggtattaatatcttctttttactttggtaagtatactccctagttttatgtcaacttgacataagacagagttgtctgaaaggagggaacctcaaatgagaaaatctctctataagatctaaatgtagggaattttcttagtgattgatagaggagagttcagcccattgtaggtagtgccatccctgggctggtggttccaggttctataagaaagcaggctgagcaaacaagtgggagcaagccagtaagcagtactcctccatggcctctgtattggcgtctgtctccaggttcttgtcctgtttgagttcctgccctgagttttttcagcgatgtactaaaacgtggaatgtgtaagcctatccttcccaacttgctttttggtcatggtgttttgttgcagttatggcaatccttagtaggacagtgggttatatatattaagaaaccaatcgatttcttacactttttccagctcagtatattaaatgttttagaaggatttctttcaaccctttggatttcattgataccttttacaatgtcttctgtcccatctctagttttattaattttgaccttttcacttttacttttggttcatttagctaaaagtttatcaatcttttcaaagaaccaactcctttcacttgttctttctgctttcttttcttttattattttttcatttctgttttgtctctgattttgatgctgtcttctggtctgattttgtgtatgacttgttcttgtttactgagaccttcatagaaatcacttaggtattaatttggaat

SEQ ID NO: 2101 - DNA, 1200 bp, mus musculus
tagagaaggatatgtagacccacaggatctcctgtgtagatatgcaagggctgcattgatcaggttaaaggttgacatctctccaacatgatacgtcatggccccaggtctatggtatcgggtccgtgagtgttgtctctttggaaccacttgaaaggggaggctcgtgggttcattccaaggaaaccctgaattgtactcaaggcccaggctggccccctgtagatctagtttggattgattgggctccatcgtctgactcctgtctctcctgccagaggacgaacagagagaaaaatccatctcccaccaaactgtacagcagctggtcctggagaaggagcaagccctggctgacctgaactctgtggaaaagtctctggctgacctcttcaggagatacgaaaagatgaaggaggtcctggaaggttttcgaaaggtgtgtctgtggagccggagtccaggtggggcttggagaggcagcagcggattttgagaggaagggagagggtgcatgccagttgtggggcaagagttcaggaagtccgtcttgagccattatgagcaggagctaaggagtcagttgtctgtgctggatgctcggttgagccccctcagtgcttctttttacggccctgtcgtgacagaatgaagaggtgttgaagaaatgtgcgcaggagtacctatcccgagtgaagaaagaggaacagaggtaccaggccctgaaggtgcacgccgaagagaaactggacaggtaactcaccgctcagctcggccaggagcaccagtggctctctgacatcgacttgcaaagcatggctgatctttatgacttgggctcagatggggctcagctaccacccactgagagaagtgaaggactatattgtaatattgggggtggagttcttggggttcctatgttcaggctctagttagtggggccgcatccaggcctgtgtcccaattcagagacgggaagagggaggtatccctgcagccaactaccatgcaccttgttccaacagagccaatgcagagattgcccaggttcgcggcaaggcccagcaagagcaagcagcctaccaggctagcctgcggaaggagcagcttcgagtggatgctctggaaagaacgctggagcagaaggtgagagggtgggggctgggcacccaaagtgaggcccctctctggagggta

SEQ ID NO: 2102 - DNA, 1200 bp, mus musculus; identical to SEQ ID NO: 2101

SEQ ID NO: 2103 - DNA, 1200 bp, mus musculus; identical to SEQ ID NO: 2101

SEQ ID NO: 2104 - DNA, 1800 bp, mus musculus
ataagatagaaattcaaaatcatccatggctacagagtgagtttgaggccagcctgggctacataagaccctgtctaaaaagaaggggaaaaaaaaaagagggaagaagggtcaggggacttgacagatgtcaagtcctgtggcagatcatggtgataatggccccagtgagtcacacaacctgggagctacaccctggttccacccatcaatgggtcttgagtctgggctacaactgggcttgacttagccaacagactgcagcagaattataagcacaagtcaaagaacttggggtctaggagccatgcagctcccatctgtgtcctctgggaacctcgtgttcatgaagtgcctgttggatactcgaaagccatgtaaaggagagccccacagaagggacacatgcttcaacccaactcccagcaccaaagggcctgccagagccttccagccagcaccctccagtgaaatgcagtctgctgatgataccaggggaaaccctgcaaaggacctctcaggctaaccaaccactcaggctcataagcaaatcagccttgccctgaagcttcccacggcaatacctttagaatttaataattggatagcttttaaattgtgtaaagtggttcccttaatatgaatatctcaaacatttgaatatgaaacgataggtccactactctcatcgttttttcactgacccagtgatgcgggggtgcgggggggggggggaggcgggggcggcgagccccgaggggctctcgcttctggcgccaagcttccgtcctgcgcatgcgggcgggacagtgctaggtggggagtttgactggggcggtacacctgtcaaacggtaacacaggtgtcctaaggcgagctcagggaggacagaaacctcccgtggagcagaagagcaaaagctcgcttgatcttgattttcagtacgaatacagaccgtgaaagttcacttcactgtgttatgtgaactgtctctaaaactagtatgatcatttctgttcctacccgtcgtgaggagccttgctgaccctgagttgtttcttcgagagccccactcccctgggatgacccttcactgatgcatttagaagaagccagggtccacctactatcagaactgaccctgaagcaaatgtcacttccagctttatttcaccgccctgagttcctaattttccatccagacctacacttttctattttttcacccaaccaagagtgtctgattgactccaggggacacttgggcaggaggcaggtgacagtactgtctgacagcagagaggagaagccagagtgagggggctgcatgggttggcagctggaacactggctgtcaagagggagcttcctgcccggtgattaacttttctttaatcctcgaattcctgaacagctcagcctgcctgctggcccagcaagctttgtctgagtcactagatgtctccgtgtggcctgaccgtgctttattcctggcaggttcgactgcttgtccacacgtccttgagaaaatgcataatgcccgtcaacccggcccagtgccatttaaatattgaattgacagtgccttactttagacaagtcaatattgacttaatagcctggaggttgggggtggtggggtggggagcacaggagaggtctggcacagtgccaaagagacaaaatggtttttcttgctgttggatcaagattgagggtccccctggacacagagcatccccctgtctaccgaggtagagaaggttattcactgtgcaaaactcattggccacatgtggg

SEQ ID NO: 2105 - DNA, 1000 bp, mus musculus
tttggcccagaacgtagaggtgataaagctggctgtgaggagagccctttcggctgcttggcctttgagactgtgtcttgcagtgttgcccggcctggcagggacctcctgggctctagcactcttcccgcctctgcttcaagcagctgggactacagatgtgcggcagtacactgggcttcttcctcttttgggaagttttcactgtctatttggaagtattgcttttaattgaatcaaactttaaaaacagcaaggtttcccaacaataacctgtttctttctggcagctgataagcacaacagtcaagttatgtatttggaaagtgttgccctaaaactaatctagtaaatgatttaagcaacagaccaaaatcactagaaagtgtcttcggggctgcgctttaacagtgcagttgggaggagccaagactggctgtgtacgcacaggcaccctcggaatggctttccagcacagggagggagagcaggtccattaccagggcacttggggcttcacgggtagacactctcatagttccctcttatttactgtaagaggctattttttggttaataaatgcttgacagggtatttctttaagaagccaattgagaatattttcaagctattaaccaaataaaaatgaaaaatttgcaaggtacacagaaaccaatagtaagtgacaatgttttattgttttgccaggctctcttcagagtaagctacttattacacaatacaaaaataatggcttcctatataaaatgaaccactctaattctaagtaagttaaatgacacatttaaatgtgcttcataataactctatttatcctttcccactgtggtgacgatcccaccgtctctgtccataaagactcacagggaggactttccatggcctgctctgctctggagaggcaaggaggctctgtctgggcatgctctgggtttgtagctgtttcctcacttattacgtctctgggtttctagacca

SEQ ID NO: 2106 - DNA, 1200 bp, mus musculus
ctcaaacccataccctcctgcttcagtgaggccatggtctctgttctatgcattttgtcccagtgtatttgtgccttttgcgttcactgtgtaggtgtttcagcctgtgaagactgcccagcggttctcaggcatcaccaactcgtttctatgttcttagccatgcatcttcagtgagagtcattccgccaccaaatgtttcaaaagaagcagtctcagtaagtgaattatgtgttaataaaaaaaattgatggaaaataatatctgaattaagaggtctgaggaagctcgtgaagagaagaatacaattctaatggttgctatagctcctgccccaccctttccaggtcctgcactgggcagcagaacatgagggtcctttgattagagtgttctgagtcacagacatgactccactctgtttgtaggtggctggaaaatgcattctattaacgcatgttcgacgttattaaaattgatgccgcttccccttaataagagcagaaaatggccacaaatttgaatctgttctcccaaagaagacagtatcaagggctggaaatgaaacaaacgcaatttttctgctcttattacatcgttcgcattttgatctcgaggacttcttagggcctattctctcgtcttccccgcttccagccactgcttctactgtgcagcgcaataatacaatttttctctcttccaaaggagtcattgccctaacatctcttgttgtctagggggctcaggggcatcctccaagtccctaaataggttgagttgaacaactctgcagtgggtgagaaaatactctgccgttcacaggatgcaattttgcattaaaaggctgctgaataatctcacatagaagcaggaggcgagaaacaagaagctgctggcagccatgtcggcacagtgcagcaccaaggtcgcttggactttcgggtgttgctgggcctgcatccggtgcctttaagtaaaagaaggagagggaaggaaaacccacccaaatccctaaaacctttctgacatccctaatgtcccatttgtgccaaccagaactgacgcttgtgatctgcccaacagccggacatgatatgctttttgggtgcgatgtatacactaggccattagtccgcaagcagcagttgtcagctttgttcccatttagagtaattttctcactaatatggcatattc

SEQ ID NO: 2107 - DNA, 1200 bp, mus musculus
ctttatggccaaggtatttgtaaatatattttgagtctgagtcttatttctgagaacccatagaggctgggaggaagaactggacttagctttacgtaactttacattgtcaagttcaagtcaaagggccaagaagaggctgagtactcagctctaaacaggacgtctatattaagcctcactgccaaggcacggggagcatcatggaagaggaggcagaaagaacacaagagcagagggtgtgaatgaggactgtgaaatgctatcttttggacctgactcagctctgcactcacggctcatagcagcaatggttgcctgcacaaaatcaaatccaagtcttggcgcagagagggtagatagtctccaggtaccatgccttcctcctgtagagctattggagtcaatggctgctgggagggggcacatcattcacttttgagagtgtggccactggtgggtttctcatgatgcagtggatgacttcccacccactcgagtatgagcaacacttactggacttagtgggttatcaggggttggggagacctgaaataggaaggaggggatgttagaaaggatatgggccaagttgaaaggaggagatgagggatatacagggttgtatttcattgtatacaattataaaattcccccaaaataaagagaaatgaaaatagttcctttttttctttcaggtgaagtgtgttgataaatcactcgacccaggaacaaagatagagtgcttagaacagggccttgcctctccctttcctcctccatgcctcagcttcagtgtcatttcctcagggtcactgcactgtcttcccagctctgacttcacatgtgccctaggaactggggtaggcactccgtacggctggcacagggctttcccataatctgatcttgacaggtttctgaactcacccaatttttttttaaactcgagaatccctcctttggccaggctgagaatttccctttctgtcacttggttctcctcccttcccatgattcttaggtgtgttcccaggctctgtgacctccctgccccacccatccatctggaggcccagagccctaagtcacacctgcatacagtgagggataaacgtcctgtacattgtgaagccccaggccccgagggctcattggagacatagactgggccaggcagatgccaaatggcaggttgaa

SEQ ID NO: 2108 - DNA, 1200 bp, mus musculus
gagttaagagcagtggctgctcttctagaggtcgtgagttcaattccatatggtggctcacaaccatctgtaattgggtccagtgccctcttctggtgtgttagtgacagtgtgctcatatacataaataaataaatctttaaaaaaaaagaaagaaagaaattacaggccataaagttgtaaaaatgcaaggccagcaatctgaaagttcatttaatttatgtatgtccgtggcttgtttgcatgtatgtgtgcaccacatggctggtgtctgtgggggtcaaaaggggatgtcgggtccctagagctggagtttataggtggttacagactaccacatggccacatgggtgctgggattggaactctaatcttctgtaaagcaacaggtgctcctagccactgagtcttctctctagcctcgtcaacattgtttgtttgtttgtttgtttttgtttctcgagacagggtttctctgtgtagccctggctgtcctggaactcactctgtagaccaagctgggcttgaactcagaaatctgcctgcctctgtctctgcctcccaagtgctgggattaaagatgtgtcactacacccagccatcagttagttttctgctactgtagaaaacaccttgagacaacttataaagaagaaaagttcattatggccagttttagaggtgtgagtcccatggtcagttgaggcctttggtaaggtatatcattaaatgaccacttcccggcccttgtcattttcttttaaacattttttttaataggcagacccaaacttgaacttttgatccttctgcctccacctcccaagtgcagggattgcaatgtgtatgctactatgtctgatttatgtgtgcaggggatcgaaagccacagactctgtccactgagtacattcccagcctctgacaattcatttcaaatttcatatgaatggcttgttgatgggaggagagacatcataaactaaacatagcatttgggcagaaggatattgaatgaggccacagaagctgagctcgtgctaaatatcagtatcaggtctgtgagcagagacatcagagaggttggggcaggaaagttggagctctgtgctcacacagaactgagggattgggaaaacgtttacagaatgatcgaatgttgtgagctgggagtggtggtccatacctttaatcccagca

SEQ ID NO: 2109 - DNA, 1000 bp, mus musculus
cgcagaacttgtggaagaggccaaatgggtgtggctgccctgctgataggagagaaggttcaagaggagactactctggtggatgatcccttccaaatggcgacaggggtcatggtggacatgaagaaactgaaggagcagggcaaagacaaggtcagtgaagaggaggatctgcacctggggacatcgtttgctgcagagaccaaccggagggacgaagatgcagacatgatgaagtacattgagacggggctgaagaagaggaaggggattgtggagcaagaggaacagaaggccaagcccaagaatgctgaggactgcccctatgagctgccagagaatatccgagtctcttctgccaagaagactgaggagatgctgtccaaccagatgctgagtggcatccctgaggtggacctgggcatagacgctaaaataaaaaacatcatttccacagaggatgccaaggcccagctgctggcagagcagcagaacaagaagaaggatagcgagacatcttttgtgcccaccaacatggctgtgaactatgtgcagcacaaccgattttatcacgaggagctcgatgcacccatccgaagaaacaaagaagagcccagagcccggcccttgcgagtgggtgacacagaaaagccagagcctgaacggtcccctcccaaccgcaagcgtcctgctaatgaaaaggccacagatgactaccactatgagaagttcaagaagatgaacaggcgctactgaggcagcggtaggggctggataacgatgtgatgcacaggggtgcgcttgtgtgcgtgtgcaagcgtgggggcacacacacatgccctcttgcataaaacctgcttattagctcttgagttccccatcagatagtgcttctgctcagcggctggatttctgttctggttttggttggagactgtagctctctgtgtatcctaggccatgaactcactcctcctccctactactgggattttagacc

SEQ ID NO: 2110 - DNA, 1000 bp, mus musculus
agccagatggatggagcttggttatggaagaggtgagggaaggattgagggacccgaacaggacagggattccattggaagagagtcaactaacctgtacccttgggggctcccagagagtgaaccaccaaccaaagaactgagcacgggccggatcttgcacctcccccacgcatgtagcagatgtgttgcttggtcttcatggggtcccccaacaaccagagcaggggctgtccctgaatctgttgcctccctgcctgtggatcctgttccaccactaactggccgtgtgtggggaggggttggggtggttgtgatactcagaggggggctccccttctcagaggagaagtggagggaggaatgggggaaggatctccatgcggaggtactgtgaggagagggggcttatactgcaacgccaagtgagtaaataaataaatataaccaaaaaccaaaccaaaccgaaagcaaagaaagcagggtgagtaggttaggatgaacaagccaggacacagcatccctctgtggtctcgggaactcagtgtctgccctgagatcccagctttccacgatggagggctgtaacccgtaagatgtcataagccctttcctccccaagttactttggctcaaagtgtttatcacagcaacagaaagatgcgtacactccatgtaccagccgaggggactatgggaacttttgaccccatcccctgacgctgggaattaaacccacagtgttatacattctagacaagcactcgaccgtgagttacgttcctacctgcctaggaatttttcgaaatggttgttggtccccagagaatggaaagaaacggtgattttcagtcagttttccccaagaggagcatcttgcaaaactgaaggtatagctcagtggtcgggcatttgctcagtcaggaatgcaaaggccctggatttgattcccagccctgcaaatcaaatcgaaacccgtacggcagcgctacagccctga

SEQ ID NO: 2111 - DNA, 1000 bp, mus musculus
cctggagaggaaggtgctctgcagtcaatgcactacactcctgcctgagaatgtgggaagaaagaaaataggacccaatgcaagatgaagaaaagaagcaatcagttagaacagaaatcaataaagtcaggaaatcaatggagaaaaatcaagcgccggctgtttgaaaacatcaaagaagttctaaacacttacccatcactaaccaagataaaacaagagaagacatgaactggaaacctcaggcacaaaggagatgtcactacagagtccaggatgttagaaggattaagaagaaatgtgataaacaattctcagtctcacctatgataatatagatgaaatcaacaaatccctcaacagacactacagaaattaagaaaaagaacttgataaaactaatagatggaactcagttaaagaaactgaattgactaacatctttccaaatataaagcactgggtctgaaagaaaataaaacttgagacctgtgattcatgtaatttatgtcaaatagcccaaagagttgtttgtgagctttgaaacctgggactgagaacatagtagaacaggccaggacatgcccgggcaggccctttgttaagacattcctgaggctgcttggccataaagataaagaggatgacatgtctggactggactggcgcctccctatctcccgcccttctgacctaagttaaatgttatctgcgtgtacagtctgctgatgtttaaatgggccaatcatgtgaaaccacaccaattcctcccccagctccagccccttttctataaaatcccctagcttccaagcctcctggtcgaatccactgtctcctgcatgagatatgtttcgacccgaagctccgccattaaactacctcatgtttttgcatcaagatggtctgtttgtttgtgattcttgggtgcacgccgaatcgggagttgagtgggggtttccccctaggttctttcaggtccagatagatatatgggcca

SEQ ID NO: 2112 - DNA, 1000 bp, mus musculus
gcagacagtatttaatctctgagccacctctccagctctgatcagagtattttaccaaatgctttggtaaaggtaactaagaggccagctgttgtgttaaaatgggaatttagccgcacagagcagtggcacatgcctagcactcaggaagcacaggcaggcagatttctgtgaattcaacgccagcctggactacagagcaatttccaagacggtcaggtatacacaccgagatagatacctcatccgtaaacatcaaagaaagggggaggtatgagtggcccccatagactcatatatttgaacgcttagccaccaaggagttgaactctttgaaaggattagaaggtgtgtctttgttgcaaaaaaaatgtatcactgtgcgtggactttgaggtttcaagcacccatcccagacccaggcttgctatttctctgcccatagatcaggatactccagcaccatgcttggcatgcctgccaccgtgctccccgccatggtaataatggaccaggcttctgaaactgtagcctaaatcccaatcaaatgccttcctttgtaagagttgccctagacagcgctcacaacaatagaacactgactaaggaacaggtgaatgtcctgaagtgtaacgaggaaacaccctgggtgtcctccacctagcagttcatcttcttgctcccagtctgccgactagggctttgcctggataggaatcctgggtaggcaaggacaaactcttccaatgctgatcagcagggaatagtggtcccaggcttgcaggagaagcagcaagtgctgccctctggtgttacagatctggtgcagaccttgagtaactatatccttaattctccgggtcctcctagaagtccaggttgctcagcccttgacagtgacccctgctacagctgtagtctgggcgcagccactgctgccttaaagtgagcgtggtctctgccactgtgaccatcaccttcgatgccactcatcggcttc

SEQ ID NO: 2113 - DNA, 1000 bp, mus musculus
tttttttttttttttttttttgttattccaaaggaatatgagaattgctcttcctaactccatgaagaattgagttggaattttgaaagttatcctgttctcttttctcctttccaaaagcactcaccacactccctggtcctctgcctccatcctgcctggagtcttcctcataccgaggccaagagctcgcttgcctcatttggattttacaactgtatccagcatagttctgtgccctggtggggccctaatcatagatgtaagtctgtatgtgcatttacatgccccaggcctctcttgatgagccttgcaggtgggttagcctcaagttctccactcctggccataaagctggtgatcctgcttcctctgagtgccaccattctcctccttatgagcttcagacatcggtatgccagcctcagagaatcgcacactcagcaccccaaagggcacagtttagaaccctggcagtggcctgcatccaccttgcccaagcctcatttttatttttcctctcattccctttctctggtccttagatcacctgactctatgttccaccattccatggccactgtgccaatcaatattcacccagatcagacaacaactatgcctcgcagccagcaatgggatttttaaattgctcttttcaaatagagtttacatagatagaggatctctccagtgtggaggacaatgctgaagagaatagcatctgcctgggatccatcaggacagtgtgaggacactttgagtgtcactcagagtgacagggccccatcttgtacagaagtatgctgtaactttacagtgactcccttcctgcccccatctgatctgaatctttggggtataaagcaaaggatgagctgccactgggtctgatcacagggaaactgtggagttgaggtgagagcccagggtgtaggtagaggggggacagctggggcggtgaagtggctctgatacccccttccagggtcatgctgat

SEQ ID NO: 2114 - DNA, 1000 bp, mus musculus
ggaggaacatgatggaacaaagacactctttattgagagctacagggagcctggatggcaaggctgagtctagacatagcctgtgccctttgaccagctgccagcttgagtggcctttctcctggtcacctctaatttgctgagaattcaagaactatgttttaatggctttcctgggactgggagctagctgggtttctggccataaactgagcttataagatagtgatgaggaatgacagagaagtagaaagaggagcccctgagcagccagcactcccaatgggtctcatgtattgctggctctcttctgtctccccactctacccaggacccttaccccagaagtgaggcaggctgctatccttacctccttgtctgtagaatggaccaaaagagccatcaggaaatccccatggctcctcaaccctgttctcttaggcgatcaaggttctggccacccacccacctgggtcaatgggccatgatcctgtgaccacagccactcagtgcccaaggacagggcatggaggcacagaagggtcagcaatgacctcttcctttacaatgtgccaccgttcgttctctgaagtggaactttgtcctccttggtgaggaactacgtgcggcatccagcctggctcctggactttgatccatcctgtttgacgctgccccactgctgcaggaacctctccttcctgctcgagggcagaggcagatgtttctgtcaggtttctctattgctccctgatgaaaagactgaggcccagagaaagaggctgagaagcattcagagctgtgcttgctttttctgactttttcctgactttttatacaataaatggatggtacagttctgttactatcagactgggacatacaagagtcccatctcccctaggtgactttgagagccccttgtgtccaaagccacccccatcctaatccctagcaatgctgatctgtcttgcatccccaacacttgtctttttgagaa

SEQ ID NO: 2115 - DNA, 1400 bp, mus musculus
agttggcactaactgcagttggtgtagattgatgggcagtgactgcagaagtttctgagaggtgtggggctgaggtggaggtggatgtcctgtctgtggagaatgaggttttggtttgagtgatggcactggttgtataaatgacaggtacggatgtatgaggagacccagtttttcctatggtggttggaagaatgtttcccgtggttgtggaggtagaggctgatgaaagtgtgtgttggggtgttggggtgataattacctcagaagttggtgtcacagaggaggttgaagaaaagggaaggtgtgtggccaacgaggtctgaggagctgatggtgtaggggaggcaatggtggtctgcacagatgtttccaaggagacacctgtggtatgtgttgtgttggagacagcaacagtggagaaagggtgtgtggtgcgtggagtctgaggactgctagttgtgcctgaggtggtgtggaccggaggagtaccagttagacccccagtggtcataagtgagttggtagtagctggaattggtgttgattgtgtgggagtcactgtggaaggttgcgagagatggggtgcagaggtcctgtctgtggagaacgagcttttggtttgtgtggcagcagtggttgtatacgtgacaggtactgatgtatgaggtggtcttgtgccttccagggtggttggaaggacagtcatcagtggcatggaggtagaggccactgatagggagtgtgggctggttggggtgttaagtccctcagtggttggtgtcacagataaggttgaaaataatgggagatgggtggacagtgagctctgaggacctgaatgggttgggaagttggtggtggtgtgcacggatgttcctgaggggagacctgtggtgtgtactgtcccagacacagccacagtggttgaagggtgtgtggtgcgtggagtctgaggactgctagttgttcctgaggtggtgtggaccacaggtgtgccagttgaactcatggttggcttaattgagttggcactaactgcagttggtgtagattgatgggcagtcactgcagaagtttctgagaggtgtggggctgaggtgggggtggatgtcctgtctgtggagaatgaggttttggtttgagtgatggcactggttgtataaatgacaggtacggatgtatgaggagacccagtttgtcctatggtggttggaagaatgtttcccgtggttgtggaggtagaggctgatgaaagtgtgtgttggggtgttggggtgataattacctcagaagttggtgtcacagaggaggttgaagaaaagggaaggtgtgtggccaacgaggtctgaggagctgatggtgtaggggaggcaatggtggtctgcacagatgtttcc

SEQ ID NO: 2116 - DNA, 1200 bp, mus musculus
gcacatacgtgctggtgcagcagatcgtgcccgtgtttggatacttccgtgtgctcattgacaactactactgtgacgtgggagacagcgtctcctgcccacagtccatcattgtggagtaccaccaggaccgtgtggtgctgacccgcaggccagttagcggggtcatgaccaaccaggtagacatgctcttgtgggtggaggggttgtggcaggcttggtctgggatagggacccgaatcctaaacttcctcctgctgtgtgtatccagatcatcttcaacaacaaagtagtcagtcctggcttccagcagaatggcattgtcacctcccgtgtgggtatcaagatgtatgttaccatccaagagattggtgtccgggtcatgttttcaggtctcatcttctccgtcgaggtgcctttcaacttgtttgccaacaacacagagggccagtgcggtaagctccactctggatattgttcgggtgttgaaggcaacctccccgtgggcctagagagatttcagactgtgcacaattgtggttcacatctgatgttccctggcggcttccctgtacaccgggaaccaaactgacttctgggaaagccagatgcacaggaaaggaagcaagacaagatgtcagttctgctcttcaacaggagtccactgggcacaggtctgctgcccagctggctgacctttgtctcatctgcaggcacttgcaccaatgacaaaaaggatgagtgccgcctgcctgggggttccatagcctcctcttgttctgagatgtccctccactggaaggtgcccaaccagccttcctgccaagggcctccaccaactccaacttcagtggtacccaggccttcacctactccgtgcccaccatcgccactctgtgagctcatcctaagcaagtaagactccaggaagtggggtagccttcctggccccatctaccaaaagctagtgggtcattaaaaggctcctaagaaaaatgagacctgccttgttccaggctctgggcactgtctctatggattgcgtcagacagttgttgctggaatgctattgtagggctgactgtggctgggttggataatctctgaagtcctccaccggcccctctcagtggtatgggcatcagttactgcctgcacatgggcaaaacccagggttcagaatgagggagcctgagggga

SEQ ID NO: 2117 - DNA, 1000 bp, mus musculus
tgctgtctaccttgctcccactcagctgtagtcataggcttcttctgacctagaccttagctctgcctcttccaaactctccccttccctgggcctgcctgtaccatcaccctgtctccaggctcagctcctctttcccagccagtcaatattcttgggccctgcctactcctaacccctctcctctatgaactctaacccctttggactctggccactcctggatcagccctctcaggaccctgctccttcccagcccggctggctacaggttgccagctagccccaggtagcaggtgggcagcctgttcactctctccctccctctttccattctgtgctccagacaccactaactgtatggaagtgatgacggggcggctttccaaatgtggtaagaactcctcatgctcacttggcccctagcctgccacctccactgtgtgcccacagcctaccctgaccagtgctatcccactgtccctgggctgtcctgggtcccctgtgtatgcacaggcattggaccatccaccacccctgggccccatcttctgccaagagtagtcttaactactcacttcctggtccccatttctacaatcaggctaggtagaggaaggacttaaactctcagaacaggaaaaggcccttgtgctggaaggcagtaaagggtctacatgtagcactgccctggagggcaaggtggacacttgtccacagaccatgccagtcagaagagaggtatgcagcactgggcttagactgaggtcaggtgagggaatggaaatgaagcatccaattggcccagctgggtaataaacataggcccaggagggtggagggtcacccattacttctgccctccaggaccagaaatccagctgtggctgcctgtccccagctccctgcctgcctacccaccattaatcctgtctgtctgctgctgaaactgtctgtgctagccagggcagggggtctccctgtatgctgctggtcactg

SEQ ID NO: 2118 - DNA, 1000 bp, mus musculus; identical to SEQ ID NO: 2117

SEQ ID NO: 2119 - DNA, 1000 bp, mus musculus
ttttttttttgttttgttttggatcaggtttcttgtagcccatgctggtcttgaaattgctatgtgaccaaggatggctttaaactcctgatcctccttgcctctgtttccctaatactggtaatccatgtgtacaggccaccatgattggcaaccacatgccttctttactatgattgtctgtggagacatgtttgattttttttctttttttgaagtcatttttttttttttggtagtctgttctcttgcatgttcactggctctctgttgcacccttcccatccctacctcagggtccctgaaccttctctggatctcccttcagaactggggtgcttttattgttcagtttggattttgattccatggactctatataaaaagaacaggagacacgggggtgaggatgggtgggggtgggagtgggcagcagagctagtcccgggctgatgtgtgtttgctgctcttgcagaggaccgaagtttggctcacagcattcacatgggccgttcacaaccacctgtaattccagctctaggggatctaacagtctcttctggattcttcaggtacctgcaatcacacgtgcacacaccatgccccacaccaacacacacacaaaattaaaaactaaaaacacatcttttttttaaaactagtttaagactagaagggaatcctatgttaaagttctgagccccagaaatgaccgaagctctctcctgaacagctggatgagagggccagcccctgtctgctcaggaagctacacctggagctaaggaggttctgacagtcacaggctgctatggtaccttatactgacaaatccacccagtcctcagcaaaaaaagtcacagggacttcgtgttccctgcccaaaccctgggctcatgtgcctccacagtggtatcaaagacaaatgggaacatcaagaagactggaccagcatcctccatgaacagcctggtaccagagtcagacccagtaacataca

SEQ ID NO: 2120 - DNA, 1400 bp, mus musculus
tattaactattgtatgtaatgcaccaattgattgtgatactgtatataatgctttggctgtgcctcgattaattttttgttttcctgtaattctttttttttttaagatttatttatttatttatttatttatttatttattatatgtaagtacactgtagctgtcttcagacgcaccagaagagggcatcagatctcattacgggtggttgtgagccaccatgtggttgctgggatttgaacttcggacctttggaagagcagtcgggtgctcttacccactgagccatctcaccagcccccttcctgtaattctttaaggggtttttgtgtttcttctttaaggacttctacttgtttagcagtgttctcctgtatttctttaagtgagttactaatgcccttcttaaaatcttctaccaccattatgagatatgatttgaaatcccagtcttgcttttcagttgtgttggggtatccaggactcactgtggtgggcgtactgggttctaatgatgcccagtggtcttggtttctgttagtaagattcttatgtttgcctttcgccatctggtaatctctggtgttagatgctgtagctgtctctggctggagcttgatcctcctgtgatcctgttaacctctgtcagcactcctgggagtccaactctcacctgagtcccagtggtcagagcactctctgcaggcaatctctcctcttgcagtgcaggtgtgcaggagtctggagctctgatccatctcctgagtcctggggtcagagccctccctgtaggctgactctcctctggcaaggaaggtgcccaggggtctgggtctcagctccaccttctggctgaggatgaaggcccaaagggaccctgaacaagaagctctgttgcttctgttgcccacctgctctccagtgaccacgaggtgctaggtgtgctagggctcctgcggcgtggagaatcctctggggcccttggcaccctctgctgggttcggacggaagatctccattaattttttgtatatgatagagttctgtttttataggttgaacaatggctgctgttagtcttctgcccataatacctctgataattgctccaatcaaaataactcctactgctaatgtttgtagggattttcttccatatttatttgtgaggaatattgtagctcataagaaaatacactgggcaatgtgttttgggtggttgtatccattaaataatttttacttgatgtgtccaattcttggcaagagaatgagttgtactggtgatgttgtgtctggttcaataaatggagctgttactcatttggtttacctggtggtattatccatcctctaggatagtgggctctttaaatttaatctgcatagtatcattata

SEQ ID NO: 2121 - DNA, 1200 bp, mus musculus
cttcttatagaagccagacaggtaccaccggagcacaagcttcatgcggcagtaggggtcatcctctgctgctgccctgtgatggggtggagagctctaattcaggctagggtccctggctaccctcctcagcacgcacctctttccccaaccatcccaacctccatctacttggctaaaagaggcagtctcaccccagatgacctgggcaccctgctccatcctcccaggtagggcagaagtaggcaagtgggctcaccacatatcgagaatagtgctgaggccaactccacaccagtgcagaagggctctgcacactccacactgtttggtgcccccacctctaggaagaaccctggatgctcacacccttatttccctcttcctggctccaccccatcccctgcctctgcagtccatagggttgtggaaccccctcctgctggaaggtgcacctggagagcaggtctccgtggtagtagtaatcagagagcttgccgaggaaggaccgaggctccaacacgaaggtcggcagcaccacacgggacaggtccatgcctggccgcagctgtcgcagcagcacccacatcaggctcttgttttcctctgacactgtctccacctgggaagtctcgtccagctgcggcagagggacatgaccagaccccatgagctgggctgtaaagcccctgctctgggctgcctaagggagctgagggacagggatccagaacagcacatctgacccttgcccactggatgccattggatgcatgtccactctgaacaggtgtcaccagcccccatcctgagcttgggagtgagagagtttctcggtggaatgggtgtcaccacccacccacactgggtttaggagtgagcagcttcctcatcaggtctgggacaagaccagcttttctactctggcatcctggttctccctctaacatgcacaactgccatggtactattcaccacatggcacatccacaagaccctcaccagaggccagatccacagggctgcctgatcctgtatgtctggcctccaaaaccctgagttaaataaccctcttgtctagaagttctagctgcaggaatccggtttccccagtcctctgtgtttatgggtgtgctaggcagttttctgctactataagaaatacctgaggcagtcaagttaaaaataagaaaggtttta

SEQ ID NO: 2122 - DNA, 1000 bp, mus musculus
gcccacactggcctgtgagtatggccactccaaggtgcttgttagacactcaggcccattccttccatctggatgctgtcctgccaggggaccattatgactaacccaactatccatctcagaagtgacctacattctcctagctaaatatccatccgtctgtccgtctgccccccactttgagggcagttgtggttatgttcaaacacctttatataaagacacctgctgtgttggccaccttgggctggaaactacaagctctgacctgaggtgggtgggctgccacctgcccagtacattgtttggagctgagcccccagggttgctgcctccatggtgaagttgaacgctgtggaagggagacccagagcatagctgatttgggagaggaaggactagagcgaagtgggtatttaagtgatccaggatctgaaggcactggacagcacagacccatcttccatttctgcaagtatgccctgtgcatggatggaagttgccatgatgccagggaaggcctgcccagcctgtcctgcctcaggcaccctgaggtgtagtcattgcttgacagtcaacagtcattgctctgtttctgcagccagctctgcgcctacttaagtcccctcctatgaaccatcaagtgttcctcccatcaacaccatagcccacagagggcaccagctctgaatgcaggcccctgcctccggctgtagctagacctgcgctatccctcctgaaagcagcctcaggatgtcttttcaagagatgaagaaatgtacaggcaggatctgtgatctcaccacaccctttaggtattttctggcccctcgctaagaaaaaagccaaagacaatgacagaggaggtctcacacagcagaagactctcagccttcagagaggccagaatctaaagtccaattgtcaggaggacctggcttgtatctctgtcgccttcattcctgccaccatcttcacagaatactcagcctgtgtctcc

SEQ ID NO: 2123 - DNA, 1000 bp, mus musculus; identical to SEQ ID NO: 2122

SEQ ID NO: 2124 - DNA, 1000 bp, mus musculus
tacacattcatacatacacatacacatacacatacatacatacatacatacatacatacacacacaatattctctctctctctctctctctctctctctctctctcttcctttctctctcaaggattctaagacacacctccaattttgacagtaaaatcatgggcaaccatgcagtttcgagctgccaggtcccggtgcacaaacttcttggcgttcaagtatgccatgccatcagcaatttctgctgtcatctgaatcatttcttgcaaggtagggggagggcggcctgggttattctaaagtcaaaacaggggttgcaattagcactctgattccatctaaatcatctcttatagggtgtgtgggtcaggggtgtagccagggtatttctgaagttaaaacatgggtttgcatttagtgaggttggtatacgtaagatcaggtaccctgttatgggtcttacctagaggcagcttacctcagcatctggcctcagagaacggaggtgacttttcaggtctccatgagccatcaattccatcactaccagcgttggctgtcctttggataccaccccaagaaggcggacctgcagaacaagcatgagaacaagcagggaggttattagaagagggtccaggttttacttcaattcacaatgctctctctggtaacagtaaaacacgggccaccctgtgtttggatggagcataggcagccctagaatgagggagcaaacagacccactcatatatagaacatcccaagcaaatctcacttgcctactgttcctcggtatataaaccatatttccacctccagaccttcgcacttcctgctctccttagtctggtccctcactcccatggacacatggttcatccctttaagactttgctcaggtagagtacaatcctcttcctctctctttttcaatttcttcaagcatttgtctcgtaacatgccactactagtttgggaactgtcttccctgcagt

SEQ ID NO: 2125 - DNA, 1000 bp, mus musculus
ttcctgcccccacctcccgggtacagggctgaaaggaatgcaccaccacacccagtgtatgcagtgctggggatggaacctaagcttcacgagtgcttagtgagcaccctagcacttgtcataactgaactgacagagtctagtccttctccttctagtaatagcaacctgtcaccatgctcacacggcctggatatctctgtatccagtgaatgagaggccaggcacttctaacttggacctttattgcgggccactcagctaaacagcttgaggccagccttgttagagcatgttataatgccctatctttgttttctgggctcctgctttacactcccgccatgcttagctctgagtggcccatggcctccagtgcctgacagtcatctggaaatagccacctccatgccacatgagaggctggagcgagagttcagtggctaacggtgcttactgcttttgcacaggacccaggttaagttccaggtacccacatagggtggcacacaactgcctgtcattctaattcaggggatctcatacctttttctggtacccacaggtacctgcacgtacatatgcacatacatataaattaaatacaataataaatagttactaagaaaggtatacaagaagctgagcttggtggtgcatgcctatactcctcatatcagcaacctgaggcagagggatcacaagtcatccctttgagaactgtcatgtgttgttggtgcccttgtcttcccttctcttcctccagtcgaagtcccccacaaaagcacaggcctggggctatgactgattattgatagagtgtttacccaatgtgcacaaagccctcactgcaaaccccagcaccatatagctcagtttgatggtgcgtgcctatattacagcacctgagtagtagaggcaggaggaccagacattcaacatcatccttgaccacagtagatcaatgctaccctgggatgacacatggtgcctgttgtct

SEQ ID NO: 2126 - DNA, 1000 bp, mus musculus
gtgccccagcggtcactcacaacataggtctgttgagtcttttttaaatgcactaggagccgactctgtccatctgtgatgggattagaaagcctggtgtttttctgtgatattagatgtcctccgagcacagcccacttggatttgtttggttggttttgccttgagactgggtctcactatacagagcagcctgcctccccgctgctgggattaagctgagaagcaccaagtctgaccacccatgtgttgatgacttgcagtcaattaactatgtgtgctgcttcgtgcaacaggagaaagccagaagagcagcctcgggaaagacagacggaagtccagcaacccagctgtaggcgcttacactgaaatctaagtctgtattgtaaacgccagcggcagccaacttctatcccaagcactgctcaaaagcagaggaacggaaagggaaagggccatgtcatcctcagccacatagtgagtccaaggtcggcctggactgcacgagagtctgtctaggaatgcagtcagtaagagcctggcgtctactgcagagtatgtatacttggtggtagagggcttgcttgaagacccaagttccatccctagcaccacagagcagggaggggacacagattcaggagagatttgtctttttctcctttggctgtgtgttgtccagggatatatatttcctaaaatctttttaaagtgaatttatatgtgcacatatgtgtgtgtagagggaggataagaactgaattatttgaaacaggttattatttgaaactgtatttttctactcagtattttggccaggtcccagtcccgggttgcaggtgttgactgccaccaggtttgatatgggatccaaatccaggcccccatctcatccatcgagcactttgtgagcttgaacccacgcccccatcccctagaatctttttctgatttttaactccaggagagatagcattttccttacattataaaataaaag

SEQ ID NO: 2127 - DNA, 1000 bp, mus musculus
caaagtgtggatactttgttcctccttagaatggggaacaaaatacccatagaagcagttacacaaacaaagtttggagatgagatggaaggaagggccatccagagactgccccacccagggatccatcccataaacaaccaccaaacccagacattattgcatatgccagcaagattttgctgacaggaccctgatatagctgtctcttgtgaggcttcgccagtgcctggcaaatacagaagtggatgttcacagtcatctattggatggaatacagagcccccaatggaggagctagagaaagtacccacgaagctgaaggggtctgcaaccctataggagaaacaaaaatatgaactaatcagtactcccagaactcatggtgtttctagttgcatatgtagcagaagatggcctagtcggctatcactgggaggagaggcccttggtcttgcaaagattatattccccagtacaggggaatgccagggccaggaagtaggagtgtgtgggttggtgagcaaggcaggggtagactataggggacttttgagatagcatttgaaacgaaaatgaagaaaatatcaaataaaaaattgtttttgaaaaaaaatctcatttccaccttttacccacccatcttctttgcttgtggagtcctctggagcaagccaagtttctctgagcaggcttctatcccagggggacacccatttccctgccacctcccctccaaccttcatcagacctgctgatcctgagcaatacaggtaggcttcctttctcccacccatattcctggttttatgagtcttctggagcaagctgagctgccctgagcagtcttctagtcaaggcagacatccattcttctaccatctctttgcccaccttcatctaatctgtggctcctgaaccatacagactcacagattctggaccatgtagacctacagatccagaaccatacaacccaaggataccaagcagaggcatg

SEQ ID NO: 2128 - DNA, 1800 bp, mus musculus
ctctaaaaggcaagtctcatttttcagggctgaattgtgcatgcttttaaggcatttttataatttctaatttttaaacacatcaggttttttgttaggtaattggttattggatttctagttgtattaggaaaatggctgaatttaatcatcatcaaaaacactggaagataaaaacattttatatatatatatatatatatatatatatatatatacatatatatgtatatatacatatatacatatatatgtatatatacatatatatgtgtgtgtatgtatgtatatatatatgtatgcatgtatatatatatatatatatataattttaatttcattatcatattactcccattcagttaggaagtggcactgcccaccaaaatttcacttgaaagagacagaataacttcatcgacaaacagagtgaatctttccaaaagtccttcttaagtcaacagtaacaaacttgatatgaaaatcctaggctccttctccactgtctctatattctggagattgatgatatttattaataattactttctgttatcctagtgttccagtatttacataggattaagtgataaatgatagtgaacaagaaaactgcctgtttttaaggagatttatgcaaagggagaagggttatagtaagtctctatctcagttttcattgtctatgcataaacaggtagtgtagaatcattgttgaggtaatggaaaggtgtcacagggttgcaaaatagaagtgacctttaaatgagctggataagatcctcaaatggagagggcttgggatgccaggggaggaaaatgactggagtggaaataaatcaccacaagttcagcggactgcgtgtagctgagccctggtctgcaggcttaggggatgagatcacagatgaggctgtagaattttgctgggcacagcatgtgcaatctgatcaccaccctgtgtcctctgaaattttttctttagataacccataatggttacctggcaagacttgcttgtcccaaagctgaatagatgcaacagaattaatgtcttagagtggtttaggatgatatgctccactgtggcaacctggatgaggggtgacaggcacttactgagtgatggtggcttattgggaaaagaatagattgatacaagaatatcaaagactgttaggagtcttgcgcgcgctcgactggccaggaagaacgacgctgcaacaggatccttctgcacacgtttattgggagagcttgcttgtagaggcgaaaagaccccgagcccagaactggtgctgcttttataggcctaggagaggcatgtctcacacctggattggttatgcactaagcctcatttgcatgttcctcatctgattggctactctctctctctgtacctcacagagcctcattatcatacctcatttgcatgtctcacatctgattggttactctcagtaccttacagaacctcattatcatacctcatttgcatgtctcacatctgattggttagactctcagtaccttacagaacctcattatcatgcccgggccaggcagtgtctttgcaaaaaactttactgcatatgtacacattggttgtttgtccaaacttatgcgtggtggccagcagtagtcagtgccactctgcaatggcacatgtggcttcccacatctcccccgtttgttttaataaaatgaggctggactaggcctgtgcaattatgcccatccgcgtggctcctgttttaggtcgttcctctaatgtcacagccttacccgtcatagggt

SEQ ID NO: 2129 - DNA, 1000 bp, mus musculus
attctaatttaggtcttcatgctgcatagtaagtgtgtatatctgctgaacttgatgatacacagagttatagagtatttactttgaatcagactaaaattaataaaagacacgttccagtgtttaatatgtgaccagcttcactgttaagtttgacatggaagagacatagataaaccgctgcctacctaccttcagtaagaagctgcatttgatgaaagagcaacaagaagggcagttacctgcagatgacatttttagcattaatcccttgaattccaacttactatttggttgtacaacaacattcttaaaactggcaaggtttttttgttttacaaagcatctagttgttattattattaatcctcccatgtaactcctttggtcacgtttatattcatggattctatagttcttactttcctaaatacataaaacaaatgctaggctcatatattgttactgtttgtgaaagttttcaaggatggatcaacaaccatttggttttggataaccagttggtgtgttctttcttgggaatcactatttctcctgctctcagttctttgtaaaatctttggttatttattcctcatatatgatcagcttagagtaatagttaactgggccaatactgagccatttgttactgacaagataagcaggatgtattgtctccttctaagcaagtcttgtttcttgtttcaaattcaatgttcattcttacaatataaacaaaaggcactagttagctttcctcactcattatctacattaatgacctttatatgacagtgactaaaatacttcaggataagttaaagaacaaatatttatttcagcttatggtctcagaggacttagtgtctggttgcttgacctcctgtgcttgggcagaacatcatggctgcaggagtcagtggtaagaaagatcatctcttaagggatagaaagtaaagactaaagataggactaggcaggccccactttctaatgc

SEQ ID NO: 2130 - DNA, 1400 bp, mus musculus
tcctatcaggcccccataaaactggacttcaacaacaacagaaagcctatttacttgtggaaaattaacaactccctactcaaagatccctgggttagagaagaaataaagaaattaaatacttactataattcactaaaaacaaggacacaacatatccaaacttgtgggacatagtgaaagtaatgctagaagaaaatccatagcagcattaactggagacatctcatgggataaggtgttgggagaacaggggagagactatggcaatcagcagtgggcagataggtcatgtctaggaaatgataaagatctagactatggtgaagccccaggaagtctgtgggggtgactttacctgagagttttaacagtgggaaatgttgagcctgaagtggtcaccttttatagccagataggactgccaatggagggatagggtatcaatccactcacaaaatccttgcatgtcttgtctacaagatgtgcaagggcaaagatgaaacagaggtaaagagaatgactaatcattgtctgtcccaaactgagtctcaccccacagacaataccaattcctgaatcctttcatatctgttatgcttgcagacaggagccaagcatagctatcctcttagagattacattcagcatccaatgtaaacagacccagagttccactgtcagtcatcctatggagcaaggagattcttgtcgaagaggtgcagaaagaactgaagtacccaaaggggatatggattcaacagaaagaccaatagagtcaactaacctgacccatagaggctccctgaaaccaaaccaccaaccaaagagtgagcatgggctccacctaggcgccccacctctgccccaacatatatgtatgtagcagatgtagcttagtcttaatgcaggtccccctccccgaccccacccccagagttggggctcttcctgaatcttttttctgtctgtgggtcctgttatcctaattgggctctctagtctggcctcagttggagaggatgtggttagtcctgcagactcttgatgtgcagggtggtgtactggaggagggtgatgtggaaattgtttatttctttgaagattcagttgtgtcatgtaatatttttctagaatctgtcttgtgagatgatgttttgctaagaacaaacatgtggtgtttttttctggaagctgcctagataaagagcatgtggtattttagtagagtagatactcttgagaaaacagaggatacctgtgtggcattggttctccttgccttctctgctgacttttataaagaaacacaccaaagaacttctttctcattctcatttctcattcagaaattaatgactctaaaacaactaagtagattagaattttatttaaaaata

SEQ ID NO: 2131 - DNA, 1000 bp, mus musculus
aatatttggcccagagactgaaggaatgaccacccagagactgcgtcacctggggattcatcccataaacaactaccaaaaccagacactattgtggatcccaacaagagcttgctggcaggagcctgatatagctgtctcttgagaggctctgccactgcctgacaaatacagaagtgaatgcacgcagccatctattgaacgaagcacagagtccccaatgaaggagctagagaaagttcccaagacgctgaaggggtttgcagccccctaggaggaacaacaatatgaactaaccagtacccccagagctctctgggactaaaccaccaatcaaagaaaacacatggtgggactcatggctctaggtgcatcctgtgaaggttctatgccccagtataggggaatgcaagggctaggaagtgggagtgggtgggttggggagcaggaggagggtgaggggaaagggatagaggatttgcagaagggaaactatgaaaggagataatatttgaaatttaaataaagaacatatgtaataaaatattaaaggagttttggtgctttaggaagtaatatggttgtatgttcatgttacatgtatgtgcttatggtgtatgtgcttatatgtacatatgtgagcaagtgtgccaatctgtgactgtatatgtagagtccaaagattaatttcagttactttgatagttatttttgaattccaatttgctacactctagaattacttaggaaatagtttcaattgagaggttattcagatctggttgtctgcaggaatgtccaaatgcctgattgttaaattgatatggagtgacagacctctctgggtaccataattcaaagatagcagttaggccctgaattatacaagacagaagaaagctagcagaatccaagcaagtagtatgactatattcacattttattttctgctctttactttgtatatgatgtgacaaactgcttgtgttcctgtattgac

SEQ ID NO: 2132 - DNA, 1000 bp, mus musculus
gggtctgagagacctgagagaagggaaattggagagggtgcaactctgggacaagccatggggatgggaaggctcctggaagaatgtggcagtgatcctagctgtgatgtctagcacctggggatttggagtctgaagtagcctcctgtaatcatacagaaattcccagtgattggggataagaatacacccaccaaatctactacccccaattttccatgcttaaagatagacaaggataaagatggaacaaagtttgtgggaatggccaaccactgactggtctaacttgatacccactccacaagagagaatctgacactgttaccactctattttttcttgaagacagaagcctaacacaactgtcacctgagaggcttcatctagaggctgatgaaaaattgatgtagagaccaacagccaaacattaggcagagctcaggaagttttgtgttagagttgaggaaggattgagagagccggacaggccgaggacaccacaggtagaccttcagaatcagctaatctgggcccatgggggctcacagagactgatccaccaaccaaagaatggctctagatccactacacacatgcaccacttggtcttcatatggatcttccatcaattgtagcagggactgtctctgacttgaactctgttgcctacctttggacccccttcccctctaggctgacttgtctgaccccggtgggagagaatatgttttgtcctgatgagaattgaggtgccaggacaaggtgatcgccaggaagtgggggttacccttctctgaggagaagggattagaatagagggggaattagagaaaaggggtgggagtgtgggactgggaggagaggacagaagggctgtaatctggatgtaaagtgaataaataaattaacaacatagtatgttttcaggttaaaaaagtaaagaaatctaggagtggtcacatattgaagaaattccctcacaatgttgagacaaatc

SEQ ID NO: 2133 - DNA, 1000 bp, mus musculus
aagactaacagagtcaactaacctggacccttggggctctcagtgtctgaaccaccaaccaaaaaaccacatacgggctgggtctaggcctccccacacatatgaaggaggtgtgaagcttggccttcatgtgggttctaaaaaactggagcagggctatcccaaaagctattgcctgttcatggaatatgttcttctagctgggctgccttttctgacctcagtaggagagggagcacctagccttgcagaaacttgaagtgccagggtcagggacaggggaatactcaggagggcccacacctgctcagaggagaaggggagggggtatggaggaaggtttgagggagggatgactggaaaaagggcagtgaaagggatgtaaaatgaatgaatggataaataaataaataaataaataaaatgtgtattctacttgttgaaagacatgggtttatgaggcatgttctgaattcaaaggtattataatgtgaaaatatgcatttatttttgagatgggtgggtggccatctcaaaaatattaacccagaacccggtggtggtggcacacgcctttaatcccagcacttgagaggcagaggcaggtggatttctgattatgaggccagcctggtctacagagtgagttaagtaagttacaaagtaagttccagaacagtaaaccctgtctcaaaaaaaaaaaaaaaaaaaaaaaaaaaaaaaaaaaaaaaaaaagacagagagtggagtaggactgaaggaaaggccatcatgagacagccccacctggggatctatcccatatgcagacaccaaaccgagacactattgctgttgccaagaagtgcttgctggcagcagcctgatatgactgtcccctgagaggttcttctggagcctgacaaatacagaggtgtatgcttgcagctaaacattagactgaccccagggaccccagtggagggaggagttaggggaaggagctgaatgggtttgcaac

SEQ ID NO: 2134 - DNA, 1200 bp, mus musculus
aaggagattctatatccagcacaagtttctattacagtaagaagaaaattctgaactattgtaactctctagactagttagtgattctgtgttctttctcagaggatgctaccatgtcacccaagttattccaaatgatttgtcctccatttcctaacagtgtttcttccagccaaattgttagctcctgctcgtacacgggtgtagctttgcagtttaccagacaatctgctttatgacctcccataagtaggatgcgcacgctgaccttgcctcttctgcgcaaggccaggacactatggctaaacatgagttatttcttcacactctttgaactacataatagatagattgtccgtacactggagatatacaagccttctgggctttctcaactcatgttgttcacacagcaataggactttgtgatgaaacattgacacattttttcttttcttttaaaattttattagatattttctttatttacatttcaaatgttatcctgaatgttcctgatacctgccctgctcccctacccacccattcccacttcttggtcctggcattccccggtactgaggcatataaagtttgcaagacctatgggcctctcttcccaatggtggctgactagaccatcttctgatacatatgcagctagagacaggagctctgggggtagtggttagttcatattgttgttccacctatagggttgcagatccctttagctccttgggtacaacattgacacatttaattttatgacacagtatgtggttacatcacagtattttactcttcagtgatgtcatcaggaaagtgaatggaagtgagagctggaaacagagcacaagccttgcatattggaggtcctgggttccacctccaacactatgaagaaagaagctagaaaaatgttttcagacatattatcaggaaccttcatggtgaacatttctacctgcactcctaagtatgggtttttctattgtttcattacagttgaatcatttaaagaattcttcaatttttttttgtctaaatttagttaagccagagagatatatgctcatgcccaagatgttatggtcttcattacatggcttatataacttcttttcatggtctctgtctaaaccaagtggaagaatggtttcaataataataattattatttctttgtaatatgtaggt

SEQ ID NO: 2135 - DNA, 1000 bp, mus musculus
tgtgatctttttatcatagtacatgtatactataaagcactggtagatgtttcaatacttatgtctgaggacaatgtaaatgactgaagtatcattaatgacaattcactaatttaactgaaatttcagtgagtatagtaaatagaacgtttctatatgtcataatcagctgtccataataagaaatgtacatttagggactgtggagggtgagcgagcagagtgcaggagctacacagcttctgagacagaccccattttgggatccagacatctgagcaccttccctgccagaggagaggtgtccatctgggagggctctaacttccagagcaggtgagggagacatcttgtgtcccgggaccctcagagaccagtctgtgcaggtaagagtgcagactacagaagtgacacagattctggtacaagcaaaagctacacagcttctgggacaggcctccttctaggctccagacatccaggcaacttcccctccagaggagaggtgtctgtctgggagggctctgagtgccagagcaggtgagggagccatcttgtctactggatccctcagagaccagtctgcacaggtgagagtgcagactgcagagacaatacatcttctgggacaggccctgtctcaggccttcatcttatgccaggaggcaggtctgaaagccagacctctgtacaccttccctgcaagaggagagcttgcttgcagagagtactctgagcactgagacacaggagagaactggactcccagaactggtgacagaggctaacagaatcacagaaggaacaagctccagccagagacaactacaacagctaataccagagattaccagatggcgaaaggcaaacttaagaatcttactaacagaatccaagaccactcaccatcatcagaaccaagcactcccacctcagccagtcctagataccccaacacacctgaaaaacaagactcggaatcaaaatcatatctcatgat

SEQ ID NO: 2136 - DNA, 1000 bp, mus musculus
attaacgatcactgacatccttgctgaaaccaggaagctgtcacatagcactgcttgatctacatctgtgtctaatttcaaacgaggaagagaacagatctctccttatgcaaatcacccggactagtgacttctctaggtattcagtgaagatactgagaaagagagagaaaacactaattatcgctttgcagaggataatgagtagcctatctgtaagtctagcagcccctggaatccagaggaaaggagatgagggtgcgggaagagctccagcgagtgactctgcttaatcttaccacatgtcagggctttttgcacagagtactacttgatggacatgcactaatgttcttttcaatctcagcttcaaggtgtgaagaatagatactgtactagtttcccttaatggctgactgtcaaatcctgtacaattggatatatttatctttcagcaagaaagattgaaaataagaattttcatgaagtaggacattatatgtcaagtgtcttcaacattagcattatatatgaccacactgaattttcagattaaaaatagggcggtacataaatactgacaggaagaaagaggacaaaagtgacccctgagcatgagtctgctgtgggaaaatcaaggatcagaagcacagagatttagggtttttctctagtcactcattctctatgagactcatgcccaagtcacttccaaagcaattcctactccaaaatgtccatttattctttttgaccttattatgatattaaaactagatttcagcactgtctctgttcagaggaagatgagggaaaagagcccccctccagacatcaaactactgaaatgcgtgcccttttaaagacgattgttcatgaaccataaccaaatagaacctctccattctggaagtgatcagatagattcaaaaagaatatttgaagcggtgccaagccagcacatcgttgcaattataaaagcaaaacccacaccccaaac

SEQ ID NO: 2137 - DNA, 1600 bp, mus musculus
agcgaaagaggaacacacctccactgctggtgggaatgcaagctggtacaaccactctggaaatcagtctgctggctcctcagaaaatagttctacctgaggacccagtcataccactcctgggcatacacccaaaagatgctccaacatataataaggacacgtgttccactatgttcatagcagatttatttataatatccagaagctggaaacaactcagatgttcttcaacagaggaatggatagagaaaatgtgacacatttaaacaatggagtaatagtcagctattaaaaacaatgatttcatgaaatagcagtcaaatagatggaccttgaaaatatcatcctgagtgagttaatcaagccacaaaagaacacacatggcatgtattcattgagaagtggatgttagctaaatagaagctcaaaatacccacattacaactcacagaacatattaaacccaagaagaaaaaagatcacaccaaagagtggatgctacagtattactcagtagggggaagagaatctctagaaagtagtgggagagagggatctgggagggagagaggaggggggagggaaaagagtggctagttcatatatgggaggagatggtggagaaatacagaggatcgggaatttaaaaggagatgtgttgcagtgagggaggggcaattggggtagccactagagagttccaggtgctaggaacccaagaggttcctaggatccaacacggaagattttagctgaaatactgaacaaagcagaaatagaacctatagggaccatatcaagggataggcatggcccccatttgagggatgggaacacacacccacctcaaaaatattagctcagaattcctcctgtttaaaggaaatgagggggcaaagattggactagaaagagatggaaaggctatccagcgattgcctcacttatggatccatcacatcttctgacaccaaacccagacactattgctgatgccaaggagtgcttcctgacagaagcctggtatagctgtcctctgagagtctctgccagagccatacgaacacaaatgcgcatgtgcacagccaaatattggactgagcatgggaaccccaacggggaagttaggtcaatgattataggagctgaaggagtttgcaacctcataggaagaacaacaatatcaatcaaccaggcccccctctcccaaagctcccagggaataaaccaccaaccaaagaatacacagggggtaccctcagctccagctgcacatgtagcagaggattgccttatcaggcatgactggaagtggagccccttggtcatgtggaggcctgatgacccaggattggaggaatgctaggctactgaggtatgagtaggtggatggggcaggttggggagcaccttcatagaggcggggggagggaaaaggggatagggggcttgtggaggggaaactgagaaggggaatagcatttgaatgtaaataaataaaaaaaccaattaaaataccttagataaatgcaaagctagagttcataattaagattaccagaataaaataaaaaattaagttaaaaaatttaaaaaa

SEQ ID NO: 2138 - DNA, 1000 bp, mus musculus
gtgtcctttgatgatgccggtcactcaaagcgagtcaggtactcatagcctgtgtcatgaatgacaagagctgcagggtggatggggaggagcctgtggcttgagaatggtgcttctatagttgctaaggccagactggggttacccacatcagcaggtcccgcacacctggttgtcctccaggctccctatatctatttcactcttggttgttatccatagatagagttctgccatggacatgcctcccttgttagagagtaacactttaaaagcaaagtttaattaagcatcgtgacttttcagttttctttattccaaggagtggtggtttgaataggtatggccccaataccctcatgtgtttaaaggcttggttgaagggagtgacactattagatatggccttgttggcataggtgtagccatgttggaggaagtatgtcattgtcggggcaagctttgaggtcaaatatgctcaatctacatacagtgtggtacacagtctccccctgctgtgtgtggatcaagatgtagaactcccaggtccttctccagcatcgtgtctgcctggacactaccatgcttcccaccatgatgataatgtactaaatctctgaaactgtaagccagcccaatttaatattttcctttataagatttcccttggtcatggtgtctctgtgtttctgtgtctctgtgttgctgtgtccttggatgatgccagtcactcaaagtgagtcagttactcatggcctgtatcatgaatgacaagagctgcagggtggatgggtcatggtcatggtgtctcatggtttcagaaatgaaaccctaagtcataaaagaaatatttcatgttaaaatgtatgcatgattacctggggtggggttgaggggacaaaactactttgtcttggtctatctgtgatttgtttctggtgtactgtgaacaagggagttcacaggataatcctgtggctggtcagacactctctggtct

SEQ ID NO: 2139 - DNA, 1000 bp, mus musculus
acagcatgggcacatatgtgtcctcaaaatggcttttcagaggtgccacttacatgctctcaggcctgagctacctctcagggaccatgaggtacctgttgctgtatggcaggcaggcatcgcttctgctagccagagactatactaaacaggaaggctgggcacaccctgggctaggctgggcattcctcctcatggccccagtagcaccctctagcctcctgattgctctttcccccagcaaggcaacctcgtcgtcgtcgtcacacctggcttgacattcactgggtttacctggccatggtagagcactcgatgtgccatccaggccgtccgtctccccacggcgaagcccagaacacctcctgaggtttggctgccttccacagggcgaagtcgctgctgtgccgcttgtcagagtcacctgctggtgacagggggttgctgagtgaggagccacagtgcagctctctccatgacaatggcacatccgctctgtgtatcttccttctcagaaatctccggttcctcctacagtgctccactcctaaccagtgggtgagcaggactgacgcctccacgccagcaggcagagcagagctggagtatccacagagcctgcaaataccagggcacttactgccaagggaccagagcccagtgcctggccagatctgttcagccacttttgagagaccgagttccttcgtgaccttttccacaatgacaatctccacagggcaaaggtgacatcaggatagaggacaaaagccaagagagcaaggagcaagcagagatgtgtcagaccccccagggacagacccaaaagggttcagcaagtcccctagacaaactctgacctctcctaaatgccatgctcttactcaactcacactttcgtggctgtcatggatttgttgaccctacttacacacatcaacaaatgaggtcactgggtcagtctggacctctgcgtagacagagcacagtacaaggtgag

SEQ ID NO: 2140 - DNA, 1000 bp, mus musculus
ttttgcctttaaagccctcagtagcctgcagcaggaggctttacctcctccacggtgcctttcctgccccagccaaggctctgctgcccttcagtgggtgtctgtgagcacagtggtagtctctccagggaaagggttgctcctttaaccctctgcatcctgctctggtcttcacttccggagaactgagcacgccagctagcaagtcttcaggagtttgaaggaggctgccctggcttccatgaccttcccatgctgtcttagctagggccatcatcacagattcttaaagctgagacttcctggacagagagacacatacccagacctcacaacagaaacaggcagaggttgtgactgtctgtgccctaacaagccacctggggctttctacttccagggtgatgatagctctgcccaccatccaggacccaggctggcactcagctgttcccagatcacttgtacccaagggcagcagtggcttggaagaaaaccggccaggatgtcctggcctggcattaacgggatttcctctgttatccggactgaagggcagaggcacacagctctgcctcctgcctctctcaggtcaggagaagtggaggtggggccagtgtggctaccctttcctccgccatcagttggttcttgtgacagtactagctttggtggtcggctgtggctgaatgaggcgctggacaccgtgcccttgggcctttccaggaagccatggaagagcaggaaggtgggtggaggaagaagagagggaagcgggcagcagcccctagctgtgcaagcccttgctgcgcacactcatcctggaagcctgccaagagtggcagttagcgctttgtgactggggtacaggaaatgggagggatgcgaaatggcaggtgataccccctggggcaccatgctgtcctccttgcagagggccatttttgctattaatcttggaaagaatgctctacaaggctccctcccagctacaaagggc

SEQ ID NO: 2141 - DNA, 1000 bp, mus musculus
tagggaagaaaggctttatttcatcttatagttccacatcactggccatcattgaaggaagtcaggacaggaactcaagcaggggagggactggaaggcaggagctgctgcagagctgatggaggagtgctgcttactggcttgctccctcatggcttgctcagcttgcttgatggtgcacccaagactaccagtccaagggtagcactacccacagtgtgctaggccctcccacaacaatcaatctaaaaaaatgcaccacaggcttgtccagagggcaatctgatggggccattttctcaattaaggttctctcttccaaaatactctagtttgcatcaaattgacataaaactgaccaacacacatgacagaatgtacaagaaaccatgttccaacatgtaagaaaactctttttaccagttcctggctaattggctgcattatggtcatccacttgcttggctaattagatgtctgattgtctgggtggttggctggcactatggttatcaagttgtccagctggttgcttggctgtacaaacatagggctggtttactggttggttaggtcctatgctgctagtgctggttgtttagctagttggctgactgcttggctggctggctgacttgttgatgggctaattggttagctgactgactggctagctggtgatctggttagctgtctaatttgctgactttggctgactttttaaaagacagtatgataggatttggaattccaaggatcgattcccagcgtaatcagaagaaatcttttaagtctgttttattttctacctcaaattcaaatgaatcagaaatgtctctcaccctggttctctttctctgcttgtggagtttctttttaattcaaaagtatgaagcccgaaggcctgggccaccacctccaaagggcaggagccgaataattctcattaagtggtattcaaagtgattcctgaatatagcttctctcctatctatgagaa

SEQ ID NO: 2142 - DNA, 1200 bp, mus musculus
acactgggacaagggagaggaggaagcctgtgtttagctagaggaggaatttgtctctcagaagacatttcaaacaattctcagagcaccttgcaggcacatctagagcctacacattgatgcaaatgaggggtggaccacaccctcaccaggatttaaacctccctttatttaaacctgaacttcactacagattgctcaagatggacttgggaaggggctttggggtctgcgggacactgaattcttcatttattcctcttcccaacgtggccacattaaacaattctcttttctctgcatctcaccattacttgtctgtctaatcggtggaccgaggatgtgaggctgagtttagcttgttgggcttccagggtctggtctctgaggcaatcaatgctcataagaatcttggtgagccagccgggagaggggtcacattttgggtatcagtcacttgtagcaagttgaccctgagtagacaggaaagactgaaaagttcccacagtggtgagatcatttgttctaccacccagccaacgcctggtgatgcagagacgggatcggggctgggtctcagacccaagagaatctggccctggtgagtctctgtggtgggtggggcactctgagcacttcatccttttagtgcagggctctgtggagctgctgttcactttgaatcaattcgacgactgtcatttggtgactgtctttgtcttctgttttattctgagccactggggttctgttgaagaatttgggcattgcagtgtttatgtgactggctttatcaatttgcaagatttttgaactaattcggtgacctggcgtgacagggaaggttaaccggtgttggttttttgggaccctgctgagtcacaggggttttgttgagcctttgacaggaaaccaagctgagggaatctctgtggtgacctgtgcagccatggataacatgaagtcggggtgctttggtgctccctagggagacagctagttgacaaggctgttacgagcgtgtgatggtttaatgttcttttgtgtcattttgtttctaaaggaacatggggaaaaaaaccctcaatctatccctcattttcctgaaagtaactaaatagcggacctctgataacacatcattttaaatttctttgaacttagtacaaggcaagagcaccattactggtgaatataatt

SEQ ID NO: 2143 - DNA, 1200 bp, mus musculus
ttctcctgtatttccttaaggtagttattgatgtccttcttaaagtcctctatcatcatcatgagaagtgattttagatctgaatcttgcttttctggtgtgatggtgtatccaggacttgctatggtgggagaattgggtcctgatgatgccaagtaactttggtttctgttgcttatgttcttatgcttgcctcccgccatctggttatctctagtgctacctgcctggctatgtctgactggagctcatccttcctgagatcctggttgtgtcaaagctcctgagagtcaagctgcctctgtgatgctgtgattctgtggtcctgtgatcctgagatcctggttgtgtcagagctcctcagagtcagctgcctctgggaccctgagatcctggtgtggccaagctcctgggatcctgggtgtgttagagagcctgggagtggagcttcctctggttgttgtggaactggctgtggagtctgtgcccaaggtctgctcaaggcactggcccagacagactgaaaggaacttgtgccactgatctggcagagtttttgcgtgcctgggtactactggcccagttactccggtgttgggacagatgttttcaccatatacttttctataaagtagtctctcttaccttttgtcaaaggaataatcctaaaaagttacaaattttccacattatattatccatcaatatccctatgacaaaaaaatcaatgggaccacattgtaggaaaaacaaaaaacaaaagcaaaaaacctttattagctaaaacagacaccatggacctgtgagatgttctatcagttaaaggcctttgccgtgcaagcctgagtttcatctttggaacacccatgctgtgaggagagaatggagctacaaagttgcccgccacacacagcacacacacacacacagcacacacacagcacacacacacacacacacacacacacacgacatgtattctctctccagtgaaaggggatgccttcaggacacctggctctgttttctaatagacttatcctctgcagtcatgtgactagggtatggagtccagatcacttgaggtgttgaacacaaactactctgtactaacttgacccggtgtattagtcagggttctctagagtcacagaacttatggatagtctctagataataaaggaatttattgatgactta

SEQ ID NO: 2144 - DNA, 1000 bp, mus musculus
tgaaggtttgtgcagtctatagaacgtgtgttttataagcagatctggagtgtgctgtttggctcatgctttctaagaataggaaagcagccaggctttctcatcccctagctttcccctaaaatattgtcagtgcagtgcactgtgacatcaacacggtccctagtggctgagaggaggaggccatcaaatacttttatttctgggaggaaaagccttcatgtttgtgccttacttggggggaacaggtgtggaggggacagtgaaaaccattgccacagcacccaggtagcaagagaggtaacactggtgcttcagggcaaggaacgactttcagcccactgtgagtacaagtcccctcagtaataaggtgctcacaagcactaattggtgagttcatataatattttgctaaatcaaagagtttgtattcagttctgcactcgctcccaaccctttgagaaagccgttatcaaaagtgaagcttgcaggtcagtgcggggtggaggaagggagtcctgggtgcactgttggtgggatgcacaacaatcaacatagacgcatcacggagcttcctacaaaacaagacagaaatggaaatagacatacgattcagcgactccactctcaggactacacaaaggagacagaggccgtgcctgcgggaggcccccacacttccatggttattcatgccaacccgggtgtgggactgacttgtgttcccagttacagatgaatggataaagagcgtagcacacgggggagaactgttcggctgcaacagacagaaatctgtcacgtgcctcgtccacgggctagaggacattgtcaggtaactaatctaggcacaaagtccagtggttgcatttggtgagctctaacaaggttggtctcaaagaagcacacagagagacatcacttaccaagttggagaaggcacccaaagaggaaagattggtcaaaggacacaaagttttagcagtgagatgagtgagtt

SEQ ID NO: 2145 - DNA, 1400 bp, mus musculus
tctcctgctctggctccaggtctcagttcttactcttaagctcaagtagacttgaactgtcgtgccacatcactaaaacccagcatcggtcaggtggagcacacaccatcagcactgctctctgtgcctccctctctgcctcagtcacagctgaccctgtccatcactgtgcagtatctgcccggtcatcacccatacgcctggtctggctaccgtgtgggtgacttgggatgcttccttggcccatatcttaactcagcagtgagcttttcctcatctttgcaacccgcttccttgcttcacctgctccccccttccccattctccctcctaatcttccttttcattcctgagatcccatctctgtggctagctctgctctatgatcctgcccttagggtcaccagtggcctcccatgtaaaaccagagtagttctggaatgtaatactgtccagttgtttgatacagctacagctactccttgaccttcaggcccttctgtgcgccacacttctatggtcatttcttgctacctaacctcccttgaggtcatttcacctagctgtcactggtgagatgagccccaggccaaggctttaaataactgttcatctctgcccatccctcgctccaaactcctctccatagggtcctccctaattcctctggatgcatgggaggcagaccatactcagctggcccaagctggagtctgctttgggtcccctgctgctctcccccaggcttagtaactgagcacagtttgctgggtaccacatagcccacgccttgtcttcccacaaatcctgcagggccttctttaaacacatcataagctaagtaagtactgctgtcggctgtgacaggatccagcttcaggctgaactgtgcgtctcactaggatctcctagtctctgtctgctgtgggtcatactctcctatttagcccttcctatcttttcccaaccagcaacagctccaagtaccctgtgaggacatgacgtatctcatgtcactcctaagaaccaaacatagaggcaccttcttttccaaaccatcttactgttttgaaactaggactcacagtggtacctgctgaatcttcttcggctaactgcctttcttggtcctgtgctcagtgacggagactgtctgctcctggctgtgtcagtggagctcagtccagggcttcttcagaacttggcacctgcctgggttcacctgctctataagaaccctgtcctgattcaacataagaccagagacactgaaacttatggaggaaaaagtggggaagagcctcaaacacaggggcacagggaaaaaatgtcctgaacagaacaccaatggcttatgctctaagatcaagaatcaacaaatgggacctcataaaattgca

SEQ ID NO: 2146 - DNA, 1000 bp, mus musculus
gctggtagaagccaatgatctgccaagcaatacactctaacctgctgtagacacgtttcctcctaactgaagcatttcatcctagagagagggcatagggctccagcaggtaaggaaacttgccaggaggagggaggtcagagagttagaagattcacggagccactccccaatgctataaaggcagcaaacaattgctctgcagagaggaatgccttttgtggaactgcctgcaacttgtgcacggggctccaaggatgcttttgtgagttatcgcctgcgctcaagtggaggttcagccgcacagctgcaaaggcttcaccgtgctcctgtaagtaaccccaggggacagtgcttcgcccaggtaggtggattcagtaagattgtctgcctgtggtggatcctgtctcaagtcagacagaggctggtagtgagcggcggctgttagggttaagaggactaaagatagcgtgagataattttggctgtcggcctatggcattttaattctccacaatcatgaagttctagcctctcaatctgtctgctggatctggaacacagatgccactcagaagggcgtcctctatcagcagaaggtgcgtgtgtgatagagcgggagctggctgcctcactatgggctgtgcagaactcatggcaatggggcaggaaaatatctcacatctgtgagtgcctctaaccatggctgcctgggctgcttgttatctctgccagctctgttggtaccagggcacacaggactccgctggttctggcggggatgctatggagtgtcttgcttgctttcatttccatgactctcccttccagctgcccagtccttgttctgtgttgccagaggctggctgaatagacagagggtgctggtgggagggggggtggcaccctgagggccaagaggatggaggtttattgtgacgcaccacaccctcagagccccagccactcactggaccacacagccaggaagggggaagca

SEQ ID NO: 2147 - DNA, 1000 bp, mus musculus
tgtgtatgtgcatgtgtgtgtgtgtccatggatattcctgttcctgcttgtgattatatattggtgtatgtgtgtgcctttgtaagaggtatgtgtgcgtatatacaggaatgcaggcatgcccaggtgcatctgtatgggcatagatgtccatgtgtgtgtacttgtgtgcctaggctctgggtacaaatgtgtgtacctcagggagggcttgggtgtatagaaaggaagcattgtgtattagcataagtgttattttctggcacatctaattattttcacggtttattcaggcaagcaaccacccagtcatcctcccagaggtctcttacagagaggtcctcttcgaagagagcttccagtcagagctctgctggggcgatgacctgcaggctctgtgcaaagcgggtgagcgcatcagaagaggaggaagttgaaaatgaaaacaggtaacttctttgtgtcccctgtcagccactgtccatagaacctgtgtgtgtgtgtgtgtgtgtgtgtgtgtgtgtgtgtgtgtgtgtgcgcgtgagcgcgtgctgctatctggggaggttcagccaagagaagcagggcttgctgataaccagagttgaatgctcctgctctcccatctttaccatttgatgtcagtcccaacacacaaagaatttagactgaatctccattgttctactgaccagggctacgatgttgctttttgcttaccctctgcacttagatccctgcctttctctgagctccagcatcaggtgcctcagactccacagttgagtttccatcatggccggttgtcccttggaacaaggtcatctcccgaggaggcagccagtgtttaaacagctgtctctgtggacaccaagggctgcgaagggttccataaatcatcgtatcttagatttcaatggggtttgactcacgaaggtgcactgtcataggaaagagaagggccagccaaaatgtcagtcttaaagttacaaaatccagg

SEQ ID NO: 2148 - DNA, 1000 bp, mus musculus
ttgcattttcctacattggggcatggacccttcacaggaccaaagccctcttctctcattgatgcccgacaaggccatcctctggtacatatgcggctggagccacgtgtactccttggttggtggtttagaccctgggagctcaggtttgttgatgttgttgtttttcctggtgttgttcttacacacacacacacacacacacacacacacacacacacacacacacgagactggatcatggaggtaggtggctgtatgaaccactatgaatacccggaatagccttcaggcacagagtctccagcttaaagttatcaccaacattaatccctgttcgattctagacttatagtgagatagaagttttaaagacagcttctgaaatttttctttttttaaaaaaaggtatcattcacttttaaaaatctccttcaaggcatgaaaaatatttaaataaaaataatgtatatttcaatcactaagatgcttttccatatttatggcctttcaatacctggtgggataacagaatgagagctagatggagacagagttagagctacagggttttctaactcagagttcttttaaacctgtttccttggagatcagtggcctcttgggctctgaagaccttgtggagcagaagtgcgcatgcccagtacaggggctgcttggagtgagtgtccctcattggcactgaaaacgtgctgatttcgattcctccctttgcattcatctgcttccatcaaaggcggcaccatccgcaggtgctttccacgccaaagatgcaaagcaaatcactgtttttgacaaaattttgatgcacaatttctcagggcccagagaaaacctagactaaccctaggtggcatttatttctgaagtcatttcttaaagagtagggtaatttttgtgaagtaagtgaaacatttatcactaagtcataatgataaaatataaaatatgtgcataaaatgaagcaggtttaatcctg

SEQ ID NO: 2149 - DNA, 1000 bp, mus musculus
tattagagattacttgtattgtagacagtgagacatgattttaggattatccacccacatggctatgatgagcaagacaactagaactctcagaatgcacctgggtttgttcagcaaggagctcccattgctggactgcctcgtgttgatagatggtggagcttctctcactaaatctctctgctacatcccagttctggaagatttcgctgctgttagtttgtcttttcactgaactttattttaacatcctttagatgagttctgtacatgttttcttttcctatgttttgaaattggatgctcaaataagtgtaccatgcatatcatttttgttggtagtatgattgacacatatttcctcctactttgaagtttgtatattctttctctcactggctcactcatggaatttttttttaattcgaaaagatctactttttcttattttccttccatttattgactttggacacttatagttctcctgggcttaggtcttgatttttctgtggatttattgttgtaattttattcccaaataaataaataaaattattgttgtaattttaacccaaaatgtttatcattttggactagtttgtctgtaagtttgtcgatagtgattttttagctaggcgacaggttactacaccttcctaggctttttgtactgattagccaactgtcattgttctatgtccttcctgagtaattatataggatcccaatcccctatttttttctagacacaacctttccttaaattttggtctagctaattgcactgtgacttttgtccctagtgaacctgggctgagtcatgaacttgaagtcaatcaatctgttatactaatgaatgatgctcctccaggcccttcatctgctggggtgtatgttggaagctgtactatttcttcttttgtgaaaaatagagaatattccaacaaagagctcattttcagcagtaaaataggtgaagaaaaaaggaatagtcacc

SEQ ID NO: 2150 - DNA, 1000 bp, mus musculus
tgatctgctcaatccccttgtccgcaggacttggcattggctcatatttggagatggtgttgtgagatgttaagtgaaacttaaacagaagagatgctctgatcatgtgtgaatgtgccttatcaaggaaatgaacagaaaaacagacacataaaaaaacagcaggtgggtgtaaagccacaagctaactaatggtctgcaagccaagggatagctcagagcatcagtaaccacaggagccagggctgggaggcaccaggaaatactccttctcacaacttccagaaggacccacccccaccaaagccttggtcttagacatccaagttacagtcttggaagaaagaattctcacatatgagccagttttctgggttaagggaccctgggaaggtaacggagtctgtttgctgtctttctggaggactgggtcacaggctcaccttcacagcgagggacagtagagctccagaccacatttccatcttgcaagatgcacgtgatggactcagaaccctgagtcttcacaaagccatcatcacagtggaaggacactgaacttcccagcagaaacctgtctccaaaacgccgtccattcacaggaatcccagggtcgtggcactcgttctgaccaaatgctatatcatgaaaaagaaatgtcagtaaagtaaagatgcttgaatactaatttcatgtcctgaacaggcaggaaacatcatatttataaaacaatatttacccaatatccatggataaattcaacaaatcaattagatattagtaaaagagagtaggagggggaagatgtcatagcacaatgacaaacgaggcttttgtctatcttctccacagcatgttgctgggggaactcactttcactgtgttccacgaagaggggaagagcacaacaaggtggtaagcagagagatcagaaaggctctgacctgcgtgagccctgcttgtagcctaaccttgtgatctggggaagaaatcttatgat

SEQ ID NO: 2151 - DNA, 1000 bp, mus musculus
aagcaactttaaaatactgaaatcatttaaataattaaaacaatagtaagtccaactaactatcaacaagtagcccagagatgtgaaggtggaatcaagccatcttatatctgttcttttaattttccattttagaactatacctgtggatacagtgaaggcagctctgccacaagcatgactgtgcttcaaacttctctctgtcatacactcaattcctgccccctaattgctcagacctgtcacccatcatgctagagttcccactaactctgtttaagatatgtctcataggtggttctggagttgtgtgcacctcttcacaaggggcaagaacgaatcatggtcctgctgtcaaaatagagcaggaccattttgtaaaaagagagaaacagcctaaaagcatccgctcaaactgcatcatttctagatgagacccaaggcccagggttcctcctatgctcttcctgggaagattcgagtgtaatatgagaaaaggaaaacaattcaagcgttcataccttctctaacttcaaatgccaatacagaaacatctcagacactggaacaggttacaacaaagggtcaagagaaaaagaaaataccatactcaagctgtccactaactgtccactgacaccacttggcagattctctttctcctgaaaagatcatgcaaagactacgaagagctcacatgattacccaaactcaccatatggatggtgcttctgtcccgctgatctctaagaagtcgtatccttcctccagctggaagtcagtaaaaacaagagcaatggtgtccccaggctcagccaagatggtccacgtgcagtcggcattattgtcatactcagaggggaagtgagggctggatatggaaccgctggttccccttagggttcccccgcaggctccctcagctgcaggggcagaaatgaaaaggcaactcaatcctcagaagcctgtcatacataaacatggtcacgcccctattgac

SEQ ID NO: 2152 - DNA, 1000 bp, mus musculus
ccaaagtccattttctatacattgaaagtcctaaatttcaaatttctcctgacttagaatctaagattgcaaaagctgaaatgtaattaagaaataaagtactgcagactgtgtggtctgcatggtcactgctgatgaatgatgtgagcttgcaacatggagtgaggatcaaaccccaggacatgggctccactgcagtcattaatcaatacattggctctgtctgctgccctgcctgtaataatagatggtacagagcacagtccagcctccaggtggaagattgaatgcaacagaaatttactcctggaccaaaaatagggacatctaaacataataccaagttacaataagaaagcccaggctctgcacccctgcacacacccccccccccacacacacacgtacctagctaggataagagaggaaggaagatgactgagggacacctgtggaaagatgaggggaagggaagcatccatttattgaccaacactttggttcctacagtgttctgcttcacccaagtatagtagagggttctatatggatcaacttaattttctctgctttgtccagaaaaaaaagagagaataaggggttggtggaggggaaagaaaaaacaaaaaaaaattggtaagataagagcagacatgactctaagaggtggagagtaaagctgacagaggggtaagagtatacacacagaaggaggttacctggagaaggaagggcagcctttgtctttttttttttttaattcatgttcagcaaaagaacaatgtgaagtataacactgcaaaccagtctcctttccctacatggaagatccatggacgatgcagatgtgtgttcagatgctttgcaaaccctgcaacagaggcaggtggcaatcttcaggatctagtgaaaatttcaagccacctctccagcctctgctgtggtactttgagcagggctgtggggctatttgtgactctctagggcttgaggaaagcac

SEQ ID NO: 2153 - DNA, 1600 bp, mus musculus
ttggtataattagatatttgaagaaatggatagtgtccaggatcatagcttcttttcaaactcacttcccgtggctgccctgacagtaagcagcaaaggacctcatgccattaggatctccttgcagaaggaaactgggacagagaaaaggggtttttcggccttggatatgacaaccaattagtcacattctcattagaatacagagtctaggtcactagactctgaatggggtaatcgacatctctgaaatgttcccaatggtggtggcagataaaatacaggatactaagtaaacttaagacttagatactaagagatagataccattttaaaatttgatttttatgtgtgttaaaaagagagaagatatggagacggagggagagctttgtgctaagggacaactatgtgcagtcagttacctacttagatctttacaagtattctggaagtcaaatctttgggtttgcttggcaagcatctttaatctacggagccatactgtcgatacaatacgcaggctttcaggtacgtaatcgttaaattcagttatcagttataaacttgatgatatctagaatcacaggaagaaaacactatgagcatgtctgtaagaaaatatcttgattaggtagaaggccccactcactgggggtggaggggcaccactcactggactgagacccagggctgcataaaaaaaagagagagaattagctgaggatctgcaaattagccaaggataggtatttgttgttgctttctttctggctgtgggtgtgatgccagctgctgctccaatctcctgccactttgacttccacaccaggatggacaggaccttcaaaccttgagctaaaacaaactctttcattttcagttgcttttgtcagaatatttgaacacactgtggtggttagaataggaatggcctccataggctcatacttgttaatggagtggaattgtttgaaaaggttagatggattaggaggtggagccttgttaaagtgtcactagtggtggggtttgaggtttcaaaagtccaagttaggctcaatggctatctcttcctgctgtctgagggtccagatgttgacgtctcagctctactatgactgcctgtgtgctgccatgcttcttagtatgacaataacagactaaaactttgaaagctgtaagccagctccaattaaatgctttcctttataagaattgctgtggtcatggtgtctcctcacagcaatagaacactaagacacacacttagacacgtaactaaaacaatgtgtacccaaaaagcaactcagccttggtatatttgaaagtcttgggtcaatggatcaggaaacaaaaaatgatagatgcaccataacctagcaattgttaatgcagaggctacatgaagtaaaatagaaaacaaaaaattatcagttgatcaattatatcctaatattcctttattttcaatccgtaattgatgacaagaaatctacagatctttaggtgaagcctatcatccatggctttctagatttatattctatctctagtttatggatggttatctttgaacacattatatagctttcttaaa

SEQ ID NO: 2154 - DNA, 1000 bp, mus musculus
atcatggcaaggattcaaaaagcacctgaaggcaggatcactcgctgctccacccagcatcacctttgaccaaggaacttacctcacaccaagaagtctggcagaaaccatggtgcatgctgcttcctcaatgacttgaaggcatatgctcagctagctttctcccacagttcagagtgacctgcctcgagaatggtaccacccacagtaagccgtacccttctacaaaaattaccaaccaagacaatgcttcacagagatgcccacagaacaaaatgatctgaacaatcccgcaagtgagactctcttcccagataattctaggttgtgtgagagttaaaagctaaccaggacaggctgtagtcataaaatcgtgatttataagatttcataccattggaatctaattttatatatacgaggaccctataaaatggtgccattatgtcagcccctgctccacctctaaggtgaacccagggtgtcttggggactttgtactgccagttatccaatgggcttgccagactagactgcaacacaattcttgcttctcagattcctcgtgccttctcctccatccatttcctaccgccaccctttgagcatactttctaatcttaattttcctttaatcctacatgcacacatacaatgattgaagtagagaaagattccctcctttataaacagaaccaaagtttgcagtttgtcccacaaccttatttttttttctttttccaatttttattaggtattttcttcatttacatttcaaatgctatcccaaaagttccctataccctccctcccccccccgctcccctacccacccactcccacttcttggccctggtgttcccctgtaatggggcatataaagtttacaagaccaaggggcctctcttcccaatgatggccaactagaccatcttctgctacatatgcagctagagacacaagctctggagggtcctggttagttcatattgttgttcca

SEQ ID NO: 2155 - DNA, 1000 bp, mus musculus
tagtctgggctgatatcctaatcaggccttggacacaaactccatagccagtcccaaaacacccagatgaagctctactcccaggtgctctaacatgtccagaatcacagcatcatttgatgccaggagcttggtcaaaccaggatctcagggtcccagaggcaccttgactcccagcaactctgacacacccaggatctcagaatcacaggatcccagaatcacagcatcacagagacagcttgattctgaggagtttggacacaaccaggatcacagggaggacaggctccagtcagctatagcgaaggcaggtagcactagagataaccagatggctggaggcaagtgtaagaatataagcctcagaaaccatggttacttggcatcatcagaacccaattctcctaccagagcaagttgaggagacaccatctcactggaaaagcaagattcagatttaaaatcactcctcatgatgatgatatagggctctaagaaggacataaatgggccatcatgggcacgaactctgtcaccagttcccagaggactctccatgctgcacgtaccctagcacacccaggatcttaggatcactgaggagagttggcctccagagagtgctctgaccctgggactcaggtgagagtgccatcttgtatcctgggtctctcagagaccagtctccgtaggagagcacacgggccacagaagcaacagagcttttgggacagggtcccttcgggccttcatcttcagccaggaggtggatcagaactccagacctctgtgcaccttttctacaagaggagagcttgcctgcagagagtgctctgaccactggcactcaggagagttgaatttctaggactgctgacagaggctaacagaatcacaggaggaacaagctccagccagagatagctagaacatctaacatcagagattaccagatggcaaaaaggcaaacataagaatcttactaacagaaaccaag

SEQ ID NO: 2156 - DNA, 1000 bp, mus musculus
ctggtgtcctcagttaagccagacttctctctgttgtttcctgtggcctcactttaagatcttctcctgctgcagacttcactgtgctttttccacatagtgctctggacttgccgcaagcagcactttgtgcatcattaaactgatgcttttctgggcagtagagattactcggtggtcaagaacatttgctgatcttgcagaggacctgagctgggttcccttcactcatgtccagccgctcataaccatatagagctccatcttcagtggatctgatggcttctggccttgtgaacatctgaactcatgtacacaacaacagcaacaatgataagaacaacaacctcccctcataagtcacacacagacacacacacacccttacatacacagacacacgcatacaccactacacacttacagagagagagagacagagagagagagagagagatgtcagtgtgaatctataaatatatttcatgtgaggaatgaggttggtgtatgacagcaaggcatcttttgcctttattccttcatactgcattttacacattccaatacatctgtaaacaacaaatactaaggtcttcaactccctatttcttgagaagagacaggagtaatcctatggagaagttgtatttgcatgatagcagacacctttatatctgcagcatgtccaaatattatcttggtgtaagaccaaagacttgaaaaagctaagtcagactaccaagagaaaagggatttgctatgtgaataagaagtctaccagagccaggcggtggtgtgcacacctttaatcctagcactcgggaggcagaggcaggcggatttctgagttcgaggacagccagggctacacagagaaaccctgtctcgaaaaaaaaaaaaaagtctaccagccctcttgtgcccaagactactaaagccaaatggctaagtaactctacttcctttttctctgagtgcttccctgcccgttttttgtttt

SEQ ID NO: 2157 - DNA, 1200 bp, mus musculus
cgattttaaaccctttgagaaatttgctgggattcaatgaaatctgaagtcttacagctcccaaataaaaagtaaaataaaagtagatgtctttttctttcaggcgtgtaccagatgtctgtttcagaagcagctgtccctgggggaggaagtaggaagggtgaaggctgaagacccagacattggagaaaatggcttagtcacatacaatatcattgatggagccggcatagaactgtttgaaatcaaaacagactatgaaacactatgttgctgctgctgctgctgctgccgccgcctagagctcctcatttagccccctgagacaagcctgtggttagttgttgttagccttgctacacagacaggaaaccatagctaggaattagacactgcctgagttttgagagcttgctgttagcacaataccaattccgaaacaggccttcctcactctcagggaagcttcttacccgccaggctttcctgcccttaggccttgtgtcagtggaactcttccgggtcacagtaattctctgttaataaaagtttcccaccgtgtgggcactcaatgttagggcaggaaggggatgcctttggtttcatcagtgttggtgtgaaagacccacaacgtgaggactcccccacgttctgactcaagagaggcgacaccccaaaatcaaccacaagaaacggtcttgctgcaaattgcaagaggatttttttattcaagagcgctctcgggcccatggtcatacaccaagcaggggtagaggaccatggcgccccaagtagctggattagggggtatttaaaggaagaaaccacgacttaaggatgtgggaagggcattgttggaaaataccaaaaataccagttaagagtcacaaggtagtacaaagtcacaggcgtcactaggaatacctggtaattgttaactctcaagacagtttctaagagcccctaacgatagtacatttgcattgcaggttccagcaatgatcagggtgggtcagggtgactttctttgaatgtacactccttgaacccaggaagcttgtgggtggaggaatgtctctatctgttttatgattagcataccttggagcactgagtttactactctttcaggtgctgggcataaaggcatgggagctccaccttctggggtctgcccatgcttttccagttcctgcattc

SEQ ID NO: 2158 - DNA, 1000 bp, mus musculus
gaaagcctgggttgactagcaacattggcaaatcctgaaggcctaccaggctttggcgccagggtcccaggaagtgagtgactcttgccttgggctgcagtagaattgttgggggtggggtggggttggctcttccccccagcactaggaagggggtgcatatctagaaattctgatctacttagcatgggatggctggacctcactggctttaaaggtccctgcttgtgtgcgtgcttgtgtgcttgagtgagtgcgtcctagtgtgcaccctgaactagatccctgctggggaggactggcctccaaggtcattcccctggtggagaacatctctgaatgaagaatggcaccgaggaggaaggagggggcaatagtcctaaatgctgacattccttcccccatattactattccttaatttaatacaaaaccccgtgagattccacaggagttcatttgggagaagaaaaagaattttgatgtcgccatctagcggccagtggtgagacagacgtttctgagaactgagtctaatttacaaaaggcttcctttgtgaaggagtttaaagactggtgattgggatgataatcccagatgcttgcttagcatgcagaaagccgtaggtttgatccccagcacttcttaaaacctggccatggtggtgctcgctggaaactgcatcactggggagataagaggcagggggatctgacgttcacggctgtctttggtcacacagttcaacacgtgagccacctgcctcagaacaactaaacggaactggagataagggtcccaggctgcacagaaaatgatggacactcaccaggaaggacagctcttcctaccctcagggctaactgacattcctttgacaaacagctggaggaaggggctggctttcaggtgtctggggaggtgtatggattattccaggtgtttagtgcctcaaggagctggggccagacaagagttcagaaaggatttcaggactggg

SEQ ID NO: 2159 - DNA, 1000 bp, mus musculus
ttgacctcaggaaggaggtgacttgtgatgtgagctcctgctgagacctatgttgcatcactgtcacatgagaagggggctccagaaggacttgccaccaaaagcatgctgaagcctgccatcaaatattgataaaggcagaggggagaggactatgtaactgaattatcaatgaccagacctggctctcaggccctgcagtcagggatgggcctacatggtgggcttgctgttattgttgttttttttttcatgagactccttatttgatttactgacttgagttaatttttttattgcttaattgttttatttacatttcacatgttatcccccttcctggttccttccctgcacaccccccccccctcactccctgcaaccctgatgctcacagccaactattgaactgaacccaggtcctaagtgaggagttagagaaaggaccgaaggctgttgtttttaaacagggacactcgggttcattttactttgaaacaatttgtggagcatgtttgttagattgggctcatgaggcaaacaccacacaggcattcaaggtcagagccactagcttgccacatgggtgacctgccttcccaggaggcaagggtgagacctgaaccacatgctcctaaggcagcccaggctgggcctatagactgcaagccctagaggcaatgaggaatggggatgggaagcaggtatgtgagacaagaaacttcgggaggttttttaccttttcagcttactgagacctttgagaatgttctgagctttcagcagcattgtgttgtgttacttagggctcttacatgtatccttttatcctacatgcagcctgtggccaccctgttaggagacagtttcctgagtccagtcatctcagaaactccttggaataccttgctgacaggctcaaaactgagtttatgttcctaggctccagaagctaactccgtcctgttctgctacttcaagtgttccaggtttgtctgat

SEQ ID NO: 2160 - DNA, 1000 bp, mus musculus
taacagttctctattgcatgctaagagaatacccaatagaagtctttatgaagaggtacagccagacaggggtgacaatgacacaggcatgtttcaaagaggctaactagcttggggcaaaggaaatgttctcatgtcaatgagaaattcatacttttctccatttcatttgcattgtaaacgggtaacaaccaaacactctctctctctctctctctctctctctctccctttattttaaaactagaatataaatgcataatatatatacatatatacacattcatatacacatatatatgtataaaaatatacacatatacatggactcatacatgcatatatacataaaatatagcaaccaggtgactcagtgggttagtgcacttgccttggaaccctaataagctgaatttcatcctgaaaaaaggaaaaagcctgtaatctctgcacccctaaatccagattggaggctaagagagtagaacagccctgaaagacaagctagacagattagaccatagagagcagcagaaatggtcagagcctctttctaactctgtggaagaagatatccagctcctgaaatttctctccagtctacacacacacacacacacacacacacacacacacacatacagaaacacaaaagagagagagagagacagagagacagagagagggaggggagaaatacacacacaagcataacataagcagagtaatgtaaccacatgtgcacaaacccctaagataaagattattttgaatcatgaatttaagtatactggtaaataaatgctgttaatatacacctgttgagtgactaacaattcagggaaacctcttcagggtcctctcctttatcttcagtgttatcttcatggaagtggcagatgtcctgcaaatttaattttgcatcatatggtcctttattcttctttaataactgtcccaagcatatttacacaatgaggaagggaataatgagtccggt

SEQ ID NO: 2161 - DNA, 1000 bp, mus musculus
taaagtggaacgttcatttctctggtagctgaatgtagaggcagcagcatttacggacatgaagatgtgtgtctgcctctcgtgtctttagtttccctgcagctctctctgcttcccaccttttatcaggcagcaatgcaaatccacccagtttcctctctccaatcacttgcaattactactttctccatggctgtgagacgcctgatctccagcaagaaagacgccacaacaggatctttctgcacacgtttattgggagagcttgattgcgaaggcgaaagaccctaagcccaaaactggtgctgcttatataggcctaggagaggtgtgtctacacctgattggttatgctttcagtacctcatttacatgcctcaggccaggccatgactcagcacaaactcttatgcacatgcgcacattggttgtttacccatattcatgggcgtcagcttgttgaaaccagcgccatcttgtattggcgcttattggcttcccacacatggctaatggaagtacaaacttatacagctactttgataatcaattttggtttctcaaaaaattgtgagtagtcctgccccaaggcccagctataccacccctgcgtatataccccaaagatgccccattataccacaaggacacatgctcaactatgttcatagcaactttatttgtaatagctggaaactggaaacaaactaaatgtccttcaactgaagaatggatcaaggtaatgtggtaaatctatacagtggaatattatttagctatttaaaaacaaggacattgccaggcgtggtggcacacacctttaatcccagcacttgggaggcagaggcaggcgaatttctgagtttgaggccagcttggtctacagagtgagttccaggacagccagggctatacagagaaaccctatctcgaaccctccccaaaaaatccccccccccaaaaggggacatcatgaaatttgcagacaaatggatggaaa

SEQ ID NO: 2162 - DNA, 1000 bp, mus musculus
tttggtttttccatgtcctgatggagtgagaccctggagcatcccagtcctgaaatcctttctgaactcttgtctggccccagctccttgaggcactaaacacctggaataatccatacacctccccagacatctgaaagccaaccccttcctccagctgtttgtcaaaggaatgtcagttagccctgagggtaggaagagctgtccctcctggtgagtgtccatcattttctgtgcagcctgggacccttatctccagttccgtttagttgttctgaggcaggtggctcacgtgttgaactgtgtgaccaaagacagccgtgaacttcagatccccctgcttcttatctccccagtgatgcagtttccagcgagcaccaccatggccaggttttaagaagtgctggggatcaaacctacggctttctgcatgctaagcaagcatctgggattatcatcccaatcaccagtctttaaactccttcacaaaggaagccttttgtaaattagactcagttctcagaaacgtctgtctcaccactggccgctagatggcgacgtcaaaattctttttcttctcccaaatgaactcctgtggaatctcacggggttttgtattaaataaaggaatagtaagatgggggaaggaatgtcaacatttaggactattgccccctccttcctcctcagtgccattcttcattcagagatgtttctccaccaggggactgaccttggaggccagtcctccccagcagggatctagttcagggtgcacactaggacgcactcactcaagcacacaagcacgcacacaagcagggacctttaaagccagtgaggtccagccatcccatgctaagtagatcagaatttctagatatgcacccccttccctagtgctgggggaaagagccaaccccaccccacccccaacaattctactgcagcccaaggcaagagtcactcacttcctgggaccctggcgccaaagcctggt

SEQ ID NO: 2163 - DNA, 1200 bp, mus musculus
tcagtgctccaaggtatgctaatcataaaacagatagagacattcctccacccacaagcttcctgggttcaaggagtgtacattcaaagaaagtcaccctgacccaccctgaccattgctggaacctgcaatgcaaatatactatccttaggggctcttagaaactgtcttgagagttaacaattaccaggtattcctagtgacgcctgtgactttgtactaccttgtgactcttaactggtatttttggtattttccaacaacgcccttcccacatccttaagtcgtggtttcttcctttaaataccccctaatccagctactcggggcgccatggtcctctacccctgcttggtgtatgaccatgggcccgagagcgctcttgaataaaaatcctcttgcaatttgcagcaagaccgtttcttgtgggtgattttggggtgtcgcctctcctgagtcagaacgtgggggagtcctcacgttgtgggtctttcacaccaccactgatgaaaccaaaggcatccccttcctgccctaacgttgaatgcccacacggtgggaaacttttattaacagagaattactgtgacccggaagagttccactgacacaaggcctaagggcaggaaagcctggcaggtaagaagcttccctgagagtgaggaaggcctgtttcggaattggtattgtgctaacagcaagctctcaaacctcaggcagtgtctaattcctagctatggtttcctgtctgtgtagcaaggctaacaacaactaaccacaggcttgtctcagggggctaaatgaggagctctaggaggcggcggcagcagcagcagcagcagcagcagcagcagcagcagcagcaacatagtgtttcatagtctgttgtgatttcaaacagttctatgccggctccatcaatgatattgtatgtgactaagccattttctccaatgtctgggtcttcagccttcacccttcctacctcctcccccagggacagctgcttctgaaacagacatctggtacacgcctgaaagaaaaagacatctacttttattttactttttatttggcagctgtaagacttcagatttcattgaatcccagcaaatttctcaaagggtttaaaattgaactttttattggtagacgcagaagtgaagtggatggatgggaagaggatcccagatggccagc

SEQ ID NO: 2164 - DNA, 1200 bp, mus musculus
tttggtctatgaatgaggaggagaagactggatgcgtatacacataatatgattctctttttaatgacagtagatcattcttgttctctttttctgtttcattgttttagttttacttatcttgctttcgcctattcattagtttgcctactgttgttctgtcttgtttttttttgtttgtttgttcatttgtttgtttgttttgttttgacctggtcatgtccttctgcactgataatgagcacatatagacacatcaacatcaaatataagcagccttaccctgcccaccagcacagggttgggcccagtgtactcgtctatcacaaagaactgattccagacccaacctctcttggagcgttgcagcatctgcccctccttgcccttctcatggtgtccatggaaagagggatgcaggtggcttcattgctccagggcaaacataccaggcataccagggcagcttgtaaacagtagttctccttcatttttggttatgcagtaggcacaggagaatgcagctgtcacttcctacaccaacagagtggctttcttttggatggcggcctcccagatgtgacctcctctggaatggagtatcttcactcactgaggacatcacaccagggttgttcacctctgcagtcagcttctgcaagcagagaaagagatgagattagctgcagcctccatccacctattgtttcgttttcatttagcaaacatgtggtttgagtatcagtttaccacttgtcagctttgggaaagctgacagctttctctgaacccagcttgctcatttcagaaatgtagataagaataatattcgttgaaaggttgctgcaatgatcaagagaaatgggaatataaagccactaatacaatgtctagaacccagaaactctattattcattgatcatatgtgtgcatccacagcaaggatgccagaggccagcacagcaaagagaggatgcttaaaggatatggtgactgaattgaatactaaagcaaaagcttctattttaagaatggagaagataggataccatggaaaaaaaaaaacaccagaattccataaccattacagttggccaaccacagcataaaccaagacttaagcacaaatggaaaataagaggaatcttatgtcatagtctgtgagatggaaggaaagacaaggcagacctcaggaaatg

SEQ ID NO: 2165 - DNA, 1000 bp, mus musculus
gaatgttaaaccctctccctaagtgtggcccagtattaaaacccaggagaagtcatctctctctgtctgaacctcccatgcactgggtaacaggtgtgtcatgttataaacacacacacacatacacacacacactttttatatactctgtgtgtgtctctgtgtgtgtgtgtgtgtgtgcgcgtgtatgtgtgttcatactaaagcattttcagacaatgtgtaaatcagggtcagcgagatggctaagtagataaaggtacttgtcaccatgacaaacatcttgaacttgatacctgagactgaaatagtggaaggagaagactgactcctattagttatcatttgatacccacaattcaccttccttgaattgccttcctctacttcccatatcaattatgaacagggtgtccttgaactgacaaagacaatcctgcctgatttgtgggttcatgaattaaaggtgtgcccagcataccgagtctctattgtgcacaccctgcctattagtcctttggacttcaataggtaaaatgtgaaggctaaggcctgggtcccggaagttaacaattatcctaagactgactacttacttccccttatgattcttttaatcgttttcatatcaaacatattcactgtaggagctagaaaagggggttgaggagtttttaacatgttttgttcttgcatagcacctgggtttgatttgtaatacataaccgtttgctcacaaaattctggaacaccaagtccatgagatgaaataacctcttctgatgtctgtgggacacacacacacatgggacacagaaagaatacacatgcaaagcattcacacacttaaagtcagtcgatctaagaagagaaacacaagtattggttgcttccatgttgactgtacctaattccaggagcctgtattatttactttttgtcattttatgaattcttctcactgtgttacaaacatgcccatttttttggtttctttctt

SEQ ID NO: 2166 - DNA, 1400 bp, mus musculus
ttgtgacctgatatgctttgacaccatttatgaaaagcttttaagatgaatattgatttgtaagcaacaaatatactagaactcttcctttcttcattcttgtatttttaaaataaaaaaagaaaattttatctaaagttactatttataattaattgtgcaaaatacccacaatcctgagccctatcagacacaaaaagtgtcatcttagcctgaagtgttattccacagtgaattgtgttgccattgctgctttctgtctctgccctagggatgctgacacaactctaagtgagcgaactcatcttggacagaagtgaagggacttctccaagtattgacttgaacttccttcactgaggggaaatatccattcctacaacagggaagctcagtctatggctatgcaacatagccaaatacaggagacccaaagccctttgcaaaggatttccagctgcaagtgtgataaagctctagagagatcagtgtgttactctactctagatcttctgaggaagatcctaaaggccctcagttctagcactggtccctagctcatgtgcaatgcaaagaagctcagcatcaacttccattgcttcccatggcatgagctgctggaaagaccccttagtagctatgcaaactgaagtattactccagagagaagcatggaagacacaatgaagcagtaattccaagggactaatgcctcgcatgaaacgtttttttatttatttctgcatataaaccattgagtgactcaggtttcactatatggaaaaagcctgctcagcaaacaagctaacaaataaacaattcttgtttacttcctttgcaatatgtaaaactccacagtaccctgctggacattgcccatggccagagcacagcctttgtcccaaacaagaaatgggctgagaaagtgaacctctggaggaccttatgctacacatgtatggggcctctgtcaatccttatcaccagaagaaaactctaatgctaaaataacttaaaagaaactcacccacattacactaatagtatttcatcctatgcttatgtgaagagagccatttagattcctctacactattctctggctggtgttttccaaaggcaaagtaggtgcgagagatgctgtggtgacagttgctgaaagcataaactgtgtggtatttctcccactgtgagaatcatattcagactgaaccaatgggcccttccatgctatgcactacaggatgataggattttctcaaccttcctcctactgtggcagttttttctgcaaattatgtcttgtagcatgtaaaccaagtatcactatatatttggtaactaatagaactacagggaaaatgtgctgtcagagtagcccatatggaggctgttgcata

SEQ ID NO: 2167 - DNA, 1400 bp, mus musculus
tcagggaaccttggagatggaaaacctaagaaggacaacagagacagaagcacagccaacagagcaaaaataatggaagagatgatctcaggcatagatgatataacaaaagaaaatgttaaacctaaaacaatttctgactcaaagtattcaggtaatctgtgacactctaaaaaaatctttttatgaataatgggaataaacaacaagtcaagagactaccagctcgaaggacaaggaaatattttcaacaaaatcataaaagaaaattcacccaaactaaagaaagaatgcctaataacgtagaaaaagcttacaaaacaccaacttcattggtgttctcaacacataatcatcttccctccacatacatcaaaataacaggaattaacaatcattggttattggtagctctcaacaccagtaaagtcattttccacaataaaaagatataagctgacagactggatatgaagtcagcatctatcattctgcttcatgcaagaaacataccttggcaaacatacagagatattacctaagaatgaaggactgtaaaaagttttcctaagaaaaggtactcaggatgaaagctaaggagcaattgtaatatctaaataaaagagactttcaaccaaaatgaatcaaaagagatagggaaggatatttcacactcatcaaagaaaaacacaccaagatgacttctcaattctgaatccccacatttacaacttaaatcctacttttaaaggtgctaatggggtttgagggccacaaagctagcagtgcacaagcagtagaacagatgagacagtgttctttctgcctccatctgcacccaggagctggggctgttccacagccctctgtgcatgggccctgccagggtgagctggtctcccagaagtgctgacacagacttacaggcccacaggagggacaagctcaacccagagacagcaagaccaactaacaccccagataaccagatggcaaaaggcaagcccaagtacctaaccaacagaaaaaaagctacatggcatcatcaggatccagttctcacacaagagcaagtcctggataccccaacataccggaaaagcaagatttggattgaaaatcacatctcaggatgctgttagaggactttcaggaggaaataaataagtcccttaaagaaatacaagagaacatcggaaaacaggtaaaagaacttaaagaaaaaacacaaaattcccttaaatcattacatggaaacaaacaaacaggcaaaggaattgaacaaaaccacccaggatccaaaaatagaagtagaaacaaaaaaagataccacaaagggagacagctctggagatagaaaacctaggaaagaggtcaggagttatagatgcaagcatcac

SEQ ID NO: 2168 - DNA, 1000 bp, mus musculus
gagttagcttctggagcctaggaacataaactcagttttgagcctgtcagcaaggtattccaaggagtttctgagatgactggactcaggaaactgtctcctaacagggtggccacaggctgcatgtaggataaaaggatacatgtaagagccctaagtaacacaacacaatgctgctgaaagctcagaacattctcaaaggtctcagtaagctgaaaaggtaagaaacctcccgaagtttcttgtctcacatacctgcttcccatccccattcctcattgcctctagggcttgcagtctataggcccagcctgggctgccttaggagcatgtggttcaggtctcaccctcgcctcctgggaaggcaggtcacccatgtggcaagctagtggctctgaccttgaatgcctgtgtggtgtttgcctcatgagcccaatctaacaaacatgcttgacaaattgtttcaaagtaaaatgaacccgagtgtccctgtttaaaaacagccttcggtcctttctctaactcctcacttaggacctgggttcagttcaatagttggctgtgagcatcagggttgcagggagtgagggggggggggtgtgcagggaaggaaccaggaagggggataacatgtgaaatgtaaataaaacaattaagcaataaaaaaattaactcaagtcagtaaatcaaataaggagtctcatgaaaaaaaaacaacaataacagcaagcccaccatgtaggcccatccctgactgcagggcctgagagccaggtctggtcattgataattcagttacatagtcctctcccctctgcctttatcaatatttgatggcaggcttcagcatgcttttggtggcaagtccttctggagcccccttctcatgtgacagtgatgcaacataggtctcagcaggagctcacatcacaagtcacctccttcctgaggtcaaggtggcccatgattggctgggcagctgtggctggagccaaggcat

SEQ ID NO: 2169 - DNA, 1400 bp, mus musculus
tgcaggaactggaaaagcatgggcagaccccagaaggtggagctcccatgcctttatgcccagcacctgaaagagtagtaaactcagtgctccaaggtatgctaatcataaaacagatagagacattcctccacccacaagcttcctgggttcaaggagtgtacattcaaagaaagtcaccctgacccaccctgaccattgctggaacctgcaatgcaaatgtactatccttaggggctcttagaaactgtcttgagagttaacaattaccaggtattcctagtgacacctgtgactttgtacttccttgtgactcttaactggtatttttggtattttccaacaacgcccttcccacatccttaagtcgtggtttcttcctttaaataccccctaatccagctactcggggcgccatggtcctctacccctgcttggtgtatgaccatgggcccgagagcgctcttgaataaaaatcctcttgcaattttcagcaagaccgtttcttgtgggtgattttggggtgtcgcctctcttgagtcagaacgtgggggagtcctcacgttgtgggtctttcacaccaccactgatgaaaccaaaggcatccccttcctgccctaacgttgaatgcccacacggtgggaaacttttattaacagagaattactgtgacccggaagagttccactgacacaaggcctaagggcaggaaagcctggcgggtaagaagcttccctgagagtgaggaaggcctgtttcggaattggtattgtgctaacagcaagctctcaaacctcaggcagtgtctaattcctagctatggtttcgtgtctgtgtagcaaggctaacaacaactaaccacaggcttgtctcagggggctaaatgaggagctctaggcagcggcggcagcagcagcagcagcagcagcagcagcagcagcagcagcagcagcagcaacatagtgtttcatagtctgttgtgatttcaaacagttctatgccggctccatcaatgatattgtatgtgactaagccattttctccaatgtctgggtcttcagccttcacccttcctacttcctcccccagggacagctgcttctgaaacagacatctggtacacgcctgaaagaaaaagacatctacttttattttactttttatttggcagctgtaagacttcagatttcattgaatcccagcaaatttctcaaagggtttaaaatcgaactttttattggtagacgcagaagtgaagtggatggatgggaagaggatcccagatggccagcatgcaggagcaatgtgttccttccaggatgacaaaacaacattggggtcctggtaagatgatgaggtcacccacaacacgagagaaaggaaaacagtgacaaggtcct

SEQ ID NO: 2170 - DNA, 1400 bp, mus musculus; identical to SEQ ID NO: 2169

SEQ ID NO: 2171 - DNA, 1400 bp, mus musculus
aaaatggagtccttatcctataataagtgaacattagaagcattctcagtgtggtttggtctatgaatgaggaggagaagactggatgcgtatacacataatatgattctctttttaatgacagtagatcattcttgttctctttttctgtttcattgttttagttttacttatcttgctttcgcctattcattagtttgcctactgttgttctgtcttgtttttttgtttgtttgttcatttgtttgtttgttttgttttgacctggtcatgtccttctgcactgataatgagcacatatagacacatcaacatcaaatataagcagccttaccctgcccaccagcacagggttgggcccagtgtactcgtctatcacaaagaactgattccagacccaacctctcttggagcgttgcagcatctgcccctccttgcccttctcatggtgtccatggaaagagggatgcaggtggcttcattgctccagggcaaacataccaggcataccagggcagcttgtaaacagtagttctccttcatttttggttatgcagtaggcacaggagaatgtagctgtcacttcctacaccaacagagtggctttcttttggatggcggcctcccagatgtgacctcctctggaatggagtatcttcactcactgaggacatcacaccagggttgttcacctctgcagtcagcttctgcaagcagagaaagagatgagattagctgcagcctccatccacctattgtttcgttttcatttagcaaacatgtggtttgagtatcagtttaccacttgtcagctttgggaaagctgacagctttctctgaacccagcttgctcatttcagaaatgtagataagaataatattcgttgaaaggttgctgcaatgatcaagagaaatgggaatataaagccactaatacaatgtctagaacccagaaactctattattcattgatcatatgtgtgcatccacagcaaggatgccagaggccagcacagcaaagagaggatgcttaaaggatatggtgactgaattgaatactaaagcaaaagcttctattttaagaatggagaagataggataccatggaaaaaaaaaacaccagaattccataaccattacagttggccaaccacagcataaaccaagacttaagcacaaatggaaaataagaggaatcttatgtcatagtctgtgagatggaaggaaagacaaggcagacctcaggaaatgatgatggtaatgaaaataatcaatgaagaaatgaatgactaaggtatgtgtgtgggaggggtacaggtatggaatccagagctctgtagacaggcacagaaggatcacagaaattttaagaagtcagaggctagtttgatctaatctga

SEQ ID NO: 2172 - DNA, 1400 bp, mus musculus; identical to SEQ ID NO: 2171

SEQ ID NO: 2173 - DNA, 1400 bp, mus musculus
gacagagtgtgtccatttacaaagtaatggtcatatatgaaaattatgacttacaatgccagataactagcttcttttcaactccttataaataaaaatataagacttcgcagtcattctcaaaggcagtgatgtatcaagtatagtctcacattactcatcagtcacctgttaggttcttgacacagagcacaaatattacccaaagtgagaagagacagttccattacttgcagaagagttaatagagaatgcaggctagtactggagcccatggaactatgcagcagccattgaataacctcaattgcatgactttgaatatcatgaaaactctccaagtttcttttgaaactcagtttctagggaaaactgcttaacaaaagcctttccctgacaggatcatatgagacctctgctgttacctcctttcagcctagctaggctggcctcagaccatccaccacttaggcagagccacctgctgtgcagcttctcatcactctcctttgatgtgcaactacctgcctgaggcccaacctgcctgagattttccagagttagcaccaaactgtgatcttcactagttcctactaaaaggctgatctgacttctacaaaggaactttgcctgactgggaatgggcctcccctcttctttataaagtgtgtttgctgacattaaagttgaaccttgatcagagtagttgtcttgtttccattctttctctctcttccccaaattcccttctttcttccagattccaagatgccttcctgggtagaacctggacatgtgagccactggcctgcctcaacactctgcatccagttagccttcactctgcatacacttagctcatgttccctcatcctgcaggagaagttcaccctcttctctaggattttcaaggtggttctcatggctccaggatgcagctggctgagaaaaacctgaggtacctctagaccaggaatatctctagagaaccataacatgatcaaggaacaggtgaatggtcacacaccattgaggttagatatctagaaattagggactagatacttaaaacattctggaaatacacacacacacacacacacacacatttttttatataaatatatatgtgtttaatttcaaaccaagggtcaaatgacttgttgcatattttacataccgaagtggtactggccttcagattctcccagcattcttcagtacctccctagcttaacctgccttcaaggtttagctttcctaccctgggggtgagctgcatttctcccagaagctcttccctaaataattcagatattttgtgttgactctatctctctatctcactctctgtctcttcctcaccccattctctctttatctttacctaccaaactccc

SEQ ID NO: 2174 - DNA, 1400 bp, mus musculus
taggtaaagataaagagagaatggggtgaggaagagacagagactgagatagagtcaacacaaaatatctggattatttagggaagagcctctgggagaaatgaagctcacccccagggaatgaaagctaaattttgggggcaggttatgctagagagagactgaagaatgctgggagaatctgaaggccagtaccacttcgttatgtaaattatgcaacaattcatttgacccatggtttgaaattaaacacatatatttatataaaaaatgattgtgtgattgtgtatttccagaacgttttaagtattttgtccctaatctctagatatctaacctcaatggtgtgtgaccattcacctgcttttttatcatgttatggttctctagagatattcctggtctagaggtgcctcaggtttttctcagccagctgcatcctggagccatgagaactaactggaaaatcctagagaagagggtgaacttctcctgcaggatgagggagcatgagctaggtgtgtgcagagtgaaggctaactggatgcagagtgttgaggcaggccagctgctcacatgtccgtgttcgagcctggaaggaatcttggaatctggaagaaaagagggaatctaggcgatgagagaaagaatggaaccaagacaaatagtctgatcaaggttcaactttaatgtcagcaaacacactttataaagaagaggggaggcccattcccagtcaggcaaagttcctttgaagcagtcagatcagacttttagtaggaactagtgaagatcacagtttggtgctaactctagaaaatctcaggtaggtttggcctcaggcaggtagtggcacatcaaaggagagtgatgagaagctgcacagcaggtggctctgcctaagtggtggatggtctgaggccagcctagctaggctggaaggaagtaacagcagaggtctcatatgatcctgtcagggaaaggcttttgttaagcagttttccctagaaactgagtttcaatcaaaacttggagagttttcatcatatacgaagtcatgcaattgaggttattcaatggctgctgcatagttccatgggctccagtactagcctgcattctctattaactgttctgcatttaacagaactgtctcttctcaatttgggtaatatttgtgctctgtgtcaagagcctaacaggtgactgatgacttaatatgagactatacttgatacatagctgcctttgagaatgactgagaagtcttatatttttatttataaagagttgaagtgaagctagttatatggcattgtaagtcataattttcatatatgactattactttgtaaatgaacacactctgtccaggaaatggtagctggggttctcttgac

SEQ ID NO: 2175 - DNA, 1000 bp, mus musculus
agaccctggttctttgagaagttccctcaataaagctgtgcttgagagtcagctgagaacaatgatacacatggtatacccagaacacttgtacccacctctttcatgacagatgctctttgtaagcaatgatcacacatcacatgcatgttaattagagtgttgaattcaggttcaggaaacaccctgcctcagtattttcacacaaattcttgagaaccataaagagcaattctgattagcaaaactgattggttcagaaaataaaagtgttgcccttgcttttgtttctccttctttttctcatagctctcatataatggcagatagaatgaagcacacttctagaaaggatttgtagttggaaatcctagaaaataacaaacacttgctagttttttcatgttctagcaatcacccagcccatacagcctaccccactaaatccctccccatggacggacacctgaaaccaatttgggttgcacacgaatcctgcatacccattgtagaaaactcgataaacaaagaataagaattttttcatcaaagaaccccaaatagtacataaccttatgccacttatcaaggacattgtcttagacagggtttctattcctgcacaaacatcatgaacaaaaagcaagttggggaggaaagggtttattcagcttacacttccatactgctgttcattaccaaaggaagtcaggactggaactcaagcaggtcaggaagcaggagctgatgcagaggccatagagggatgttctctattgggttgcttcccctggattgctcagcctgctctcttacagaaccaagactaccagcccagatatagtcctacccacagggggccttttcccgttgatcactaattgagaaaatgctttacaactggatcttgtggaggcatttccccaactgaagctcctttctctgtgataactccagcttgtgtcaagttgacacacaaaaccagccagtacagacatgt

SEQ ID NO: 2176 - DNA, 1000 bp, mus musculus
gataagtggaagcatacagtctttgtccttctgtgacccttttcccaagtgatatgtcttacaggtttatccgcgtgatcacaaaaatgggatttcaaactctcatgttttaaaaaacatgcctgtttaattgagacagggtcccattctgtaggctggcttagaacgccgtgtagcccagattatccttgaattcgaaggcaccatcctgcctcagccctccccacccctcagtgttgggattacaggctcaggtcacctggcagggttgtcttcattcgaaaatggaataataatgccatcatgtatgtgactgttgtacttggatgttgtcggtccaggccacacgatgatttaaggtttctccatactgatttctgcacttctttctatgagtggcacagcaggcttatatctccccagctgcctctccaatatgtttggagtgcttttgataatggccatcctaacaagctggaggtgataacctgggactgcaggttaccactttggggacatcagggctgttactgagtttactgtgctgactgcttgtctctgtgcctgagttatgtgtcaagttctaagcctgttgtggtgtccctggaatagaggtcttgggaagttcttctagttggcttcagctgtcagcttgatggagcccagagttatctgagagagtcttaactgggggctttcattaatcagattggccttgggcatatctgtgggggtttgtcttgattcttggctggtgtggaagggccctgcccattctgcacagctccatcttctaggcaagtggtcctgggctatataagaaaactaaacaagcacaagcaagccagcaggcagggctcctccatggtttctgcctttacttcctgcttgagtccctgccctgactactctcagtgatgcgctgtgactcggatgtgtaagccaaataaatcctgacttccccactgtgattttagccatggggtttatcacatggtca

SEQ ID NO: 2177 - DNA, 1200 bp, mus musculus
ataactacattcaaaaaacacaggaaataagtaattccctaccagcaaaaacaaggaaagcatacccaaagatatacacacacaaacaccaccaacagcaaaataacagggaataacaatcactagttattaatatctctcaacatcaatggactcaattctccaataaaaagacataggataaccaattgataggacatccaggcaaaaactaaacagagaaataatgaaactaacagacactatgaatcaaatggacctaaccgacatctatagaatatttcacccaaacacaaagaatgtaccttcctctcagcacctcatgaatcatgccttgtgtcttatcatggattgtagcctcccccagcctgaagtggggttgtacaaaccttgtcgccactgaggtggggccacttgcggtgcagctttccgacttggctggctcctttttgaagtgacaactgccctgtgattctgccacctgctgaacctgtcttcctgagatgttcctgagatagctgactacctgtaaaattactgctaacagctctggcagactagtgctaacaacttggcaacaatacatcaagaagcctggtgacccgagtgctgatggaatggctccaggcaccaagagtggactggagttggggatgggccttccctcttataagcatggtctcttacttgagagccttgaacagggaatcgtcttagctccattatctttctcacagtctaagtctttttcagccctagcctgcctcccaggtgtacccggttcaagtaggcctcgggcctgcatacaacaatggattaaagctgaacttcaacaacagaaacactggaacgcctacacactcatggaaattggacaactctctatcaattacctctggggcagagaataaataaagaaattgaaggctttctagaattcaatggaaatgagggcccaacatacccaaatttatgagacacaatgaaagctaaaagttcatagcactaagtgtctccataaagaaattagtaagttctcatatcagcaatttaagaatatacttgaaagatttggagaagggggggagaaaaggaggagaaggaagagggggaggaagaggaggaagaagaggaggaagaggaggaggaggagggggaggagggggaggaagcacaccaaagagaagtagaaggcagaaa

SEQ ID NO: 2178 - DNA, 1000 bp, mus musculus
tactacaatagaagcttctttaaatatatatacatatatatatatttaaatttttaaatggaatcaccaaataatggaggagacaaagctccaactaaacatctcttgttaccaaatggaacttccagtcccaggaatgggttacatctcatcaaattattggtccagggagccccatgaaagcccccaacaaactccagctgttgccacagctattggttgttctccacaaacttgatggcaagaccctattgctgaagagaacacttaagaagttgacctggtacctaccaagagccttcatccctcctgattggtgttcatggtactggaatgtactgcgcacactaaccacatgggtacaatagtggcacagatgttgctggagtaaccacccatcaattggatttaagacccactacatgagatggaacccatgcctgaggctgatcacatagccaagaatttgagactagatagaccctggatctggtgacaaactgtctactgcctgaggaacctagcaataaaataactctgaagttttctcctaaagtagatgagaacaaacacagagacctacaaccagacaaggtgcagagagcatgagactgtggaacactcggtcctcaatggaatgtctccatccctctcctcagttctcagggagagatgccaaagaaagagccagaggcaataataccaaagaaaccacgtcttccaacactacaggactgacccacgcatgaactcacaatggactatgacagcatgcacagggccaaaccaagcagggtctctgaactgaaaggggtaatcgacccaagctcccatccccaaccatgaagctatcggcaatttaacaaccacttgcaaaagaaaaatgactttcctccagggagactcactgtgtatgcaaactactctagaaggcaggatccacgactaaatggtgagcagcaaatgaactcaggggtgtttctgaagatgttattgcctc

SEQ ID NO: 2179 - DNA, 1000 bp, mus musculus
gcctaaactgctagctttagagttatttccacatggtgtgaaagaactgacttgagagctatcagagaagctgaaaatcgagaatggggatcacagagaaaggagatctacagatcgatgattctccagtttttatctaaactctcggcaactatttacttgaccaaagataagattatatgtgtgtggctctcaggagctccacagctagaaaggtgtgatatttctgctgaagtcttgtcaacttgcagagttttgataaagatcttctagttttacaccctcctattagaggtatggcttaaaagatatggcttaacatttcaaagggatcagaaaatacattagatgaaatgaatacctgattgctacccccagttccacattccccattgctacacacctcaattcaattccacatatctccaaatttttaacaaagaattgttcctgtctaaaggaaatacagagacaaagagtggagcagagtctgaaggaaaggccatctggagactgccccacctgggaatccatcccacatgcagataccaaaaccagacactattgcagataccaagaagtgcttgctgacaggagcctggtacagctgtctcctgagaggccctgccagatcctgaccaatacagatgtggttgcttgcagccaaccatccaactgagcacaggaaccccactggaggagttaggcaatggactgaaggaggagaggcccttgatcctgtgaaggattgatgccccagggtagagaattgctggggtggtgaggctggggtgggtagatacatgagggagcaccctcatagaagcagggtaagggggctaggataggaggtttgaagagggggaaccaggaaaggggataacattttaaatgtaaataaataaaatatccaattaaaagaaagaaatgcaaacctgaagtagatctcctatccaacatagaaaccaggctgtcagatgcaggtgacctgcttgccagc

SEQ ID NO: 2180 - DNA, 1400 bp, mus musculus
ttagtagaaggagcactgtggaatgttagagaaaattcagttaaaaatgacgtgattccgaaatgtgaaaattttaaggtaggcaaaataaaccagagaactccagccaaaaagatactttacttgataactcattgccggaagcactgaaacatgtaaacagagcttgagaggcccagatatatgagtttgtggcaaacctaatcctcttatcaaattttcattcacatagggttagacttttttttttattgggtattttatgcatttacatttcaaatgttatcccctttcccagttggatactccctctcccacgcacccacttggtcctcaccaccctggcattcccctacactggggaatcaagccttcacaggaccaagggcttctcctccagacaatgtcattctctgctaaatactacatatgcagctggagccatgggtccttccatgtgtatactttggttggtggtttagcccctgggagccatgggtccttccatgtgtatactttggttggtggtttagcccctgggagccatggggaggggggtctggttggttgatattgttgttcttcctatgggtttgcaaaccacttcagctcctttctctaacacctccattgaggaccctgtgctaagtccagtggttggctgcaagaatctgcctctgtatttgtcaggcactagcaaagcctcttaggagacagctataacaggcttctgtcagcatacacttcttggcatccacaatagtgactgactgggtttagtgtctgtatattgatcctctgggtggtcttttcttaaggaccccaactttgtacccatatttcctttagacaggagcactactgagttaagaatttggagatgagtgggtgccccatcccccaacctggggccttgcctggcccctggatatggtctctacaggttctccctcccttttttttttttgggcattttagctaatctcattcctgttgggtcctgggagcctcttgcttttccggcatctgggatttgctggtggctaccctcagttccccacccctcattgctacatatctctgttcaaactcctgatactttgtctatcatccccatctcctctcatacataaccagcataactttaaaagttgtgaaatcagtgaaagaaatgctaaagagcatccttcctgataagagtgttgcaggtatgaatacctgcacatcaactatcaaagcacagtctggcatgaaacacaaaaatgggacatgcaaaaagaaattggtgtcatattaatattatgagtccttcgtgtagaaaacctgtttgaaatattctaagtgagcaaaaatgactcaatatatgccaataacttccccctcaatagggcatgcagctt

SEQ ID NO: 2181 - DNA, 1000 bp, mus musculus
aggctttcttctcctctaatgatttcaggtaatatagaggtagaagagaatatgattaatgacagagaatcatttcagcacttcagagtttattaatcaagtgtgtgatacactgggactctaactgcaatgcgaaattgcaggtgctcatgtgacatttctaaatgagtcttaacacatgcaaatccactgcatgggaagacatagatctaaattatggcagactgactcaggggccatttgaggactgctcatagattgttagagtttattcctaagtcatttacactttaatccctacgggggcaggagaaaagagattccccatgttcaagatcctgtaaagcttcttgttttgtttagcatctttaaacacaagtcaagagggaaaccatgcactcagataaatccaaggcaaaacaagcaaggaggaatgcaattggaaataaataaggagggcatgtgtcattgaatggcttgcattcttcctgcaaaatgctgatatgaccatgcttgtcccagtaagaaaaagttgtaagttgctgataattctatccattgtgcccaaaaacctctcatagaaatttgtttcctcaagggggctcctcgtcctcttcttcagcaagctatttttagtttattcaattttgtagtgatcagggtagatgagttcaaatcccttattaattcatgtctcagaaaagcaatttgaatatctactggttttccaagtgtcctttagaaaaggggaagtcctaagtgtcctgtctcattcagctgagggtcagtgccgtgttttctttagagaaatgtaaggtacagaatactcagcataaagccaaagccaagatatgccctaacatcatcgaaaacagatagtttgctgtatttctaaacatggaatttacctccttttctttagttgaggacagaaaaaagtcctcagaagaaaattttgttaaacaccttttaaaacacaaactggatttgaaagtgaatc

SEQ ID NO: 2182 - DNA, 1800 bp, mus musculus
caacttagcccaagggaacatttacagcaacagcagttcattaagatcattatcctctgtgacacagggcattcctaatcacctctatgattgctgtaaattctaatgacaacgaatcatttgtattcttatatcccaatatgtttactacttactataagtctattaaaacacaaatctacagttattgactaaatacttctcatttttcatttttaaagctccagccatccatattttaaattatgatctacaaagtattcaaagaccagtttcacctctgaaagggatctacaaaaaaatcatttttaaatcctgtctactgctttttattttgacttccccttcttttgatttctcagattctataaacagcccccgtggtgaagaggaatctttataatatcccttcataataactagttacataatagaatcagctttctgagacgtaacaattgagcatcctcagctcctttagtcgtgttttataattgatatcataattaactttgatcccatagaatatgcttcacgatctctatttgctagaaatgtcagcaaataagatatgggcattggagaagtagaaaagagaacctctgcccaggtcttcagtgttagtcattgttaagaaaacactaccgcaacgtattgattgcttaaatacaaatgttatccaataacaaagttaggtgactctaaggtgaagtcccaattagcctgagatgattgatgttttacttccttcactgaaggctcatggaaagaatcaggcttccaaagggacttggaagagtctcagatatttaggtaacctcataggaaacaagtgcatgggacatagaaacagaaatagaatgtgctgatagcaactgcacaaactcccatggagaacagaaaggcctgtcatggcaggccggagcggaacagtagcactaatgacagtgggtgtctctgctggatatctcggccatcatgctggctttcaggattcccatcagacagtctagttttcttgggagtcagcagctccttatcgctgctcccatccttgttcaaatctttcttctctgatgtgactacaaccactttcagcatgccttcttgtttctgtatgtttctgtcacttgcatgaaaaattttgtaataaggaatatctggaaaaaaagaatatctgatgaattaagtcatcactaaatatgaagcaatatagttggctaaaattctcaggccatatcatgtcacagataactgatcaaaccttccaacatgagctagacccatcagttctgcttgctcacaaaaataaatgctatggtcagagtaacagttacttggtaactgaacgtaaaacaataagcataaagaaatgacagtgaggatttgtatctattgaggctatagatgtgaaacatactttgtgcaattaaatagtgatgaaaattttgttttaaatctccttatcaatacaaagaaaatgtaaaaatactgactctaaattattttatatattgtatatgatatacttataatgaccgtaagaaattggtattgtatattacatttagtttcttgtttgcctatttaaaaataaattggttttcatacaatgtattattttcacatttccctcccttatctcgtgccagatcttcctcacttccaaagccttccctctctttctctctctctctttctctctctctttctgtctgtctctctctcttaaacaataggcaaatcaaacacaaaccaatcagaataaataaaaaacaaagaaaatcaaaagacctgaaa

SEQ ID NO: 2183 - DNA, 1200 bp, mus musculus
tcgagtccagaatcacctggaagacaaactggtaggcttttctctctcccttggtgatgctgatacaggccagattagaccagattgaaaggaaatgaaggcaggcgtattaggaggcagctcttggatgggtgcactagtctcactgatagagacactgaagtcacaagcccaggctaaagcaaggaggttttacagatcttaggcgaggagtgatggcgtgtcagctagcagctgggattgtgtgcatacgcggtcaaaactgaccctgggcgagcactcttgggtgggtttccagaaacttggagacgaggagttatgacattgttagcctggagttttctccatgcatgcagggttgggggaaggagggtagatggggttttccagctatgcaggggttggggtgccaaccaaacacaacctctagttgtacctgtgaggagtctccaggctgcgttaactgggctgggatgactgtggggagcaccattccatgggtggagtccaaagcagaataggaaggaaagatagagctgggcacccatcttcacctctctgccccaactgtggatgcactgtgagcggctgtctccggttcctgccactgtgatgtcaccactgtgctaactgtagccttagactgtgagccaagtaaccttccttccttaagtcgcttctggcagatttcctgttctagtgttggagaaggcacctaactcaccttccattctcttgggctgccacagttgaagagccatcttctcccccccccctgcccagagggttccagaagcacctcagctcctctaaataaacatccattcattgctttcctgttggctctcatgcttgggattcctgtatcccgccctccaacgtggctaattaccatgtttggcagatcaatagtcactctacattatcatcaccatcatgcagattatattcatagaccaaccagagattgcttttcttgtttgtcttgagctcgtaattgagcctaattttttgattactaggctttctgtgtagtcgtcagtagttcagcaccaatctcttagactagtcagaaataattactcctttctttcttctgcagtggctgtgtgtatgtatcatgctctaatttgaatttcagctaatgatttaacatttacatcatcatcagaagtgccccgaggctcagtttgttccaga

SEQ ID NO: 2184 - DNA, 1200 bp, mus musculus; identical to SEQ ID NO: 2183

SEQ ID NO: 2185 - DNA, 1000 bp, mus musculus
ccggaggggaggggagaagagggttctctagggtagctaggagtcctttttatatgctgctgctgctgctgctgctgtgcctggctcacatctggctggcaatctaggcagatggtgatgaaagctattactaggtccctgttgctaggtgcctctgaggcacctagcagaactgtcttttaaccaacagaaattgtctcaacgtctcctttccccttctttgttacttcttgatgctacttgcccatgagcttctgtggctgccattccatccttactgtgctgcctcccataagggaccctatgtgcacatatatgtgccttcttaagggatctgcagaagcgttcattagctatctcttcttttctcctagagaaaaacatgccatccaaacccgtgatttctgttgctaatatttataccacagctgtagtgatatttaatctgatactatattaagaagtacttgatcttttaggaaaaacaatataaagtgtgccccctttgtattgtttttaagatgatctttctctcatttcaattttctttatttcaaaagaccctttcacaaagcccctcacaaaacagaagaaatttctgggtaattctcagccttctatttgcaaacattttgcctgttttcctagaacaaatgtcatttccagcctgaagcttgcaaatatgcataagcacgaatccaaaatttttatgatgtgcagtcactagaccagaacttatttgtgatgcttaatgtgccagagtaccgaatcccacccgcctggcacgcgcggaggtattctgaagcattctccagaaaggatgctgccaccggggagcctcagaacaatccggcaaagctgaagaggcctgtggaagtggatctgagttctgctgccagctatggtgacacagagtctgctcccgaggactttacgaagcactcacctctgtgcccattggagtggctcgaaaatgccggaaagttcaatgaataaaata

SEQ ID NO: 2186 - DNA, 1400 bp, mus musculus
tgatcaaaagcaactttggcttacacttccacatcttagtcatcattagaggaagtaaggactggaactcaaactggccgataacctggagacaggagctgatgcagaggccatggatgggtactgcctcctgccttgctctccatggcttgttcagcctgttttcctgtagaacccaggactaccaacccaggattgtcctcacccacaatgggctggacccttctgtatcagtcactaatttaagaaaatgccttccaggcttgcttaacacccaatctgacggaggcattttctcagttgaagctccatcctctttaatgactctaccttgtgtcaagttgacataaaaactagccaatacaagtggtgccatcaacttgatctcttgaccttccacaatgtggctaggatgatttccactctagtagatagtatccaaacactggttgtgttcgctattgatgcctgtgaccagagtcaccttgaaagaggaagggtttatttcactcacgctttcacaggttttcctcttcgataaggaggcatggcacagccacataatggtgactaggaaacagagaaagaacagagaggatgccacacaagcgggaacttcctccatcttccctttcattctgtcaacctcctcccatggaattgtgctcagatgcagagggaatctttccccagtgagtcactcatctctggaaacaccctcacagacacagccagagatgcgcttctgtagtctcctaggtgcttcttcatcccctgaagctgagagttcatcttcacaggtgtcagtgaactgaatctaagtattcgtatttatatgttgttccacccatgtgagctctgggctaggcttgcacctcatctaatagggctgacgtgacagtatgctggatgtgggattcaggatgcctggacgcctctcttagcacttttaggcttgagctgtcaggtaagacactagaaggccaggcccctgagctatgagaatagggagagcaaagcagacatcccagcacaccaggcgagtcttcagatgattctagctccagcggcctcctgcctgacagaccacaagaaggagtcaaacgggacagtcacccacccacttgtccatggtatcataaaatagtgtcgtttgtttgggagccttaaggaccgaggctgttgtcacaacgtggtagtcattgacacagcttcccacagaaacacagttagaaatgagaaaacactactccctcagatgccagctttaccagtggggctgtgggagccatcacagtcccttctgtttgcccagtgagcttcctggctccaaacacaaagacaagctaacagatgacctaggaagaaaaacactaaaaaacaaaacaaaacaatatggt

SEQ ID NO: 2187 - DNA, 1000 bp, mus musculus
gaaagacttttttgtttgtaactcagtttatttggtgttctgcttcctgcttccctcgatccctggtgcgcctggctcttcctcattctcttcaactgatatctaacgcatggatgggcgccctcagggatgtttggggaggtctaggcaaggatctagaataatagcgcttgtcctgtggctgggaggaagtaccaggttttgccgtagcacaggaagaggtgtgtgggaagggccagtactggagtggatgtttctggtagttttccctgatttggctcttaattctcgtctccccatagggaacaccttgatgaaagactcggcagccatcattagtgggcttctgtttgagttgttgaaaaccgtggcaagtgctggccaagtctttaccctctcttgtcacctgcagctccgtgccagtctctatggaagcgcacgggaagatctattgagggcaggctcagccagccaggccttaggtttctcaggctcagactttctgacatgaaaccaattgctgggagtttggggtattatttcatctttctctgggggttggtggcctttccctcacaggaagtgaaagcacactggtacacattctttagtgctgctcaggccttagtgaaaactgccttcttctcttcagaagggctgataggcatctcagacactcacagaacgcacgtgaccacctcatgagacttgagagacttccccccaccacacccctcctctgaggaacagcactgtgtctcagggactcttcttttgccttctgacgtttcatggcagccggctgggcagcaccggaagtggctgagcgggtgggagggactccacggccatcatttctgagggatcaaggtactgtgttatctctaatttcttgcaagtgggttttgggttgtttctggtgtcctctatctgcaagtgtataggtagaggtttaccatgcgacttttgtttcttgtttgtgttcttcccctttgcagac

SEQ ID NO: 2188 - DNA, 1000 bp, mus musculus
gcaagtatgaattcccttctactgaatgggtcttaagtcccattagacagccattggttggcaccaacatgtgagtgccacttattacatatttaagacattctgccgtgcctgtttttattttcagtcagtgttcaagcaatgattggctacttccctgccattgcaacttgtctagtttacaggtgacatggaactagacaacaggaaaaaggcttttgggctagatccactgagaatcaagtgattctttatccttcatgcatggagtcttccacaaaaactacttgatcaatcgtttaaaagtaaaaattacaaatactgaatcttgtgattattccaaaatacacattcttttttattgcaattatacctacaaattgtttcagcttctccccagcccttagtatctgttcgttttacttaaagcacatcagtgtgcaatttctgtgtctaggttttaaaaacggatatagtaaccgcaacgttatgctgatctatatgcattaaatgtattgatgacataaaagcaaatagaaataatgcataggctttagactcaggacctccacaatacagtgatagtaaatacaacataaatagatagatttagcatgctggggaaagtggaacaagagtgggacatttcgagctctaaggagtaccaagcagaggcactatagggacatgatgaagtcaggcttcttctgagctgaaggtaggcagacaggaagtaccttcaaactaaggaagtggtcctcaactaatcccttaagatcacaaaagataaagaagggacaccagtgcacatctcaagagagaagaagacccatcagtaggtggtcctcaggaggaagctactgtatcctctcctcactgaagctctatcagagggtctcctggagactggacttcccacttcccactgcacagtcatgtgtgtcaaagctttaaatcttctttcactcttgctctctatttataactcattggctttttg

SEQ ID NO: 2189 - DNA, 1600 bp, mus musculus
caactcagacatttgaatgcttattaaaatcactgatagtaattttaaacaaaaatgcagaaatacaaaatagtaattcattattccctaacttaggcctgtgtgaatggcagtaccatttttctgttattaattaccaaaactggtgattttaatatttgcctttcccaacctatgcatacagtaatttatcctactcattatttcatggttgttttttatgactgtgttgatacaaattaatagttgcagttaatatcacttctatttatttttttctgtggctttccaaatgtttcccacatctctagccttgatatcttaagaatcattctacagaacacccgtgaaagtaagatacagatgttatatcatcccatcaggtcagaactttcatctcttggctgtaatgtccccaatgcactgtttttattgttatcagatgagccaaattctgcaatagtgcacataatacaagcaaccacatacacccaaccagatagagcctccctgaatactcacattatttctctgcttgtgactagcttactgttgtattctactttagttttaactttctaataaacacatgaaattcatcactaatttttggatttcttttcaaggcaaactttaagcttccattatatgcaaggattttctttctctgatatatcagggtaagttaaaaagctcaactcttaggtcctctaacatgcccaggatcagagatgaggccacaacatcttcctcaacacccagagtaactggatcccccaggatcctgggacacaggaaccctgcccagccagtggtacaggttcctttcggtttgagccagtaccctgagcagacctcaggcactagctctgcacctattcccacaacacccagagtacactggaccccaaaatgctctaagactaccaggatcacaggatctcaggatcacaggatcacaggatcacaggatcacagaatcacaagatcgcagaggaagctagactcccaggagattggcacacccaggagcagtggagctttgatacactcaagatcacagctgaggctacaacatcttttccaacacccagcataactgggaccccagagaaatcagggaaacacaaacttgcacctagtcagaggcacagattccttctggcctgcacctgtgcctggagcagacccagggctcccgctccctattcactcctgcaacactcagagaaagcttgattcccaggagctctgacatacccagaatcacaggatcacagcatcccagaattacaggatcacagagatagctggactctgaggaattctgacacaaccaggatcatagaaaggacaaactccagtcagagacagtaagaccagctagctccagagataattagatggtgagaggcaagcacaagaacatactcaacagaaataaaggctacttggcatcaccagaaccccgttctcccactacagcaagtcctgcatactccaacagactggaaaagcaagatctggatctaaaatcacttctcatgatggtgatagaggactttaagaaggacataaataacttccttaaagaaataca

SEQ ID NO: 2190 - DNA, 1000 bp, mus musculus
tgatgatggtgagtgtttttggtttctgttagtaaaattcttatgtttgccttttgccatctggtaatctctggagttagttgttgtagttgtctctggttagagcttgttcctcaggtgattatgttagcctctatctgcagacctgggagactagctctctcctgagtttcagtgttcagagtactctctgcaggcaagctctcctcttgcagggaaggtgcccatatatctggtgtaccttgcaggtggctgcagactctgtgcccaaggtaccccagtgctggcttggactggaagggacttgtgaccctgatcaggccgggttttctgcttccctaattaatgcagtcttatgtcccgcaagatcggattggagcagaagctgtgttccactcaccagaggtcttaagatcccatggagggtcctgtggttaccttgaggctttccgcagactcagcgcccaaggtacccctgatttggcgtggaccagaagggctcatgatttcttattgtgtgaaatgttccctaaacactttaccaaagacattggagagatgcgtgaagaggtcagattagcattgattttcacagttactctttgttaatgactctcatggagtcattagagtgctggatttgagtaaccctcatctatagtaacagagatttttcactgaccttagaattaacatatatttcctatattctttccttattataatccacttagaaatatgtgttaaaacaaaacaggggcacaatgacaattaacatacagaattcatggtctacttcaacttttaaagagcgagttagttattaaaatgtgtctaagagtctcacctgaccgtaattactgacaatttcattctgtttgctccttcacctgctgcaggtggcttctcactttgattactttgggtatcattcacttacaacacattacacttgggtgctacgtatttctcttgatgcatacacagcttcttgatgcta

SEQ ID NO: 2191 - DNA, 1000 bp, mus musculus
ctgaattctgggggcgtgaacagagagagaatcaaagggggccagaatattaaagatgtgtagaccctcaagaacatacaacgtactttaagtaccctgggctagagggccggccagtagtctcaggacctatttatagaaaaagaaaaaaaaaacctacattaaagtggcattttgccaaaagtagttatgtaacagattacatcattgtttacttttgggttccccaggcatctggtgttagccaatttgtgctgactcacacccctcctacctagatgtccagaaccagccaccttagccaatactggatatcgttatcagtgccatgttaggtaagcacgaactggaacgacagccctacgctccccacaacagtaactatgtggggagagggattcttgttgaaataaagaaatacagtgatttctggataccagaaatatacaaagtaaacactcaagtttgggggaggggcagaaaatgtttaaaccaatcagaggctaatgctctgtgaacttttctaggaggaggtgaaaaaaatgtctcttcaccgaggcagggcaccaactacgtactaaagtctgacgacacccaagtctagcttgatgcatcaatagatttattgagtccatttacagagcagacatgaagagctccttacagaggctttgatatctcccaagtacctacctcatcagaaagcctctctctattgtgaacgtggcttctgaacagcagcatgaatggagactccttttcagctaaccttccaccctttatatattctgtcaactcccaagagcctgagaactgcatgcggctgggagatcagtatcgcaggtcgtgcctaggatctaattgccctcctcacaacccttccttgaggaggcgacgtcaacgtcacgaagggagcctgcaagtagtcacaggtgctctcatgaagatggtaatgattgttatactcagagaacttgtgttctaccacagccacagacta

SEQ ID NO: 2192 - DNA, 1400 bp, mus musculus
tgaatatgcttataattgttctttttaatttctatgtttcacagttcatggggattattctggtagaggaacattattataggattaatgctctgggtgcaggtggaggtgggacatgtattgtttttttcatactgttcctggttttgcactgggacctggatatcttgagttaggttggtgattgcacgcttgatataaacctctagcttacctacattgtgtggaattttgattgattgattgttgttgttctgtaattctggctgcttacagatcagcagaaaagtgtttaaaactcagttttgcagatacttagtgttgctgtatcagtagggatgctgggataattctaattctgtggcagctagcatgctaagacataccctcattgaaattcaaaatttaaaagccatttataaaataaaacccattttcaactaagtgtcctgtgtcatggctgccacctgtggatatgatgaagtcctgtttctgctacctctaagggagagctctggttccatgctcgtgctgcagttgggggtctgtgttgatgcctgttgcccatgttaccaccaaaggccaagctgatgtctgtagtctatgctgcagctctaggctatgctgatgtccacaggcagtgctaatgcctagagccatgttggtgtctgtgatccaggctgcttccaaaggccttgtcaaggtccctggtcctattgcaaccagggctttatttgtggtctgtgctgtcaacagaaaccatgtagaagtccaagatccatgctctccttggactgtaaagagcaaggaagctactttggcagcgatatcaatggctacagaagcacagttgagaaagagggacatggtaggcttctggatcaaccctacccctaatcttagcctctccccctaaaaattaacagtctaaacaagaaaccttcatagagatctcttactgtgataaggatgctgaagtgtacctctccacttcatgctgggggagcaggaagggaaggacttagttctatttaaagggcaggccactgggagtttgcccaatctccagtgagtatatagataacaaattggacttgttttgtttgttgttgttgtagtacagggggagtcacaaggacagggagagcatggaaggacttggaagtgaatgtgtatgatgtgaaattcccaaagcatcaatacaaataagttttaaaaagactcagacactcacatttattggaagggaaaacactttattgactgattcatctttccagccccaaataacaaaacatttttatgatatgtatgtatatcattggactttatttgtatatagactattattctctcttgtcctcatttctcattctggcccaacactatgcaatagctcc

SEQ ID NO: 2193 - DNA, 1000 bp, mus musculus
tagcgttaagtgtaagttttactctgaggtaggtatggttaggcaaagagctgattgcagtgtggctgctgggtcctgccagatgagctctctaagtctctgcagttccattctatttagtcatacaacagctggggcaggatggggcgtggggatggggatggggagatggaggggggtcagtggaggctgagttcccacaaggatgagcctttgctctccagctctcacttgctaattctctccagtgcttaagcttgcaggtggtctttacccactagccagagctaagaatgtttctcctggagatgtagatattcacagggccacaacaaattctactgctggaacttcccttcaaggaacagtagagtcagctgggagaagtgggggaaggggcaagtgagggaggcaggagaaatggaagcatctagcatcctttcttctttggataactattggcttgggatgagaactatgcagttgttttgaaagtcttcacagtgctgaagtcaaagaaaaggacagatgtttacaatagactcaataaacgcttgtcacagatgggctacacaaagtgagtattttcacatatatccaagtgtgggtttgtctcttttgtacttgatctgagacagctgcagggtccctgtagtatttactgtaccaggcaattaaaccagtggttgaagcattggaaactgtcaattttctgaactggttttactgcattacaaacaacaaccaggattcatctccaggtgaataaagcaatggctgatgtgaggtacaaatataatagaaaatgtcagtactgggagaaaacaaaaccttaaaaaaatgagaagagttagaaaaaaaccctaaattttatggatcttggttggatataaataaggcaaacatcttgttgaattcattattttcatggcaccaaggaatggtatagaaatgttatgatgtgggaaaaccccacagccgacttccaatcctagtttag

SEQ ID NO: 2194 - DNA, 1200 bp, mus musculus
ctttcttcctatcttaatagagcaatgcaggcccaatgcaggcacataataaatacattgttaattgattcatattcctcacaggccctcattctcttggccttatcccccacacatcagggttcaatagtactaacaatggaaaggataataagtgaatctaaatttaatccctttttgtttaaactaatctctccctaattaatggctgctcataccattattgctaacgaatcaggagaccttcatcacatctgtgcaggaagctctctgttaaactgtcaattcattttcaaaggaaacaagccgagtccaactctccattgttcccctggtgaccttttggctaatgaaaagggaaagggtgctcaaaatacaaaaaagggaatagacccttccctgtcctatgtagttcttaattctgggctgcacccaggcttttgctacatgttttacataacatttgtgagggctatgtactttagaacagacaaaggacagcattgagatatgacagcgacgagcacagaataaagacctgggaggagagagtaaagccacaaagatggtttaccttcatctgagtctcccttccaaccctatgtcatacagagtactcaaagctcgggctggctctgagcatgcgcactttgagacgtcccctttgggtggtttctccacgactgatctcactccaacatacacacaggataagacaaccgctgcaatacaagagagcttacctgagaagatattgctgtgaaaacaggcaactttttatacttttggaaacaatttcagtctctctcttaagaatcacattaaataaacttagtgttagctcacggacagttctgctacacttctcccagagacctggccacagcttagttgtcacctgctgccactacctgcagggacaggtactgttggcctggtgtactcgccagccctgttgattctctccctgttcccacatgttctcgggaggtctctctttcttccccctttctgtccttctttgtgtctttctctttccccacttcccatttgtctgcgtctaccccttctccagaccatacctcccttcccctcccccaaataacccctcccaagtcatacaagatttgttacatggagtgatttctcatggagatacctcggcatgggccctccaggcaccccacctggctctgcatt

SEQ ID NO: 2195 - DNA, 1400 bp, mus musculus
gcttcggtgaagtagctggatataaaattaactcaagtcaatggcctttctctacacaaagaataaacaggctgagaaagaaattagggaaacaacacccttctcaatagtcacaaataatataaaatatctcggagtgactctaactaaggaagtgaaagatctgtatgataaaaacttcaagtctcgagtcggatcccagcagcagctgcggcggctcaggtcttcagttgctctttctgtctccctttcgtttctggaaacatggcctctggtgtggctgtctctgatggtgtcatcaaggtgttcaatgacatgaaggttcgcaagtcttcaacaccagaagaagtgaagaaacgcaagaaggcagtgctcttttgcctgagtgaggacaagaagaacatcatcctggaggagggcaaggagatcctggtaggagatgtggggcatactgtggacgacccctacaccacttttgtcaagatgctgccagacaaggactgctgctatgcactctatgatgcaacctatgagaccaaggagagcaagaaggaggacctggtgttcatcttctgggcccccgagaatgcaccccttaagagcaaaatgatctatgccagctccaaggatgccatcaagaagaagctgacaggaatcaagcatgaattacaagctaactgctacgaggaggtcaaggaccactgcaccctggcagagaaactaggtggcagcgcggtcatttccctggagggcaagcctttgtgagccacctccagccccctgcctggagcatcttaacagccccagacctgctcttgggtgttgcaggctgcccctttcctgccagacctgaggggctggggggatcccagcagggggagggctatcccttcaccccagttgccaaacatccctcccaccccctggaccgtccttccccctccatccctgactgttctggccttcccaaactgcttttgatcttctgattcctcttgggttgaagcagaccaagtcccatcctaggcacccagtttggggggagcctgtattttttttaatgacacccctactccgtatccctccccatcccatgctgccaacttctaaccacaatagtgactctgtgcttatctgtttagttctgtgtgtaaatgaaatgtggaaatgaccctccctgccccagctggctgtcctcccctttcccttgatcttgaccactcatggaagcaggaccagtaagggaccttcaatttaaaacaaaacaaaacaaaaaaacaataaaaaggctaattaacaccatgaaaaaaaaaacttcaagtctctgaagaaagaaattaaagaagatctcagaagatggaaagatctcccatgctcatggattggcaggatcaacattg

SEQ ID NO: 2196 - DNA, 1200 bp, mus musculus
cggagtaatgtatgcctgaaggtctctgtatttcttcccatctgctgtagtttctctgatgatgtctgaataaggtacttatctatgagtgtagagaatgtcattaatactcattttattgctcctttttttgagcattagtatctggttttaacatcttttaggtcatctagtctctggttcttggtcgccacatcagtgttgggttctatctcatggagtgggacttaggtcaaatcagacataggttggttgcttccataaactttgttccaccactgcattaacgtatttttcaggcattgtagatcaaaggttttgtagctaggttggtacttaaacgtttctctttttggtatggtacaagaataccttcatctaccaaagacaatagaatgtagaattctatggaggaaccagaaatatctccccgtgttcaatgaactgtgtgtgtgttgtcttcagctatagggccctgctgtcagtttgtggaaaggaatctatagtctctgcaacagcctgggttgtttgaaatttccatgtgacccctttggccaacaactcagttggatataacatactactagtgcaggaagcattggtttgtgacaagagatagccatgagggataatgagggactctctttccctcattatttggatacttcagtaagatcaccttcatatattttaggaagattctttgagctgttcttgttaccaaaattttttgagaattcagattcaccacagattaaattgaaaattgggtcatatcttgctgtcctttgtctctttaattaaataatttcaaaatatgaactcaaaaagggaattttcagagccaggtatagcggtatacacctttagttcaagtactgggtggcagaagcaagcagatcattatgagttcaaggatttcaaggccaaactggtctccatagtgagttccaggcaagggctacataattagtctgtctcaaaaaaagttctagatagaccagaatacataagttataaaactcagaggaaaatggaaatgggaaaagtggaagagagaggagagggagattagatagatagatagatagatagatagatagatagatagatagatagatagatagatagatagatagataatgtgtgagagagtcagagagagagacaaagagagggagagagacaaagggagagaca

SEQ ID NO: 2197 - DNA, 1000 bp, mus musculus
tattccatgggtcgtggaggacagaggcctacaagagaaacgggcggagaaaggggagcgagacaaagcagagttgtcaaggtctgtttaatggaggctgggagcctgattaaaagcacacagtgagagaaaatagggaggggtcgaggggccataataaaatacagagaaagggatggacatctggggcagatgctgattacaggcttcttgcagcttatcttggaatgttggccctgaaatagtcctgggcaccaaacggagacatggaggaggaggtgaagctgccttaatctaagcagttctaggcaccaagtgaaggagggagtgaagctggcagtctcaggtgccaggtagaggaaatgaaggagggggtgacataattcccttcaaagggtcagcggatcttcagggtgagagtaactgcgggacctagtttcccacggtttggtctctcacatctccctcttttttctttattaaagttggggggtggccacggaaagagggtcagtgaagcacctgtcttaggccttttctgtggtccatgtccaattaccgcaatttctaggccttttcaggtcctaggtgggcaaggctcctgtcataggctatgtgagttgcccccactcccggcaccacgtcttattccaatgacttgatcaggccactggtagttgtgatgggcacccaggcagtggacccacaataatcctatcattgggtaaccttgcagccaataggcggtgtgcatctggctcgtggcaccacaagatccagtcattggtaactctacagcttatgaccctcagccactataagatctggaggtcaccccatccatcattgtcgtttccatagcttatggaaccaagaagtctctgtttctgcagcaagggtggagaattgaaggccagcggctgctctctctgcattgctggaagagagatcttcatctgaattctagtcaatggtagtagactgcaactattttgtttaa

SEQ ID NO: 2198 - DNA, 1000 bp, mus musculus
tcagggatatttttattagcaaagacccttggaaggcatggtgaggtaggctcgcagagaaaaggacaagtgtgtttttattcttcagtggtggatgccctaatattttacagccataagagttgatgtcccccaaagctgcatttttgtcttgatgaagccatgccaatgaggatcccatcagccgtctttccggttgggcatggtggacattgacactagtgcccacattgtaattgctctgagtgtccacctgtcctctgtctctagctcaggaagctcctgttaactagaatcatctaccaaattggagaaggctgttagctatgaagcagggctgcacaattcttgataatcatcatgttttatagaaagtatatggaatggacttagtccaaatcacaattctaaaagtatatgggactgatcaaaatatgattgttcttttagattttatacaaaaaaaaagccataaggttctactggaagatatggtaagaacttagcaattgacaatatctagtagagctagagaagaaggttctgcactgtaaagatgacagttttatgcaaattaatcttttgcttaattgaatgctgatgaaaaatccaataggcttatttcatgtagttactttaggggagttctgagactgtgtagagtatgagaactgggatggaagtcgacttgtaattttatcatctccatccaacatcataggcaaatgtgttcctgagtttcactcattgtttcatttaactttaaaaataaataaaatgcttaacctgtattcccttttagagaaggctttgactctgatatagtaagcataaataagaagcatggtctatttttatcactgaaaatgaagttggaatcttggatggattattttcaagtttgcttaaatcttaaaatgccagtgagcataatttactgttattttttcatgacttcgtactaggctaaaaatggctcagtgggtaattgctcttccag

SEQ ID NO: 2199 - DNA, 1000 bp, mus musculus
ctgctttttcttattttaaggaatgggtgggggtaggtttatttggtgttgccatctgctgtggacttgtgtttatgctctggttggtttgtaagctcagaacccaacaaaaccgtgacaaggtcgttattgctcaagcacttgcagccattgaacaaggggcctcccctgaaatttggctgtccatgcttaagacctaaatggcatctgagttctctgctattgcgtcccacggatttgtggatacattgcactgggatgtaagagactcaacgctcattgatcagcacttacacctcgctgaggtttactaattcgttttttggctggcctcttttatagagttcaccctaggtcatttagtagttactgtcacatagcactgcagtatccatggacgggcaactttcctcatgtgcagaccaacctaagacacgggacctggtggcaatagggttaccctatgacaggaaaggctgtgacattggaggaatgacctaagacaggagccacagcagatggacatgactgcagaggcctagaccagcctcaaattttaataaaataaaaagggggagatgtggagagccgtgctacgagcaatcgcgtgcatgctgtgagcaattgccattataagatggcactggcttccactgcacttaactagtaaacaagccttatgctcaagtgcaagagtgaactcacacctagtcactgcccatctcacggcatagtaatggggtgatgggcaagcaacaaatcaggagctgtcacaccacatcaggtgctgaaacgtcatgctgcaggctatataagcagtgccattttcctggttcgggggtcttccctcctgataagtaagcaataaaagctttgctgcagaagattccggttgtcctgagtgtgttcttgctggcggggacaaaagctccggcaataggtagggaagggggcatcctctttgaggcagaggtgggggaaggaggtatggactgtggaa

SEQ ID NO: 2200 - DNA, 1000 bp, mus musculus
tctaatcatattcatatacatacatacatacatatagtagataatttcacaaatttattaatagagacaagaaattactgttagatttttgaagagaaaacatttctaattagttgatgacttgaaaattccattacaaatctgttccgatcagggccacccctgccatcttccttctgagcccaacagaggctgctaagggctccagagtgctctccacaccacactgcaatacctagggatcacctcgggaccacaggtaagtggaatgcaacatcagcaccaaagaattgcagagtgtttgtgccagcaggaacagggacaaagaaaccccgctggaccagaggctgggatccattcaggtcagggtcagccctgccatcttctgcatgaacccagccaagggcatctagggcaccaatagactctccatgccacaggacccctagcacacccaggacttcctgataacctgagagcatgtgggcgatagaaacaacagagcttcttggtcagggtcccttccggccttcatcctcagccaggaggcagagctgagacccaaacccctgggaacattccttgccagaggagagtcagcctacaggaagagtactgaccccagaactaaggaggtggatcagaactccagactgctagagacctgccctgaaagaggagggcttgcctgtagagagtgctctgaccactaaaactcaggagagagttggactcccaggagtgctgacagaggctaaaagaaccacaggaggatcaatcaaactccaaccaaagacagcttgacagcttgaacattaacatgagagatttccagacggcgaaaggcaaacgtaagaatcgtactaacagaaaccaagaacactgggcatcatcagaacccagtacgccaaccacaacgaatcctggataccccaacacccccgaaaaacaagacacagatttaaaatcatatctcatgatggtagtagaagattttaag

SEQ ID NO: 2201 - DNA, 1200 bp, mus musculus
ccacctctttgtactatgtagtatttcccactgacaaagaatccatccaacatgtaagggcaagcagtcaatcaaatatttaaaagcaaaactataaacatttttttctattttctaccacattttatttagtagcatctcaacacatctactagatgccatctttcctcctcaagggttgcctcgcccagtcatggcaggaggctttgtgcttggtcttcatgtatcttgttattaagtgctcaggtgatattcctgggaggcctgcccttttctgaagggaaatggaagaggaggagtggatctgggagagaggagaggtgggagaggggctggaggagtagaggaagggcaatgtgttgggatgtattatgtaagaagaatacaaataaagaatgttaaaaagaactaaaaggagaataaaatatttcattttctttctttctgtagataaggaagatttactaaattaacataagtaataataagaaatagttgggtcaaagtatgtggaagatagctagattgccgtttgtttaaattagctattttcaacttacaactttactttgtgacttaaaggaggcattttgttgttatcattgtggcacatatgatgtgttttggtcaagtgcatccatttattttccctgttctcctcactgttctttcctatcaacttcatggcttttggtgtgtttttctggctgttttcttttaaaacaacacagttcacttagaacccctagcatgtgcttgggtgcaggggcatcctggggaccatggctagctttatgggaaggggattaaagtcttgaagaaatggtctttgtctgccccagcagccatcatttgcagtagctctttaggtagagcaggcaatacatgaccactttccctcctcaactctgggattttatctcacctcatcttgtgcaggctttgtgcatgctatcacaattgttgtgagctcattagtaccactgcactgctgtgtctagcaaagtttcactgcagttaaaccaacccctctgtatcttccaatctttgtttccacattctgcagtgatccctgagttgggatgcacatatctgaacttatttcttatttaaaaagaaagatacaacaagcaagaaataggacacaattcttaccacacacacacacacacacacacacacacacacaaaatcagtcaa

SEQ ID NO: 2202 - DNA, 1200 bp, mus musculus
ctgatattctctttcatctcttgtattctgttgctgatccttgcatctatggttccagatttctttcctaggatttctatctccagtcttgcctcactttgggttttctttattgtgtctacttccctttttaggactagtatggttttgtttatttccatcacctgtttggatgtgttttcttgtttttctttgaggacttgtaactctttagcagttttctcctgtatttctttaagtgagttattaaagtccttcttgatgtcctctaccatcatcatgagatatgtttttaaatccctgtctagcttttcgggtgtgttggggtgcccaggactggctgaggtgggagtgctgggttttgatgatggtgagtgttcttggtttttgttagtaagattcttatgtctgcctttcgccatctggtaatctctggagtcagttgttatagttgtctctggttagagcttgttccttttcgtgattctattagcctctaccagcagacctgggagactagtctctcctgagtttcaatggtcagagcactctctgcaggcaagctctcctcttgcagagaaggtgcacagatatctggtgttcggacttgcctcctggttgaagatgaaggcccgaacagggcctgtcccagaagctgttagcttctgtagtccactctttcacctgtggtgactagtcttggtggggtccaggaaccaagatgtcacccgcagatgctccggcaaggccctcccaggcaggcagacacctctcctctggcagggatgatgcccggatgtctggagcccgaaatgggcctgcctcacaagctctgtggctcctgcctgtcccagaagctgttagcttctgtagtccacactctcacttgtgcagactagtctaggaggggtccgggaaccaagacgtctcccacagatactccctcattttctttattgtttgttttctctctctctctctctctctctctctctctctctctctctctctctctctctctctttctcctctcttccccctccccctctcttagtatgtttactattgcttgtatgtataatattttgggactaattggtattgaattatcaactagtggacttatcctagaaagttaattcccaatcccatctctacctttcagcagtcattagttgcatgtagtgtttgtttgtttgt

SEQ ID NO: 2203 - DNA, 1800 bp, mus musculus
agcaactaaaagtgatacagaagaaacgagcagatagaccagtcagctggaatataaattaagaaatatattctcaaaagtgaaaatttttactttataaagataaccctttggggctagagagatggctcagtggttaagaacactggctgcttttgcagaggacctgggttctgttcccagcacctatactgggtgactcacaactctctggaactctatgtccagggaccccataccctgcatgtacacaatgctcatgcatacgtattcccagatgcaacagactagaaaaggtacaaaggtacaaaggacaaaaatacatgcatccttgtagagtctatagcaagatgagaaggatctgccagaaacagaaaggtcaaggttcaactatgttcataaatagtcaaagcactttggtttttatgctcaccacttacaggcttcagaaagaagcagcaggagacgattattttcattgtttcaaaacttacaggatggctttcaaaacttcattggaaattcaagcacatctgaagcaaacagcaattgcttcactacaacacctttctcattccagtcatgctttgtggctccgcagaggtgggtatgcatgtatgcactcatgtgtacagctgtgcttgtcagtgcatgggcatgtgggggtcagacattgatactagatgcctttctcttccacgtgccaccttccgtgtttgagacagggagctctctaaatctggagctcactcttggctaccctggctggccagcaaggccctccggatcagcctgtctcctccctctgccctacacctattaccaaagctacatgcgcaggctgccaggctgagctttgcctgggtgctaggggtccaactggaggtcatcatagccatctccccagactgctttgtggccttataggatcttgtaaatcgtcacacaaagaaaggcttacatgggcacttcaatgatttgacagcaaaacacaggttctccctgcccccagcatcctctctttcctcattccctctggccttgctacatagcctaggctagacttgaacccccaaatcctcgtgcttcaaatacggaaggatggggattacagacatgcccccccccaccacacacacacacactctctgcttgagattgtgtttctttataacgctcagttacttctcatcccaaaagtttttacctttttaccaggagaggagggcttaaagggcttgaaagacacttccttcttttcttctctcctaaggggaggtaaatggtgctctaaaaagtaagggttagtatcaaaatagtccttcgggtgaagatgcagcttgaaaggtgaccctttgattagtcgatggtgctcttcactttctttctgtgaattgaagagtttcaaagttaagacacaattcaagaccaaaatcaccttttaaatcagttgtccatgtgcagactctaaaacacatgccactgggtgtgctgtcgaaaacattcccttatgttcaacttctatggttaaaaaatggaggatgaggataaaggaaggaaggagggaacaagggagggagggaagaagggagagaaaggaaaaagggaagggaagggaagggaagggaagggaagggaagggaagggaagggaagggaagggaagggaagggaagggaagggaggtaggcagggagggagggaacgaacatacttgctgatgagtaagcacaaccttccctttggacagaatctacttgagacttaacagtccgtcacctgaacaagttcttgctgcttc

SEQ ID NO: 2204 - DNA, 1200 bp, mus musculus
ccaggagtactagatcctcgatctcgctgcctcggtacttcctcttacagatcttcaccaccaccttcttcttgagaaataacttcagtgcttctctcgatgcgacggcttttgcgttttctttgctttttccacagccagtgcccaaatataccgacttacacctcaattcacagacaatactttcttgagagctcttattttgaggcagatctgccagttctttcagtgggacaaaaaacacatccagtgttgctttcagagcctcaatagccgcgttcagcagctctccgtgattcacagtggggctgaagccaccaactgctactaacttccacgccaccgtcttatacagtctattgaagaaaggttgcttctgttttatgtcttcattggttaacttccgacaagcaaacttgacagaactctcactggcctgggaggtacttttcgaaggcaactgtgaagtgctactctgagaaccactcttggcagctagctgagacacgcttcctaaggaagcgccacttttggtcgctagcagtgaagcagctacctgagccgtgcttttggatgtcagcagcgatggatttgtggaactgctctggggggttagtaaagagctgcctgacgatgaactgttttttgaaactgatgatgaaatgtttgcctctgaactagatttagatgttaacccactggaagctgtctctgaactagacttacaagacagtaatggcaactctacttctgcacttccagaggagcccaacaagggcacctcaatctctgagctgctctgagaggctgagcctgaagaaccttccagagcaccctttttaggtgacccactctgttgtctgttatcagtggactgggtcatatgactattcatactggacttcaacagggaagaaacaaatgacgctgaaccacgtttatgtggagcttctgactccaaagcctttccagaccctgcggttacctgagaggaattgctgctgctctggctgcacacagatctgtctccttcacttgtggcgctatcctgatgggagccactggagctgctccgagctgaggtcccaccactctcggatttggtggacgaccccctggacggcgaactgttttcttgctgagctgctgaacgatccgttttggcagattttttcccatgatctcgctcaactgaagaat

SEQ ID NO: 2205 - DNA, 1200 bp, mus musculus
atatatatatatatttacttattactccagattttattccctcctcccctgtccactctctgactgttccacattccatacctccttcccaatcccctgtctccaaaaggatgtccccagccccacccccaccccacctgacctctaaactccctgggggtccagtctcttgagggttaggtgcatcatctctgaatgaacacagacccggcagtcttctactatatgtgcgttggggtcctcatatcagcctggtgtatgctgcctgtttggtggtccagtgtttgagagatctcaggggtctagattaagactgctggtgctcctacagggttgccctcctcctcagcttctttaagcctttcaatcttgcatttcttatgtgaatcagcattggcatgtatacttttacagtaaccaacaactctttaattgaacctaacatcccctcaaatcctgccctgcactatggagtgtagatatcggaggagaacctactacaaagcctactttactaaatcatcataatccaaggttacattctaagtattcatccttatgaatacagataatcacagtcttcaccttcagcaaggaaacgtctccattccaagacgcaagggacaaatatcatagaaaaccacagccaatcaaaatgcagagttctggaggccagagaaaatagatccatttacaatgtattccctacgtctaagactcaaaaaacacttcagaagaggggacagaaagactgtaagacaatatcagggagtttgctgtgagactgtgctccctagggatatcagaaggtaacgcccagaaagtctgtgtactgtgactgcctatacgtgggctgaacaaaaacaatgcattcgtcaagctaaagtgggtgggaagaccctttgaatccccaatcctagacaaagacctgtaggcaactaaggaatgctgtcagcaggagaaagtcttccctagatgagcacaccaactggctatccaatacccaatgctcagctctgataacacatatacaagtaacattatacagtctgcgcttgttgtacttgtgtatttaggagcatatgtgtatgtacatatgcatcattatatgcaataacaagtaatgaaaaaagagaccgtgatttggaaagaacacaaagggatggatgctgtatgggagggtttggagagagaaagtgg

SEQ ID NO: 2206 - DNA, 1000 bp, mus musculus
atttaaattaatccacaagaatatcgtgggactaagaatttagaggtggattcccatggatggaagcttctcttgtaagatgaatggaagatgtgtttgaaatcacaaaaataacagtttgctgtggttatgtaagtctatttttcttcatggaacctgcaagtggttaagaagtggctgaaaggattccccacagaatcctaagacctctggtgagtggaacacagcgcctgccccaatccaatcgcgcggaacctgagactgcggtacatagggaagcagactacccgggactgacctggggcacaagccccttccgctccactcgagccccgggctaccttgccagcagagtcgcctgacacccgcaacggcccacacaggattccacaagggatcataagacctctagtgagtggaacacaacttctgccaggagtccggttcgaacaccagatatctgggtaccttccctgcaagaagagagctttcctgcagagaatactctacccactgaaactaaggagagtgctaccctcccaggtctgcttatagaggctaacagagtcacctgaagaacaagctcttaacagagacaactataacagctagcttcagagattaccagatggcgaaaggcaaacgtaagaatcctactaacagaaatcaagaccactcaccatcatcagaacgcaggactcccaccccacctagtcctgggcaccccaacacaaccgaaaatctagacccagatttaaaaacatttctcatgatgatgatagaggacatcaagaaggactttcataagtcacttaaagaattacaggagagcactgctaaagagttacaggcccttaaagaaaagcaggaaaacacagccaaacaggtagaagtccttaaagaaaaacaggaaaacacatccaaacaggtaatggaaatgaacaaaaccatactagaactaaaaaggaaagtagacacagtaaagaaaacccaaagcgag

SEQ ID NO: 2207 - DNA, 1200 bp, mus musculus
ttattacaacttcagtacttacagacaggggttattatggtagagtgagagaaaacactggaaaagctagaagaagaggaagtatactctgatattttgtctcctagaaatgttaaagaaattacccctaaccacagctattttttaatgtatagtagtgttttacccacatgtgtatataaaccatatgtatgcagttccctcagtctcagaagtgggcagtgaaactcttggaacgggagttaaggagagttgtgaactgctgtgtgggtgaagggacccagcctaggtcttatacaggagaaacagagttctcacactctcagccatctctccaggactcatcattagtatcttttcagaatcacatttccagttttcccttccaaattttgatgtcaagtgggatcaagaatctaatgatggaatggaaacaggcatcctcgggaagtaggaggttgggggaaccaccagaatgcaccagagacctgggaggtgagcgactcttaggactcaaagggagggaacttagatgaaatgcctgacaatagtgggagggaacttatagagcccaccttaagcagaaagacagagcattaagtgagggatggggttgccatcccacagtcacaactctgacccataattgttcctgtttgaaagaacttcaaagatggaaatggagaggagcatgaggaaaaggaggtccagcgacaggcccaaagtgggatccagcacaaggggaggtcccaaagcctggtactattactgaggttattgagcgatcaaaaaaaggaatctatggtgaccatcctcttgaaagacccaacaagcagctgagagtcagatacagatatttgcatccaaccaatggacagaagctgctaataatccctgtggttggattagggaaaagctggaagaagctgaggaggagggcgaccctgtaggaggaccagcagtctcaattcacctagacccccgagatctcttagacactggaccgccaacactagttgatatgaggcctccaacacatacagcagaagactgctggatctaggttcagagaagatgcatctaaccgtcaagagactggaggccccagggagtttagaggtctggtggggaggggggtagggatattctgttggagatggggatggggggggtgggcggtggggaggagttatggggggt

SEQ ID NO: 2208 - DNA, 1400 bp, mus musculus
tataaaagatgtagatagggtggtttatgctcataatcctaggattataggaacggaggcaagcagattaccacaagttcaaagtcacattgagtgactattgtgagaccttgaatccctctataatataaatgggagagaatagtattaaaatgaaaaagaaaacttatattatagtggcagaaaacagaaagttatgtcatcatgaaaggaactagcagtaaacgtgaaaattaatagaaagaagatttaaattacatagaatgaaagggagcataacccaagaatggttgaaaacagtagttccaagagataaacagattgaaacagattgataaaagaagcttttattaagagtaagaaagagagatcagtgccctggcaaatactctcccaaacactggagccttcctgtttcccaggaggtccgaagtgaccaaggacacagagttctaccttccattctgcccacttccccaattaggccagaccagttgccagatacctgcccaaacactacagcctgtgagcctcccaggaagtctgcagtaaccaagggcacaggaagccctccctaaatggtgaaaacactgcctgcctctaaggagaccagccctaactcaggtcacagagctctacctgtctccaaggagaatggttccagtcagagacacccaggccagttaacaccagagagaaccagatggccaaagccaagctcaatatcataagtgtcagaatccaatgcaatttgtcaccatcagaaccagttctcacaccacagccagtcctggctaccctaacatgcaggaaaagcaagataatgacttaagatcccatcttataaggatgataaaggcctttaaggaggatagaaataactcctttgaagaaatacagggaaacacaggcaaacaggtagaagtccttaaggaggaatcaaataaattccataaagaaatataggaaaatacaataaagctggtgaattaaacaaaattatccaagaactaaaaatggaaatagaaacaataaagaaaacacaaaaggaggcaaccctagagatgaacaacttagggaagagatcaggagctatggatgcaatcataactaacagaatacaagagattgaagaaagaatgtcagacatagaagatactacaaaaaaacgttgacacatccatcaaagaaaatacaaagtggataacactcctaactcaagatatccaggaaattcaggacacaatgagaagatcaatcctaaaactaataggagtggaagatggagaagaccccaagctcaaaggtccagaaaacatcttcaacaaaatcagagaagaaatctccctaacctaaagaaagagatggccataagtgtacaagaagcctacaggacacca

SEQ ID NO: 2209 - DNA, 1000 bp, mus musculus
tcatcagattggcatgtgagaacgaatgtgatacatttttttgatgggcatagatactagggtccagttcatctgcgggttagttccgtctctgacttggtggtcctgggtactataggacagctgcctgaactagccatgagaaggtagacgggaattagtgttcctactctctgtgtcagctcttgtctcctagaccttgcatgtgtgaatacctgtactgacttctctcagcgatggattatgctgtagaactatgagctgaaacaaaccctttgctctcctaactgctctggctatgatattttatcacatcatcagaaaccttatgataatttatatttgtcaggcactggcagagtctctcaggagacagctatatcaggctcttgtcagcaagtgcttgttggcatccaaaataatgtctgggtttggtgactgtatatgggatggattcccaggttgggcagtctctgggtggtcattctttcattctctgttccacactttgtctctgtaactccttccatgggtattttgttccctcttctaagaaggattgaattatccacactttggtcctgagaggctctgccagtgcctgacaaacgcagacatgaatgctcacagccatccatgggactgagcacagagtccccagtgaaggagctagaaaaaggacccaaagagctgaaggggtttgcagatccataggaggaaaaacaatataaactaaccagtagccccagagctcccagggactaaaccaccaaccaaggagtacacatggagggactcacggctccagctgcatatgtagcaaaggatggcctagtaggtcatcaatcggagcagaggcccttggtcctgtgaaggctcgatgccccaatgtaggagaatgccagaatcaggaagcaggagtaggtgggttggtaagcggagggagggggcatgggatgggggctttcagagggaataccaggaaaggggataacatttg

SEQ ID NO: 2210 - DNA, 3000 bp, mus musculus
cttgctgattagtggatataagcccaaaatgcccatggttcaatccacagaccttatagaatttacgaggaaggaaggtcagagggtggatgcttcagtcctaccttgagaagaagagaacaggatcataacaggaggaggaaggaggagagggggacctgggacagagagaggagagggagttaataagggggaagtatcagatactggcaggaatgggagagatgtacagagggtcaggaaccgaataaaaatatgcagcaggagtgggggggggtggataagaaactggtgctagccactggagggttacagacaccagggaaaagagactcctaggacccaacaggttgactctaaatgcagaaatgcacagagaaggggagatagaacccatagagaccatctccaacagataggcacagcctctggtggagggattggggaatccacccatctcaaagattttaacccagaaaagttcctgtccagaaaaacgaaaagggacaaaaaatggagcatagactgaaggaaggggcatccgggaacagccacatctggggatccatcctgtctgcagacaccaaatcttacactgttgctgtgggcaggaggggtttgctgacaggaacctgatatggctgctccttgggaggtcctgccaacaactgaccaatgcagatggctagagccaacaatcagactgagctcaaagaccccattggggagctggcagaaggactggaagagctgagggggatagcaaccccattggaagaacaacatcagctggcctgaccacccagtgctccaagagactagatcaccaagcaaggagcgtacagggagggatccatggctccagatacatatgtagcagaagatggccttgactgacatcaatgggaggcaaagcccttggtccttggaggtttgatgtcccagtgaaggggggtgctgaagcagtgggacaggagagggtgggtgggtggaggagcactctcatagaggcaaagtggagggaggagagggctgatttgagaagggggtggtttgtggaggggtgactgggaattgggatatcatttgagatgtaaatgaatggaatgattaatttttttaaaagcaggttatgttgtatataactttcatgctgtatatatacaaatacactgagaaacaggtgatatgaagaaaataataaagaataggtttaataagataagattacattcataaaagcctaaagagctatctcctacatcatagggataacatccaggaggaaatgatttgaattagaacaataccatgaagattagtatgtgtgtcttttaaaaagtacagtaaaggaattgcggaagaaggaattcaacatgagtacaggagaggatgtatacttgtcaggcatgggggaaggaattttgacattttataaaggtaaaaggcatttgaaaattgttaaaaatgcataaaaaggaaagaatagacattaaatagtgaaggttttaagaaacaaacataaaagatagaagaagctaagaaaatattttttcttaacttttgcaaagaagggatagctaagatgactcactttggaaaattgtttgctgccaaacctaaaacttaaatttgacacatagtggatgttaagaactcactcctccaaggtgtcctccaactgcatatgcacatacccatcacatatctacagaacgcagacacacataatcaacttaaaaatgtaaaaaaaagaatgtattcttatcttgtacactgaaagtaccaatttctccccaatgtctaattttaattatcttcataattttatttaatcctatgaatattaccaaaaatatcaaaactttgaacttgatacaaaataacagcatttcctttttccaacaaataatgcatgaatatcataaccgaataagaaatgacaatttaccttcgcccttctggtctgcaactttgtacccatggcagattggaatgtctgctttctgaacccacaaccatgcctgcctgtctctcaggaggcagggacacagacaatatttacagtcaaccactgatctgaggtcaaggatctctatggaagagttaagaggttgaaggaactgaaggggatggcaaccccacaggaagaccaacactatcaactaacctggaccgagtagctcccagagagtaagccaccaacctaagagcctacaggggctgcttggattacctgccaccaccaggttgagcacatatgtagcagagaactgccttgcctaatccctcccagtgagaagatacacctcatcctatagagatttgatatctccaagaagggggatgggcagtagtggtaccttcttagaggcaaaggagtcggggatctggtgaagaactctgggagtggggatggtgagtagagcaacatttggaatgtaaataaacagaataattaattttaaaaagaactgataagttaatagtaaacaagtcactggctttcttttcttttaattaaaacacaaaaaagaaaatgtctttaaagattttataatcactagagtgtaagaaaagttttgatcaagtgaaaacattatacaatatttgatcataacattatacagttttgatcatattaaatattgttcaacactcattgagcttctagtacacactaagctgtctgcagatcttgcatatctccttttgtgtaattctcaatgaaggaagtcctataaaatataattttacaaataaacataacaagatctcatagaaattaaatcaattctttgatgacagggttgaatttaaattttgggtgaatcaggaatggacccagaatttaagttcaaccatttcattaccagcaaagaagataatgtagagttattttgctaaattaatgaagctacgacaaagtctaaaagtcaaaacaggatggaaaagaagtgaattgttccctaattataacaattctcttacaacctctaa

SEQ ID NO: 2211 - DNA, 1000 bp, mus musculus
aagtttgtttctgcctgagctcagggaaaatttgactacttctatcagattagtttccatttgaaaataaattatttctgtaatcatcaacagaacccaaaatccttttagtccttcctgaggggatattattgcactgagaagaacagagagtgtttgtgtgggggaagactggaaagacacggatagagatgatgtagggaagaaccttgagacgccttgcctccatttcttcccaggaagatgcatagtgggcatctttctttgagatcctggactaaattgccacaattgtgacaacatggtcttgaagctatagtttggctttgaggaatgaacaatacagatgtagatagcttttcagatgcttgtgaatggaaggggatagaaagtaggtcagttcacgctgctttatatatatatatatatatatatatatatatatatatatatatatatatatatatcaaggaaggtcagttcctacggttaacacttcagcaaacctatattttttctctgattgttagtgtgcacaactgtgggctacagtttcatggcaagagctgtattctatccttgttttcaaacccatatatactcagaaacacagtcattcatatatatatatatatatatatgtgtgtgtgtgtgtgtgtgccaaaatttaaagtattaaaaattatctataattttagttttaacagacattttctctctatatatatgcttaacttgacaattttccttggcacaactgctcagactaggttctctgtcttttaaaattcaaacttttttttgttttgttttgttttgtttgttttttcgtgacagggtttctctgtgtagccctggctctcctggaactcactctgtagatcaggttggccttgaactcagaaatccacttgcctctgcttcccaagggctgggattaaaggcgtgcgccaccactgccggcaaaattcaaacgttttacttcttcacagctaagggc

SEQ ID NO: 2212 - DNA, 1400 bp, mus musculus
atccaataaagcatagttaatcttcaactaaaggtggagaactgcattactaattcaattgttaccaacttaatctgtctcttaaaacatcagttgaccttgtgactggatgagtccattttttattgaacaagtaaaatgaaacttagaaaatctaatctaatttttatcaatataatttgccaaatacattcctaccttgctcaaaatgaaagccaaagtcttttgctcacaacactctccacacagtatttggatcagtgttctctttgtgattttaattgtttacaaaataaaactatttctaaactttagtaagagtaactttgtagatggaaaatgaacaataattcaagatgatagtttgcaaatatttttattttccttcataacaatgtattaatgatagaggataggtgtccctaggccagggagggctttgcctgagcatctgtgggagacatgttggttccaggactccacctagactagtctgcacagttgagagtatggactacagaagttaacagcttctgggaaaggcgggagccacagagcttctgaggcagcccccttttcgggctccagacatccgggcacattccgtgccagaggagaggtgaggtgtccgccctgctcaggagggctttgcaggagcacctgggggagccatctttgttcccagatccttctgagactagtccctgcaggtgagagtgtggactacagaatctaacagcttctgtgacagaccgaagcaacacagcttctgggaaagatcctcttttgggccttcatctttggccaggagggaggtcagaacgccagatgtctgtgtaccttccctgtaaaagaagagcttgcctgcagagagtgctctgaccactgaaacttagatgagagtgctagtctcccaggtctgctgatagaggctaacataatcaccagaggaacaatctctaaccagagacaactataacaactaactacagagattaccagatggcaaaaggcaaacataagaatcttaataacagaaaccaagactactcaccatgatcaggacccagcactcccacctcgcccagtccagggcaccccaacacacccgaaaagctagacgcagatttaaaagcatatctcatgatgctagtagaggacatcaagaaggaatttaataattcacttaaagaaatacaggagaacactgccaaacaggtagaggatcttaaagaggaagcacaaaaatcccttaaagaattgcaggaaaacactaccaaacatgtgatggaattgaataaaaccatccaaacttaaaagggaagtggacacaataaagacaacccaaagtgaggcaacactggagatagaaaccctaggaaagaaagctggaaccatag

SEQ ID NO: 2213 - DNA, 1200 bp, mus musculus
aggtaacacaatcacaaaagaaaagacatggtatgtactcactgatcagtggatattagcccaaaggcttggaatacccaagataaaactcacagactacatgaagctcaagaagaagggagaccaaagtatagatgcttcagttcttctaagaagaggaaacaaaaatactcatgggaggaaatacagagacaaagtttgaagcagcgactgaaggaagggcaatcatgaaactgtcccacctgagtatctatccaatacgcagtcaccaaaccctgacactattgtggatggcaagaagtgcttgacagaagtctgatataactgtcttctcagaggcttggtcagagtctgaacaatacagatgcttgcagcccaccattggactgagcacaaagtccctaatggaggacttcgataaaggactgaaggagctgaaggtgtttgcaaccccataggaagaaaaacaatatcaaccaacaagatccccaacccacctatagctgtcagggactaagccaccaaccaaagagtacaaatggagggacccatgggtacagcctcatatatagcagaggatggacttgttgggcatcagtgggaggagtggcccttggtcctgaggaagctagatatcctagtgtaggggaatgtgagggtggggagaccagagtgggtgggtgggtggagaatatcctcagagaaccattgggtgtggggatgggatagggggtttcaggtgtagggacgagaaaggagatagcatttgaaatgtaaataaagaacatatccaataaaaaaagaaacatacactttaagtgtaatgaccaaaggagagttgaggaataaggaaagactaggttgaagcataatactttaggctatgttcaaactttcaaactttatgctttcctcatacctctcccaagccatcatgttttatgttttttcttcagctaaatactctttcttgtttcctatgtatttgtatttgtatgtttttcaatatctacagtgtttgaaaatggagtgatttaagaaggccctcattattctacattgaataaaataaaatttgaaacttctgacagaaaaaaagagagagagagagatgacagagagagagagagagagagagagagagagagagagagagagaagaagaagaagaagaagaagaagaagaagaagaagaagaag

SEQ ID NO: 2214 - DNA, 1000 bp, mus musculus
aaaacaaaataaaaataaatatatttcatgggcctattctttctgctgttacccgatattaggaatgaggttggcacactgttatttacttccaagtatttgctcactagcagttagggattctttgatctccaaggctgctgttgcataattgatcaaagctctgaacctgacgatagagcattaagagattggattgtgaaacgtcagtccacccccttattctttgaccgtgcacgtttctagacagattgttaaacttattttaaaaagaaggaaagaaaacaattgcttgttccagtataattacaacacaacgaaaagatgttttaatagtcatctcagaggacaatttagacttacatttctgggcactctaaaatatgttaattagtatacattttttgcaataatcatgtaattagttttgtgtctttgattatgtagagaaataaagtgtccaaaccgtcattctgacaatcatctactagtgtgaaattaaatcaaacttctccaggttttaggagtttgaacattatgaataatgtatatgtcatgtcagaagaactttttcagaggtcattccaaatccttggaatttcaatgcttgctcctgctctgtgctggctgacagtggctctgaaagagagagaaatgctgtgaagcaagtgtcattctgaccccaaatactgacttctaaagtgtgtttgaggatccagcagggaaagtgagcagtggtgctagtgacacactcctcatgacattgccaagacaacattgattcaattgcctcaaccaagcttaattaagctgtggtaaaaggtgttcctggaaccactgcaatggacatatctgatctccctcatcaagcaactgggaatagtgacccacttgggaaggacagaaatgcagtggcattttgtttccctctgtttatctctctttctccttactctgtatatcaagaaagttcaatgccactgagttctcgggaagtact

SEQ ID NO: 2215 - DNA, 1400 bp, mus musculus
tatcactaaagtttaaatcacatattaaacagtaaactctcattgtggaagacttcaaaacacactctcaccaatggacatgccatcaggcattaagtgactagagaaatcctggaattaacagatgttataaaccaaacatacctagatagtgtagcaaatgttaagaaacataagtacttagcttgtataatattagacaaaagaaaatctaaactttgattatgtctttttattctttgcaatactggaaaaattcaataactcttatgactctgtataataaatatcaattttactagttggtacaaccaattaaaaaacaattaatattacatttgaaatcacataaattcattttacatgtacattggctacaaaagcatcgtatctatcttggggacattattttaaaatttgagaggtttttcttatcaatatgctttcttatgatgtcaacatattttctcattatttttttttaatttatgagggtgctcccccacttacccactcccattctcctgccctgactttcccctacactggggcattgaaccgagggcctctcttcccacaaggctatcttctgccacatatgtggacagcgccatgggtccctccatgtatattcattggttggttgtctagtccctgagagctccaggagtctggcatgttgacactcttgctccttccatggagctgcaaactctctcagctccttcagtcccttgtccaactccttccctgtggacccccgaactcagttcacgggttgactgagagcttccttctctgtatttgccaggctcttgtagagtctcgcaggagacagtagtgtcaggcttctatcagcaaacacttaccagcatccacacaacatccagatttggtggctgtatatgggatgcatcccctggtgcggcagtgtctggatggtccttttagaatatgtgtcttgccctttccagctggaaaatttgggggaattttcctgatgaagatccatccccttgtttcctatttaatatttaatagacgattactttaaatatagaaaagtgctttcttattatttttttgaatttatttaagttaactcatgatttttttagtgtatttctaagtgatagacacaatgaaggaaaatacaagtaaaaatgacactgcattgtgaaaaccaagctgatggtaaatgcattctgtgtgcccttgtatttaagatagctcaaaccaacttcatggattatacagaaaaaaactatttgaaccaaagtttagaaagcaaatacgcattaaagaaatccgagagtttgcatttttaagtaaacgaaacaagatacatttaacaatcacatagaacattctgttacatatttactgagcttacattatat

SEQ ID NO: 2216 - DNA, 1000 bp, mus musculus
tctggcaccaatgggaggggaagcctttggtcctgtgtaagggcatggaatcaacacaggaccaccctagggtgttgagccaagatgtaagggcatggagtctacacaggaccaccatagggtggtgaggcaggagtgggtggatgggtgggttggtgggagagtaaataccctcatagaaacagggtgtaggaggcaagggataggaagttttcagaggggaaatcaggaagtgtgggatcctgaacggcagcctgttttctggttgagctgagtttaaagctgggagacccagaagttgtttctgcaaaggaaggaaggtgttttccacacccccagacacaaggttcctgacaggagattctccataattctgtggccatcagtaacatagtacaacaccccaatccccggtactctgtctggactccaccctcacagtttcttggcaagagttagatatgctcctctccacagttacctgaaaacagccaggtaggccccctcctccctcctttactcttgcctctctctcttgccctcttgctcccctgaactccacattcccttcccccatccctccacttggccatgggagccctctacttttcttctctctccctctttctgcctttctctgcttctacttccctcttagctccccttcctagatgctcattgctgcaaatggtatttaaccacaggactgccctgagaaaggggtatggtttcactcatcacaactctcagccttgaccataaatgccttaaaccatggactgcctcttcccttcaggatccgaagtgctggagcaatggaccaggatttcctctaaagagctgagcatctaatattctgcaggaggtctctctgtgctctcagccatgctctcagccatggtctccaccaagccaagctaccagcctgagcatagctaagaaactctcctctcagaaggaaccagtcagagcactctcctctaacccctttcccttcagc

SEQ ID NO: 2217 - DNA, 1000 bp, mus musculus
tctcatgaacatctggaaacttttgtctcaaatgaagtgctcaaagttaagatcgagtatccaaaatggtatttacataattcacaatctggtacccaattcatacttcttcaagtaaggcctcacctgctaattctgcacaaagcaaatgaatagacaccaagttttcaaattcaagcaaaatgtagcaagcatctcactcacaatatttttatatagttattgaacccattggatgcccaatgtagatagttaagactgatctcagaccatctgcaagaacagctagcactttaacccttggatatagttcttaaaccttaatttaagaaaggtaaaaacaagaagaaaggcccaagaaagaatgcttgaatttcgtttagaagaggaaataaattactcataggaggcagttggagggatggaacttgatgatgagaaagggaggagaatgaggggaggtgaagggattaggtgtggtgagatacaggagaaagaaccacagtgccaaaagagagaatgcagtgaagggctgggaacatctcagagacttgccaaaagtttggggtaggagaggttcctaggagtcaaaaagggtggcaatagctcacattagatctaatctcatattagattcacatagtagtagtgatgtgaaaactgaagaggctacctgatggagccaggcagaacccccagtggaaagaaaaggataccaactcacacatacatctgtctacccaaaatttgttctttctacaagaaattgctagagccagcttgttagacagtgtgggaaccctggctgggcaaatgaggttgattatacaaaaggtaaaaagaagatgcaagaaacagctatgggaatgttgctggttaataccatgctagtgagcaagtatattttcttagtatattttaaagacaaccatcacaaagcaggatcaattccagaaagataaacagtgacaataaatgaaatgctacatggcaagcttat

SEQ ID NO: 2218 - DNA, 1000 bp, mus musculus
gcttttattctttgagacacatgttcagccccttaatattccaatcctagtaaaagactacactttcgcaaaacaaaagcaaaagcaaaagcaaaaacaaaaacaaacaaacaaacaaaaattaaggcttatctcaaagtacctattttttgagattaatattaactgcaatgaatataataaattttgttttttaatttctttagggaacataaattcacgttagattaagataccattctacctcagagtgagtcccgttaaaagaacaggtagtaagaagaataaggaagggtgtagaataacaggaatttcagatactgttgttgatcaagcagagtgacatttatttatgatgtataatctaggataaattgtgttactacatttatttatatatttaactaaacaacattatggattggctaagccatcaagatactgaaaggtctatagtttccaagggttatccagtagaaatgataaatgaagaaatggattctgtagagcactgagaacacgctgtataatgttttgatggcaggttcaggtcgtggtctgcttgaataaatgtcctgaataaacagtaagaatgaaatctgataccaactcttggtgctgagtgatgatgatataccatggcagactgactcatcaattgggacacatgtccctatccaatgagggttttgataatgaaaaaggttatgcaaagaaggatgagagtacacagggactgactaattacaaagaatattacaaagtgaacataaatgccaggcagtggtggaacacgcctttaatcccagcacttggggggcagaggcaggtagatctttgtgagtttgagaacagcctggtctacatagtaagtctctggacagctgaaagtacacagagaaaccctgtccaacaagaacaaaagcatacaaacaaataaaacaataaagtaaaacaaataccaaaattgaagtataaagattacatattggaaaataaa

SEQ ID NO: 2219 - DNA, 1400 bp, mus musculus
ataaatctgcacaatcttctttataggagaagaaaaagaggataaattgatgaatgaacagatatatgagcacataactaataaatacttatttgaagaaatgaattgtatattccacatttacttattcttttttattgttttgcaaatctgatgatagaaatgaatagatacatgaatgttataaattccaaaatctattgtatttgttgatatctggagcaacagaaatagatgaatgcttcagaaaaaaaatcagtctgaaatacaaacagaatctgcattagaaaatgtaagtattaaatttaataactttaaaccgtggataagaagagaacatttcaaaccaagagtatgtgagattaacattgattggtgatttatttattcattcattcattcatttatttacatcccaaattttgccccttccccatctcccccttgaggagttcttctcttatcacctgttctctttgtctctaagatagcaacatctctgtatccccaaaccctgaggaatcaaatctctgcaggtgcatatcttccactgagtccagacaaaggagccttcttctacttatgtgccagggacctctgaccagcccttgtatgctctttggttgctggctcagtctctgttggtcttcctgtgtaattagcatccccttgaggaccttcaattcttcccctaactcttccataaaggtcaacaaactccatctaatgtttgtgtgtgggtatctgcatatatcttagtcatatgccaggtagagcttctcagagggtatgcaattcctcttaattcttctaacactgtcaaaatcctggtttctaagcattcaagtattttcacttttggggagtattcttagttaaactaccacacccaccccacaacactatgccactattgcacaagtgcctatgaaagctcaaaccagaccaaatactaccaaagacaacatagatgcaattgaagccctttccctggctgaagagtttgtggcaattgaactcttgggagagggaggaccagtttttagtaaaatttagaccatggcaagtttagtgaaatcatactctagtgaaaggccacacaacccaaaatatatgagaagtacaagttacatttattaaatttttgaaaagctataaagttgggtatgtaaggaaggtgaaatgaatctttgaggagttagaggtaaatatcaaactatattgtataaaattgtcaaagatagatatagatatgtagaaagtaaattattttagaatgctatgtagataacaccactaataaaagtatttacattaagaaattttaaaatattttactgaaagcaaagttccaagagataatacatccatttatattttcttttagttctcattcacca

SEQ ID NO: 2220 - DNA, 1400 bp, mus musculus
atttactactaggatgctatatccattttttattcatttttatcatttgttatccatatccatttatttattaacatttaatatattgtaaatatgaactatttgtttatcatatctattttaaataattttgtagagatttttgtttgaggtataattaatgatagctcagtggattaaaattttttatttaaaaaaattcgtattatcaccatttccctaatgatacagtgttttgcaatgtgtatatgttgtttaatttgggaagtaatatgactgtgttttcttccatatcttttattaattttcataaaatttaacatcatttattaaactcaattttttcctattttctgaggtaacctcaggaaatagggggttggggggaccctccagaatgcaccagagtcctgggaggtagaagactctcaagaatgaaagggagggaccttagataaaatgcatgagaataggcagaaggaacttacagaccccacatccagcaggaagacagggcatcaagtgagcgatggggttgccatcccacagtcacatatctgacccataattgttccattcttaaagaattacaagggttgaaggggagaggagcttgaggaaaagaaggtccagcgacaggcccaaagatggaaccagctcaaatggaggtcccaagacctgacactattattgaggctatggggcactcacaaaaagggacctagcatgaccacattatggaagacccaacaagtagctgaaagagtcagattcagatatttgcacccaactaatggacagggaagcttcagaccactgtggttgagttagggaaggctgaaagaagctgaagagaaggacaatcctgtaggaagaccagcaggctcaattaatctgaacccctgagatctttcaaacactggggcaccaaacagccagcatacccacctgatatgatgtccccaacacacatacagtagaggactgctgggtctgtgttcattcagagatgaagtgcctaaccctcaagagactggaggccctagggagtttagaagtaagttagagtagggggtggggacatccacgtggagtacagggatggggaggaggtgtgggatgtggagcagttgaaggttggatgggggcatggagaataaaatatggagtgtaaaaaagtaaattaaaaaaaaaaacctccctatttcagagaaattttttttaaatgatgctggagaatttgaaagttgtttacaggggcctgttgctctctggcttctgggtcaaaataagtacaggtcctataggcttcaagtagacattttagatagtccttggagcactcattcttttcctgcatcatctggctcacctaaaataaatttgtgagctctctgacg

SEQ ID NO: 2221 - DNA, 1400 bp, mus musculus
aatacataaccttaaatttagaaatagggaaaataggtacttgaaaagatgatagttattctgaatagaagagaatttatagttctaaggtcaaggaaaggctgaagaatttagagcataatacagagagaatgttgtagaataattagttttacagatggctaatattatataaaatataagaatattcagaatgttttaagagtgagattaaaaaaaatcctcaaaggtcggcaacagagttcataatgtaatggaatttctcatagagcttaatgacttgagtttaaaccctgaaaacctataaagcaggagaggaaaatcatctctttcaaggtatcctctgaccaacaaaggaactacatggcatagatgtttctatatatacacaaaagcacacacatacactaacacagacaaaataaaacactatcaatatctatctatatctatatctatctgtctatctctatctctatatctataatctctatctctatctacttatctatctatctatctatctatctatctatctatctatctatctatctatctatctatctattgtacactccagatttttattcccctcctggtccaccctccaactattccacatcccaaacctcctccctgtccccctgcctccatgaggatgtccccatcctactagacctctaaactccctggagccaccagtctcttgagggttaggtgaatcttctttgactaaacccagacccagcagtcctctactatatttgtgttggggacctcatctcagctggtgtatgctgcctgtttggtgatgcagtgtttgagagacctcagggatttagattaactgagactgctagtcctcctacagggtcaccctcctcctcagcttcttccagcttttccctaatttaaccacaggggccagcattatttccttttgaaaaataattaaagttggaatataactaaattttattttctgcaacttcacaatgtggaataaatttagtaataattaaaaattctatcaaagtcaagaaaaaaatcttattttatgtctgaaaattgacatttagaaatttatgtatagtgctgggtttacttgagtatagagtatagattgaaacttggactaagcagatcaatgttttacttgcttagacacaaatactaatgttgttttgaacttaaaatggcttattttccccctgatgctctaaaaatatacggtcagctacccagttagaaatgtaagagtaaaaaaaaaaaaaaaaaaaaaaaaaaaattagtagaaatttgagagagggtgtgtgaaatcatgacatttagaaaaattgtaggaagtctattaacaggatatagaaaatggcataaatcccaaatgataatctagtat

SEQ ID NO: 2222 - DNA, 1000 bp, mus musculus
tccacagaggactctccatgcgatcttaggacctttgatgattgcatcaaacttctgttccaatccaattgcgcaggacctgagacagcattaaatagggaagcagaaaacccagcctgaccagggtcacaagtcccttcagttcggtgccaggaccgggtcattgggcacagagtccgcggacatccccaaggtccccagaggactctccatgggatcttaggacctgtggtgagtggaacacaacttctgccaggaggcaggttctaaggccagatatctgggcaccttccctgcaagaggagagcttacctgcagagagttatctgaccactgaaactaaggatagatctagtctcccaggtctgctgatagagggtaacataatcactagaagtgcaagctctaacaagagacaactataacaactaattccagagattaccagatggtgaaaggcagaagtaagaatcttactaacagaaaccaagaccactcagaacgcagcactcccacctgacccagtcctgggcaccccaacacaccggaaaagatagacccagatttaaaagcatatctcattttgatggtagaggacatcaagaaggactttaataactcacttaaagaaatacagaagatataagatacaatttgcaaaacacatgaaactgaagaagaacgaagaccaagtgtggacactttgccccttcttagaattgggaacaaaacacccattgaaggaattacagagacaaagtttggagctgagacaaaaggatgtaccatctagagactgccatatccagggatccatcccataatcaccattgcatacactagcaagattttgctaaaaggaccctgatatcgatgtctcttgtgagactatgaaggggcctagcaaacacagaagtagatgctcacagtcaactattggatggatcacagggcccccaatggaggagctagagaaagtacccaaggagctaaaggtacc

SEQ ID NO: 2223 - DNA, 1400 bp, mus musculus
ccttgatttggttacaatttatttcagaagatgaaggtggggctgtgagtggcattgacatccactgaaccctcccaaaggtttttcttatacttgagaatataactacagagcaataaggggattctgaataatatatcccataaaaaaaaactattactccacttcacaagattttagtgcttgctctaaaaagtacagatatgctcagtaccttacttttaattttcaaatagcttccagggaatttaggtagagtagataataaaaaggtaagatagtgtggggctgtgataggcagcctattttggtagaatggggcttgctccggagacccagtagagaactgtacaacggacagaaaagcgagccactctcccagagccaggtgcctgataccacagagcccccacctccataattctgtgactttaaatcaagcagacaatgtcccaagcttcaggcattctggctagactccacccccacagttacctgactatagccaggtatgctcctccccacagttacctggaaacagcaagatagctcagcccactataagaggagctgcttggcccctcctcactcactttaagccttcatctttcttactctcttctgtagccctttctctctctccctcctttcccccctctctccatgtgaccatggccagcctctctttttctaccttctctccttctccctgtctttcaacaataacgctctaaaaccatagactgtcactgctcatcaaggctcaccgtgcttgaaagatgggataggctttctcctaatgagctgggtttaacctcccaccagaaggacttcctgcactccaaccacagatgggaccaaggactctcccccatgtgggaaccatcaagcaccttctccccttgacctctcctcgcttcagcccctgggctcaatgccgccccgggggagggggggcccattctgttctcagctcttccactgtatccagtgtgggatgctggaagctgggaacctggtgcctaggactgcaccttgtccaccaccctctgagctgggatcagtggcttcccacagccagacacccacctggggctgcatggaaagcttgcagaactccccctgtgtccacctgcccagagcaccagaattctggcaggatgcgggttttctcccaatccctctttctcctatacctacagccctacaagataacacatgaaagaggatgaaatagacatgttaaaggatactttttaaatccttctaatgaatattgccagtttccaggttatttcatctaatttctgactcagaaagaggatgacagagattcagactaaataaaatatttcaattatagtaattggcatgtagccatttaagaagaacttttggta

SEQ ID NO: 2224 - DNA, 1000 bp, mus musculus
caattctttctatgaagccacaattactctgatacctaaaccatacaaagaggacttcagaccaaatttccttatgaataccgatgcaaaaatactcaataaaattctcacaaaccaaatccaagaacacatcaaaacggtcatccgtcatgataaagtaggcttcattcctgggatgcagggatggttcaacatatggatattcatcaacataatccacaatataaacaaactcaaagacaaaaacctcattagatgctgagaaagcatcgggcaaaatccaacacccattcatgataaaagttgttgaaagattaggaattcaaggcacatacctaaatataataaaagcagcatccaacaaatcagtagccaacaaagaagggcaaacaaaatacccatggctggagttacagggacaaagtgtgaagcagagactgaagaactgaccatacatagactgaccctcttggagatccaacccatagacaaccaccaaactcagacactattgtggatgccaacaagagcttgctggcaggagcctgatatagctgtctcctgagaggctctgcaagtgcctgacaaatacagaagtggatgctcacagccatccattgaatggagtacagggtccccaatgaaggagctagagaaagtatccaaggagctgaaagggtttgcagttcagtaggaggaataacaatatgaatttaacagtatctccagagttccctgggactaaaccaccaaccaaagaaaacacatggtgggactcatggctctagctgtgtatgtagcagaagatggtctagttattcatcaatgggaggagaggcccttggtcctgtgaatgctgtatgcctcagtataggagactgccagggccaggaagtggtagtgtgtaggtttgtgagcagggggaggggggaggggataggtggtttttggagttgaaataggtaagaggataacatttgaaatgtaaataaaaaaaata

SEQ ID NO: 2225 - DNA, 1200 bp, mus musculus
tcaagcttaaaattgaatttatttatttatttatttattcattcattcatttattcattcattcattcattcattcaatttacattccagccattgccctcttctggttcccccccccccaaagttcctcatcccattcctcctcctccttgtctctgagagagtgctcccctcaccagacctccctcttacctgtggcttcaagtctcctaagaaataagttcatcttctcccactaagtccaggcaaggcagagctctgctatctatgtgcctatgccattgaagtagcccctgtatgctgcctggtggtggctcagtctcagggagctcacagggttctgagttatttgaggctgctgttcttcatatggggttgctattgccttcagctttttcaatccttcccctaattcaaccacagaagtccctgatttcagtccaatgcttgggtgtatgtatctgcatctatctatcacggtcacctgctgggtaggcctcttggaggacaggcatgtcagacttctgtctgtaaatacatcatagcatcagtaatagtgtcaggccttggtgccctcccccagcacccatgagatggatcccaatttggactggtcactggctttccttttaggcaggatcaattctcagtcagaaattctgactgtgggttagtaaccctgtcactccacttgaggtggactctacaagttttttggagcctaagttcttgagttctttatatattttagatattagccctctttcagatgtaggttagtgaagttttttcccctatctgtaggttgctgatttgttctattgacaatgtttttttttttttgttttttttttttgtttgtttttttttttgccatacagaagcttttcagttttatgaggtcccatttgtaaattgttggtctaaaagtgtgggtcattggtgttctggtcaggaacccaccctgccccccagcccccaccccatgccaatgagttcgaaaatctttcccactttcttttctattaggttcagtgtttctggttttatgttgaagtccttgatgcacttggacatgtactttgtgcaaggtgagaaatatgggtctattttcattcttctacatacagaccaccagatagactagtataatttattgaatatgctttttttcctccacaccatctgtttttagcttct

SEQ ID NO: 2226 - DNA, 1600 bp, mus musculus
gagaggctgcaaaccgtcataggccgcctccaaagcacaggagccaagaggcctcaacccagacagacgatgatggtctccttcatcaccgagctcaagagccccagccaacaaggacagccaggacccactggggctgcctctgcccaaaatgcccacagtcttcctgaggctcctgcccatcctccagcccagagggcttcctgccttctccttggagaaagaggcaccaagaagggccctgctaaaagatctgctcctctcatggccaaggccctgaaggactacagaaagtgcttctataaaaggtgaaccccagatgatttccatcaccagaaaacctgcaactcctgagacttggactgactggacacacaggtgcttccctccagggactgccacatggtacaccctgggtttagggctccgggcagacttcccagcagctaatcttggcattctcactggacttctttacacagttttccacaccttaacttttgtcccatgtcaattctcaaaacatcttcaaaaataaatcaatatctctcccacaatcaactttgtgggtttgtctctacattacttgtgaaggattgatacccatggacatagatacagtttagcagttggacaaagagactaacagtctgcctgctgacagttttgcaaagacgcatgtaggatcgtagatggtagaagagatacctagagtcacaaagagaagtaggcacatcaatatgtttgtggaagtctggcagtagacttgatatcagtgcccacaaaccagtaggaatcaaggcagtttgtgtgtgtgtgtgcctgtgtgtgtgggggggaatgtgcatgtatatgtgtgtgcatgcatgccctcatgtgtgtgtattttttatgggtatgtgtctgtgagtgtgttcatgtgtgtgtgtggtacaactatttgtatgtgtgtgatgaagaaaaggaaagttacacgagtacagagaggcagagagagagagagagagagagagagagagagagagagagagagagagagagaaataacttgcctataggattgagaacaaaactgatccaaagttcccagacattgtctctcattagggtaagagctcagatggattggcacttaaaattaaagtatgctttagagggtcctagggatgcaagcaaggtcacatgttggtgtcagcaaaagccaaggagaaaaccagcagtatacccactaattgtaaagtgagtattgggtaatcacacatagtgtgtaaaggagagacagaaaagagagataaaacattgatagtgagaaaaagttagacaggcatgagccagagaagcaggcaaaggtccaatgagaatgaattcaaggcagggtacagataaccctagacacagagacacagaatcccatctacaaccctgaaatgccaaggtgtggctgtgcacctggttctatgcacctgtgtggacttccattggctacaaggttgtgggaagaagcagcaagaggctttcagcaaacaggtgcctccaataagttttcctacaaaggaaaggactttgccctaaggaggttcagtgggtggaggtcacatgg

SEQ ID NO: 2227 - DNA, 1600 bp, mus musculus
tggccggtcgtgagaacgcgtccaataacaggcctcctttaacataggtctctgtcttgcccatgagattttcccctacctcctcacccccatcaattgcagatttccatttattttcatggccaccagctatctctcttgtccttccccacacctgagaaccccctttctcctcccatgcccctcccgtttccttactttcatctgcctcttatgagtattttcttccctcttctaagtgagatccaatcttccttgctttggccttccttcctgtttaccttctttgggcctgtagagtgtagcagggtaactgtatataccattcctttgatttgggatatggatttcttcactcaggattatattctcaaattctttccatttgcctgcaaaattccttgtgtgtttctttttaataacggaacagtatttcattgtgtagatgtatctcattttctttattcattcttcagttgagggacatctaggttgtttacagtttctgggtattatgaataaagctgatatgaacatagttgaacaagtgtctttgtgtgatattggtgtatcttttgagtatatgtctagaagtgatacagctgtgtcttctataaaaagaattgttaaccctttggctgcttggaaaattcatctttgcattgtccctcggcagtgttccttgttcactgcagccacattcaccacccacaacctcttcaaatgtagactcctgcagctttctctccagagtccttgaacccaactaattcttcacttgctgcatcaggccactgacatgccccaccatgccagatagggcagtagacaccggctcagagatcactatcgaggacttaaaggaggagaaagaagttgtggaggaggcagagaatggaagagaagaacctgccaatgggaatggtgattaggaaaatggggagcaggatgctgacaatgaggtagatgtagaagaggaagaaggtggtgaggaagttgagaagaaaaatgaggaaactgaggcttgacgggaagcaggtagctaaggatgatgaggatgaggatgttgacaggaagaggtagaagactgatgagggatcactacacagtaagaggaagagctaaccttattatgcactgtgacctactcactctttgctttctgtctcagaatttaaatctgtacaccttcaagcagagaagcaagtcctgcttgtttctactttctatttgtttttcctcaaatttcaattgatcaaagttcttcaaattctataaaataaatatactaccttgtagaaattataaattcttgaagatttaaatggttttaatttttaataaataaataatttttaaaatttatttatttcttaatattcagatactgcaaactttacatcagtaaatacaatcacctgggtatagtttttataggaaaaaatattttgatactaattataaaaaggggaaaaggaaaatgttctttagatctgcataccataataagttttagaggagatatattttaatttttaaaaacttgcccattttgctaacatacagcttaaatattaatatcaaaaacagaccctgcaca

SEQ ID NO: 2228 - DNA, 1000 bp, mus musculus
atataaatttcccaggagtcatttatagagcacatttattgtacagttcctaatacacaaataattctgaggcactgtggtggagaaagagtagagtccaaaagggaagatgcaagttagtccttacaaaattacatctagagacttggattgtggctaggctatgtgagtgcttctctaccatactcaaagccttgagttcagtccatagcaacacataaactaggggtggtggttcacattagcacctgggatgtgtaagcatcagaacttcaaggtcatactgagatacattaagagcttggctcaacctaatcttcatgagagagtgtttcaaagacagtaacaacaacaacaacaacaaaatggaaatcacatctgattttaaaattattcaataatgagcatcactttaccccaatgccttaatgcatcctagcattaactaccaccttctgcagtcaaaagcttctctgacagtgacctagttccttcataccttcaccttcagcctttccttttagcccatatccattcgtttgtgacacctactactcagagtgctactttctgccaaggacccagtagccacattaggcattaacccagagtaggcaacagcaaccaaagaacacaacacatatttaacaaagatgagaccagaaatgtatgccaagaagccccgtcatatgtcataagtgtagatacctagatctcagggcaaaaccaaagcatgaccaaccaacacagtatgccttctccaaatgccagcaaccctattgcaatcatccctgagtaaagcagttttgctgaagcacaaaacaaggacttcaaatggcagtcacaactatgttcaaggacattaaggaagttataaataaatgtgttagtggaaactataaatattcagttgaatggaataatgaaaacatgaaagtagaatataaaaaatacttagaatcactaaagaaaatccaaaatttaataactggaaatggat

SEQ ID NO: 2229 - DNA, 1000 bp, mus musculus
acacacacacacacacacacacatatgaaaaaatatatggattcaacctgacaagtccattttgtgttgcttgtatgtatatgatggtaaagctgatcactcagtgccggggaccatggcctcagccatggccttgtggatattttctagcttacataaataatcctgagagaacattcatgatcataagagtaagaatgtttgaggacactgggaccgttggttccaggagctgaagattgccacctgaccttcggggagcctaccccctcaaactctcccccctcccttgaaacctcctcttgcttacgcttatattgccactgctgaataaagtttttaagagcttgatcaggaaattgacttgctctcattcttcatgtttcttgtccctcccacacactctctctctctcctgccctgggtccccactgattatccctgaggtcgggacaactcagtgttagggaaataattttagggctcattcttagaaaagactaactctccctctcttagcactcattaattgcctgtagttgttcacctaggggtggagatacacttgcgctggggtgccagctgttggcactagtagtttgggtattatttatgcagccctactcttaagatatgaaggatagaattctgtcatttctaggaaacaaaatctcacagcagagttccgggtcctctgtcccctacaggctttctgacccctcttccatgatgttccccaagccttagttgtagaggttgtgttgtaggtatgtaggttagtttcactgagagccccattttaaccaacaaagttacggctttttgccatggtttccatctgcttcaaaaacaagtttctctaatgaggggtgatagctacatttaaagacaagtattaaaatgaagttagggattacttcaggacagtggcagtagtagggtctcattacgctgagatttctttgaactcttaagaattttacctctgcatataatttac

SEQ ID NO: 2230 - DNA, 1000 bp, mus musculus
caaacaaacaaaaacagtctccagaaaaacatcacatgacacaactgggtctccaaccagatcagaaatttccacttcatgggtctcctaacagtgggagcaggagctgtctctgactctgttgcctgttttggggatcctcttcccctactgggttgtcttgtctagcctcaaaaggagatgtgcctagtctcactgcaagttgatatgccaaggttggttgatatccacgggaggcctctcctgttctggaggcaggagtggatgagggaggaaggagagagggaaggactgggaggagaggatggaggggaaactgtggtcaggatgtaaagttaattaattaattaattggcaagaatacttgttaattagttaatagactgtaactaattttatattcaaaatactcaaaactagttatactatcccaaattaagtcccaccctagtgactatgatgtgtacaaataccactccaagttcaacctcatccctgaacatctcagagatggttgaaaggctttggagtagcacgtcaacttgtgagatgttttattgctcttgatttctttacaaaggtgctgtcatcgaacacacttacagtcacaaagctaaagaaaccaaactggcatcctggaggctgaggcaaggggatagggagcttgaggccagcctgggctacagagagagacccggtttcaaaataacaggtcctgttatctacagaactcgctatctagaatacattctgttcttagtcgaaatgagacgcggaatctttcagcatgggcttaccacagtccttggcactctctagacacacctcgactgataatttctgcctttgacccgacacctgactttctcctcaatgtcttcctcagtgtacagatcagcctgacatctctaggtacctagcattagaaatttgtcaaacagacccaggctcagcttaagaccaccccagtgagccttagcctctccatcaggcacctgcc

SEQ ID NO: 2231 - DNA, 1200 bp, mus musculus
tatgttgctaattattttctttctgaaatccattttacagcctccatggttaaagtttattaccctctttcatatatagacatgtaaagatcagaaaaagataaagagaatgtgaaatttttaaaccttccttaatctggaaataatattgaaaaattccatactgaccctcactttgacactaattgaatttcagtttctacctgtaaatgcaaatagtaattggggtttgtgagttttgtttttttaaatcatgggcaagttgtttaaaaaaaaaaaaacaaaaagaaaaacaaccactggagcaaatactgaaatttgataataaatgcattaaatactaattaaaataaaaaacaaaaatgacatgcatgctctcttatcctattccaattggcattccaattttaactgtaaaatcaaagtgctttgtagtagtcacatcaaaaacatacagatgtactctggtatatttgccaagcattcttttaatgatcataaaatattttataagcgtaatgcctcggccatcagcatctattcgtcaattaaaagttgatattaactttgtttacaaaacaaggcgagcaacttgggagcatcaccatgacacctgtagaaggggtagagcattagggtgtcacagcgacccaggaagagcatgaactgatgcttgtaaagtttagagggagggacttcagcacagcagttcctggggctgctgggatagagtaccgaatgtgtacatttgcttcagcaaatgtcacggaaatttttcccgaataaaattactatgcttattaaattaatggttagtttgagaacaatattaaagcctgattagaatgaaagcctgagaggaaaaaaaatcttcaaataatagctcatattgagaagaatatatttccacccatggggtttaattttcataaacgaatttaaatgctaagcagccgagtttcatattaacttcttaaaaccaggggcagtttgaatcctccatttgcatgtctattaaataaaacaaactaagataaaggaatataaacacaacaaagatacaggaacaagaaacaaagcaaagtcatagctgctaggttcagaaaagatatttgtaacagctctctaatattattctgtttaatattatcctgaatttcaagtgaaagaagatacacatgtgatttccccattgcctga

SEQ ID NO: 2232 - DNA, 1000 bp, mus musculus
agttctctggtgattctggacctgcagtgaggcagaataatatgaccttggatcctttagagcggctactcatcttacagtaaaaaggaaacagagataggaaggggccactaaccaagaataacaataaaaggcctaaccagggttacctacttcctccaactaagactcacctctccgtttctaccgactctagcacagctccaccactgaggatgcagtgttcagtgcaggagccagtggagggtaacagctggcgggcagcaaactccagcaatcctcctgcctcagcctcccagtgctctgggtttacaggtatatacaaaatcacattggacttcttgtagggatgctagagatcatatttaatgcctcaataacaccccaagcacgtttactagctaagtcatttcctcacccccacctgttttgtattttatctaaacaccgttgcccaaatttacttgtaaaacatctgctttaagcatattgtttattttgaacttacccttgatagcactgtttattttaatgtcatctcgattttatagatgagttttatttgtttactgtacatgttatcattttctagtgatgatttatcacaaatcatcaagttaaaatgttaatgaaatagtactccatcttaaggtccattattgctagctttttaaattttaattaattaattaactaactttttgtttgtgagacagagtttccttttgaggccatggctgtcctgaaactcattttgtatatcaggctggcctcaaactaatggatccatctgcctctgcttcctgagttctgggatttttacttaagtatacttatctgttttagtctatgccaagtgtgtatgggggcttgcagaggccagaaaaaggcaatggttcctttagagctttgggggatgggacgctgtgtattgcttgccatctatgctgagaactccactcaggtgctctggaagagcaacaagcacttttactcagtg

SEQ ID NO: 2233 - DNA, 1400 bp, mus musculus
actggacatagtactaccagaggatccagcaacacctctcctgggcatatatccagaagatgttccaaccggtaagaaggacacatgctccactatgttcataacagccttatttataatagccagagctggaaagaacccagatgtccctcaacagagggatggatacagacaatgtggtacatttacacaatggagtactactcagctattaaaaagaatgaatttatgaaattcctaggcaaatggatggacctggagggcatcatcctgagtgaggtaacccaatcacaaaagaactcacacgatatgtactcactgataagtggatattagcccagaaacgtagactatccaagatacaagatataatttgcaaaacacatgaaattcaagaagaatgaagaccaaagtgtggacactttgccccttcttagaattgggaacaaaacacccatggaagaagttacagagacaaagtttggagctgagatgaaagaaaggaccatctagagactgccatatcagggggatccatcccataatcagcctccaaacgctgacaccattgcatacactagcaagattttgctgaaagcacccagatatagctgtctcttgtgagactatgctggggcctagcaaacacagaagtggatgctcacagtcagctattggatggatcacagggcccccaatggaggagctagagaaagtacccaaggagctaaaggggtctgcaaccctataggtggaacaacaatatgaactaaccagtacccctggagctcgtgtctctagctgcatatgtatcagaagatggccttgtctgccatcagtggaaagagaggcccgttggttgtggaaactttatatgcctcagtacaggggaatgccagggccaggaattgggagtgggtgggtaggggagtagggcgggtgggtatggcagacttttgggatagcattggaaatgtaaatgaaaaaatacctaattaaaaaaattaacattaaaaaaagaaagaaaatagacctttatgactgaaactgataccttttttaaaggatagtgcattttatgcttttatccaacacacaaatagtatattcttattttctcaatcttttatgtttttaaatattgttattaaacaaagcacttgtgaaatttcacgcaacagatatatcattatattatgacataaagatttttttaaataacatacatttatacatagcacaaaggaagtatagacactttgccaacacgaaagccattgtcatttccactacaaaattcttggagtaagaacattattatttagcaaaaagcttataaggaacacaatttaaaaggaagtaaagtatccatggctcaagaaagtttttgttacaataca

SEQ ID NO: 2234 - DNA, 1400 bp, mus musculus
tttggtgttcatgaggtcccccaacaactggaactgggctatccctgtgcctgttctgtatatctcactcccctaaatagaccactttatctggcctcagagggagagggtgagcagcgagttaatgtgtggggacaaagtgggtgttatgaggatgcctctgcttttcaagaaagaaggggaaggaggaatgtggaagagaacttgtgtgagggagtattgggaggagaagggctactaatattaggttcagaattaattcttcatagagttagaaagagcaatttccacattcaactggaataacaaaaaaacccatgatactgaaaactattctcaacaataaaaataacttctgggggaatcaccatccctgaacttaagctatactacagagcagtactaataaaaatttgcatggtattggtacagcgacagacaagtaaatcaatggaatacaattgaagacccaaaaatgaacccacacacctatggccacttgatctttgaaaaaggagctaaaaacatctagtgggaaaaaaagacagcattttcaacaaatggtgctggctcaactggcagttagcatgtagaagaatgcaaattgattcattcttatttccttgaacaaagctcaagtccaagttgatcaaggacctccagataaaaccagatacattaaaaataatagaaaggtaagtgggaaagaggggcaagaacttggtgcaaccagttccacagaccacggagcaagctccactcccacatccaggatcgtaggatcagggataaggaaaacagaacatctgttccaacactacctggtgtaactgggaccagtagcatccagggacacaggaatcccaatggcttgggttccttcaggtctgagcaggtctaccttgcaaaacctcgatggccaatccacagccccagaggaggctgcactcccaggtgctatagaaataccaaaaccccaggatcccatgagcttggtcacaccaatatctcagggtctcagatgcagtttgactcctaggaactcttacacacccagaatctcaggatcacaggatcctaggatcacaggttcagagaaacagctgcactctgaggagttctgactcaagcaggattataggaaggacagggtccagtcagatatagtgagggcagggagcactacagatatcatatggtaagaggcaagcttaagaacataagcaacaaaaacaaaggttacttggcatcatcagaacccaattcttccaccatagcaagtcccagatacaccatcacacccgaaaagcaagatatgtatctaaagtcacatctcatgatgatgatggaggactttaagaaggacataaataactccctcaagaaatacaggaaaacat

SEQ ID NO: 2235 - DNA, 1000 bp, mus musculus
aagatggggtagaaagattgtaggagccagaggatcagtgatttgctgtgggaatgtttctcctagtaatgacagaagttccacccataaagtctaaccttcctgaaaagtaagtgaaaaatacaaaaaaaaaatgtatataataaaatgaaagcatagtcaaatttatcacattacctaaattggcagaaatggagttattcaaaaccattccacagtaatatgcagaggaagactgtgtggctaggggagagggaggataatggggaggcaggatcaggtgtagggagagataggagagaggcccatagggccaggagaatgaatggaaatatgcagctgccaggatttgaagggaaggtggaaaggagaatatgagaaagtcccagatacatgggataggggaagctcccaggagtaatgcaggtgaccttggccaaggtgcctaacagttgggacatggaacctaaagagaccgcctcctgtagtcaggcaggacccccaatagagcaataaggacaacagcctacccacaaaactttcgaccccaaatttgtcctgtctaaaagaaatgcagggatggagcagagtctgaaagaaatgcccaccattaatcagttcaactcaaaacccatcccatgggcaagcaccagtctctgacattttaatgatactctgttatgcttgcaataggagcctatcataatggtcccctgagaagctctacctagcagcagactgatacagatgcagatacccacagcccaacattggacagaggttgggaaaaccaaaggaagagttgggtgaagtaaaaggccctgaaggagaagggaacaccaaatgaaggacaacagagtcaactaacttggacccctgggggctctcaaattggagctacctaccaagaacatacatgggttggaacgaggccttggcacatatgtagcagacatgtagctcagtctctaatgacatgtcatttatgtgaatgaatgaa

SEQ ID NO: 2236 - DNA, 1000 bp, mus musculus
tttattatcactatgctctttatgtctgtatctggaatacagtttttttccttagtatttgtgtttgttttgttttgttttgttttgttttctatcacagcatctagcctcccaagcatcagcatttaactgaggcttgtgagatattgaagaatgtgagtcattgggctatgcatagacagcctggtttccagttgaggctagatgttgaaccccagtaccgggtggtgataattcacctacatgggatggaaggagttttctcatgtctcctgtaaccctagcccctgtcgaagttaccatcccctaagcccctaaaagataagcatggttaatagtcacatctgcaatgtcccaagcttctgaccttcaggctaaactcctccccagttacctagcaacagtaaagataacacaataccataagaaggactgcttggccccacctagctttcttgctcttactcctcttaatctccttactctcctctcctctcctctcctctcctctcctctcctctcctctcactctcttcctctctccccccttattctctagcctttcttttctctttctcctttccccctttctctcctcttggccatggctggcctctctctctaccttctctctttccccctgcctttctacaataaagctctaaacccatagactatctcctagactcaaggcccactgcacttactctcacctgcatgggaacctcttttcctaagccctttctcccataaccccggggctacagggtgtagcccgggggtcccctggtgtctggggccgccccttgtccatgtcccatcaagtggcttagatgccccccccaacccagggctgagtggaaagcttctggcagccatcccacatcttcctgcccagagcataggaggaactctggcctgacatgggctatcctcactccccactctttcccctgcaccttttagttcccacagaagactagttaggaaacaagagctc

SEQ ID NO: 2237 - DNA, 1200 bp, mus musculus
gcagtgtatttcccttctcaaagtccatgaaacctagttttcttaaattttagtagagatgtgacatagctgtttactaattagtaatcacaaatctaggcatattaatgtcaattacactaaatttttttttcctgaagttgtggcttttaatacataaccaagaaaagtacttaactgtagattcacacatacccaattcacatattaagaattgacagaaaattttcaacacaagagatggtgaaattctggtctgtatacagggtgctatctgctgctatccgaggggtacaggctcagcctgagcagccagagttgcagctctctgaggggaatcttgagcaaggtagactgctgggcctcttccttggctagtgctgccccagagttggcggcaggtggcaatacacagtgagtagctaggggccaagatcggggccaacaagcaggaagtggctgtggtcaagcgcatgaacccagctggttgggcctggtagaggtccagcaatgaaagcttccagagagaaaattcttcactgcagtgttacagctcaataagacaggcactctcagatgatctttagtgaaataactccctttcagggtgggttgggacgtagaggcagatgccttctgttgcttggtgtgaggtgttacggatacctcatctacatgtggaagcacttctggtgtttgatctaatcagtggaggcatacatagccctggatgctctgccaccttattcaatactcaactattctcaactgtgtttttcccccactttttcacacagagcatcatgtctatagtgccagggctcttccaaactctacacctatacttgtaaactcctgctgcataacatcttcatttccattaaaaatgtagctcatgagctcaaaccaagaaatataaggttaatagaagttgccaagatttcttttctctctctctctctctctctctctctctctctctctctctctctctctctctctctctctctctcttcctttctctctctccctccctccctacttctttctttctttctttctctttctttcttccttccttccttccttccttccttccttccttccttccttcctttctttctctttctttctttctttctctctttctttgtaaggactaaagatgacagaggatgatgttcactgaaatgaggcctc

SEQ ID NO: 2238 - DNA, 1000 bp, mus musculus
actaacttagatccttatgtacataattttacattaaaattaaattaacaactgaataacagatgactagagattgaaaaataacaaaaagtaatgggaaatcagagcttaatttcagtctaatcagcactcagattaagcattgccttaaaaataaaaccttgaggggagaaggatcttctgatgagaggattgcttcactcaggaactcacagcatttttgctgcctgcagaagactttcaccaaatccagacagacaacatcatagcatggaattcataggctcccaccccaaaccaaggagcaattgacagggatttcatgggttcatggttgaaggagtaaattttctttaaaggtatagctgctccttgagccactgtccattaaatgtcctgccattttgatgaaaaggaacagcctaaattagagataatgggctattaacttaattatttaaaagggcatgtgaccttgaagggtaatctgtaaagactggatctgggatgagttaagaggactagctgaggatcaatttaactaaaacatattgtatagaattttcaaagaattaaaatgtagttggcattaaaaaaccaaatcaactaacagtaccacccagagctcccagagaccaaaccaccaaccgaagagtacacagggagcgatccagggttccagctacatatgcagcagagaatgaccttatctgacattaatgggagaagaagtccttggtcctctgaaggcttgatgccttagcatagagggatgctagagtggtgaggcatgagtgggtgagtgggtggaggagcatcttcacagaggcaatggggagggaggagagggtgaatgggaggagggctgtagagagataactgggaaaaggaatctcatttgaaatgtaaatgtataaaaatattaatgaaaatatccaagaaaaactaattttcaggtagaaaaattttattatgatgttcatagtcatttaaaataatg

SEQ ID NO: 2239 - DNA, 1600 bp, mus musculus
agtgttgcctcactttgggttttctttattgtgtctacttccctttttagttcttggacggttttattcaattccatcacctgttttgttttgttttcctgcaatttaaattaaattaaaaatctttaagggatttttgtgcttcctttttatagtcttcttcctttttagcagtgttctcctgtatttctttaagtgagttattaaagtccttcttgatgtcctctaccatcatcatgagatatgcttttaaatctgggtctagcttttcgtgtgtgttagggtgccctggactgggcaaattgggagtgctgggttctgatgatggtgagtggtcttggtttctgttagtaagattcttacacttacctttctccatctggtaatctctggagtttgttgctatagttgtctctggttacagattgttcctctggtgattatattactatctatcagcagacctgggagactagctctctcctttgagtttcagtggtcagagcactctttgcaggcaagctcctcttacagggaaggtgcacagacatgtggagtttggacctcctcctggccgaagttgaaggcgcaaaacaggaactttcccagaagctgtgttgctttggcctgtcacagaagctgtcagcttctctggtgcacactctcacctgtgcagactacattcggtggagtcccagaaccaagatggcccccgccaattctgaggcaaaagactcccgggccaggtgggcacctgtcctctggccgggaaggtggccggatgtctggagcccgaaaagggcactggctcagaagctctgtggctcccatctgtcccagaagctgtcagcttctgtggtgcacactgtcccctgtttagactactttgggcagattcccggaatcaagatggctccttctgatcctgaggcaaagggctcccaggccaggcagacacctgtcctctggtcgggtggttggccagatgtctggggcctgaaaagggtgctgcctctgaagctctgtggctcccgcctgtcccagaagctgtcagcttctgtggtgcacactctcacctgtgtagactaagttcagaggagtcccggaaccaagatggctcccgcagatcctaaggcaaaaggctcttggactgggtagacacctgtcctctggccgggaaggtgatcggatgtctggagcctgaaaagcgcgtggcctcagaagctctgtggcttcgcctgtcccagaagctgtcagcttctgtggtgcacactctcacctgtgcagactgctttgggtggagtccaggaacccataaatgcatattcactggataaaacagttatggctgtagaactgcatggaatgaaaaattactatgatacattagtttcctagggcagcacaataagataagaaaaattttaagaattcttggactacattatatatgtaataaaaaaaggctatatagccatatcatgatcatgctactgggaaaacaaaaaaacagaaaaacacctattcacagtacaagatggttatcaaatttaaatattcaaaaatctgtaataactagataactaaaaataatctaatt

SEQ ID NO: 2240 - DNA, 1200 bp, mus musculus
tctgatgttgaaaacttatttaagtgggtctcagccatttgcattgtactgtattgtattgtattgtattgtgaataaataaattaattaatagaaaagatttttaaaaaaaacagtaagtactgaaaaagcaaaccttttcccatgttcatgtaatgaaattgtaaaagaacaacctttatttcattttattttttaattattcactttacatcctgctcattgccctcctcccagtcattgcctcccacaatacttcccccattccccctcaccttctcctctgagttgatggggaccctcctgggtatcctaccactctgatacttcaagtctctgtgaggctaggcacttcctctcccactgaggccaaaaaagtcagatcatctagaagaacatatcccacatataagcaatcttttaaatgaatcactataataagtcatgccttaggtaacaagaaaggcaatggaatttcagcctttaaaaagtcctttggctgaatgattttattaattgctctcagatctgtcaacatctttcatttgccagattttttgaagctgtagtttcatttcattgaaaaaaaaaaaaaaaaaaaggcagctttgccaattctttctttttttttttttaatttttactagatagtttcttcatttacatttcaaatgatatccccttttctagcttcctctccaaaagtcccctatatactccccctgccctgctccccaacccacccactcctgcttcctggccctggcatccctctgtactggggcaaataatcttcacaagaccaagagcctctcctccattgatggccatcctctgctacataagcaacaagagacacaagctcagggtggtactggttagttcatgttgttgttcttcctataggattgcagaccactttagctccttgggtattttctttagctccttcatagggggccatgtgatccaaccaatagatgattgtgagcatccacttctgtatttgccaggcactgacatagcctcacaagagatagctatatcagggtcctgtcagcaaaatcttgctggcatatgaatagtgtctgggtttggtggttgtatatgggatggatccctgggtggggcagtctctggatggtccttccttccatcttagctctgaactttgtctctgtaactccttccatgggtatt

SEQ ID NO: 2241 - DNA, 1000 bp, mus musculus
atctccccctttttgttttaataaaatgaggctggactaggcctgtgcaattatgtccatccgccgtggctcttgttttaggtcattcctctaatgtcacaaccttacccgtcatagggtaaccctatcgccaccgggccccgtgtcttaggttggactgtgcacgaggaaagttgcccgtctctggatgtggagagccacaataacatcataagatggcgctggctccgcagtgccttatgccacctaaacaaagaatagctatgtgcgcatgtgctaagagcaaaagcccgccaaaaagtcaccagcccatttccggggcaccagtccatctcccagggcactagcccaacccctgggggctatagcctatccccagggtgcatgagaatcgtgggttaagctaccagtccaagtttaacacgtcacaccttagggtatttaagccacacacgtttctgagccttctttctctacctcattatgttgtgaaataaagtaaccacagaaggatctgtgtcctgtgtgcgttcctgctgggcggggacaaaagctcaggacatctggatacctcagtgctgtgtgacagtaactgctaaatgacctagggcgaactctgcaaaagaggccagccaaaaaatgaattagtggggaaatcatgatcaccgtatcgcttgcaatgaggaaatctcagtgatgtgcaagggctgatcaatgatcgttgagtctctctcatctcagtgccgtggagtgcaagagcagagaactcagatgccgactaattcttgagcatagataaccaaatttcaggggaggagcctttttcaatagctaaaagtgcctgagttataatcaccttgtcacgtttttgttgggttctgaatttgcataccaaccagagcatgaacaccagtccacagcatatggcagcaccaaacaaaatcactcccacccattccttaaagtaagaaaaagcagaggtaagccaagaggtaaagtc

SEQ ID NO: 2242 - DNA, 1000 bp, mus musculus
caataagagaatattgggattgttttgcttgtaaggttgcaaaaattgctataattaagaatgcggaaattgagtgtgatatctatggccattgagttatttttgtggccaagccatttgcagaagcacactgaggctttcatgaaaactctctgtccaaggagggaaagataaagggtcacagacaggaactccatcaaaggatatgttccaataagctccaagagggagcttagacaaaaaggggaacaaggatgctgtgaggggacaagtgtcatgaggaggaactctatcgagggaggattcgagtatcataaaggtccagagtgtcataaggaagctgatagccttagcagacaactcctagggggaggtgaagacattctaggagagaattgaaaacatgtggggattaagaaagagtgtagggttgaggggtggggaggcagacacttgtcagtgacaaatgtcccaagtcacagacgataagcatcatgatggaggtaccatggaatgaatggagacacctggcattccactctggattttaaagtaaaagaatccaaagcagggagggagggagggagagagagggggagagagagagagagagagagagagagagagagagagagagagagaccctatcatggtccaggagcaagagatccagaaagcccagattctcattggagtaacatcacagatggaagaaagaagcagattctagaatttgaagtcaaatatagtgggtgtcagaaacaaatattccatatatatcttagtggaatcaaatcacagcttggttcagtctggagaggctgagtctttaggaagagagctcatatatgcttctcccaggtttcaggcaccagatccataaagggaaaattttctgaaccaggtgtatatacagaaaacatgagacagcttcaaggtctagttgaggggaaggatttattatagatataaaggtgattacagccagagttaatgaaag

SEQ ID NO: 2243 - DNA, 1600 bp, mus musculus
tactttacagctgtttcatctaaaagtaagatctcccccttttacctaaccatgaaatcctgtctttcttttctccacatctaagagactacaagggcaagcttgaagaatgttccagaaattgaaatgttgtatttctagcaagtgttgcatctggtataaataaataaatatctctctatatatacgatatatatatacacacatgtgcatatatatacacatatatgtttgtatatatatatatatatatatatatatatatatatatatatatatatatatatatatgtgtgtgtgtgtatatataaagttatttcatgtttataattaaaaaatatccataagaaaatataagtatactctctgtgactatgactaacacaaaacttccaagaagtacaatcttgctttatttgaagaactctggagatttgagaaaaacagaaggtcaaggtgaacaagcagtgtgcagagattaatgcaatctagacgggattataactcaatgtcctcaaacattttatgacaggtctgaaagacagtttcatataaatgtaattttaaaaattagatgcactaagtatgattattttctttctttcttttttttctctttgtctcttttgctaacagtatgaaagaagtaggaggaagccataagcaatggagaggtctcccgtcatctacctgcaagccatgccctatcgcctatgccagcccagtctgtggttctgatgggcattcctactcttcacaggtgaggagagctctgttgatccaggttgtggtttgaatatgatgggaccaccgaggctcatgtgatccttatctgttgttactgctctggaaggttccagagtcttaggagatagagccagctgaagcaattgggtatgtgattggagattttatagcctggccccaattcctatctaccctttctccctgagatgagactgaaggtaacctattatcccctccacagtgccccacccaccccatgctttactgacctacttttctcttcatgaattcctgccaaagcaaatctagcttgcagttatatcagatgtttgagcacaaccacacaaaagtaactgatatagtaagtaactgagttaatcagtcatctgtctatgtggtgattttgtaattactttgcttacttttaagtaatattaataaactcactggtaaggagggcagtctgaatggcatttatttctcctatataaaatttataggaacatgaaatactagtgttgtgattattctgagcctttatatctaaatgccaatgtttcctacattcctttctgttgataaattcagaaaaagcataactagcaattattgttataacagcaattacaaaccccacattcataagaagtctcattccctatctcccttgttatcttatttaagttgccaggaatattttggaagtacagggttcagtaagtaacagtgataaggccaattttacacttttgattatcattaaagccagatttggtagcatttttagatccatgttcctggttttcttctacattattctgacttcctagtaactatgctaaaagtttaaatg

SEQ ID NO: 2244 - DNA, 1000 bp, mus musculus
aaatataataagataaagctaacatattggaattagacaaaataaacaaaagaatgagcccaagagaaggcataggaatcaaggacgcattcttttgcaagccctggagtcacgtaaatcactagcctggaagccataacttaaatatagaaagctctcgatgccgacctgtgtgggccatgtgcgtgctgtttcagtctctgtggttttgtatgcacgtgaatcatgttaactcagagggccttgctttgatggaattctctctcacccgggctcttacactctttatgcctttctccagcaggattcccagatccctaaagagagggatttagtagagaaatcccatttagagttgactgttccaaggtctcttactctctgcattgtggttctctgtgaatctctggttgtggttctctgcctgtgtttcaaatgatgcagaaggaagtttcgctgatgatgtctgaagaaggaattgatacatgagtaaagtagaatttcattaggagttattttttgtcgttgttgatttattttattattatttttgcaatagtatttggttttacttcaagtccccagactatatattctctggtcctggttacctaagcaaggagaggcatcaattttatctcatggagtgagctttaagtcaaagtagctattgggtggttattcccataacctttgtgtcactcttacctttatataccttgcaggctgtatatcaatgtagaccaaagaatatatggctgtggtggtatttatgtttcttgtttggtaacatgcacattatttccacgtaccaaattattgggaatagaggactgaaggctctatgtaggtaccagcttgactttttcatgttctattatttgtaggtgttttcttcagtaatggagccttactgtcagattggagcaacagcttgggttatcatgggactcttttgtgcatcaactcaattagatgtaactcactctggattctagac

SEQ ID NO: 2245 - DNA, 1200 bp, mus musculus
ctcttaataaaaggaataaaatggtttaaataagaatgagactattaagggcttatagagcatatatatagttatttctcaatacaagcataataatgaaaccaagtgtctacttaaatgtgtaattcaagaataagtgaagtttgatttaaatatttacaaagaatgaaaggaagaaactaagtaaaaagaatatagactactcaatactaagagataccttcagagaataggtgtccgcccggccgaggagggctttgcctgagcatctgcgggagacatcttgaatcccggactccactgagaatagtctgcacaggtgagagtgtggactacaaaagctaacagcttctgggacaggagggagccacagagcttctgaggcagcagccttttcaggatccagacatccaggcaccttccctgccagagaagaggtgtctgctcagtctgggagggctttgcctgagcatctatgggagacatcttagttccctgacaccactgagactagtctgcacaggtgagagtgtggactacagaagttaacatattctgggacaagctgaagcaacacagctcctgggacaggtcctgttttgggccttcatcttctgccaaaaggcaagtctgaaagccaggtacctgtgcaccttccctgaaagaggagagcctgcctgaagagagtgctctgaccactgaaactcaggagagagctagtctcccaggtctgctggtagagtaaaacagaatcacaagaggaacaagctctaaccagagacaacaataacaactgactccagagcgtaccagatggtgaaaggcaggcttaagaatcttcctaacagaaaccaagaccactcaccataatcagaacccagtaatcccacctcagcaagtccagggcaccccaacacacccgaaaacctagacccagatttaaaggcatatctcatgatgatggtagaagacatcaagaaggtctttaataactcacttaaagaaaaacaggaaaacacaaccaaacaggtagaagtccctacagaaaaacaggaaaacacatccaaacaggtgatggaaatgaacaaaaccaaactagacctaaaaagggaagtagacacaatagagaaaactcaaagtgaggcaaggctggatatagaaaccctaggaaagaaatctggaaacatagatgcaagcatc

SEQ ID NO: 2246 - DNA, 1000 bp, mus musculus
agttggatctcatggaggcatttcctcaactgaagctcctttctctgtgataaccccagctgtgtcaagttgacacaaaactagccagtacacacactaaataataattgttttttattaattatgtttgcgccaccaaagcttggcaagctataaagcctccccaccagcaccactgtgcgctgctctcagttcctgtgacaccttctgccctgatgccccaccagcaccactgtgcgctgctctcagttcctgtgacaccttctgccctgatgccccaccagcaccactgtgcactgttctcagctcctgggatggcttctaccacttctcccagccttgttccttccctttaaatgcgggagagaaaggaacaaaggtggcaagaagaaagtgagtatgtgttactgcaggtctgccatcacagggtgggtgtcccttgcactcacgtgaagtgcatgggatcagcaggcgccatcctttccattccgagccccagaatctctgctttgagagaatgattcccaccacagagagctgatgtggttgctttcagccaacccagaaatccaaactatttccattttaacgaacgacgtatacattctgagaggtgtgattccaaggtacatggaggtcagtgccccgacctgtgcaccactgcagaggagggtggctgagttctcaaggaaaagtcctgcaaggaaagatattccctgcggccagagctgttgcactaaaaagaaagccaaggactaagtggaaagcagctgcaggtcttcccgggcgtggcccagtgccaacctgtcagaaagcatgttcgctcatttaagaccgaggaaacatgtgaatttgaagtgtggttttggtctgcaacttaagtagacaaacagatatcgtttctaaacagaggattcctgtggttcagatttgtatccgacaagatggggcagagaacagagggcaagtggctgagagactggacgaagccacagatggg

SEQ ID NO: 2247 - DNA, 1200 bp, mus musculus
actagaggtcttaggatctcctgtggaatcctgtgtgggcccttgcgggtgtcaggcgactcagctggcaaggtagcccggggctcgagtggagcggaaggagtttgtgcaccagatatagcccgggtagcctgcttccctatgtacagcagtctcaggttccgtgcgattggattggggcaggcgctgtgttccactcaccagaggtcttaggatcccgtggggagtcccgtgtgggcccttgggggtgttgggcaagactctcctggcaaggtagcccggggctcgagtcgagcggaaaggaaaggagtgttttggaaagaaaaccttttataataatttccacagctgcctcaggcctttctcaccccaaaggctctgattttactgtttcctgtaaacttgtctgttctgaacatttcatatgcatgccatcatacaaacagccgtttgtgtcaagtagtataacaatatgactgtctcttgctggcatgcggtcaaagttcattgatattatagctttgattcctttcctctttgtagttgagtaatattttatcctgtgggaatactacaatgttttcttccactgtgtttattcatatagttgcttggcataactgtaggaatagttatgtaagaaaaggtgtctgaaggaagatagtgcatcatgttccactggttctttggaggctggtgtgtaacttttacgttatgggatttccttagaagttctaattataattggttgacttagaagggaacactagggtgctggtgcttcctcttttgcttttttatttctggccaaacacaagcagtttcttgtgcccaaaacacctgctgtgatatacagtgttaccgtacactatagcccaaggacaatgggatgaagtgcctatggagtgagccaatacaaaaccttccatctttataaattgacttaatcttgggtatgagttacagcaatgaaaagctaagttgtacaaacgctaacaagtttttgcatttagagacagattaaaaaaaaagagtttataaaggaaacagagaaaaaaaatatcccaaatgatgagacaaaccacagagggttttcttcttgttataaaaactaaaaatgaagaatgtttccttcagcaaagtggctcgatacaaaaattgacaagaaaaaatcagtagccctctgttttataaatgata

SEQ ID NO: 2248 - DNA, 1000 bp, mus musculus
tgatgtcctctatcccctctgactcctacaatttaccctccccctcttcctcaatgttccttggtttctagggtgagggaactaatggagacctccaatttagacactccaaataatgtctggctatgggtctctgcactcattcccattgcagccagaggagtcatctgatgatgactggacaaggcaccatactatgagtgaagcagaataacattagaaatcaatcctttatccagtctccagttcctggccatctgagcagtgaagtaattgggttccctttcgttgggtagccctcaagttaaaccaatcactggttggccactctcacaagctgtgtgccactattgctccagcacatcttacaggcagagcaggttttgggtcaatgcttttgggtctgagtcagtttctcttttcatagtctgcagagtaccttttggcaacaaagagattgtaaagggtagaggtgaaagctccatgcaggccctagctaggcctctctgtgatcatgagctgtgtggacattttcctcagcaatctgtctctattgtcagtttttaggcagcaaccctctgtcatagcaatggcctcgcttgtgtcagaatctccacgggaacacctcagccatcaactcaactgaacacaacccaatcccatcgttaaaatccttgcctggctataacaaatggccaggtcagatctcatagccttaattactagtaacccttactagggtcactctcagatttcaggtcgtttccactgcactaagttttcacactgcccccaagtgctcctcaattctagctgtctctcccctcactttctctttccatgcccctccaacttgatttttcttggtcctgggttccacccaatgtgttataaatggtttagaacatcgctagtatgtatagggacagcaacattgaagttctcatcagtgctgctcacagaatactgagggagtcacttctgctggtaactggatttc

SEQ ID NO: 2249 - DNA, 1000 bp, mus musculus; identical to SEQ ID NO: 2248

SEQ ID NO: 2250 - DNA, 1000 bp, mus musculus
gaaacaaaatactcactcaccggagagagagggtaggagggactttataggaagaggggaaaagatgggcaggatcaggtatgggaggagatggggttgatatacagatggtcaacaatttgaacagaggtgtgtagcaatgggggactggaactgggaatagccaccagcaagtcccagatgccaaaaaagcaagaggctcccaggacccaacagggatgtgcttcatgaaatacccaacaaaaggaagggagaacctgtagagaccatatccagaggttaggcaaggcccctggttggggcatcaggccaaccactcatctccaaatttttaacccagaatggctcctgtctaaaggaaataatagagacaaatggtagaacagagactgaaggaaaggccatccagagactgcccatcctggggatccatcccatatacagtcaccaaacccagaagctgttgtggatgccaagaagtgcttgctgacaggagcttgttatagctgtctcctgagaggctcttccagagcctgacaaatacagaggtggatgctcacagctaaccattggactgagcacagggaccccaatgaaagagttagcgatgggactgaaggagctgaagaggtttgcaatctcataggaagaacaataatatcaaccaaccagaaccccccagagctcccagggactacaaaaccatcaaccaatgagtacacatggagggacatatcaatccagccacatgtagcaggggatggcatcagtaggaggagaggcctttggtctcctgtgaaggctcattgcctcagtgtaggggaatgccaggatggtgaggtgagagggtttgggtgggttgcagagcaccctcagaaaagccggggaaagaaattagggtaggtggattccggagggggaactcggaagggggataacattttatatgcaagcacataaaatatccaataaaagaaaagagaaataaaagagaacattt

SEQ ID NO: 2251 - DNA, 1000 bp, mus musculus; identical to SEQ ID NO: 2250

SEQ ID NO: 2252 - DNA, 1200 bp, mus musculus
cttcctcccagccccatgttccaagaaacaagactcagactcagaatatatttacaaataccttgacaatatagctaggctcttctctgactagaatcatagtttgagataacccacttattttaacctacattctgacacgtagctagatatcagaaagagctgctctcagtcaactactcattttgcctttatcctcaaattgttcttctctttggtcttttgaagatgaaaatagattatagccattaagcgactatgcacaggacacagtggaagaactatgcatagtaatcctcctttagtggtatacgaatgtatttcaatacccacagtgtatgcttgaaaccatagatagtatcacactcgatacataccccattatatctccataggcattcctatggaaaagttttgtcttgattagcaacagtaacggagtaacaatgactctgaatacaatggaatgactatattaattaagccatggaccacaagagaacacaataatacaccaacaatagcctgctactgtgtgactgtgggtgactgtgtgtgactgtgtgtgactgtgtgtgactgtgtgtgactgtgtgtgactgtgtgtgactgtgggtgactgtgggtgactgtgggtgactgtgtgtgactgtgtgtgactgtgtgtgactgtgtgtgattgtgggtgactgtgggtggctgtgggtgactgtgtgtgactgtgggtgactgtgggtgactgtgggtgactgccatatatagtacagacattctggggatgattcacatcctggatgcaacatagtgagattgcttcaccattgatcatgtttcttagaattatgcacggcataaatcttatgaatgttttagttctaggtttttatatttagcagtcctgcaccatgattagcaacagacacctgaagtcatagaatcataaataaggaatgggctattgaaggtaagtcctggctcttcctcccagccccatgctcccagaaacaggacttggactcaaaatagatatacaaataccttgaccatatagctaggatcttctctgactagaatcataacttgagataacccatttattataacctacattctgccacatagatggttacctgtgttcaggtaccacaagtctcgggctctatcttgcagaagctatttccatactaagaaatcaatata

SEQ ID NO: 2253 - DNA, 1200 bp, mus musculus; identical to SEQ ID NO: 2252

SEQ ID NO: 2254 - DNA, 1000 bp, mus musculus
tgtgtctgaaggcagtcagcaggaacagtctcctgcagaaaatctttgtgttcagaatccattccttttctgctaaattgtatgctgagccaactcaagtgattctggacagctgttgtgtaacccagaagcatttgcaaagggccctgactcacaacaatgaggctggatgtgctgggagccattttctagttggcattgagtagatatcctgagaagatataaggtcttgacaggctagttgtgaaataaaaaaaggaagggggggcagagagagagagaagacagaagaggactggaatttatatacgattacttcaataagaagttgtagctgaaaattactttttttataagtagttttgcagttaagttttgaatttgggtctttgtcatgtgacaaatgacttgaaagactgaagaccatgcattgggctgtactcctatataagatggcaccggctgccatcattgactaaaacaacacagtaagatgtccttgaatgcccagttaagatcacatagtccagttttatcaagcagcaagcatttacttggagtcttctgtgtgccatttgctgcccataagatttcaggaatgaatgagacacaaagtctctcacttcagtgaatttgcattctgttatgatgggaatttcaggaagaagttaagtgagttggttggcctccacattctgtgatttggtcagttgtggttttctatagtggtcaccatctgttgcaaagaaaagcttctttgctgagaggtgaagactacatttatctttgggtataaggacaaatgccatgatctatacccatgctttctcaggtacacgactgcctaaacataagctgaacaagaatggtaagaataacatgccaaaatggacaagtaaaatcccaaaatttgtcaaccctccacaaagaactattggcaactaaggaacggtgataacaggagaagtagtcttccttggggagaagcctatcaattggt

SEQ ID NO: 2255 - DNA, 1000 bp, mus musculus; identical to SEQ ID NO: 2254

SEQ ID NO: 2256 - DNA, 1000 bp, mus musculus; identical to SEQ ID NO: 2254

SEQ ID NO: 2257 - DNA, 1000 bp, mus musculus
cagttctctctggggagaatttcggtttgcaaagctgtgccacaggatcagctctgggtgcagatggaaaccagaaggatcctatccctggctgcagcttggttcatgtgtcctgggggttctgggtggtttcctctgagcagaagttgtggtcttatctgcactttcaggtgtgaccgcactcctggaagaccaggtttccccaagcagtatttgagtatatagcactgtggcacaggatcagctccaggaactatggcacaggatcagctctggacatagatctattttcacatttttagtactgcccttaacaggaaatttttaattttgataaagcccattttctttttatattacttgtggttctttgtgcatttataaaatatagtctcatgtagcccaaatgtatgaaattgtatacttttggcaatttcatgtggctattagaaaatacaccaagtatttctttcttccaacccacatttctctcttaatgtagaattatatagaggaatagcattttcctaagctagataactttgtacatttttggactgataatatccattttttttgaagagaaaagaaataaagggaaaagaatgtatcctcacaaaaaccttgaactcctgggggaaaatatattgatgcataaacctaaacaatgtacagttttgtgcaatttcgggccaataaaaaagaactgacaggggacatcttaaaacaggatctttaaactgttttcaaaacaggatcatgactcctttggagaagaacattgctgtattctccaaagaacaatcttagccttcctccttcctccctctccactcagcacttttgttgctttgctttcccactctgccctagaatatgaatttactggaattactcttactataattcaaacttgtaactgaaaaatattcacttcaattaccagtatcttttgatccaggttttctgtgccactagtgttgccagtgtccacaagatg

SEQ ID NO: 2258 - DNA, 1000 bp, mus musculus
taacccaggcgcttgttgctttggagcatggtgcctcccccgatatatggttatcgatgctcaagcaataaggtcgctggccatccagctccacaaacccctgaggcgagtcttgctgcatggggcggagcgggtgtgctttagcagcccaggagagttgcgaggctaagcactgcactggaatggctttgcagtctaatttgagcttcttcctgggagatatgtcatctttcaagaaggttgagtgtcctaatgtccttcccccaggaaaaacgacatgggagtggaccaagacccctccgggtgacgggcctgggaggaggttttgtgtaaggcccctatgcttgcacactggggatttgacctctatctccactctcagtactgggtggcctgttgcttctaaaataaaagaaaatggggagatgtgaggagccaccctcagggtcgccattacaagatggcactgacatcgttgctcgtggtgaaaaacaagtagtgtgcgcaggcgtcagggtatctttccattacctgagccccgcctctcccgtggcatcatctgggctgatggtgagcagccaatccgggcggtgcacatctccaaccgtacttcgcagcctatataagggaagggttttctgctctctgggtctcctctcctgaagctgatcatctatctctcgagatgcatgaaagctttactgcagaaggatccgagtgtcctgcgtgcgttcttgctggcgagacggtagtgtgggtcacgtgagcaggctgttgatactgttgattcaggcttttgcagccctagagctgggacaatcttctcaagtgtggcttggcatgctagagaagtagtcaatggcaggtaagactccctggaggtattaccaacctaagacagggatcagaccactgctgtctgtcctcccgatgacaggtaaggagcattatcacagggggcaacctaagacaggcattctctctgccaaaataataaata

SEQ ID NO: 2259 - DNA, 1200 bp, mus musculus
tcagagaggacacgaggctggctgaggccacatgggagacaggaaaaatgcaggacaccctctgactatcaccatggcatggaatggaggtcaggggacctatatgcccagaactaccgaccgccagcacccccaccaggccaagatggtctagacccaagagctccatccatagagatactgagaaaagtattattttctcctacaccagccgcctgtttctgaaaagaagtcgtgtgaagccttgttccctgtacgcttcctgaagattgagcccagcgcagccagctgtgctcaggccccaccagctcaggccattggccctcagggaagcagggatgaaggaacaatagagatactattatgcaccattgttctctgaggtctcagttttgtaccatccaatcaccaggcttggtggtccaggcctatcactctaccaatttgtgaggttaagacgggaggacctgagtccaaggttaaggtcaacttgggcaacagtgaaaatgtaaaggaggggctgctgcagctcaggggagagcactggcccagaacccatcagtgagggctgctgccgctcagggaggaaagcctctgcctagatcactcagtgggccatcactggcctaacatacttgaagctcaaagcttaatccccactatggaaaaaacatggaatcaaacaggacaggagtgtggttcagtggcagagcttgtgtgtgcctggtacatgggaggtctggggcgctatcttagaaccaacaaagaaaggtacaaatacatgagataatgtgacaaaccaatacacggtacaatgtgatgatgagcaggtgcaggacagatctacagcagtaagggcagcgatagcactggctgtgaagcagcacgttcctgactctgccctcaatatgggccttagcctgagcccaggagaaacagagggcccagcccactgtgggtagctatccctgggtgttacaagaaagcaggttgagccgagcatagtggcacacaccctgaatcctagcccttaggaggtagagaaaggtagatctctgtgaatttgaggtcagtctggtctacataatgaattctaggatagccagagctacatagtatcactctgttttgagaaaaaaggaaggaaggaaggaaggaaggaaggaaggaaggaaggaaggaaggaaggaaggaaggaag

SEQ ID NO: 2260 - DNA, 1200 bp, mus musculus
gggagggcgctggcactcagcttttgtctcctgctgcctgcaggtgttcgctcctgggaggatgtggaccccgctgtctgcagcctggatgagcagctcaaggccttcgtgtcccggcattcagccaccttctccagcattgtgaaaggtgacctgccccactctgcctcccttagttctcctgctcctctctgggtgctgagctgctgagtggcagctgtatgccgggcgtggggtgaggcagtgctaaggcctgcacagaggtacctctggcctgtggatgctgccttggttttggacagtagaagaaagtcatatgctctgtccctaacttacagaagggtgtagtgactttagggaggggccctcagggctgagaaccaatagggaagcagagatggggtgcagggcgatttccttgggatcctggggtggccagagcagccctttcatgggtattgcttgtagctcgtccctgcccagtgggttgagtcaccacctacagctgcaggaggggaaggaagtgtccctttgggtcgtagtggcttcctgacccctgatccattggagaaaaagctggaagtgacctactgtgtgaccacagccctctggacgccccttctgggtagtcacatttctctggcctggtcttgcaggggagggctgaagctgctgtctgccatgtagagcctcctgtgtgtcctcctggcttaggtgctgagctgtgctggtgctgatacgcagtctagcacccctggctgatcatctgtgttgtccctgcttgaggcccagggcacccatgggcttcttccattttctttcctgtttgctctcagctggggcaccctgctgtgggttctgcagcttcagtacctgagggtcccctggtggtaggatttgggattaggcagcctgagccggggcctgggcttgtcatcccacagggcagcggagcctgcaccaccgtggagagaccttggagacgctggtcctgctgaacccctcagacaagtccctgtgtgatgaggtaggagcagggccctgtgctgtcctcactcctgacccagcatatgtgcttgacacttctgcacctacttcctcttgtagacttggggcaggaaggctggtcatggaatgcactgatgagctggaggcaggtgggaggaacccatggaacccaatgtcctggcttagcctcta

SEQ ID NO: 2261 - DNA, 1400 bp, mus musculus
tgtgataaaaacaccatgacaaaaaaaaaaaaaaaacaagttggggaggaaagggtttattgagcttacatttccagatcatagtccttcagtggaggaagccaggacaggaacctggaggcaggagctaaggccatggaagggtgctgctcacaggcttgctccctgtggcttgtttagcctaattttttttcattaatttatttattttacatcttgaccacagtttccccctccctcctctccccccagttcctccccacctccttctcttccctactcctacccactcttcctctgtttctcttcagaaaagggcacaccttccgtgcatatcaaccagccatggcatatcaacttgtagtaggactaggcacatcctcttctattaaggctgaacaaggcaacctagtagatggaaagggccccaaagacaggtagcagagtcagagacagcccctgctcctgctgttcacaaaaaactaagcacgtccataacatatgtgcacagaacctaagtcagtcccatggaggctccctgttggtagttcattctctatgagtccatatgggctcagattgatggattctgtgggttttcttctggtgtcttttacccctctgtctcctacaatccttcctcctctgttccacaggattccccaagctctgcctaatgtttgactgtgggtctctgcatttgtttctatcagttgctgggtgaaacctctctgatggcaattgggttggacactaatctaagtatagcagaatatcattaggctttaagttattgacttttttgttgttgatgttttgccagtcttgtttggttctatcctaggtccctgggttatccagcctttagcttctggacatccaggcaataccaggggggtgggatcccggttgtggcatgggtcttgagctggaccagtcattggttagcccctccctcaacctctgttccacctttactcccgaacatcctataagcagtataaattgtaggtcaaaatagtggctgggttgaagtcccagtccttccacttaaaatcttgaccagttcaggttccatgtccctcactgttgggagttttagctagggtcaccctcatagattcttggcagttcccattgctctaagtttctagctcatcccagagatgttccctgattcagttgtctctccagtactctctcactgtcctcctcccacctgatccctcctgttcccatcccccatcaatcagtaatgcctatctattccctttctcagtgagattcacacatgcccctttagccctacttgttgcttagtttctttgagtctgtggactataacttggttatcctttactaatgtccacttagaagtgagtacataccgtgtttgtctt

SEQ ID NO: 2262 - DNA, 1400 bp, mus musculus
cacatgggtgagagtccttggtcaggtccatgactggagcacaggatgtccttctggtagcagattagatgcggctcattaggaaaaagcctatcccatcattcaagtacggtgggccttgatgagcagagacagtctatggttttagagctttattgtagaaaggcagggagaaaggagagaaggtagaaagagagaggctggccatggccatgtggagagagggaagaagggagagagaaaaggagggccagagaataagaaaggtgagagcttaagagagtgaagtggggtctagcagcctctcttatagtgggctgggctatcaggctgttgccaggtaactatggggttatatatggggttatagcatacctggctatagtcaggtaactgtgggggtggagtctagccagaatgccagaagcttgggacattgtgtgacacaatgtgatgtcacagaattatggacaggcacctgattttgggaacgtggctcacctttccatcccttgtagatttctttattgggtcaccagagcaagccccattcaaccaaaataggctgcctatcacagtcccacacacatgtgtgttcttcctagtctcacttctctggcccccgccaaccttcctacacagcctgtactggggggtcaacatgcatacatacaatatgtaacagtaaaataaatcctgaaaaagcgagagcagagaggagtacacagtgagatctgagtcatcccgcagagacaaggtggggcctgggagagagacaggacctgaaaagaaagggctgctcaacacaaaaggctatactgcagagtccaggagtccaagggaaccaccaggaaaggatagtccccttccatacatgccaggaccccaggaaccctgaagctgcagaaaccaacagtccttgttccccttcctccacatagcacagagcctgctggagctagagaaatcagagagattgagggactagaggactaacctttctactcaggcagctgtgccagcaattctttccgtaaatgaatgctgctctcatccttgagcaaggagaccttatttttcagtaagcagcagttcgtgcacagactcatagctggtcaaagatctgaggttaaattgtgccaggagccaccaaggagaagctaaaaattagcaggtgatcttcatgagatggttccaacatggactgccaaaattaatgacagatttgcttctctagacaaggccaagaagagcttcattttaggaatgattcatgctatcaatatgcttttcctgctattattaagtatatataacaatcactaagtattagcccacccttttgagcagatctctgcagaacaatgaagatgtacttattgccttgtagtgatacttta

SEQ ID NO: 2263 - DNA, 1200 bp, mus musculus
tattgctgatgctggcatctatggttccagatttctttcctagggtttctatctccagcgttgcctcactttgggttttctttattttgtctacttccctttttaggtctattatggttttgttcatttccatcacttgtttgaatgtgttttcttgtttttcttaaggacttataactctttagcaatgttctcctgtatttctttacgtgagttagttattaaagtccttcctgatgtcctctaccatcatcatgagatatgcttttaaatctgggtctagactttcgggtgtgttagggtgccctggactgggcgaggtgggagtgctgggttctgatgatggtgagtggtcttgttttctgttagtaagattcttacatttgcctttcaccatctggtaatctctggaggtagttgttatagttgcctctggttagagcttgtgattctgttagcctctattagcagacctgggagactagatctctcctgaatttcagtggttagagcactctctgcaggcaagctctcctcttgcagggaagatttacagatatctagtgtttggacctgcctcctggcagatgatgaaggcccgaaacagggtgtgtcccagaatctgggtagctcgtgtagtctacactctcacctggacagactagtctaggtggaatctggaaaccaagatagcttccccagatgctgtagcaaagttcttccgggcagggcagacacctgtcctctgggagggaaagtgcctggttgtttggagcctgaaacagggtctgcctcagaagctgtatggcttctgcctgtcccagaagctgttagcttctgtagtccacattctcacctgtacagactagtcttgtcgggatctgggaaccaagatggctcccccagatgatatggcaaattcctcccaggcagggtggacacctctcctctggtagggaaggtgcccgaatgtctggagcccgaaacatggtctcttattgagtatttttcatgaatattcatgaaggaaattggtctgaagttctcttcttcgttgggtctttatgtggtttaggtatcagagtaattggggcttcatagaatgaattgggtagagtacctttggtttctattttgtggaacagtttgagaagaattggaattaggtcttctttgaaggtctgatagaactctgcacta

SEQ ID NO: 2264 - DNA, 1200 bp, mus musculus
gtaatatgatagtaatgcttctaatattaattctaaagatgataaattgttttaaaattgggttttgctttcccaaagttatagttataatctaatgctgcaaaagaaacttagtaactctaaaatctgtcctcatggcaagaggaactaagcttggagcagcctcagcgaagtttgtgtgactttcttttgtcttacaaacggtgcctaaaaaaggctctccttgcacctttgcagatctagccagatgctgttttaataaagttcaaattcaaagtttataaagagtcaatcagactgtagaatttataaaggcattacaatctggcttgcctactttttatatagttattatagatccaaaagtttggttttttttttcctttacatcttaatgattgtaaagtttttgcttctagtgagtttgtaaatactgaaaaattttgcctcttggtatggctaaatataggtctacattatgtgagaaatttttatcatttctgcttctatacaagaagccaagagtttaaatctttcagtatatattgtttcctaagtgaaaaatattatgttagctaatgcctctcaagggaaattttcttaaaaccttagctgtcattaaactaaccctaggcagagccgctttatccttactgtaaacatttatctggttcctgttaattcttttgaagtcattcctttgtttcatgtcaggtaacttctaaatattttgcctgctgtgacttcctatcctcttttattatctgtattctttggctccgggccagcgaatgctggcggctacagggcgggggccccttggtcgagcagctttccctgaacgtggtgacacaaaaagctgccaaaaagcgggtagctttgtaacaaactcagggcgtagggccttgcccgccatggcccatgagcctctgcctgtctcctctggggtagccggattccccccacccccaggcccggggtgctccgccaccctggctttgatagcagggcctgcgccgctgccagtgctagggctgcgaagctgctgcttgacatcacggctgagcactgtctgtggcggtggtgggcacgtcaggtgcgcaccgctgatgtggggctcaaaagcgggttaaaatccagagtccttttcagagtgactccacatgccagggtgacaggcagccagggctgaagaggatt

SEQ ID NO: 2265 - DNA, 1200 bp, mus musculus
tagctcttcagaatgtgaaatataattactactgtggaagatggaccatatgagcattgtaccaattcttcaataagaagaggcaaaacacataagtatttacaataggaacaaactgaaaggtcttcagctgtgctcatcagaatacagggagaaatgcatctctcaagttatgttaccatttacataatctaaaacaaaaaacttacaaagagaaaatcaaacacacagagaggttacatctaagtaaatttcaaaaaaacttgtattggaagagagggagaaattccatgacttggaggcagaaggattagatttaagagctagaagagaaaaatcatccaccaatgtaggtgcaaaggagaagtggtcccatgggggtgcttcatagaagataacagggtagcaaagaaaaaatatagatttaggaagtgttaagacaggaatattgtaatgggagtgctaactggggaagtgtagaagtgcccaaccattgagctagtcaaggcatatcaaaattaactggtgtgtgtgtgtgtgtgtgtgtgtgtgtgtgtgtgtgtgtgtgtctgtgtgtctgtgtgtctgtgtgtgtctgtgtgtgtctgtgtgtgtctgtgtgtctgattttctgtctctctgtctgtctttcatttatgaatccagagctcttgggtgggtgcagcatgctcatgacccacaaggagttaaagcagactaactattcgccactacatcatacttcaagccagagtcagatatggactccctctcatggcttgggccttaagttagaccagtgattgtttggctgtccccacaagctctgagttaccattgccaaaggacatctttcattcagtacaggtaatgggttataggatttgtggctgggttagtgtcccagtaccaccatggggagcctagcctggttacagaagatgacaggttcagactccatatcctccattacaaggggttattctcgtacattgtcactcattacagtcatcattcccaataccctctttctccttcactccctccctgacttgatccttcctattcccttacccatctgtccctagtctacccacaaaaatctattctatttcccactcccagggagatctaccctagccctttcctcttcatctaatgtctccagatctgtggattatagtgtgattatcctttact

SEQ ID NO: 2266 - DNA, 1200 bp, mus musculus
tctcttgtattctgttgctgatgctcgcatctatggttccagatttctttcctagggtttctatctccagcgttgcctcactttgggttttctttattctgtctacttccctttttatgtcttggatggttttattcaattccatcacctctttggtcgtgttttcctgcaattctttaaggaatttttgtatttcctctttaaggtcttctacctgtttagctgtgttctcctgtatttttaaagtgagttattaaagtccttcttgatgttctctaccaccatcatgagatatgcttttaaatccggtcttgcttttcgggtgtgttggggtacccaggattaggtggcgtgggagtgctgcgttctgatgatggtgagtggtcttgatttctgttagtaggattcttacgtttgcctttcaccatctggtaatctctgaagctagttgttatagttgtttctggttagagcttgttcctcaggtgactctgttagcctctatcagcagacttgggagactagctctctccttagcttcagtggtcagagtattctctgcaggcaaactctcttcttgcagggaaggtgcccagatatctggtgttcgatccccccatggggggtcctgtgtgggtccttgaggttgtccagagactctgagggcaaggcaccccagtgctggagtggaccggaatgaacttgtgcccctgatcaggccgggttatctgcttccctagttaatgcagtctcaggtcacgtgcgattggattggattggtgtgttccactcaccagaggtcttaggatcctgtgggtaatcctgtttgggtccttgtgggtgtcttgagactccgtgggcaaggcaccccggtgctggagtggaccggaagggcgaggtcccatttattaattatcagtctagtgccagcactgtcaatgttctgttcaagaagttgtctcctgttccaatgtttccaaaattaatccctactttctcttttatcaggtttaatgtatctggttttatattgaggtctttgattcacatgagttttgtgcagggtgaaaaatatgaatccacttgcattcttctacatgcagacatccagttagaccagcactatttgttgaatatgcttttgtttttccattgaggcctctttatccaaaataagcatgtagatatgtgtttgagtct

SEQ ID NO: 2267 - DNA, 1000 bp, mus musculus
tcagcttgttccagtatgactccacccatggcaaattcaacagcacagtcaaggcttagaatgggaagcttgtcatcaatgggaagcccatcaccatcttccaggagcaagatccttctaaaatcaaatggcatggtgctggtgctgagtatgtcgtggagtctactggcgtcttcaccaccatggagaaggccaggacccacttaaaggatggagccaaaagggtcatcacttccgccccttctgccagtgtccccatgtttgtgatgggtgtgaattatgagaaatatgacaactcactcaagattgtcagcaatgcgtcctgcaccaccaattgcttagcccctctggccaagatcatccatgagaactttgtcattgtggaagggctcatgaccatggctcatgccatcactgccactcagataactgtggatggcccctctggaaagctgtggtgtgatggctgtggaactgcctagaacatcatccctgcatccactggtgctgccaaggttgtgtgcaaggtcatcccagagctgaacgggaagctcactgtcatggcctttcctgttcctacccccaatgtatccattgtggatctgatgtgctacctgtggaaacctgccaagtatgaagacatctagaatgtggtgaagcaggcatctgaagacacattgaagggcatcctgggctacactgaggaccagattgtctcctgtaacttcaacagcaacttccactcttccacctttgataccagggctggcattgctctcaatgacaactttgtgaagctcatttccttgtatgacaatcaatatggctacagtaacagggcagtggacatcatggcctacatggcctccaaggagtaagaaaccctggaccacccaccccagcaaggtcactgagagcaagaaagaggcccactgttcctgaggagtccctatcccaactctgccccaacagtgagcatctccctcacaatttccatccc

SEQ ID NO: 2268 - DNA, 1200 bp, mus musculus
aagcatgattataataacaaatctaaattagcaacataataaaactataagacataaaattgatataaatattttccaacatacaggtaaaaaacaatgtggaaatgtgccatattctgtgttagcgaagaaacaaatagttaagatatggaaaaccaggtaggctgccaggaaatcttatcttttctctctattcccccagatccaatcgcccagtatccccagggctgcaacagaacagtttttctccaattcccatatctgtgggtcccacagggtatccccactttaccccctatgaactctgttgctttatcccatttcccatttccagcagataatccctgctaacccacaggccatgcctgccagaaaaccaggaagttatcccgtagacctcttctgtctctgttcctccagatcctctcccccagtctcattcccagctctgcagcacaagacctgagacagctttccctgctttctgctcctggaccccagtcctagtaggcatcccctgctaaaccaagggctccctctcccagggcaacaagttggctgaaggcagacccatacttctcctactgctcctgagatccaaacttcccagtctcatcttcagttccatagaaggaaacctcctgtggtctctactctttgacctcatccctaacagatcagaaggaccttctctcaactcatcccagtatctcagctcccaacaccagcaggcatttcctgtgaagacatcacctgagtaggccaggaagacaggtaacacacagctatcatactctgaaaatccagagaagaaacagaaaccagggagcaaaacattcacccagtaaagacaaacacagaaatcatgcctcgacctataatcatccaaaacctagatgcctacatgccagcaaaaaaaccacaatcagggcactctctgtttccattagagctcagctattctaccatatgaggtcctgagtattccaatatagctaaacacaagggaaaagatcttaaaaccaactatatgaagatgatagaggtcctgaaagagaaaaaaagaagcaatctctttaagaaacccagagaaattcaaacaataggaggaaattaaacacaagtagttgaagggatgaataaagctattcattgttcaagacttgacagtggaaatacaagcaataaggcaaacaaaaa

SEQ ID NO: 2269 - DNA, 1000 bp, mus musculus
tcacctgtttggttatgttttcctgtaattctttagtggatttttatgtttcccttttaaggacttctacctgtttagcaatgttctcctatatctttttaagtgagttattaatgcccttcttaaaattctctaccagcatcatgagatatgattttaaatctgaatcttgtttttttcgggtgtgttggggtatccaggacttgctgtgatgagagtactgagttctgatgatgctgagtcgtcttggtttctgttagtaagattcttacttttgcctttcgccatctggtaatctctggtgttagatattcaggctgtctctggctggaggttgttcctcctgtgattctgttcgcctctgtcagcactcccgggagtccaactctctctcaagtcccagtggtcagagcactctctgcaggcatgctctcctcttgcagggaagttgcaccaaggtctggagctcagcttcctctcctggctgaagatgaaggccaaaagggaagctgtccaagaagctctgttgcttctgcagtctgcacactctcctgcacaaactggactctgagagacctgggatacaagatggagctctccgctagaaatgttaaatagccctaccttgtttcaatattttgtacaacatccattagagatgattcataaacaatttcttcattccattatttatcactatatagatgatatcctaatggctgatgcatatataactatcctaaaaagaatatttgataaagtaaagcaaacaaacaaacaaaatcctttgacttgctggggatgacaaactgtcccttaaaaatacatttaaaaataagattcagttaattttgtagaataagtctacagaagtttaggccacaaaaagtacaaatcaaaagaaaccaattaaagacacttaatgattttcagaagctactaggagctataaactggctatggcctacaaatgacttgtccactcaagagctaaacaatt

SEQ ID NO: 2270 - DNA, 1000 bp, mus musculus
aaatccttctgttatacaacctcgagtttggggttgtgcgtgtgtatgcagatgtgaagaaatgtgccaacatacatgctgagagctgtacatttctgataattgcttttaaattactaaaagaagaatgaaatcacagaggtgtgtagcagaaggacagtctctctttttaatgatgacaaggtcaaaataaatgcccactggaaagatagactcgaactgtcccagaaactatacaatgtaacttgtgagatccagcaagtaagacgtcatgtcaatgatctgatcaaggatacctgccctggtcactctgcggacgttcctgtccacttgttcacattgaggaccaagatagccctttttacagaggcacttgttcggtctgacacagacacctccatgacggcacgctggctcacacttggctgcaagaaagaaaacaacacagcgcacttaatcttcacgcccgaagccatcatgtctgtggtcaagtaaaggtaggcaaagaaggtgggagacagtcacgaaatgactggacagagaatatctaagtacgtaaacggtttgcagacacaaggtattttaagggcagggaccaagctaaacatccagatgtcagcaggctaagaagcagagagcatgagaaactatctctgatgtgcagaccgactctaacacaatgatgtcagctctttcaactcctgcttcacaaggcatttcaacccacaaccaattccattcctgcagggaggagcacacaagatagaggttggccctgagaaagaagcccctagtcagagcaggtccagtgtgacattgaagtaaggtcattttgggagtggaggtgcataagctatcctgtatctggtctccctggggtccccacttccctatgcttttaggaggtgccccaaacacattgctttgtgattatgccccaaagcccatcctgggcctaatgcaagagactggcagatgaagttctgagcaatgctctttg

SEQ ID NO: 2271 - DNA, 1000 bp, mus musculus
ttacaagtaggatagtttttctgaatgggaactttggggatgagcatgtcacaagggcagaccattcataatgaagttaatgcatttataaaagaaacctcggtagctgccttgtcccctttatgtgtgaggtcactgcaggaaagcactacttatgtaacaggaaacagactatcaccaaatactgactctacagatgctttcatcttgcacttccaacctctagagctatgaggagtaagcatgtgttgtttataaggcacttagtctggggctttgtgtcatagcatcctgaacagaccagagatcttcctttgtcactgaaatcaacatgttgcagcctttctcctgttgcctttttattctgacaaaatattgtgaccaaaagaaacttaggtagaaggggacttatttcacttctaggttacagctcatcacttagggaagtcaaacagaacctcacatagaatcttgaagcattgcctgctgctagttctttggcttattcttagctagttttcacacacagctcagaatcacttgcccagggaattcttatacatagttataaatgatatatataagattgtgatgcttaaaattgatcgtcaacttgaaggattttagagtgacctggaagaaaagcttctgagagtacctgcagggagtattcatcaaagtgggaagacacatctcagttgtcagtaacatcatttcctggacaagggatctttgaacaatgtggataaatgaagtcaaactctaggaagcatgcatacatttctctgttcttctgattataggcatgctgtgactgcttcaagctcctactgccttgaccccctgccattatggactataccttgaagccagagaataagccctttctcccttaggttgcttttgtcagaatgtctaattgccataacaggaagagaaggtaagacagggattgcctctgttaaaatccttgttgtggtctctgttttcagttggattg

SEQ ID NO: 2272 - DNA, 1400 bp, mus musculus
ttgtgccgatgttctctatggaatcttctgcacctgagattctctctcccatctcctgtattctgttgctgatgctcgcatctatggttccagatttctttcctagggtttctatctccagcgttgcctcactttgggttttctttattgagtctacttcccttcttaggtcttggatgtttttattcaattccatcacctgtttggtcgtgttttcctgcaattctttaaggaatttgtgtgtttcctctttaaggtcgtctacctgtttagctgtgttttcctgtatttctttaagtgagttattaaagtccttcttgactctaccatcatcatgagatatgcttttaaatccgggtcttgcttttcaggtgtgttgggttgcccaggactaggtggggtgggagtgctgtgttctgatgatggtgagtggtcttgatttctattagtaggattcttacgtttgccttttgccatctggtaatctctgaagctagttgttatagttgtctctggttagagcttgttcctcaggtgactctgttagcctctatcagcagacctgggagactagctctctccttagcttcagtggtcagagtattctctgcgggcaagctctcttcttgcacagaaggtgcccagatatctggtgtttgaacctgcctcctggcagacgttgtgttccactcaccagaggtcttaagatcccatggagggtcctgtgaggaccttgggggtgtctggaaactccgctcgtagggaaccccggtgctggagtaaccggaagggacttgtgcccctgatcaggccaggttatctgtttccctagttaatgcagtttgaggtcccgcacgattggattggagcagacgctgtattccactcaccagaggtcttaggatcctgtgagagatcctgtgtgggtccttgcgggtgtctggagactctgagggcaaggcaccccggtgctggagtggaccggaaggctttctgatgcttttaaagactatctatataaaatatatctgaactgttaaaccttgactactcttagctatttctaattgaataatattaaaaacattttgctataattcagatataaatcagaatctaatataaccatgagtttactatctggcccttaacttgtattacttaatcatcccaaacagcttgtaatagcagctagaagaactgggtcaaagccttgtattcttaaataagttgcataggcacaatgcctatctaagagtaacaatattaatttcaaagattttatcaatatacaaagatttatgccgatgaaaatcttaaatctgtatcaatatataaattctgaaccaatgtaagaaattataacttcaattttgcatcaattacaaagatttctatca

SEQ ID NO: 2273 - DNA, 1000 bp, mus musculus
tttgaaattaaaacatagtttctaaaagagcagaacatcgtaattgatgatactcaatcatcttagctctgagctgcattcactggagtctcatggcacaatgatgtgcatgcacatcaagttgtgcagtgtgtcatggctgagcatacacttcagactcattatgcacttgcctttgaattaagttttttttattagatattttctttatttacatttcaactgttatcccattttctgatttcccctccaaacccccctccccctatcccctcctacctccccctgctcacaagccccacccattcctgcttacctgttctggcatacccctacactgggacagaaccttcacaggaccaagagcctttcctcccattgatgaccaagaaggccatcctctgctacatatacggctggagtcgtagatccctctatgtgtactcctttgttggtgatttagtctctggaagttctggagttggggggtctggttggttgatattgttgttcttcctatggagttgtaaatcccttcagctccttcagttctttctctaactcctgtattggagactctgtgctcagtccaatggttggctgagatcatccacctctgtatttgtcagacactggtagagccccccaggagacagctatatcagactcctgtcagcaagcacttgttggcatccacaatagtgtctgagttggatgactgtatgtgggatggatccccaggtggggcagtctctggatggcctttccttcagtctctgctctatactttgtctctgtaactcctaccatgggtattttgtccccccttataagaaggaatgaagtatccacactttggtcttcctttttcttgagcttcatgtggtctgtgaattgtatcttgggtattctgaacttctgtgctaatatccacttatcagtgagtacataccacgtgtgttcttttgtgattgagttacttctctcaggatgatatttt

SEQ ID NO: 2274 - DNA, 1200 bp, mus musculus
caatgaactccaagttcctgcatatgtcatggactggcagaatctttgaaatcctcacattttctaaaatgtcacagtctacacaggtgggatttataagcctgggcttttagttgaggctgctgaaagaaggtgttccatccccagagctagcagcttcctttccacccgagcttcttgttctgagattatgaaaagagctctcaggcagagatatgcattctgacagctttcagggtaatctgaagcacagtggagtggatcagtcgtgcacagtatgtgtaatgcacagcacagggccaagaaggacactgagtaatgtggtgagcaaagtgagtatcagaggagcaggaaatgactttgaggtctgaccactctttcaagaatcattctgcttaatggggacaaagaaatggcccaacaactgatggagaggtcaagctagggaggcctgaacagtgacagagattgcagcatcttaacagatggttgagttagtaaaacacaaggaaacatttctttagaagttcatgagaattacagcaaagctggagggattctgatcacaaaggagatgaaagagttttagctagggacaaagaggaggaggatgcatgtttgggggttagtgaatgagtagaggacttctctagagtcctgattgttcttctcttcttagaaaaccagaagccattgctgtccactgaacatggcaatggaattccaggagaaagaacggtaaagagaagccacagcacagcatagtgagaggaagcctggtaaaattgggccaaaggcttgaagcccaggagaccttgaagggatggtaggagctttgcctgctcctggcagcaggcctctatcacgtagccacagtcctccaatagatttgtggctgtcagtcacataaaggaaacacctcaagcccttccacatgtagatgagacatccctaacatctcagaccaagacaacaggaaaagagacgtgacctgtggtcacgtaggctcaagacagagatctccatgctaatgatgtgcctagaggctcaaagggcatcgccaataagattcccttcccatatattcctccctgcaaaggtatttaatctcaggcccaccctgagaagtgagatatggttttatacatccattttccattgtgacaataaactgtttagaaccatggactgcctcttttc

SEQ ID NO: 2275 - DNA, 1000 bp, mus musculus
tatgaaacttttcatctctaggatagagtattttcttcttttattggttattttatttatttacatttcaaatgttataccccttcttgatttcccctccacaaactccctacctcatcacacacacacaccccgcttctgtgaggatactcccccacctgcccacccattcccaccccattgccctagcattctcctgtgctgaggcatagagcctccacagaaccaagggcttctcctcccattgatagtaaataagaccatcctgtgctacatatgtggctggagtcatgggtccctccgtgtgtactctggttggtggtttagtccctgggagctctggggagtctggttggttgatactgttgtttttcctatgggttgcaaaccccttcagctccttcagtcctttctctaactcctccattggggttcccaggctcagttcaatggttgactgggagtatccgcatctacattgatcaggcactggtagagcctctcaagtgacagctataacaggctcttatcagcaagcccttctttgcatcagcaatagtgtctgggtttggtatctgcagctgggatggatccctaggttgggaaatgttgaggagggggaagtacagagggtcaggaaatggaaaggagatccgtaaaagtgaaagatggggaactagaggcagccactagaaagtcccagatgcaaggaaatcaagaggctaccaggacccaatggggatgacattagatataataccccacaaaggggacagagaacctgtagagaccatatccagaggttaatcatggctgctggttgagggctggggactactacccatctcaaaaattttaacccagaattactccagtctgaaggaaatacagggataaagagtggagcgcagacggaaagaaaggccatccaaaaactgtcccacctagactagagtattttcttatgtaatatataatcttcaaacattttaataaagat

SEQ ID NO: 2276 - DNA, 1200 bp, mus musculus
gtttctcattggcttataaaaatactctgaggtggttaggatgcgttcatatgcaagagtctgtatttctcttacatgaacttcctcaaaatccttcaggaagcccaccttgggcagtgtggtgtgtaggtccgcaggagtgctgggcaggcaaaacacggagggggcaggagttagaaataaagagttgggtgtccactgacccaagatgagggagctctcaaactcctagacatccaggcgctgttgggtcgtgggaagttgggagcagagttgggggttcatgggcctgtgaagaggccagaccagtgaaaggggaacttcagcttagctcctcattgaaagcccttagcttagtggtggctctccaggagtgcagaggggccttctgcaggagccttaggcagtacagctctgtaggcagaggctttcttcaagctctccttggaagttcttgatgcaagagacagtccttggtcccaaactgtttgttcatcatagaaaacgggtgcataccaccccctcagggtggaccagagattaaatatcttttgcagggaggaatgtccaggaagggatgcttattagctaaaccctcaggacctctagatacctcattagcgtggagaactttgttctgagctatatgaccacgggtcatgtttcctatgtgggaaatgtggtgtggcacgttccaggacaggaatctggaagggatcagtgagccacctaccatctcaggtgggtgcctgggttccggggactctgaaccagctcaaccttgtcaagtttcctgtcaaagtccactgtcgcacagtggtggtcctgctagcaatgttcaaaacggacatgaagcagagacatctacaggaatatctgggaactgaaagagaggcgcctatagcagtcaggactgaatgacttctttggaaatggggtgtttagtttcttaagaagctagaaaacaatgttttattttatgggcttaaatcccaatccaaagtaatatacatttgaggacaagagtcaaaggcttatgagactcactaacattttaaaagttcctggaaccaaaaacatgtaaaaattcacacgttgctcctaaatatatatattatattttgagttttattatatcttttcatggttctatgtattgtggaggtacttagtaagcaaaagccaaagttactgaacaag

SEQ ID NO: 2277 - DNA, 1200 bp, mus musculus
ttcctggatgttttgagttgggatctttttgccttttgtattttctttgattgttgtgctgatgttctctatggaatcttctgcacctgagattctctcttccatctcttgtattctgttgctcatgctcgcatctatggttccagatttctttcctagggtttctatctccagcattgcctcactttgagttttctttattgtgtctacttccctttttaggtctagtatggttttgttcatttccatcatctgtttggatatgttttcccgtttttctataaggacttgcaactctttagcagtgttctcctgtatttctttaagtgaattattaaagaccttcttgatgtcttctaccaccatcatgagatatgcctttagatctgggtctaggttttctgatgtgttggggtgccctggactggctgaggtactgtactgggttctgatgatggtgagtggtcttggtttttgttagtaagattcttatgtctgcctttccctgtctggtaaactctggagtcagttgttatagctgtctctggttagagtttgttcctctcgtgattctgttattctccaccagcagactggggagactagctcactccttagtttcagtggtcatagcactctctgcaggcaagctctcctctttcagggaaggtgcacagatatctggcgttcatacttgcctcttggcagaagatgaaggcccgaaacaggacctgtcccagatagcttctgtagtccacactctcacctgtgaagactagtctccgtggagtctgggatccaagatgtctcccgcagatgctctgccaaagccctcctgggccaggtggacacctatcctctggcagggaaggtgcccggatgtctggagcccaaaaagggggttgcctcagaagctctgtggctcctgcctgtcccagaagctgttagcttctgtagtccacactctcacctgtgcagagtagtcttggttgagtccaggaaccaagatgtctcccacaaatgctcaggcaaattgttttgtttttttaaagcatagctttcaagggtcccatggctcaattggaaaattgttgaaaatagaatatatatatatatatatatatatatatatatatatatatatatatataaactaacaaagaaaataatgacatcattcttagaactaacagttattgc

SEQ ID NO: 2278 - DNA, 1000 bp, mus musculus
caattttgatattcaacccttatgctccaatgaatgcccccctccacacgcacacacaaaaggtaactccgttttgactgtgcagcatgcaaccaacaatgactttgaactttcgatattcccgcctttacctccccagtgtcatgaatgtatgtgccaggcaagcactctgtcacctgaactacatcctcttgagtctgtcacagggaagacccaaccagggacctccagttctgtcctttctgctgtgtcccacgcaagctcataacacctactctactctcccaggaggggtgacattgagttaaaggaagttccctgggactaacgaagcctgcatttaatacaccctagctgaagttttacttctctggtcaaaattaactggagtgccgcaccccttcatgctgcagacaactggggcagaagaggaggcagagctttgagtaagagtgatgggaatattaccaggaggagcctgagcaggtcctgctccaggcaggactccataggcaccacaagcctcttctgtggttttgttttagttccggaatgtctctaacaacccaggttacctgccatcaaatacttccacaggattttagttctgtttaccgtgtagcttcctctcaggctatgactctaagctgctaaccctcctcccaggaccctgccaaagccacatctctgccagaataaaccatattagtcaccaagccttcctccgcagccaacagcaaccctctcccatcagtgtgctggccaggactcagtcagacaattccctggtggcctccctgaccaccaccagctcactgagaagcacggtgttaggctgtggcaaaatttcctctacacattctgcaatcgtgcacaaaagcataacccaggacggccaacctttgccctttgagggaactcaaagctcactccgagcattgcacttgaggacccactcggctgcctctgcaaaggagcgcagcagccaccttctcagaaa

SEQ ID NO: 2279 - DNA, 1000 bp, mus musculus
tctgcactgagagcctggccttcccatacatgggcctctgggagactgtgctgacgacctgacacaagccagagtcattttgggagagggaacctccattgagaaaatgtccccaccagcttcccctgtgggaaagcctgtgctgccttttcttggttgatgattaatgtgggtggacctagcttactgtaggcagtgccactgctgtactggtggttctgggtgctgaaagaaagcaggctaagctagtcctgctcccaggttcctgtcctgcttgagttcctgccctgacttccctcagtgatggacggttacctgagaaaggtaagatgaaactctcctctcaaactgctttggtcatggtgtttggtcacagcgatagaaaccccaagacagggactcttgcacccttttctgttccccaccagcatttcaagagctcagctcacaggtaaaccaacctgtttactccaatcaaagtctcaggcaacggtgtgtgtatgagtgtgcgtgcgcacatatgtgtgcatgtgtgttcaaaggacaacttacaggtctctccttccaccacatgggatcccagcatcaacacaggtcctcgggcttggcagcagaggtaaagttgaggtgcccctcaccagcccctactggtcacctctgcattggctctgacagaatttcagagagagatagcttacaggaggagatcactcctgagggctggagccgtgacttcattggccagaatgcttgcctagaattctcaaggcctcagcttccatccccagctctgcacaaacctggcacagtggtgcttacctgtaacccagcatttagggctcatagcaggagatcagaaactcaagatcatctgctccatggtaataatatgagcttgaggccagcctgtactatggtaagaccatgccttaaactgttctactggctcacagtttaaacatctcaaaccagggctggagagatggctcagtagtgaaga

SEQ ID NO: 2280 - DNA, 1000 bp, mus musculus
taaatgacacagatgttgacaggggccagggtgagaagcctagaggacagagggaaaggtcagacctcaggaggctcccagcgctaacagccaagtggggctcagagctcagccagtccataccccagggacttgacccatagggagagtggcaggcgtggtaagagggagccctgaagaagtccccaagacaaactgatccagtcactgagggaagacatcctcaggacatttctagatggaacaaattgttgccttctaacatcctatagcagctggaaagggtcaaacccttgctatcatcggcagttgtatgggtgcccaagagggtcttcccaggcagctttgccttttgcccagtcaggccaacagaagtttgaagggttctatctgcccctaccctgcacccattagtctgcaggttgagtttctcttcctgttcccaccctatcactccctggctccctctacaggcagggctcccccccaggactggcagccaaactgctgcagcagatcttatgaggcttccgagccaccgtaatgctagtgccctgagaaagactgagtgatggcttccagctccaacgatggtgaggctgagccctgttgttatagcaacttcctagacactgtctgccccttaagtcagggaggggctgtgatgggggctgaggggagcaggtggagagaaggagtctgtggacccttaagtatccctggaaatgcctccattcctaaaatcctgggctagaaaacctgaggaagaagaacagggggatgaatggtccatttcagaccaaagcagatggtctacccggagtagggctccagctgggacaggggatggagtagtcccacccagctttgggattcagaccagaagaaagataggtccaccttagacctgggtacagtagagtttgcttgataccctgaaccctgcctggagatagagggaacctagtgttgggggggtccccctcaaactgggggtata

SEQ ID NO: 2281 - DNA, 1000 bp, mus musculus
ggaatttagtgatatcctgggggcttggggaactttgaggaatgctcaaaagatgggcccagcagagcaggggcaggtccctgaatctcctctggggcaagccatcaaagatgaaggtttgagaggaaacctgacccacacagttaccatgtcctaatacgcccctttctggccttgcgagatgagggcatagagccctctgttggcatctttgtcttgtgggtccctattctagaattatttccgcgatgcctggaacatcttcgactttgtgactgttctgggcagcatcacagacatcctcgtcaccgagtttggggtaagtctcctgccagcttctctctgggtgactcggggctgcactagtgggaggcaacagttgctggcaggcacagtggccagctggtagcatagagggagaacatcagaggcacagcctgagacaggagtgagggtgaagtttttctgggtggtaatttgggggtacgaaaacagtttttaaggtttcagtgaagaggggagagaggtatgtccaaagctgggacatagggccaaggcagagcagtgtgcctctctgcctggtggctggtgaattgtgaatagtgttaccagttcactacattgagagctcatgcctttaaagacaaatagaactgaattcctgatccaaccggaccacgaattgtggtccactgccccctgctggccatggtggggatagcactttcaagaccttaggctagtctctggaataagcagccctccaccagccccaggcaatgcaaataaggaaagtggggagagaggagtacctgagctttcagactacattgtaattatccctttttaggtaaatctaagagtccccagagtcccctcccaaaccttgtccttggccatgagccagtgacccctgacttgggaaccctcaggagactaaggagaccataggagatcctcccaggggaccagaaacaaaaagctactcatcgatgcccag

SEQ ID NO: 2282 - DNA, 1000 bp, mus musculus
ctatcagagctccatcttccttctaggccgcatctatgaagggggaagttccttaattgtttcttgattgggtcaataaagacagcagaagttcatttctgggtgaagataaagaggtgggatttctgggtcccaggaggaagaggaggagatgagatagagaaaggcgttttttttggccaggctttggagagaggagcatggacaccatgtaggtctggggactattagaactggtagtggctgccaccagaagaattctaatataggattgctgatgagcttagaacaatagagtccatgcctagcagttgtgtcatctggccgattttaaaatatactaagattttctagtgtcttccctctgcagtgactcatgtgggcaggagaaagcaggccacagggcagttggtcagtggtatgagcagtagctccaggcattctcagaaaggatggttgttgggtggcttagcaagccagctggaggaacaggtagtgttcttgggaaaatgccagctggaaacatgatggtggctgttctcaaaacatagctggaaaattggggagagatccccagaaagaataagtgtgtttttaaaactacacacaacacatcttcatctgcatccctggatcagcataccaatccctgcctaagcttcgcttgcctctcaggaggtttgcttcaacccaggacatataggtctacctgcctctcagaacctgtttcaactggggatacccaggaactaccagacagccaacatcagagacaaacacatggcaaaaggcaagtacaagaagataatcaacagaagccagtgcaatatgtcaccatcagaaccctgctctcctactacagcaagacctatatatcctaatacacctgaagaacaagactgtgacattaaatgttatctcatgaagatgatagaggcccttaaaaaggctataaataaatatacataaatccattaaagaaatacaggaaaccacaaac

SEQ ID NO: 2283 - DNA, 1000 bp, mus musculus
ggtaccaacccagcctggcatctcagggcactgtagaactaggtacatcttcttccactgaggtccgacaggaagcacagtaagggtaacaggatccacaggtaggcaacagattcagggtaaactgccacttcagttattgggggacctgcatgaagaccaagctgcacatctgctacatatatgaggaggacctaagtccagcccttttatgttctttgtttggtggttcagtttttggaagcccaaggattagctgacttcattggtctttttgtggagactctattcctcctgggttcctcaatccttcctctaactctttcttaacacttcctgaactgggtctaatgcttggctatggatctctatatctgtttcaatctgatgttgggtggagcctctcagaggacagttatgctaggctcctgtaagtgcatccaggttgacagatacaaagataggctgaggctccaaggtagtcaaaagagtaaggcaggtcatcaatgtgtctctattgatcctcctaggacagcttggtacattattccctctgcccccaaccccaaattgtcaggggttgctattgtatttatttatgtccatctcacatagggtacctgtgtatccaggccagcactgacaaatataactgtcaacagtgtcttcatgcccttctggtcagcgccagcactgggtcaccttgggcacagaatcggcggacacccccacagttcctagaggactctccacgcactctgaggatcactggtgagcagaacacagcatcagttccaatccagttgtgatgggcctgtgacagcaggaacaaggactctgaagcccttcctgacctgaggctcactcaggttccttttgatcagttctgtttaccttggtttcaaacagaccagacagctccacggtcctcaaaggagacaccatttccaggcactgtaacacgcccaggatcttagaacaacaggatcccaggataaca

SEQ ID NO: 2284 - DNA, 1000 bp, mus musculus
actagacaggctgcatgaatcctcctatctctgcttccctactatccatcttagagttacaggtacatggtactgtacctggtttttggagatctgacatcatgtctgccttcttgtgtgacagacacttttctgagtgagccatgtctccagctctaaaatcctttttcagaactataaatgttgactttcattgtgttttgcatattgtgaattcattcaattctaagtattttctgtttttacccttaattttgtcctttatttcacacaagtttgaatccatcaaatttccttcagacatgtggtgtttggaatatgcttggcccataggaagtggccctattaggaggtgcagccttcttggagtaaatgtggttttgttaaaggaagtgtgtcactgtgggggtgggctttgaggttctatgcttaaattccacccagtttgaaagagaccctcctagctgcctgaaagacagtctcctcctggcttcctttggatgaagatgtagaactttctgcttctttagcaccaagtctgtctgcatgctgccatccttcccaccatgatgagaatgtactgaacctctgaaattgtaagccagccccaattaaatgctgttatttataagaattgtcttcaatgaggttgtctcttcatatcaatgaaatcctaagacaagttattgctaatttccttccacaacaataagaaaaatactttttatgcattcagtcttttcaaagttatttagacctattaactttatcctaaagaatggtcgatgccagagaccagtccatgcaggagagcacacggactgtagaagcaacagtttcttggacagggtcccttcagccttcatcctcagccaggaggcagagctgagctccagacctcagtgcaccttccctgccagaggagagcttgcccacagagagtgctctgaccactgggactcaggagagagttggactcccaggagtgttgacagaggct

SEQ ID NO: 2285 - DNA, 1400 bp, mus musculus
cctacaattttcattcaaatgctcccacaaaacccagggacattgatggtcaagagaggagtggcctgtgttacagtgtaatggcacacctggggcacatgattgctgccgagttcttcatcttccctgaaacttctaaagttgtctgtaggtttgaaaacactcataggagagtgttgcaatacttgtgcattctgaacgttgctgattagaattttctggatacttgtttctaaaattagaaggtccagaagctttgtgtgaagactcaagattcagcagaactgggcggggcttagtctatctgctttgaaatgcacaccacattgctgcggtgtgtgtgtagaacaacataggagatgtctctttctgccccggtttggggtggaatctctcttgcttctgctgctctcttgctatcttctgtgcattccagacaagctggcctatgagtttctggcgattataaatgtgtgccactacatctgatatctaaaatatttattcattatttttgtgtgtatgagtgttttgcctgtgcatatgtgcacagtgtttgttgcttggagaggccagaagatggcactgaattccatgaaactggtgttgaggatggtcgtaagctactatgtgggtgctgggacctgaacccaggacctctgcaagagcagtaagctctcctacctgctgagccatctctctagccctgcatctgatttttttaaaacacaggttccggtcttttcacaaggaacttgggtggtgtctcaaacttgcaaggtaagtgctgccactgggccatctctcttggctacctgaagttttaatcagctctccagagcaagagtaagtactgtttgggaaacactggttaatttatgtgcagagaatttgatgctgtgtggaagaaaaaagtagaacacaatagaactacgacagtagggacagggacaagtaactagatcccagacaaggtgcgacattggagactcagtcttaacaagatttttaagtgattatgatgttgtataagggtcaagaaactccaagtttggaagcattttcccaaagacagtaatgttttgccagctgaatggtaggttccctggatttcccagaatgtataaaaaactgtaagataggaaaataaattacaccagttactggtgttcttgctcctggggaactgagctcatgacaggtgtgtcccttagttccttttggatgtgaactcaccaaggcaagacaccaaggcaacctataaaggtctaggtgggtaaaaggcttactttacatgtctttgccagccacacaacacagggtattctacacagctctgtaacacagcaggaggagctatgaagatgtgttcacaaaggttctgtcccaggagaaggagg

SEQ ID NO: 2286 - DNA, 1200 bp, mus musculus
attcttcgctaacaacgcgcatgtactggtttgcttcacgttgcacagctcagcatcctctgttcatcataacctgcatgggatccctctgtgacttgccaaggatcctgaaacaagcactagacattggggcagcgacctggggctttctcctaataatgacaaacataggtcacacatcacggagcctcacgcacctccattacctccattcacttcatgcaggaacagacagttaccacacataggggttggtgcggaaagctagccaggatgacttgatgccagaacatatgtggtcaggcttcagataggcctcctcccagaaggaagagatgggtctgatctgcaacaggatgcagtcagactgaggtgtagtccctgcctctggtttccagtcacgagagcttttgagtctttgtgttagagcaatctggagcagaccctgtcacatcagaaaagggaatggcagggctggagagatgactccatgcctaagaggacctgttgttgctcttataatagacccagagggggttcccagcacgcacctgatgtctaaccactgtcaggaactccagatccgggtggatgggatgtcttcttctaacaccttagccaacaccagagtacacatggtgcacatacatacatgtctgcaaaacaatcgtacataaataaaattgataagacctcaaaaaaaaagctacagtaatgtcactttagaagactgccatcattcagaaataacagtattaaaaatgttgaatttagggtagggattgtgagaacccagtttaaacagctctagccaaggcctcaaagctcagcagaggggtttctccaagttcctgtatctcactgtggaggaaatctaaagcacattctggtcccctgagacgaagagacactgctgggagaagatctgctctgcatctcacagacaagcgcaagcatgctgacctgttgctgggagcgggccaacttcctgcctgtgtcctacaaaaaacttgacagacctgggaagtggctgagggccagacactgacatcagggcatgaggcttgctcatggtgggcgtgaccttccccctgatttaaggtaggaatgctgttggctgatgaatccatggtctcacaggttggtgaagtaaaaagagtcatggttcgcagaagcctctagtccaggccagtgggcctg

SEQ ID NO: 2287 - DNA, 1000 bp, mus musculus
agtcagtaggcacagcaagacagcctaggactgactggtccaggagtaaccatgagacccttacagcctctggcttagttactggtacagaaatgggcactgaggctggccttggtgggagctttccattagccactttgtcttgcaatgactaagctgactgtatgttagcctgaggctccgaggctccagaggaggtggtccttcggaagagtcacgttggaaaacagaggcaagagaccttggatcaaacccaacctgaagcttatacacctcttaatcttctcaatccagcgaacccatagattcctcttctaagtttggcccctttgaactggactctcatcctttgcaatggctgagtattgcctgacacaggtgtgccacccccatgtgcacctgtgcacacatatgtacatctttcattctttcacctggggttcactaagtgcatcttctgcctagagagcccagcatgacccataaccagagcctacagtgggactgagacacacagcccctcatctcaggagtgctgagaacagggacaacggaagctacttctctgctcagatgtcttttggaacagtctcaggcagcacatcactggaagccagtgccaaacagaagcacacatcccttgttcaaaatgattgacagtttaacgagggttggtggcacagtaccagggaggctggggcaggaaattcaaggccagacaggctacagagtgacttcaaggccagactgagcaatgtagtaagaccttgtctcaaaatagaaagtagccaggtatgctggtgtatgcctttaatcccagcacctgggagagaaaggtggaggaatctttgtgagttcaaagccagcctgggatacaaagtgagttccaggccagccagagttacagagtgagaccttgttttaaaaatccaaaaagtaccctccccctcaaaaaaggaaggggctggcgagatggcaagcaagaatgcttgctgctctt

SEQ ID NO: 2288 - DNA, 1400 bp, mus musculus
gctgacagcaaattatttgagcttttgtttatctgaaattatatttatcttgttctaataagctgggatcttgctgtatcctgaaatgctcaagttgactctgaactttcaattttcctgtctcggcctccacttctccatatttttctatatacaattctgaatatgcaactgttgtatataattttggagttacatctccctcttccatctccatttttagacatcagttttcttgtcatatctttttttctctgactgctttacagagctgtatctcaccattttttaaatgttagcatatgtctgtgaatacataaacatcagattttaatgttgattacatatacttttgagtaggctcagtttctcaccttttctggttggttttttgttaacctgacacaaatctagacatatttgggaagaggaatcttagttgagaatatacctccatcagattcttctgtggatacgtctatagaaaattttcttgattaatgattggaatggaagggccaagcccatgttggtgctgtcatcctgtggtcctgggtcctataagtaagcaggttgagcaagcaagtaagcaacacccctccatcatctgtttcagtttctgcatccaggttctgacactgacttccttcagtaatggaatatgtcttagttagggcttctattgcagtgtaaagacaccatgaccatggcaactcgtataaaggaaaagacttaattggggcttgcttacagggttagaggtttagtccattatcatcatggtgagaagtatggcagcacacaggcagacatggtgctggaggagagttctacatatggatcagcaggcagcaggaagaaagagagaggcactgggcctggcttgagcatctgaaacctcaaagcccacctccagtgacacacttcctccaacaagaccacaccttagtgccactccctgtgagcctatggggcctttaaggtacattcttctttctggtgcatctctcagttcactctttttcacagcatctaacctgactccaatagtgactatttcacttcagacataataccagttcatgaatttccactttgttctgttgaggtttagatgctgttatgtattgtagtggtacatactctccctcaagatctggttgccccaggagaggagctcttcagggaaaaggggatcctcacttataccaagtgatgttatgtaactttgctccttactttaaaactactggtcgagtgatgcctcccaggcgctcagctgtgtcgagatgaagctgaacatctccttccccgccaccggctgtcagaagctcatcgaggtggactacgagcgtaagctccgcaccttctatgagaaacgcatggccacggaagtagcc

SEQ ID NO: 2289 - DNA, 1000 bp, mus musculus
tttctcagctaaagaagagaaccaacattgccacatgccactgaagctccttgggcgctgtgcacatgataagcatcactcctcgccagccttactctggcctgagcatcccttcctgtttcccttctaaggtaacagggctctcgtgacagtggatcagcggctccctggtcacctcctcttccttcccgtccagaattctcacccacctcctgcctctcatagcatccttctgacagagtgtcttctccttgtgccccgccagccgtcagttcacatgattccttatccttaccccctccaacccaccagaccctccccttctgctgtgacaagcagcatgtcccctttccctccttggagcaggcagagtcactgacacactcctaccttgcattacctaaccacctcagaccctgtgacaggcagggctgcaggcctgccctgggcaaggctctccctcccctctcatctctctctctcctgcctgccagcactgacctcctggtacaagcctgtggggcttggcacctgtggtgagctttgacaagacaaagactctgtgtcacttccattaattatgtttgcgtgtggctatgaattttctgatggtaaaaatggatgtcacaaaatttacaattttagcttctattgaggtggctctcttgcctgaacccggggagtcgtctgtactgggtatgtgttctgtgtcagagctgtgttgctacctgcttgaagcgatgatgtttttctaattttttttttggtgttttgaaagagggtctccccccaactccccgagctaggattaggggtatgtatcaccataccccacttcagcaaccgagtgttttttccatgtatttattttccatttgaattacatatttagagacatggcagttcatatcctttgctcctgttttatggtgtgtgtgtgcgtgtgtgtgttatgcatacatgtgtgggtgtgtgcacatgtttgtgtgtatgtgcatgc

SEQ ID NO: 2290 - DNA, 1000 bp, mus musculus
ggggtttcttccagaaagtatgtttgaacgtattctcactggtcccgttgtgagagaggaagtaagcaggcgggggagaaggcctaaaagtggaattgccaaggctaccacagcagcagcggttcctgctggcagtgtgccaggcaaccctttgctggccaatggattgcttccaggcgtggatctcacagctcttcaggccttacaacaaaatctgcagaacctgcagtcgctgcaagtgactgcagggctgatgggcatgcctgccggcctctcttctggaggagaaactaaaaacatggctgctatgttccccatgctgttctcaggaatggccgggttaccaaatctgctaggcatgggaggactcctgtcaaagactgcagagtctggggcggaagaaaagcgaggaaatgactcgaaggagctagaaggaaaaaaagaaaggacagagagccaaagtccggagaatggaggagaacgctgtgtgccaggttctccttcgacttcctccacggctgcattgagttcagctgcagctgccaagcccatagctcttaacccactgttgctgtctaacatactttacccagggatgctgctcactccaggccttaatcttcatcttccaaccttgtctcagtccaatgcttttgatgtacagaaaaacaaaagtgatgacttagattcatctaagtcagtggaaataaaggaagagaattccagagttagagatcaggaagagaaagggggaactgagcctagtcctctcaacgagaacagcacagacgagggttcagagagggcgtcctccgggtctgatagctcatcttcatcctccgaggactcagactcgagcaatgaagactgactggggctctgcaacctcctcctgaactggttttgccttctctttaattactaactgtaaatatcccagtgttgagtgcatcaataacttactgacagaacatttcagttgtttgtttagaagtgcaaa

SEQ ID NO: 2291 - DNA, 1200 bp, mus musculus
agagagggagggagagagagaaggagggagagaggaagaaagaaaggaaggaagggaaggagggaaagaaggaaggaaagaaggagggaaggaaaggagggaggaagggaaggagggagaggggagaactagggtttgtctggaggtttctttttggatttttttattgttgtttggttggtttggtttaatttttgtttctgttttaagcaacctaatttaggtgtaaaaatccaacttccgtctgaacaacgtggcaacaagctagaagctgtgagtggcagtgctaaagcagagaggctgtaaggaaaagcttttaccaaagcccaagggggaagctgactgcagtcctgcaggactcccctgagccagttagaggcccagcaagctgaagaacctgttaattgcctgatctgaagccatggaggacgctcacttgttctcttcgccctctaccctcccacttcccgctcccacccttcctccttcaccccccaccccccagagaaaggatctaccttctctggtaaactccagttcttcagccatcaccttcttttggagacattgactctagcaccactatctgctgcatctttgactcctcctggattgccagagcatcattacccagtatcctcagctctccctgcagccataggactgtgttctaggtcaggtcagtcagggctgcctctggaatgttctccctgaccatcagtagtaacaaaagccctgtttttcctgaagtgaaagtgccacaccggaggggtgagatgcatgtggccaccttgccagccccgaaggcaacaaaaatgggagagatggaaataatgagactgaatcctgaggacattgttaagtccacagatgaagccaggcctgcctgatgctcactctgagccaatcaagcccccgttctcataaacacccatttgaattgggcattccattacttattagggaaagagtctcacccagttcatacaatctatccctaaaacactgaatcttgtctttgaataatcaaattatagttgtcctactcatcctaaaccagacaagggttcagatgccacagcccatcagacccatctttcacctttctgtgttctgagcaaaaacaaacttgctttgtttctttgagtttctggtcaggttttagtaatattaaaaaatgatattgtgccatatattctt

SEQ ID NO: 2292 - DNA, 1000 bp, mus musculus
gtgtgtgtgtgtgtgtgtttggttgttttttaagtgtgtgagtgagtgtgtgagtgtgtgtgtgtgtgtgtgtgtgtgtgtgtgtgtgtgtgtgtgtgtgtgtggtgtcacagaataaaagtacaagtaaggtgatttgctgcaagtggttctctcgtacttcatggaccttcagagataaaactcaagttgttaggcttagaatcaagcaacttcacccacagaaatgtaattttggcccaagatgccttgttttgttttgtgtgtttaacttggcacttgctacccaggcagttctggcctctagaaaacgatgattgatccttatatctcaatgtggatagaagggctagtaggttatattggcataaattttttgcaacctattttaatatgagttcaacttctcctcttgcccaccaccaatgggggaagtagacctgtttagcaatagttctttggggacaaattcaatcttctttggcagcagttcagtccaatagcaaacagcaaatactactcagcagctgcagaccagtcctctatgcagacacatgaaccagcaacttcaatccagtcccttcagcaggcagataccgggcacacatcagcagctgtagttcaatcctgaaaaataccaaaaagctcaccaacccacctgaggtgaggctgcagaagtctcaaggtgctgcaggaacctcacaagcagtactttgacaagtttctctcagtggtggcattatcacaaatgaagctcaacaacactatgtaagattgaccaatacatgcatgtcattagcaaagaatagcaaggtggggtaaaccaaaccaatgctcagtacaaatttccctaatttctttctcagcctgtttatcctttgtgtagagaaaggccactgatttgtttgagttaattttatatccagcaactacactgaagctgtttatcaggtttaggagttctctggtggaatttttaggctcacttatatatactatc

SEQ ID NO: 2293 - DNA, 1000 bp, mus musculus
aagggtgaggagcagaatccacgttaccctctcactcaggctcacactaaagccctgtggtgccacaaccctcctgtaagcatcccggagctactgaactctggacaccaagaacaccagcccaagctgtgccttgtggggtccagtgaggactgacgaagtgggaatggcatcttggaactcggccacagtcattgtagtcgcagactctgacagaggggcacgtggccacacaagctgcatggcagttacagcatcctcacagacctgccatgcaagggactgtaacaggaatcccagctacctgggaccagagccaaataataccacaaatgaccacacaaaggcagaaggtaagaacggactctgacctccacttgcatccggtggcttctatgaccaccccatgcccacacacatcatccctacaacacacacattaatagaaaaaacaattaaagtaacggcaaagtacaaatccccaacatcgcccacagggagaaaaacggcttctgtgaatgcttcagctgggtgccttctgcacagccaagaccaggcagtctatggggaagcacagacacacaaccgaatctctcgaaacatgcaaaaggaggtttgaataagagtagcagcctgaacttcctcagtctggaaactgcttgctcccagaagagccgtttctatcagggtgaaggtcaacacctctctggtgtgacgcccactcctgtcacagggctccttatagctggaatggaagggctcagtcgacaggacagggagaagggaaatacaagggcaggaaccctaagtggcccacagtttcctcctcttttgtaggaatgaaacttggagtatgagcaaatatttaaacagtgagggggagagcactagcgattagtgatgaatcatttagaaagggactctctaggggtcggagaaatggctctgtggttaaaggcacttgcttctctcccagaagataggagcttagttttagttc

SEQ ID NO: 2294 - DNA, 1000 bp, mus musculus
aaacaaattagatattgggggttgatgaaagaagagaactggggggaagaaggaatggggaagagggaaagggaagatcatacatagggagaacagggaaaaaagaagggatattggtggttaaggggcatccatctctaagatgtgccagaaatatggaattcagggagactccagatggtctctggaggtgactccagctaagaattcttgcagtggggcatatggatcctgaagtggccacttgctgtaaccagtcaagactcccagtggagggataaggacaacaacccaaccacaaaaccttctacccaagttgtgtcctgtgtagaagatgtgcagagacaacgctagagcagagtaggtgaaaatggccaatcaaagacaagccccaaataagacccatcatatgggcaagagccaatccatgacactatgatcctctgatatgcttcagacaggaacttaggataactgtcttctgtgaggctcccctaacagccacttgtaaatgatacagagattcacacacaaacattagatgggggctcagggagtcttatggaagagttgagagaagcaccgagaggcccaaagaggatggggactccacaggaagatcaacggagtcttggatttttcacaggaagaccaacagagtcaactaacctggacttttgggggctgccaaagactgaattaccaaccaaagagcaagcacaagctgaacctagatccctgcacatatgtagcagatgagcatcttggtctcaactaatcctcattaactgaaacagcctgtccttgagcctgttgtctgcctgcatgtagatcccatacccctaaatggattgctttgtttcgcttcaatgggagaggatgtgcctagttttgtagagatttgatgttctgttatgtgtgtggggcggcaggcaggggtgaagacagggatagagggtatagatatagagggtaggggctgttagtggaggagttgaca

SEQ ID NO: 2295 - DNA, 1400 bp, mus musculus
ctaagtttttgctcaacatgggttaaatgaatgggtgggtggatggatgtctgagggatggacaaatggatgagtggatagatggatcgataaatgaatagacagatggatggatggatgcatagatggatggatggatagatggatggatggatgatggatagatagatggatagatggatgaatgggtgggtgaatggttggatggataaatgggtagatgggtgggtggttatatgggtggatgaatggatggatgaatgggtgggtaggtggatgggtggatggatggatagatggatggatggatggatggatggatagatggatggatgaatgggtaggtgaatgggtgggtgaatgggtagatggatgagtgggtgggtggacggtgagatgaatagatgggtgggtagatagatggatggatgactggatgaatgggtgggggatagaagggtggatggatgaatgggtagttgaatgggtagttgaacgggtgggtgaatgggtagatgatgaatgggtgggtgtatggatggatggatagatggatggatggatgagcacaatctaacttgggaaatctcagaggagacaattccagcttggctggaaatgagccataatttaatatttgtgtttgagagaattaaatataatattaaaaaatacagagggcattcccaaatagcacaatgagggagcaaaattcccatgagagtggacagacctgtgagcataggtaaaacaaacactgctgctcagaggaacccaccccagaacccacaggacacgggacggaggggtggcctcagacaggagccttctggtttccatcggcacctggagcagatacttttccacagggctccatatccaaatagtgccaagagggagtgagcctcccaggagcatggacaggactatgagtacaagtagggcaaccacttctgttcaattcctggcccaagagggaccctcacagactcatcaggacacagggacaaaggattagctggggcaaggatccttctggccgctgtctacaccccagagctgaccctgtaccacagctctccatacctaaattccctcggagagaactgttctcccaggagtactgacatacaggcttacaggacagacaagccatagtcagagacagcaagaccagctaacatgagagatgtccagatttatgaaaggcaagcacaagaacataagcaacagaaaccaaggctacttgacatcatcagaatcctgttatcccactgctgagaagctgggttacccaatcacaccagaaaagcaagactctgatttaaaatcacatcctctgatgatgatataggaatttaagagggtcataaatagctcccttaaggaaatacaagaga

SEQ ID NO: 2296 - DNA, 1000 bp, mus musculus
tacagtagccattagttgtattaattgaaggtgagtgatgaactagctcagtagtaaatggtgtttaccacaatttgatatcctactttacaatgtgaaagaagagaataaactctagaatttccacaggtccaacatgcacatacacacactgcacaccacacattgcacaccacaacacaacttgtcagagattgattccatgtgtgtgtgtgtgtgtgtgtgtgtgtgtgtgtgtgtgtgtgtgtatgatcaaacacgcataggtatgtgtatgatcaaaagttagagaagtatgtttctttgtttgttttgtcagtgcccaggatggaaacctgggcctgaaatgtccactaagctaggatggaaacctggacttgaaatgtccactaagctactttcccagttatagaagaaattctgaaacttggtatattgtgaactggtcacataagagatgaattaaacaatagcctacaaactagtttaatgtgttgaagagtaaaaagaatgtggccatgacacaggaccactactctaaatggacaaggaaggaaatgttgcttctattgttgggataacaggacacacaaaaaaagatgtagcccacttactagctcctatcttaattcactcagagattacccagtgccaataatgcatatatctcagttccatcaacccctgcaataagtgttataaatggctactgaaataggcatcagcttggaagcatctcttcttggaaccattccactcttgggaatatttcctactcttctttaataattctatactcactttgcattctacattccattatacattttgggcctgacacaagtttagaagcttctggttaatgttggttttttatgaacgttgatcctgtgacattctagatctccaaggtaagcctacaaagagataagaaagattctttcatcctcaaaaaaaaaaaaaatcacaagcaatgctacaggtgtgccaggcttagagg

SEQ ID NO: 2297 - DNA, 1000 bp, mus musculus
agggggaggaaaagttttatttcatgttatacatccaagtaacaggtcatcatggagggaaggcagggacagagctcaaaacatgactgtggaagagggaatgcagtagagaccttgaagaaatgctactaactcattcctgtgagtttgccagtttacttctaaatatcagagccatgtggtgagggactgcactacccacagtgggctgaggagtccaacactaattattatttaaaaatttaatttaatttaatttaatttaattttttacttgttcactttacatcccacacactgcttctctcctgatcacccccctcccacactcattcccccatctcctgagggatgccctggttatatcctggtcgtgtcacttcaaggttaggtgcttcctctcacactaaggctggacaaggcagcccagctagaagaacatatctcacatacaggcaaaaaactttgggacagcccctgttccagtttgggacccacatgaagaccaagcttcacataggctacacatatgtggggaggcctagtaccagactgtgcgtgttatttgattggtggttcagactctgatagcctcaaggatcctggttagttgactctgttggtcttcctgtggagttcctatcccctttgggaccacaatccttcctcatattcttctgtaagagtccccaagctctttctactgtttggctgtgggtatctgtatctgagtcagctgttgcgtagagcctctcagaagacaacatgctctggtctataaggataataaagtattattaacagccaactccagttattaatcaaggaaatccccccaaacagcacccacaggccgatctaagaagacatttcttcatcttaagttctctcttcccaaatgagtatagtttacatcacactgacaagcactagacagaacaagatgtctgtgctcacgatattggttcttcctcttcgaagctactttaaatagtagtgt

SEQ ID NO: 2298 - DNA, 1000 bp, mus musculus
atcccctacccacccactgcccctttttggccctggcgttctcctgtactggggcatataaagtttgcaagtccaatgggcctctctttgcagtgatgaccgactaggccatctcttacagtaggttgaataatgctgtgactaataattccttgattaaaatcactagaacatgattatataaatgtgagtgtgtttgtgtgtatatatattacataatatcaacattgattgtcactgaatttgtatttttaaatgtctatcaatataattatgatatcaaattgaaagaatcatattaactatgctatgaattttaatgcaaggataagtgacactcaaagagaaaaatgaggcagattcaatggtaaaagaagggaacccatagaagaaataggcagaattgtgagaaatcaaaaaggaaaaaagtatgaaacacagcatagttaggaaagaactcttaaagacctgtaaagagaattcagttttctgttgatatctttgtctttcatttctgactttcagaacaatgggagaatgcagttctaatgctttatgctactaaattgctgtcattttaatagagcagccccaggaagcaagggaaagaattaatgtcattcaacacatatggaagaaaaatgagaggtaaaatgtgtcacccaaggttaggaagtcaggaagagacaaagctttgattgagaccaaagcctgagaaattcaaagacttttgctgcatactggttttactttcctacttgatgtgattaaggtttgattgacattagaaccttttgctttaacttgtggattcaaattcctggcagcactgctacaagaagagcagagtctgccacctttgttacataaagagctacatgtggattatagtgacttgaagcaccagtttcattctgttccattgtttcatggtgaagggatttgggtacttattgaatggacagtttttcctcctaatttagcaatgacctagaagcaa

SEQ ID NO: 2299 - DNA, 1600 bp, mus musculus
tcaggttctctggcgcaccctctcacctgttcagactaatttcctaagttaggcgggtctcggaccaagatggcgaccgctgctgctgtggcttaggccgcctccccagccgggcgggcacctgtcctccggtccagacggtggctggctgtccccggcccacaaagggtgctgcctcagtgcctctgtgcttccgcctgttccagaagctgtcaggttctctggcgcaccctctcacctgttcagactaatttcctaagttcggcgggtcccggaccaagatggcgaccgctgctgctgtggcttaggccgcctccccagctgggtgggcacctgtcctctggtccggaaggtggccggctgtccccggcccacacagggtgctgcctcagcgcctctgtgcttctgcctgttccagaagctgtcaggttctctggggcaccctctcacctgttcagactaatttcctaagttcggcgggtctcggaccaagatggcgaccgctgctgctcaagactctgatttcaaatgaggtcatcttcacagtagcagtaaggaactggagtgtgtgcatgtgtacgtatgtgtgtgtctatgtgtgtgtatgtctgtctgtgtgtgtgcgcgcatgcgcataacagatgtagtgataattaattccattgcattaccattaccactagaaccgttttgaagcaaggacttgaattaagtctgtacgacctaactttcatgtgacccggatgtattggaatgcctgtgtcctgactaattggaatttaaggtttgccataccttgtaatgcgttagcctacctcccactgctttctggcagctttggcagcagacatctagctttttcttgccccctatctcccctcctgctgctctggttctcaaaggctgtttaatgggtactaaatcctccatgccctccagtcactaaatcaggatcttaatagcatcctattaattgtataaaataaggatttgaaacataccatatagtttttttttgcattttaattaaattccattgatttggaaaaactgatttattgagaccttaacaaccatgcaacacacataactgagttcttaagtctcaataaatattttggtgggaatcaattgacttttgattaacaacaaatatctgcttttataaatctcagtgaaataagctgtggagtgtagatagacattttaattaagctggactttttattcttatacctaactgcctcaacccagaattgcttatctaagccttttacttgggaaaaaatcagaacaaaagaaaatctatttattggcattaatggaataagtgttcatgttcattgtgagtgtgtatgaagactggatgaaagcctcttagaaattgagcctcttaggattttcttatttttaactaggtttaccatgaacatccttttgggattattttagcaatacagctaatacatgttttcttacacaactccaaatcctgtcatgcaataatgagctttctcttatctcaggacaatgatccaattgtgatatctactgcaagagaaacatcattcatgatactctctttgtgtttctggaatca

SEQ ID NO: 2300 - DNA, 1200 bp, mus musculus
tcataaacgcatattggtgtgaattacttcaacattaccattatatattgactagatttatttattttctattattgttgttgttgttgttgttaacttttgcttactgtgagtgagaattcgcttgcatgtatgactatataccacttacaggctagagaaggacaacagaactcctgggactggtgttgcagacacttgtggtctgccatgtgggtagtggcagctagtgctcttagcagtggaaacatctccctaaccccttgaatctttattttgatctctagcttgaccatgattttaattttcctaaatatatcaatattgtttgttgctgatgagaatcaaaataaacactaaaaatatcattcagtgaatgaaaactcaatgaagggatagccacaaaagtataagtggatctaacacaaaaatgtataaagaaacacctagcttgcatctcagcaaaacatataccctcttctcctttttacaggggtagaagtaaattggtataacaaaggccaacaaaacctggaaaaaaaatctgtctatctatctcttgttttctggttataaattgacagcttttctacatgctaggcaagtaatctaccactgaagatctagcattttccttttttcaaaattatttattctctctatagcccaatgtcagccattcctctcctcccagcactccctcatgcaaatccttacccccattccaccagaaaaggagacaccctctgggtgtcaccaccccaagacaacacacatcaagatgctaaacgggactaggcacagtccctcccactgacgccagacaaggcagtccatttaggggcatgggatacacaggcaggcagcaggctgaggagcaacccctgctccagatgttgatggacctacatgaagaccaagctgtccatctgctacatatgtgcagcggacctagttccaactagtgctcactcttttgttgatgattcagtctctgggagccacagggttagttgactctctttgtctttctgtggagttcctgtcctctttgggtctcttaattcttctcccaactcttcagtaagattgctgagctccatctactgtggggttgtgaccttctgcatcactttcctttggctgatgggtggagctgcaaagaggacagttattctagattcctgtcaagcatgtcct

SEQ ID NO: 2301 - DNA, 1000 bp, mus musculus
tggggcctaaaaaaaattcttgacgcttctgcaagtagaagggttgaaaccatgaaccataaattatacccaaagaagagaggcaaaacaatcattaataaaacagaaatggatgccagtagaaatggacattcaccaaagaagatgtgagggaaatgtatgatagaaaagacagcaacttaagaagtttaaaataaatattctggaaatgattttcctgtaggcaagcctgtggtgtaatttcttggttgatgattaatggggagggtccatctcactgtgggtggtgccatccctggattggtagtcctgggtgctataagaaagcaagggagcaagccgcgaggagtaagccaataaaaatcatgcctccatggcccgtgcttcagtttttggcttcacattccttctctgcttgaggtcctgccctgatatcccttagtgatgaactgttatctggtggtgtaagcttaaataaacactttcctttcaagatcttagttagaatgcaggtaagtaatgaacaatatcaagataggcatgttaatggtgatattaagagccatttcttaatagtttattgttatgcgtgttacttctgtataagacaaatgtgttgtcatgaagttaaacagagcctttcttccaggtacttactgagacattccactttctgctgcgcctagagcaagcaggtattcaccagaattctaatgttttattatagtattttgagagggtgctaataagcaatcacttcatttcatacatgaaactgaagcctatcagcatagtactttccaattaaattggagtttattcaaatggacattagcatctcaggaagaaatccttcctacacagcttatctattgaccaggttattgcctcaaaagaagagatgattatttactcaataagttgaagattttagcccttgctctcttgctccctcttgccctcttgttcttctctctccccattcccttcccccttctct

SEQ ID NO: 2302 - DNA, 1000 bp, mus musculus; identical to SEQ ID NO: 2301

SEQ ID NO: 2303 - DNA, 1000 bp, mus musculus
ctggccatgattttctgttctatcgaagacccaacaaaaccttttcatttgcttgtgtccaccagcaatgagattttcagagccaaatatattctatttctgtggcattagataaataaacagaatgcagaagacttagggacttttataaaagtgagggaacatttctttcttgctcaatggtaattggaatatcttatgtgcctaagaaaatggaagagtataatgttagttattgggcatgtggactataccaccagaggaactggcatggaacaggcaaagtgaagcatgtgccaaccccagaaatctcaaaaactgagataagaatgccattcagagaccagcaagattagggctaaacccctccctatttctatggctgccagtgaatgtaagcaggtcaccccaaccaggagacagaaccccaggtgggttgtcacaagcagtcaatcaggtagcacagcacctagaattttttccatgcaaatgaagcatctcagcaggcttagcattcagtcgatgtcctttttccctccctggatattctcacacacgaccctaaaactttataaccattggttcatctggaataaagtatgtccattcaaacccatcctccaataaagaaatactaacaagctaatatcacctcagagagtactgcttcattaaagatcgttggagaaagctttcacctaaaaaagccttaacactaagattcttgaagaagaccttgttctccccgcccccctctcccccccacccccccacccccagacagggaggtagatcctattaattcaagacttcccctgtcctctccgagctgatgtatgagtggcattcagacacccttaagaagagagacagaatgaggaaccagtattgcacttcttcatgttctacaaataccagtcaccatatatctactgtttaccatggctatccctttccacaactatccacaagccactttcttcaatacatttatgcttgt

SEQ ID NO: 2304 - DNA, 1800 bp, mus musculus
aaaatgccattggatttgtaatttttacaaattttgtaatttgtaattggctttgtaatattgtaatttgtctcaaatttgaaaaataactaagttaacatttaatcattccttacttttaaattggaatattgaattttacaaaacaaagtagccttcccactaacatatggctctttataacaactcaattttaatttttttttgcatttttttttagttttgtttaaatgtgtataggagggaaggctactacatataactattcactaatgcaaatatttgtgaaaaacagttcttcaaacaatataaatttcattattaccctcttgagaaaaaaaaattgaagaatttattgaaaggatgttgctaatccccaaatcttgagattatatattatgcttattggtatgattcatgataaacattatctcacatcgttcttacaattcttacatcccaaatgccgctagatatcgtggaagacctgagaacaaagtgggggggccagaagagggtagcttggacagcccgggggcccaagggagaaggggcagggggagaaggcactgggtggttcctgtgcaggtgagggtctttgattcagtctggcagctggaaactctgggtggcctccgggtgggaggttagaagagtggctcattagagggaagcctgctccttttctccagtaccctgggtcctgataagcagagacaggccatggttttaggtcatttatttgtagaaaggcagagagagagagagaaaagaatagagaaggagaagccagccatagccaggtggagagagggaggaaggaaggggggcgggagggcgggggggggaagtgaaagatgagaagagaggcaagagcttaagaaagagaggaggctacaagcaggcccttttatagtgggctgggctaccttgtggttgccagataactgtgagggtggagtctagccagagtaccaggagcttggggcattgcctaagtgactgatagccacagaatgataagagttgagggcttctggtgtcaggagcctaatgtctaggagtacagcttatgtcccttgtagaattttctactgggtctccggagtaagccttgctcaacccgacagaacacagactgccttatatggtctaacaaggaagtaaattgtcataaataatcgtcatccaggagtgtttctcaactctgctactggtggttagggcctgggtgttactcattgtcttatgtgaagatcaacatatgtggtccctgttctataatatgtctagaatcttgctactcaagtgcaatcgtttagtcatatttacagtgccattaaaccatttattttatattttaagacattcctaagagattgcatgatgtatatctgactcaacacaaaacatactgtcaaatatgatattttgcttgggtttacaagaaattgaattaggaagcaaaattccaagtattatgatttgaatttgcacaggaaaatgttattgtaagtgttacaaccctgcagtggaatatatcaaatttcaaataacaaatagtatttgttgcagtttctcttcttgtcaatgttgtggtgtgtatatttttcaccaatataattagtcattcatcctaaaaacagggaaattttactgcactacattctgccagaagttttgttgttgttgataaggcaaagcttaccataggaaaaaggcgtgggggtgggggcgtggagacaaagtctaatttgcttgaagagaacagaatataaaaataacattatccattcagtt

SEQ ID NO: 2305 - DNA, 1000 bp, mus musculus
tttaaggtcttggattgagacaatagggacgctaattttcataaagggaaatttgcctttcagctgtctggttttcttctatgtctttgtcttctaatctgtttactggatatgtgatattatatgagttccccatatcatccgaagtatatacattaatctttagaaagaacaaaagtgtcacctctgtaagattcgaaatattatataataacaaatacagtcagtatctcagacactatatgcaaatttgataccagattgcataagagataatttaatgatacacagttggatgtaactaaccagagctcctgtagatttcttgattatccggtgtcttcaactgatgcagacagccaaatcaaagtttcaggccaaataaattttatttagaagcctcactgattcactgaaattaagaggattaaccagataatcggcaaagctatgtttctgtttgtgtgttatgaaatggctttgggtgacactgttttcccaggtgtatatcagacacagctgggctgccatctgtggaacacgttgctttgttattcgtgttacagaagcaccaactttctttgcttttattatttttcttctttttgaagatgtataacatttttaataataaaagcatacatgtattcctactgtccattaaaaatctcagattttggaaaatattgctaacattttttatttttactatctttttttcttttttttttaaattgggtatttatttcttttacatttccaatgctaaaaaagtccccaatatcccaaaagtcccccacacactcctccactcactccccttcagatcccttcagctccttgggtactttctctagctcctccattaggggccctgtgatccatccaatagctgaccgtgagcatccacttctgtgtttgccaggccccggcatagtctcacaagagacagccatatctgggtcctttcagcaaaatcttgctagtgtatgcaatggtg

SEQ ID NO: 2306 - DNA, 1000 bp, mus musculus
ttaaaacgccaggcaaggtgatgcggctgtgaaattgccaggcttggaagattgtcacagatagatccccagagctactgctctgtcaggccagcaggattctagagaaactacagaccctgactcaaaaatatggctgtcactagaggttttcttctgcactaaatacacacacacacacacacacacacacacacacacacacacacacacacttacacacacacagatttcttcttacaactctcaattgatttttcacatgctatgctgtagcaactttactaagattcctttgtcctgggtattagtactcttttaagcatgagttgttcatggattcagagatagtaaatagttacatttatctaatacatgcatttttgtagccctgattttgcaagatatgatcatggcagagaagataaagctacaaatgaaccaagattaaatcactgccattgttgaattttccttctgaaaggaagcaagataaatgtatatacagttaataggtatcatatcaaggtatgactcactatttgaggaaagctaaatgttcacaatagatttgttatgtgtcagacagaagagtacatatgagtcttagtgtggtgggggatatttgggattatatttgtactggcttgttttgtgcgtcaacttgttacaagctggagttatcacagagaaaagagcctcccttgaggaaatgccttcaggagatccagctgtaagacatcttcttaattagtgatcaagggtggaagggcccagcccattgtgggtggtaccattcctgggcttgtagtcttgggttccctatggaagcaagctgagcaagccaagggaagcaagccactaagtaacatccctccatggcctctgcatcaattccagcttcctgatctgcttgagttccagtcctgacttcctttggtaatgaacagcaatgtggaactataagctgaataaaccctttcctctccaacttgcttct

SEQ ID NO: 2307 - DNA, 1400 bp, mus musculus
tgtctagaaaatgatctatttcatctagattttccagttttgttgagtataggctcttttagtagggtctgatgattttttttaaaattttttcagtttctgttgttatgtgtcccttttcatttctaattttgttaatttggatactatctctgtgtcctttagttagtttggctaggagtttatcttgttgattttctcagagaaacagctcttggttttgttgactattttttttttttggatatttctcttttgttgctgttgttgttgttgttgttgttgttgttgctgttgatttcagccctgaatttgactattccctgccctctactcctcatgggtgtgtttgcttccttttgttctagggctttcaggtgtcatgttaagttgatagggcacttcgagctatgaattttcctctaagtgttgctgttattgtgtcccaatcaaaaatttgggtatagagaattctcaacagaagaatctcaaatggccaagaaatacttaaagaaatgttccaactccttagttatcagagaaatacaaatcaaagcgactcagagtttccacctctcaccaaccagaatggctaagataaaaacctcaagggacagcatatgctgacaaggaagtggagaaagaggaacacttctccattgatggtgggattacaaactggtacaacactctgaaaatcaatctggtggttcatgaggtaataaatagttctgtgtgaatatgcagctataccactcttgagcatataaccaaaagtttacctaccataatacatgggcacatactccactatgttcatagtggccttatttataatagccagtagctggaagcaatgcaagaaggaagaatagatatagagaatgtggttcacttacataatggaatactatgcaactattaagtatgaggacatcagctgggtgtggtggtgcatgcctttaatcccagcactcaggatttatgagttcgaggcgagcctggtctacaaagtgagtcccaggacagccagtgctatacagataaaccctgtctcaaaaaaaaaaaaaaaaaaaaaaaaaagaatgaagatatcatgagatttgcagacaaatggaaggaactaaaaattattacctgagcgaggtaactcacacccaaaagtacatgcatagtatatactcactaacaagtggatattagccaaaaatgtacagaatacctaggatcaaatccacagaacttaagaagattaacagcagaagggccaaagtaaagatatttcaatcccacttggaagggagaagaaaataatcacaggtggcaaagagagggagcgactatatcatatattatttcttgatatattatatataataatataagttataagaatggtt

SEQ ID NO: 2308 - DNA, 1000 bp, mus musculus
cactcagcgtggcgccaatatcaggtgctgctatgtacatatcaagcaaggtctggagaatcattaacttaggtctagatttgatatatatgacgtattctgagccgagttgctgcaatgatgattagaaggttaagaatggccagggcttacagaggatgtgtaggtctcttcaagtcttcagagacattcacggagataatgggagattgtactgccctgagaatgtaccagagatctgggaggtgagagactctcaggactcaaagtgagggaccatagatgaaatgcccaacattggggagaaggaacttgtagagcccacctccaccagaaagacagggcatcaagtgaaggatggggttgccatcccacagtcaaaactctgacccataattgtttctgtctgaaagaacttcaggaatggaaatggagagggccctgaggataagaagtgccaatcacagacccaaagtgggatccagctcaaggggaggccctaagacctgacactattacagaagctgtggagcactcacaaaaagggacctaccatgactgtcttctgaaagaacaaacaagcagttgatagagtcagatgcagttatttccacccaaccaatgggcagagaccactatagttcatttaggggaaagctggacagagctgaggaggagggtgatcctgtaggaggaccagcaatctcaattaacttggacccccaagatctatcagacactgaaccaccaaccaggcagcatacgccagctgatatgaggcccccaacacatacatagcagagaactgctgggtctaggttcagtcagagaagatgcacctattcctcaagagactggaggtcccagggagtttagaggtatggtggggttagggtgtgatttggtgacatcctcatggagaaagtcttttatcctctttaagcctcagtttcctcacaaatcaaatatgttctttcatagaatagcacacgattttcag

SEQ ID NO: 2309 - DNA, 1400 bp, mus musculus
tttagatgaggaatttttttctatgattttaatgaaaataatttctgggttttgatgtgggattcttcccctttctttattcctattattcttaggttgtgtctttttgtggtatcccaaatttctgagatgttttgtgtctctaactctttatacttatggtttcctttgaccaaagtatccacttcttactctgtcttcggggcttgagattttctctctcacattccttacatcctgttgctaaagtttgcctctgttgtttgtattcaagtgcctaatttttcttttctaagatgtcctcagtttgtgttttctttatcccttctgtttcaatgtttagatcttgaatagttttgtttccttcaactatttcttttttctttgtattctttaaggggtttattcatttgctctgtaagaacctaacccatcttcaaatagttggtatgacggttttttttcgtgggattcgtctatgttgaaatattaagtagcggctctggttagatagctgggtacttttggaaacattgcaatgggtgctcctaagctagcatccaggcagatgggattgcctgctggtattggaagctaggatgaagagacgattatggagaggcaatcaggagggaatgatctgtggcagacataagaagtgtgactagggaaaagtcaagtggatagccctgagtattagatttgggggaccagagggagtggagaatattcataggcagcttacctgatcgtcattgttcttcacagcacattgaaatctgggatataccatactcacactgtgataatcagtcaaagtaataagcattgttttctgagtactgtgcatggggtatcttggaatcaaggggcgttctctttgccatcacttctgcattttatcttgataatgaaataaaatacatataatatttaaaatatgtatttacgcctcatgttttacttctctttacaatacgtaaaaatgggcttttccatcatgagaaggaaacatccttgggcttagcaaacattatttaatatactctttgtattgcaatacttgtttatatttgtgcttttcacttttaatttatatgaaatgtttagatagcaaattaaagtgtgatattttcccttaagatacttaaaacaaaatcttaatacatttattatttgtttactccagaaatgaagcaaatatgttcacagataacattgtataaaaaaaagcacttaatagcagctgtaagccaaagccttggtacaagatacatgtcgtaaattttggtgttttcattctttgggcattaaatacttttcttttacaacataaaactgtctttattttattttgcactaaattagtctaactgtgtttttcattttataagatttta

SEQ ID NO: 2310 - DNA, 1200 bp, mus musculus
tctaatccatgtattcctccaagaaacatacttgttttttttcttaataatcaaagatccacgtataagatgctagtcattttacatggcacaagggaacctgtgacataaatttgatccttgacttgacagtggtgcacaatagtagtactagtgcttgaaaggcaaagccatttctgtccctgtagttctttcagacaggaatagttatgggtcagagttgtgactgtgggatggcaacccactccctcatttgatgctctatcttcctgctggaggtttgctctataagttccctttccatactgtctggcatttcatctaaggtcccaccctttgagtcctgagagtctttcacctccaaggtctttggtgcattctggagggttctccaaacccctatacctcccaaggttggctgtttccattctttctgctggacttcagggtttcagtcctttccctcacccaatacccagatcaggtcccctctcccctcacaacctccacccctgtccactgttcctcccaggtccctcccttcttccccacttgtgactgctttcttctcactcgcaagtgggactgtggtgtcctcacttgggcccttgatggaaatggagtggagcctgaggaaaagaaggtccatggacaggcccaaagtgggatccagctcaaaggaaggtcacaagccctgacactattactgaggctatggagcactcacaaaaggaacctagcatgactacactcctgaagacccaacaagcagctgaaagagtcagatgcaaatatttgtacccaaccaatggacagaggctgctgaaccctgtggtttagttagggaaatgctgaaagaagctgaggaggaacatgaccctgtaggaggaccagcagcctcaattaatctggatcccagagatttctcatacactggaccaccaaatgggcagcatacaccagctaatatgaggctcccaacacatacagcagagaactttctggtctgtgtccaatcagatatgatgaacctaaccttgaagagattggaggccccagggagctttgaggtcagatggggtgggggtggggggcagtgacattctcctggagacaggggtttgggagggaggtatgggatatggaacagtcagaggatggaccaagaggggttggcgaataaaatctggagtgtataat

SEQ ID NO: 2311 - DNA, 2000 bp, mus musculus
taaagcagaaaagaaaaacggtgcaacaataaggctttttaatgttgggcactaaagcaatgcagctgattagattctttgctaattaccttctgttacttagatggaatgtattttggcaggagagaagcatctatttgtgaatagtcgctttcttagtagtgagataaagacatttggttttggagtttgaaaagtgcctctctcatggtccagtccctcagatctcaacttgaccacaaatgaagtcacacacaacccagacttcatctctccttgtttctattcagttctaggtgctttggaggttaaaagactaatgtttgagcagattcttaaatagtaaaatctgtctgtgcaagaggcaacactgcaaaaactttaagacaaagacgagatttacaaagaaataatagagaaatgagtgtcaggtaagaggtggtatggatgatttgtgggcaaacataatgggttttaaggctcatttgcaagtttaatggatttaatcagagcaatggtaacaagaactaagtcttaaaccacctgaaaactaaccagactagaagttacataggtaagacttgaacttgcttgcactctaagttagctagcaagagatactttttttcttaaaatgtatatattgaagccttaaatagaaatgtaactatcattagaaatagagacttttagaaaacactgagtttcaatttgttcttaaaagagatgatggattaaaccaccaaccagataatacatatgcagggatccatccaaatgcatatgtagcagaggatggccttgtctggcatcaacgaaaggggagacacttggtcctgtgaaggctgtaggacccagcatagtgaaatgctagggcagtggggcaggagtgggcaggtgggtggggaaacacccttgtggatacaggaggaagggatgggatgaggatttttagagaggaaaccaggaaggggaataacatttgaaatgtaaacaaaaatataaccaatacaaaattaaaatgaaagagagatgatggatgaatagcttatgttttcagtataatttgaagcactgagtcacctgatataattataatctcagaggcttactgctgaatacgcttaccctctgcagttctttctaaactgtttagctggttcaactccactgttcaaattcaaactcttcgccaactaactgattcaatctggcttctctcagcttcttaatgaatggctctgcttagtctcaaattaactctggcatgttgttctcatcttctgactccttattctctggcttgaactatgtctgctgatctgccctgaactgcaactcaactactttgcattgcacgctctgcactgattcctaattgactggcaaagctgactaaaatgaactttctctccctatgttgctcctaaataccttttcttttttggtgtatgccatctctgatttattctgtcaaacatttgtttgtgacacacacacacacacacacacacacacacacacacacacacacacacacaggagagtacatgccaacagctgtgcaatcacagaaccttcatatgtgaagccttgtagaaatctattggctgaagacaagcagaattggagagttcatgtatgagaagtcgatgtctcagaggaaaatgaaaaggtctgactaattgactagaaaagttgaagaagtgatctaagagaatcatacagaatacggaatactgaaatgaaagaaatggaatcaagagatatgaatggtatgtttactaaaacagaaaaacaaaaccccgcaaactctcctgcacagtgaaatcccattatagcaaattaatttatttcagcatttctgaatacctagagtcatgtcatatattttaaaatgaaaagccattaattacaataatggcctaatagatggaacttctcaagtaatatgagacttatgaaggcctaccccattgtagaagggggtggagcagaga

SEQ ID NO: 2312 - DNA, 1200 bp, mus musculus
agaaagtgctgtatgtagggtattttcttaatttatgatagatggaggagcaaccaacccatcattggtgatgccaacagtaggcttgtggccctgggggctataaaatataggatgagcaagtcaataaacaacattcctctctgtcaggttcctattccacatgcttgacctgcttaagttcctgccctgactacctttgataatgaacagtggtggaagattataagaaaaaaaaaacctctttccttccaagcatgcttttggtatttcatcacagcaatagtaaccataagacagaaacattctgaattgaaccctacctttttcctatgtcagctctgaccatagtaatagatcattagaagctatataatttaaaatataatactaataacatagataaacacacaggaaattatttgtcatggttaacttagaagccagtctgcaacacagtgagtatttgaactctatgtaaccaaatgctaaccttctgcttccttgcatcttaagagaatcctgttgaatcttagtactatggagtatctacaaaagatcacacttaaattagtaccattaacttcatccagccgtgtagctcctcccagtacattacactttgccaattatggaactcatctgttcctctttgccatttagttattgagcttttcttggccaggcatgccaccgagggccagcctgggcatgaagttgactatctggccatcattattggaatctaatccattccctgggaaaacacccctcaagccataaaatgcatctgtgtgttgattttattaggtcatctgattgagcagatgctgatggctctagaaagagacgtgtttccccctgccaaccacaatttgtactgctggagttacaggcagaacccatcaacagagctatttcaacattttaacatggcatttcagatcacataacaatttctgcatcagggaacctgagagcacagagcaatttttactctgttgttcttagttactatgccccctttttagattctatagacaatacattgatatatttggcctatgccttatttcagtgtcgtctcagaacctttttaagtagaaatttctacacgttaccactggctcattcccgggcttcttctgaagtagttttccagtccttgagacaattggtttcagagttttgatagtaaca

SEQ ID NO: 2313 - DNA, 1000 bp, mus musculus
taaagcatccattatagattttttttccttccttggttaggtttattcctattcatgcttttgatgccaccattaataagagtgtgtccatgatatctttttctgaatgtgtattgttttacagcaaagctattgacttataaatgtccattctctcttgtgagactaggccggggcctagcaaacacagaagtggatgctcacagtcagctattggatggagcacagggcccccaatggaggagctagagaaagtatccaaggagctaaagagatctgcaaccctgtaggtgcaacattatgaactaaccagtaccccggagctcttgactctagctgcatatgtatcaaaagatggcctagtcggccatcgctggaaagagaggcccactggacatgcaaactttatatgccccagtacagaggaacgccagggacaaaatatgggaatgcgtgggtagggaaatgggggggggagcgtatgggggacttttgggacagcattggaaatgtaattgaggaaaatacgtaataaaaaatatttaaaaggaaaaaaaataaagtatttggtatgtgtatacattctcatgcaaaaaaaaaaatatccattctctatcttggcacattgctgaatttgctcaaaatttctagaactttcctggtagagttttcagatctctaatgtgtagtatcataccttctgaaaatggaataatcttccttttttctctttaatttccttcacattcctttattgcttcagctggtatttttcaagcacaatattgaaaggcattggggataacgcttattcctgtcacaatactgacttcagtgagattatttctaatttcctctattgaggataatgttggctgtgggttcttaataaacaattttattaaactgaataaatgtcctgcttttttgtagaaactatataatagtatacatgtttaagtattactatcataaagtcatactagattttatctgagaa

SEQ ID NO: 2314 - DNA, 1000 bp, mus musculus
tgtaacattattgttaagagtcatcatcaaaagtgtctttggagccatacaagtctgccagtttcttaaaacgaggtccccagttctgtagatagtcgtagtccaggtctgagtctgtcgtggcagactccaaggagctcagggacccagccacggaaccccggccctcataaccatagatttggatggagtcatagggaggggctgtgggatcattatctgcctcctgtattcttgtgttgatgaagtcgtccacatccacactgttgggtgctggtcgcagcccaggtctaggcatatactgatactcaggtttgatatctttgcgagggataaatccattgatgccgtcaggattctgcagggtggctatgtcgaaggcttcagtgtcttcctcaccacccccttcatcatcataggttatgatgttctcacggacatcctcctcttcaaatacaatgagtggttctttcttttgcctcctcagggtaacaaacagcacaacgatgactgtagaagaagaaacagaatgtcagccaacccagtgctaagctcatcccccccggcttactcatgccagaggggctttgtttcagaacctggagtggtgagaaaaaggatagcttttccagaactctcaaagagctacatgctgccctgtctctgtctgtacagcctgccctgagagcatcacaccctgtaaactgacaggtcggaactatcttcagcattttgcaaattaatcccaatgctacttggcagtcctctgaagaatcagcaaggattactgttgcctaaaagaggcaaatgcctatttctctttgcaaaggagtgtaaccgacttccccacatgtaagattaaaatgttcactcaggactgaggtgaaaataggcagctcctgtccaaaggccctactctgtaggacagaaggaaaccttatcataaaggtgtgggggaagagcaactataaaaaccctcagacgaaagatacactgccta

SEQ ID NO: 2315 - DNA, 1000 bp, mus musculus
tccatccattagctgactgtgagcatggatgatattcttatagtagaaaaaaacccaaaggatttaactgaattaattctgaaaaatatgattgaggtattgatccagcatggactaattgtcgcccctcataaaattcaacataccaagccaacaaattatttgggggaaaacaattcatagtgaatatattatatctcaaaaattacaatttaggattgataaattaaagacaataattttcaaaaactgttgggaaatattaactggattacgcctttttaaaaagataaacaaatgtatttaatagtaataaagaatacattctgtgcatcaaataacacacctcctggtcaaatgtagcccataaaccttgctttagtgacccatagactggccagcatgcaaggtcccttcctgctgtgagacaggttgtctctgccagtatcctgtgcactgtttgtttgtaagggatgcaaggcagcttcataagtattccaaagtggttctcacacacagatgtgagctgtgtcttcaagaaaaatcctgacttgctgagggcaggcaccaggtccctggttctcactgggactgatcccccagcacaaggcgaagcccctctgagtaagggctccttgtagctgggggcagaaagccaggcagaatgactgtccccagtcagtgtcttgggagagctgggaaattttatcactaggaggcctgagctctgcatcttgggaaagcagcttccatcactccaggtgttccagggatctgaggggagagaatcaaggttaatgactttcacttacagaggtgtgccaggcttataaatgaggtctccctttcccctttgggagcctgtctgctgcagggcagatgtggttgcttatgcaagaggctacatgcttccttcaaattatctccattgaacaggtaggtctctgggtgtcctccctgtggagactccatcctgtcaaaactgtgttctggagctgat

SEQ ID NO: 2316 - DNA, 1400 bp, mus musculus
gtttagtttttgagcactgcttatgtcagactagctggtttatgagcttctagaactatatatacatataacaaataaaacattttacatgaacttccttctctaaagacattgagttcatccccatcgtgttatggttccaaaccctagaattatagaattacgttgtcataatcatcttgtaagctatataataatgcttgctttaaccctttacttttcagttttgatgaagcaagaacaaagagaagacacagatttgccttcagttccatctttgcctgtgcctcattctgcccaggcccagaggccctcctcagagacagggcacccccatgaccgtgcgatgtcagcaccgggaagcctgctttgtcaagtgcagccagcatatacatctatggtagcctccacccatttgccacagttgcagtgtagggatgaaggtgctggtaaagagcagcacatagcaacatcttcagtcatgcaccagcctttccaagttacaccaacatctcctatagggtcttcctatcagtctatacaaactagtatgtataacggtccaacctgtcttcctgtgaatcctgcctctagtcaagaatttgacccagttttgtttcagcaagatgcagctctttctagtttagtaaatcttggctgtcaaccactgtcaccaataccatttcattcttcaaattcagatgcgacaggacatctcttagcacattcacctcattctgtgcaaaccccacctcatctgcagtcaatgggataccattgttcaaatgcaggacaaacagctctttcttctccagtggcagaccagatcacaggtcagccttcttctcatttacagcctattacatattgtccttcacacccaggatctgctacagcagcttccccagcagcctctcatcctctggctagttcaccgatttctgggccatcatcccctcagctgcagcctatgccttatcaatctcctagctcaggaactgcctcatcaccatctccaactaccagaatgcattctggacagcactcaactcaagcacaaagtacaggccaaggaggcctttctgttccttcatccttagtatgtcacagtttgtgtgacccagcgtcatttccgcctggtggtgcaactgtgagcattaaacctgaacctgaagatcaagaacctaactttgcaaccattggtctacaggatatcaccttagatgatggtaagtcccagctcctccccacctcgccctacttaccctaccttgtgaatgtgtgtgtttatgtattttgagttaggctggccttgaacttactgtatagtggagagtgaccttaaatttctgattctcccaagtgttaagatgacaggtatgtacctccagacccagata

SEQ ID NO: 2317 - DNA, 1200 bp, mus musculus
gccagattatagttcctatgattttttttttttcctatacaattttcttctttatcatcattctgacactgtggccaaatacttgagataacttaacagagttaaaaggtttcttttgacccatggtttcagaggtccattatccctttgtctatcgttttatccaaatgctggagcaaagccactcatctcttggtagccaggaaacatggaggtaagggaagccaggcgcaaaatatcctctcccgagacacgattccatgatttccaccctccagctacactccaccctctaatggtttcacccgactcgacagccccaccttccgaaaactgaatcgtcgacacagaaatcctttgaggacattccaggcacaaaccataatagctctgttcccagtatcccatgttgccatcttttgggttctatttggttaccatggacatatctgtacttctccctggatttaaatgccactactttatatgtgtgcttttgccatatgtggattttattttattttttttattattattaatctcatctctcaagagttttcctatggttttccgaaacgctcttgttggagccggacacaccctcagcctgaagctcagctacagccgtgagatgttcccttcaagcatcctgggtgtttccttttcctcttgggcgtgctaaaggccctgtttcccacctcccactcccgtgattcacacctactagcgagcactatttatgctactctgcacataagccaaacgaagacgcggggcatttttttgtaaattagtctcaagtaacgtttttttttttttttttttttttttggtacaactgacacagaaaggcctcaagtccagaatccatctaacactgaggcaaggttctggttacttgctgggtggtcaccgtagaaccctaacggccctggccaaggagatgtctcagcctggagcacctccagggagcatctccaggtgctccatgccttatgtgggctttgctcgtgtccagttcatccatggcaggattcttatcttaaagcatttttttttttttagcccctgactcaccatccctcatggcagtttcttatttctgggattagctggtttaaaaaaaaaaattgcttctgggcatgtgactattctcagaactttaatgtcagaaataatgatcctgttaaattggagctc

SEQ ID NO: 2318 - DNA, 1000 bp, mus musculus
ggtccaaatggcaacaacaatcacctggcacatttgccagaagcccagccaatggaaaactgatttttcccaaccacgtcttcccactatcaccctgcaacagcgaggcagcttctggagacaggcaagaggactagcagctactagcaggaggcacgttgtggaattgctttaaatagatgggatgacttggagccagcacaaagactccaatgcaaaggatatatgttggctttcactgtttgggtctggtgtggatttggtttgggttttctttttcctcagtgtgtggcacagctgtgtaagccggcatgccatgactctctcctgaatcttgtcctcttgtgcccacaacaatattcccagactcggctttggaactccagcgggttcccatgttcccatcgggagcttcccaagtcatgggtgtttcctccgaattgcagacttgatttgccttgattattattattttttggctctggtccaagatgtcttcctgtcatcctctcactgtctttttccagtaatcccctttttaaatatcaccaacaattagtcgatttatctccatcagcaaggaccactgcccaccccccatttccacatccccatgcagacatacactcggctgagcgagcccccatccctgtcttgttttgccttgaagtataagaaatcacagctcctcattagctggagagcacgtttggaacggctttgtgtttactcacttagtaagtgatgctggcctttttaattatcctccttccgcatgccatttagagcagcaagctgttcaaatcaaaccgaacgggtgcgcatcgtcggcaaggcggttggaaaggactgggttgcttttttttttttttttttccttcctcttcttttacctcactgctgctgcgtccttccttgtctgtcagcaagccaaggaatccccccaccaaaagctcttacgtaggaagacaccaaaaccgtgagtcacttttcactccca

SEQ ID NO: 2319 - DNA, 1000 bp, mus musculus
aggaagaaactgaaataaaaatcaaatgaaaattaagacaaccagaaactgcaacacaacagaggcagttttaaagtttatagcttctagcacctacattaaaaacagctaaaaagatattctgcaacccagtgatacacttcaaattcatagccaagccccaaattagtagatgtaggcatatagttttcttaacctactttaaaagggttcaaccttctctctagctcccaccataggtagtagaaaagaaaagttattagcataccggggttccaatcttcactgtccatactccagtccactagcaaacaccaaacataaatcagcagctgcagtgcagtccactttgcagacaccacacgggaaccagcagctgcagttcaatccagaaaaaactgtgatgccaactggcctgtctgcagaagttgcaagaagccccaggaacctcaggagaagttctttagggcatttctctcagtgatgtcaccacaagtgaagcttagcaatacaatgcaaggcgaaccaatacatgcctgtcgtcagcaaacctagcaaggcagagcaatgcaaaccaatgcttgaactcctcctgtctgtggggtcatgtttatatcccctctaggcatcatgcatcctttcacatgtctgatatagcaaaacatccttttctttcacctgtatgcccagcaaaacatcatttgacatagctgacttgccaaagaaaccagaagttttcacttcaaggagctgtaaagcaataatcaagatcacaatggaaatgaatgtaatgaaaactgtaaaacaatgcagagaatactaccaagtgttaaagaaacaagattgccaaacccttagctgaactaaccaaaggggcagggggtggggtggggagagaggatctgaattaataaaattagacataaaatggagatatgactgttatcactgaaatgtgataaatcacgaggaagatttttgaaaataaaaaaaaaaacta

SEQ ID NO: 2320 - DNA, 1200 bp, mus musculus
aaataagtgtgtaaggttagacacggctcaccgacagagaaattttgtggtatttttgaggacccccagcagcaaggcaggaaaaagaagcaaatcagagtagaatgtgtgatgtacatttctgagagctagtgttcctcaacaggtttgttccgcagcttccaactgctcttcttgtgctactcaatgccccgttattatcaggtcacaaggtttcctcttcctggctgtgctttaagtcctgaaggacacagaggaatgtgtttacatttgcagtattttctttgcaggtgggaccgccaccaggcagagaggcttcctagggtgcatcaggtccctgcagttgaatgggatggccctggatctggaagaaagagccacagtaacccctggggtgcagccaggttgcagaggacactgtgggagctatggaaagttatgtcgccatggagggaagtgcagggaaaagcccagcggcttcttctgtgattgctcttcctctgcctatgcaggaccattctgctccaaaggtaggtgtgagccaaacctgtatccccgtgagtaagacacttggcaggccttgtgtgtgattgcatggacaagcacaagtgcgagcatgcgcgtgcatgtgtgtgtgtgtgtgtgtgcatgtgcgtgtgcgtgcatgcgtgagtgcatgcgtgcgtgcctgcgtgcgtgcgtgcgtgcctgcgtgcctgcgtgcgtgcatgtgtgcgtgcgtgcgtgcgtgcgtgcgtgcgtgcgtgtgtgtgtgtgtgtgtgtgtgtgtgtgtgtgtgtgtgtgtatgtctgctgtgtagctgtttgaaacaaaagtagctacatttaaaatattcttttgaaaagtggttattgtatgccaatcatattttaattcttgggtctttgaactcaattcaggaaaaaatgcttgtctattgctgaataggcacaaatggtagtctttagatgtcgtcaatgttatccatcaatctacttttactctgtctgctactaatgtgtttaaagaatagagctgtcaacaacctatcctatggggcagccctttgtttaaaaaagtcattccagggtgtattgttatttttgttgaacaggttcagcattgcaaaggactgtagaaaaatgtatgtacttttatatcattcaaattaatattttctaataactgccgatgcaaaa

SEQ ID NO: 2321 - DNA, 1000 bp, mus musculus
acatgtaatggtgaacaaagccctagaaactaagcattagatcaagttaaaatggcactttgagcatcagtagcaatcataactctaaacaagctgacaaacacaaatagaagcatttcgtttggaatcttagtgaagggctagaggaggaataggtagaccagaagtcctatgctccagtggatgggctggaagttttatcaatggcttgagatggcacaatctacaaggatcctttcctgtccctttcctgggacagaaaaaaaatgcttccaaattaaccaggagaatggacagggtagaagcctgttgtctgcctggatgccacaggtcaatataaactaataaaagagacaaaactaacataaatgaggctgacagaagttctgatggacagaaacagttgatcactacagacacagagaggacgatggcctcaaatggagatgagtagtgtatgttaagcagttcactgtcaacagaaggatccatctgctatgcacatcaattattagctgggctaacgacttcacacttgggtaaagcagagtcaaattttgatcatatttatgcagcaaacttagggagaatatgccaaatgctgttcccaaatcttcattcacataaaaatcactttcaaaaacaaacagagagacttaactgtatataaacaaatcagtaataagttttgagtagttatttttgataagcttatatgcataatgttatttgaataggaatggctaccatagagtcatgcatttgaatgattgaactatagggagtgtcactattagaaagtgtggccttggagtagttgtggccttgttggagtagttgtggccttgttggaatagttgtggccttgctggaaaaagtatgtcacttaagggcagactttgaggtctcagaagttcaaatcagttgccttctgctgcctgcagatcaagatgtagaactctcagctcttttccatcctcatgtctgccatgtttctccc

SEQ ID NO: 2322 - DNA, 1000 bp, mus musculus
cagccaagctccctgccagacccgagcaagcaaaacttctgagattcataaacttgtggtttggggcccgagtgccattgaagctgggcctccgtggggagagggtgacacagacagtccttctcttgggtgacctctttcaaccaaagtggggggcctctggcaggactgcaggaggagcaggtggggcccgggacacagcctaagatgatttcctgcatctctgggtctagtttccaagaaatggacactccttgcggctcctaattgagtcagcttggaggaggaggctctgcttctccaagacaatgcctttgactggggagtgtgctgtgcgctcggggtaactgaatctgatgctcatcttctgccaacggagcctttatgacagtgccatagcatgcggctggggccaggttctctgggtctctgtctcccctgtgatcacctgcagaaaggcggctggcaggtggagagaagccagctagggaaacagccgcctctgacctcaaatggtgagcacagcttggagatctatctagcttggagcttgtctctttgcaaagaccctaagtagtcacctggctcagaacatcttgaaaatgaactccagggaagggaaactgctagctcagaactaaggaaatggtccctgtgaggcccacatgcgactctggtaagaggcatgattaggtcctgcttgtgtgcactcctgctgagaccacccaggacggccaccttgctcaatgcagacacaaactctctagactctaaacagctgtccagaagtgactgtcagaagtcatctccccctgccttagaggatctcactcaaagtcagcatctggggggtgtggaggggggctgcacatgctctgtgagcagcagatgcccagagctagctgtggtcagcagacagttacctaggatcaagcctgtggtcgaggctgtggggggtgggcagctggctgaggcttgatctcttgcctggacataagaa

SEQ ID NO: 2323 - DNA, 1400 bp, mus musculus
ccacagtgaggaatgtgtccacaattgtcccttgccgctctgggtcactggggggctgtttctcacggttctgctccgcccttgttttcgtccaggatggtgaacgtaggcagctggctcgagatagtgggtgcagacctggtgaaaacacagaaaggtacagtcaagaattcagtaagatgggggactgagtctccaccttgtggctctgccagtctcagttgcgtggtttctgggtgcacataggcctgggtgtctgccactgcactgtttataggatatgcagggacttttctgatgtccctaggagtcactgggctttttttttttttccctctcattgttttttgagacagggtcttgctatccagctttggtggcctggagcttactacaaagactggactggcctcaaaatcagagatccagaaatgctgaaattaaggccatgcaccactatgtctggctcaagtcttgagactgtctgccctatcccccacattgacaggccactaccaaatccctgacttcctaagtagcttaatatatcttgcggccctgtaaggctgacagtgtctgtcccatcatgagacctcagctgctgtccagggtgcaggcagtatggggctaggataacagttgggctggagttgggcttccactctgcctgcctggccacagatgtcacgggccatctcctgactcagcatacacatgcaggctggaggggaaggcagagctaacaaggggtgtcaccagataaggttagactccattctgcaggagagctgggccgggaacccacgagagggagccggggtccaccttcatgctgctgtcttatctcagagcccacagctccctggatacatggagtccactccaccaacctccagaagcacgtgagctggcagagtcctcactgggactggtggtgcctttcataagaatgttgatttcctagcaattgggaggcagaggcaggcagatctgaatttcaggccaacctggtctacagagcgagttccaggccagcccgactgcatggtaagaccgtgtctcagaagagaaaggaactgtgactttcttcgggcccttggcatacggtataggccctaatcccggtcatgtgcgcctgtcttgacttggggctggggcttagctcctttgcttttcctaccgtgtagcacaaagtgggggtctgaagatccatcactgatggaagaccaggtgtggggactctgatcccagcacttgggaggcagagacagttggatctccgagtttgaggccactttggtctataaagagaagtcaaccaggggctacatactgagatttttttttagacagaatttcactgtgtagccttggctatcctgaaactcactctatagtac

SEQ ID NO: 2324 - DNA, 1400 bp, mus musculus; identical to SEQ ID NO: 2323

SEQ ID NO: 2325 - DNA, 1400 bp, mus musculus
ggactctgggtgttcccgaatgctggccccctctgccccccactctcagcttgccctggctcttgttcctcttcacagtctgttctctctctgccctgctgaggccttcctgttcctctaggagttgctcatgacttcaggccagccagcagagtcctctgaactgcactgtggccatgctctatccagtggttctcaatcggtgggtcgggactccctctggttggggtcaaacaatcccttcacggaggttgcctaagaccattgggaaagacatttacattacagttcataacagtagcaaaatcacagttatggggtagcaatgaaatatttgtatggttgggggaggggcaccacagcacgaggacatgcattaaagggttgtagcattaggtctattcatttagaacctcagcctcatacctacactaacattgaggttgtgggaaatcctggccttgaaccaacactaacctgttcctttaaagcctggatgcctttgtctctctccccgagtggagaagccatcaagcctcagctgtcagccttagaggctgtctgtcatctgtaccactgatgcctatccacagctgaccaacatcaggaagcgtttatctatgggccagggccccgaaacacagccctccatggtgcctgccacatgcccctggcaatggtgcccaaaaattgggtccccctgccctccagtcaccacatccagccttccggtctcttgcacacagcctctccttgtggactctttcagaactggatctgtgtgtgtggtccctgaaaatacgcatctgtttcccagtcagggagccagttctctgcatttggccctacagaccatggtgaaccctgagtttcctcttgtcctgctaatgtggaagtgtaagacctgatgcagggcagaggggtacagagaagtcagagcttcctcagcttctagaaagcctgtggctgagtccatagctcatacagggcccatctcagtagcaaagcccaggctactttatgggctgtgggcagagtcaccctccttcttgtcaaacacagctgcgttttggggaaagggaacacaaagccaatatgacatcagagggggtggcacttagattcaccctcaggtggctcagggcagaggatgtggggtgggggtggggtgcaggaggagaaagaagcctagtgtgggaggggacatagcagacttctgctcaggagaggacagcagataaagatggcactgtgccatactgaacagagaggacaacacagccaccctgttctgctgcctcactgtcagccctgatcatggtgggtggggtcagttaatggttagactctaaggcttctggagctgagggcggtacaagaagttgtgcagtgcttgtgtg

SEQ ID NO: 2326 - DNA, 1000 bp, mus musculus
cagaaatccacctgcctctgcctcccgagtgctgggattaaaggcgtgcgccatcatgcccagcaatgtgaacttttaaaatagaaaagtttaatctcataaaccagacatcttcccagctttctatctcatggctactgtggtttcagtagaattaagcacccaagaacataatcctctggctctcttcctcttcctcttccctcctccctctctcctcttcccttttcttccctctcttccttcttttccctgccttccttttctctgttgaatgtgtgcacgcagcagtgagctttatggcagccttgggttttgctgtgaggaagggataatggcagcctgcttatttcagaggtctttcgggaaaaagccgccatctctccactcctactttgttttctgttggtgcgataaaagactgagcaaatccaactctctctctctctctctctctctctctctctctctctctctctctctctctgtgtgtgtgtgtgtgtgtgtgtgtatacttataacttcatcttacactttctagtccctcattggcagaggtcagggtgggacccccaggcaaaacctggaagcaggaactgaagcagagactgtgcaggaatgagcctcactggcttacttcccattccttacaagaccctggagtggcaccacctacaacaggctgggcctccccacatcaatcatcagtcaagtgagtatccaacagccttgtctgcaggccagtctgatagaggctccctctccccaggtgtctctagttgtatccatttgacaaacaggcaagcagcacattcccctcactgagggttttatgaactctgtgagccttggcttcttcaatgccgttcaagctgtcaccctagtctcaggctcccaggggagaagtgtcaccccagattagcaggttgcctgtctctcacactcaaaggctcacttgatcttgacccagatgtgggcactgagtgttgagtgattagtg

SEQ ID NO: 2327 - DNA, 1200 bp, mus musculus
gaccattgtgtctttaagaccgatggactgccaaagatgcagaggagctcagagtctcagtgaggctctggaagggaacccgaggctctgtaaagccgagtccctcgggaggtccactgaagaagcagatgtgaaagcagactggtttttccaattaggaaagtggcatggagctctcagaaggctgagtgagaaaccagagggataagacttcaataactagttgtctgtgaaccaagtcaatgctgcagtacagatttgaatcaagtaccccacaggcagtatccagacagggagcgacatggttgcccactgcaccctgagctagctgtgagctcagggtccttcttcatcttccttgggagggaggaggatgcctcttctgtggggtagctgccaccttcaaggtgctctgtcctgagccccaagtcctcaggcatcttgtaaaagagcaatccgatgtcctgtttgctcctccccctcgccttcagaactgtctgaagcctgactattggctgagcaatccgatgccctgtctgtttgctcctccacctggcctgactattggctccttggcctctgtccatccctcaggcagtcaatagcttttcagggccactgccctgttggctctctcatgtgcattgtctatttccttggcttgctgtttcagctgatattcacctgtgaacccttgaataattaattaacttacaggctcctggaggggtgggcgcccttgcagtcagaggcacagtgactcatgcttgctcacagaaatggctaagccatctgacctgccaaggtcacttggctaccagaaggatgggacaatctaacaagagctctgcttgctctctaggtactcaagtcacttctatagggaccataagacatagagggacatggcctgttccgtgctaaggcctggcctggaatgacttccccattctcctccactttctgttaggctccacactgacccttgaaggcagtgcacgaagacacatctgctgtgacgctcggtcgtgttaattggagctgctctgtgtcctgccacagttactctggtcaacctccacgtctgcagagcgaaagcacattgtgccatggacatagtactcagccatattgctagagcagctggcctttctctaactgatatacccacaatggacatctcaggggtcatctctcatg

SEQ ID NO: 2328 - DNA, 1200 bp, mus musculus
cacatagtagtacttcatctttctcccattccttaaagtaaataatattgtctctgatttaccagtgaggtaactgaggctcaggagggccagttctcctagttcatatagtttatacgccgagtctcacctcaagtccttggcctgtacttcagcagctgtctcccatcccacacatcaaagactcgatgatttggggaagggagaggtaaaggctgaagaaggctaaccctgggtgggtgagcaagatctttgtgggagggaaaggcctcctgtgccagcttgctctcaggtccctgctgacctgcctgcctgactctagggtctgtcagggggcaggtgccagcttgctacacagaacacagagtagaatgctctctggggactaccaagggcacctgtctctgtcacttgctctgttctttacaaggctgggacaatgccactgtcatctctggctgagagcaggccaccacccagagaaggacaaaggccactgtagaaacatgtgtcctagctgatctctgacgtcaatgtacccttctcgcccatgaagtcactggacttctccaggtttggaatttatcaggcttatggtgaaatgtaaaaattgggctttcctcctacttaaatactcctttctaccaggcatgctagatcacacttgccatggagagataggagctgaggcagggggatcacaagtttgagccatcctgggctacataagaagaccctgcctgaaaataactcaagaagcacacacagctctgagctccttctatttcttagcctctctgttttcaatctctcagcctcacagagacaagataccatctctggtgtgttagctgcagagctcccatgaatggtacaacgggcatcataggagacagattgaactgaagctaagataacttcagcatctgaaaggggaaaaaaaataagcactttctggagccccttgcccagaggcaggtccacagtcacaaaacctccagagacagaagactcacagcctgcctccattgccaggctcactgaaaggacagcgactccttctgcaatcccttgtcttagtcactcacagaactcatgatgtttcaaagaagttcacagagctggggaggtagctcagttggcagagtgctgaccaagcattcacaaagctctgggttcaatcctcatgatggtgggtgg

SEQ ID NO: 2329 - DNA, 1000 bp, mus musculus
acagaacagaaatcggagtacagctgaaaggactatttttgatcacagataatccactgtgttgggagttacacatttagtgatttaccaccacaacaaagtgatggcaatgtaatgcacagggccatgccttacgatttcttaactggtgctttttccagtcagcagaagcttatgtgcaactttccatcatcatggatagttttgacaataatatgacctttaagcatatattaaaacccattgaacgctgtaggcaatctattttgtgaggtggaaacataacttttttttccagtgtcagatcactgaccatagtcatcataactcttacatatagcccttattgtttaattcatccaagtgtatttcagtggtctttttatgatatatagctctaaatataataaggttgttgatggaaattaatagtaggcagtaccaaggaacaaatgcctcttatatatcatcttagtatggagatttagcacctcagtgagagagaaagataccaattgaaacaagtattggaattaagactgtgtcttttgcatttaatttttagtaatttgtactttttcttatatttagatatgagtatctaggtgcagtcaaacaaacaaacctaaaatgaataatcaaaagaacttgcacttccaatgaggcagttaaaatatcaactgggtagtctatcatgcctaaatctttttgtgtaaacattagttgcagcaggacacataatggaagttgaaaatgtttccagatcctgacacagagtgttgaccttgcttgggagagcttagctgcactgtacacatctttattagtgtgcattcagtgtaaagagtgaagggattcatagcaggatttctttgttcaagtacacatgtacttagattatattcacttcccatgattctcttctgttccctttcccctgtcctcttccttttcccatagtataaagaagactgctagctagtgaaagaactgctgggca

SEQ ID NO: 2330 - DNA, 1000 bp, mus musculus
gcccttcacttggaagggggaatggaatggtgatggaaggcagatggggggaggtatgtgggtgggagtaagggtgggtcagtgtctgatgtagggaggggcagggggatggccagatggctaggagaatgaatgggaatctgcaactgatggggtcgtgggaggtagtgagcatctccatgaagaactgggataggggaggcacctgagaatcaatgggagtgcccatagctgtgactcacatcactgggaataaagagcttgtggatgctgtccccagtggagcaatagggataccaatccatccataaaacttttgaatagaaacttatcctgtctacaagaaatgcagggacaggagatggaacaaagactgagggaatggccaatcaataactagcccaactgagagccaacctatgggcaagcactaatacctgacactctgttatgatattttgtttatgcttgcagacagaagtctagcatggctgtcctctgagagtaatgacccaccaactgactaaggcagaggcacacatacccacagccaaacagtggatggaagaataggaggaaggacagaaagaccatcagaatcaactaatctggatccttgggttctcagagtctgaaacactaaccaaagaacatatacaggttggacctaaggcctccctgaacatatgtaacagatgtgcaagttggtcttcatatggatcttgaacaacttgaggggggacagctattccaaaagctgttgcctgtctgtgggatatgttcttctagctggcctgccttgtctggcttcagtgcctagcctagcagtgacttaaagtgccaaaggggaggaggaggaaggatgtaggaaggattgtgggattgggtgaccaagagggggcagtgagagggatgtaaagtgaaaaagcttaaaagaaaaataaaaaagaacaacaacaagaaaccccagagatctaaaattaattataatacaattcaa

SEQ ID NO: 2331 - DNA, 1000 bp, mus musculus
agaaactgctagtatattatcatttggtgtagtgctaacagcacaaccctgagagtgagacagcctgctccaaacctgtaattatgtggcctagagccaccttttgtgcctctctcagctccaggttctttatctgttaaaacttacatatactaatgcctttatcataaagtagttacaggtctcccaggagttactagaaaaataccttgtgatctgtgccctgaagctaaggttgtcccatagccctctgtacctaaatcctgcctgaagaaagctagtctcccaagagtgttatcactcctaagttgccaggtgagactaccacttttgttccactaactgtccaaagaggaacccaccaggagcccacagggcacaggaacctcaaaacatccagggacaggatctcttcagtttccatcaatgccccagagctagccctgtggcacagatctccacaaccagagagaactggtcacccaggggtactgacacacctaagatcacagctctctgcaccccactaccaccaggagagagctagtctcccagtagtgctaacagacctaagattatgggcacacaggcccacaggagggacaaactacagttagagacaccaagaaaactaacaccagagataaccaggtggcaagaggcaagcacaagaacctaagcaatagaaaccaaagctacttggcatcatcagaacccagttctcccaccatagcaagtcctggataacccacactggaaaagccagacttggatttaaaattgcatatcatgatgatgatagaggactttaagacagtcataaataactcccttaaagaattacaggagaatacaaccaaacaggtgaaggaattgatgaagaccatccaggatctaaaaatggtaatagacacaataaagaaatcacaaagggagacaacgctggagataaaaagcttaggaaagagatcaggagggagggtgggatagggggtttctg

SEQ ID NO: 2332 - DNA, 1000 bp, mus musculus
taataaatgaatatgagccaaaaaaattacagagtacccaagatacagtccacagaactcaaaaagatcaataagctgaagtggccaagtgaggacacctcagtcccacttgggagagtgaagaaagcaatcacaagtggagagggagggagggacctgggagggaaagtggatgtcacagagtagtggggggtagaggggaacctgatctggtattgggtgagggaaaaggactgaagccctgagggtcagtagaaagaatggaaacaggcaacctcaggaaataggaggttgggggaatcctccagaatgcaccagagacctgggagataagagactctcaggaatcaaagggagggaccttggatgaaatgcccaacagtcaggagagggaaggtatagagccacctccagcaggaagacagggcatcaagtgagagatggtgttccatcccacagtcacatctctgacccataattgttcctgtctgaaagaataaaaggaatgaaaatggagaagagcctgaggaaaagaaggtccagcaacaggtccaaagtaggatccagctcaagaggaggtcccaaaacttgacactattactgaggctatggagtgctcacaaaaagggacctaacatgactgccttccgaaagacccaacaatcagctaaaagaagtcagatgcagatatttgcaccctaccaatggatagaagcagctgactcctgttgttgatttaggaaggctgaaaaaagctaaggagaagggcaatcctgtaggaggaccagcagtctcaattattctggacccccgagatctctcaaaccctgggccaccaaataggcagcatccaccagctgatctgaggcccccaacacacatacagtagaggacttccgtgtctgtgttcattcagagatgatgtacctaatcctcaagagactggaggccccagggaggttagaggtcaggtaggcggtgggggcatccaggtggagac

SEQ ID NO: 2333 - DNA, 1800 bp, mus musculus
tttgcaaaataggatatctgataatttatgtactttaaagtttctggttcaattcagttaaaacattaaaagcaaattgactacagtcataaaattgatacaatatattcatacttatatattttcttagagaaatgtgttagcatgtttgatggtttgtatgtgcttggcccaggagtggcactgttaggaggtgtagccgtgttggagtaagtgtggccttgttggggtagagtatcaatgtgggcatgggctttaatacccttgtcctagcttcctggaagtcagtcttctcctagcagccttcagatgaagatacagaactctcagatccactttcactgcctgtctgaatgctgccatgctcctccattgatgatattgaaccacaaaacctgtaagccagttccaattaagtattttccttaaaagagttgtcttggtcatggcatcagttcacagcagtaaaaccccaagatattattatatgtttgtatattttttaaaccttcattaactcgctaagatgttccaaggtgtgatccataaatttcaatcaagtgtaaatgctttgaaaaatgtgaaaatttcttttttccccgttttattaatattgcttattagaaaaatttatagaataaattcctttaaatgaaaaggtaaaaatctcattattttgtttatatagccaaaaggttagtctgaaaatttaaaattgcatctccttttgatcttcctagctttggctcataagtgtacataagcctataaaagcattgtacttttctgtgcggcaatgggctacgcacagacaccctggtctccagtcaagcttaggtcttgaacccctgttcacctagtgggtggtaatttccacctacatgggatcatgcctcctggacccctggctcctgtccaagttaccacccccacagccctcacaggagaggcatgtgtctcagtcaagaaggggcaacaccaagccttcccacatgcaaataaggtttctccaaaactctcagtccaagccaatgagaggtacctgctggtgaaccctgaatcacccccaaaactgtatataaatccattcagggaattaaaggtgcacaagagctactccttcctctgagtctttttgttccgagagctttatgtatcacttgggaagagatctctcctgaagagccacctgaggtcctgctgcactcctcactggatattctcatcggcccagcccgacccaacttcagagcagctcggagttaccgagttcatctccctgcctgcacttgccccttcgctgctacccacgcaccagggcaccaggcctggacaaagatctccgtggaaaacctctggtacccaggcccacactttacaacatttctatcaaatcagtaattgctgtatagaaattcataaaacacctttaggagtcatgcattgataggacaatcttgtgtgatacaatttgaatatttcacagaaaatgaattaattttataaaaagtgaaactacttatttttattttgttgagaatttaaaagattactcatccaatcctttcaaactaatcaatatatgtgttcaaagcatatatgggagggtgggaaataatacaataaagatcagcttaaatccgttgtatttggctgcatgttgctatgttcaatggctaaaagctcagttgcaggcttttactttaaagatacagttgaacagtgagaaaaaacaccatcgattcttagttgataaagagatgatgcaattatttattcagttttagtgtacagtttgtc

SEQ ID NO: 2334 - DNA, 1200 bp, mus musculus
ctggtaaaacctcatggaatttccccatccagttgacaggactgttggtgttgtcactgtgcttgtcttggtaaggtaaacacagatctgtattttttgtgtgtagcttccctgtaataatataaggtactatctcacagcatacttgctgctcatttgtttcttataacctttccaaacttattttgttatgcttcctgagcctcgggtatagatgtcatgttacagatgcatcagttgggtctggagaatttagagataattatctgcagtttagtccagttgtgcctttccatacggtctccatctgttaaaaaatgaggcttctgtgacaagactaaagaagcctacctgaagatagaagagtaagtatttcaaatatgcttaaaatcatagctgttgaaaaaattggaaatgtgatctctgggacggtttgtataagcttgggccagggagtggcactattagagggtgtggtcttcttggagtaggtgtgtcactgtgggtatgagctttaatatactagtcatagctgcctggaagtcaatcttccactagcagccttcatatgaagatgtagaactctcagctctgtctgcaccatgcctgcctagatgttgccacgccctccacttgataacagactagaattccgacttggtgtgccagccccaattaaagttgtcctttataagacttgtcttggccatgctgtccacagcagtaaaaccctaactacatcatcctctatgatgtatgacttcatgaggcatgagtagtaagttgggtttacactatcaggcttagtatggagcatgtcttaagtctaatcacatagtatgtggttaccaccataattttagtgtctctgctacacacttaagtacattttgccatgcatgcagtcatgctggattgtaagctctgtagctgactaagaactattgattacttttctcccttggcaggttccatagcatcttagatatattagatatagtcctaaaagagctgatacaagcttcaattaaatacacttctggtgagccaccgaaatgctaaaaattctcattagcagtattttacatagcaggcattctgaattggttttttttttaaataatgttcattaaatagcaaattacggatgtttgttaatatatgttttcatagatttaataattataatgataataaaag

SEQ ID NO: 2335 - DNA, 1400 bp, mus musculus
ttgtcaactgcatgtttctcattttccatgattttcagttttcttgccatattccatgtcctactgtggacatttctaaattttccaactttttcagttttcctcgccatatttcatgtcctaaagtgtgtatttctcattttcagtgattttctgttttctcgccatattccaggtcctacagtgtgcatttctaatttttcacgtttttcagtgatttcgtcatttttcaagttgtcaagtggatgtttctcattttccatgattttcagttttcttgccatattccatgtcctacagtggacatttctaaattttccaactttttccattttcctcaccatatttcacgtcctaaagtgagtttttctcattttttgtgattttcagttttctcgacatattccaggtcctacagtgtgcatttctaattttttcttttttcagtgatttcgtcatttttcaagtggtcaagtgcatgtttctcattttccatgattttcagttttcttgccatattccatgtcctacaatggacatttctaaattttccaactttttcagttttcctcgccatatttcacgtcctaaagtgtgtatttctcattttccgtgattttcagttttctcgccatattccaggtcctacagtgtgcatttctcatttttcacgtttttcagtgatttcgtcatttttcaagttgtcaactgcatgtttctcattttccatgattttcagttttcttgccatattccatgtcttacagtggacatttttaaatttttcacatttttttaagttttcctccccatatttcacgttttaaagtgtgcatttctcattttcggtgattttcagttttctcgccagattccatgtcttacagtgtgcatttctcattttttcacgtttttcagtgatttcgtcatttttcaagtcgtcaagtggatgtttctcattttccatgattttcagttttcttgccatattccatgtcctacagtggaaatttctaaattttccacctttttcagttttccttgccatatttcaggtcctaaagtgtgtatttctcattttctgtgattttcagttttctcgccatattccaggtcctacagttgacatttctaaaatttccacattttttaagttttcctcgccatatttcacttcctaaagtgtgtatttctcattttccgtgattttcagttttctcgccatattccagatcctacagtgtacatttttcatttttcacgtttttcagtgattttgtcattttttagttgtcaactgcctgtttctcattttccatgattttcagttttcttgctatattccatgtcctacagtggaaatttctaaattttccacctttttcagttttcctcgccat

SEQ ID NO: 2336 - DNA, 1000 bp, mus musculus
ccattttcctcaccatatttcacgtcctaaagtgtgtttttctcattttttgtgattttcagttttctcgacatattccaggtcctacagtgtgcatttctaattttttcttttttcagtgatttcgtcatttttcaagttgtcaactgcatgtttctcattttccatgattttcagttttcttgccatattccatgtcttacagtggacatttttaaatttttcacatttttttaagttttcctccccatatttcacgttttaaagtgtgcatttctcattttcggtgattttcagttttctcgccagattccaggtcttacagtgtgcatttctcattttttcacgtttttcagtgatttcgtcatttttcaagtcgtcaagtggatgtttctcattttccatgattttcagttttcttgccatattccatgtcctacagtggaaatttctaaattttccacctttttcagttttccttgccatatttcaggtcctaaagtgtgtatttctcattttctgtgattttcagttttctcgccatattccaggtcctacagttgacatttctaaaatttccacattttttaagttttcctcgccatatttcacttcctaaagtgtgtatttctcattttccgtgattttcagttttctcgccatattccagatcctacagtgtgcatttttcatttttcacgtttttcagtgattttgtcattttttagttgtcaactgtctgtttctcattttccatgattttcagttttcttgccatattccatgtcctacactggacatttctaaattttccacctttttctgttttcctcgccatatttcacgtcctaaagtgtgtatttctcattttccgtgattttcagttttcttgccatattccaggtcctacagtgtgcatttctcatttttcacgtttttcagtgattttgtcatttttcaagttgtcaactgcatgtttctcattttccatgattttcag

SEQ ID NO: 2337 - DNA, 1000 bp, mus musculus
tttttcaagtcgtcaagtggatgtttctcattttccatgattttcagttttctcgccatattccaggtcctacagttgacatttctaaattttccacattttttaagtttcctcgcgatatttcacatcctaaagtgtgtatttctcattttccgtgattttcagttttcttgccatattccaggtcctacagggtgcatttctcatttttcacgtttttcagtgatttcatcaatttcaagtcgtcaactgtatgtttctcattttcaatgattttcatttttcttgccatattccatgtcctacagtggacatttctaaatttttcacctttttcagttttccttgccatatttcatgtcctaaagtgtgtatttctcattttcagtgattttcagttttctcgccatattccaggtcctacagtgtgcatttctcattttttcaggtttttcagtgatttcgtcatttttcacgttgtcaagtggatgtttctcattttccatgattttcacttttcttgccatatttcatgtcctaaagtgtgtatttctcattttcagtgattttcagttttctcgccatattccaggtcctacagtgtgcatttctcatttttcacgtttttcagtgatttcgtcatttttcaagttgtcaagtggatgtttctcattttccatgattttcacttttcttgccatattccatgtcccacagtggacatttctaaattttccacctttttctgttttcctcgccatatttcatgtcctaaagtgtgtatttctcattttccgtgattttcagttttcttgctatattccaagtcctacagtgtgcatttctcatttttcacgtttttcagtgattttgtcatttttcaatttgtcaactgcatgtttctcattttccatgattttcagttttcttgccatattccatgttctacagtggaaatttctatattttccaactttttcagttttcctcgccatatttc

SEQ ID NO: 2338 - DNA, 1000 bp, mus musculus
catttttcacgtttttcagtgatttcgtcatttttcaagttgtcaagtggaagtttctcattttccatgattttcagctttctagccatattccaagtcctacagtggacatttcctaattttcgacctttatcagttttcctcgccatatttcacgtcccaaaatgtgtattccttattttccatgattttcagtttcctcgccatattccaggtcctacagtgtgcatttatcatttttcacgtttttcagtgatttcgtcttttttcaagacgtcaagtggatgtttctcatttttcatgattttcagttttcttgccatattccatgtcctacagtggacatttctaaattttccacctttttctgttttcctcgccatatttcacgtcctaaagtgtgtatttctcattttccgtgattttcagttttcttgccatattcctggtcctacagtgtgcatttctcatttttcacgtttttcagtgattttgtcatttttcaagttgtcaagtggatgtttctcattttccttgattttcacttttcttgccatattccatgtcctacagtggacatttctatattttccacctttttccgttttccttgccatatttcacgtcctaaagtgtgtatttctcattttccgtgattttcaggtttctcgccatattccaggtcctacagtgtgcatttctcatttttcacgtttttcagtgattttgtcatttttcaagttgtcaagtggatgtttctcattttccttgattttcacttttcttgccatattccatgtcctacagtggacatttctaaattttccacctttttcagttttcctcgccatatttcatgtcctaaagtgtgtatttctcattttcagtgattttcagttttcttgccatattccaggtcctacagtgtgcatttctcatttttcacgtttttcagtgattttgtcatttttcaagttgtcaactgcatgtttctcatttt

SEQ ID NO: 2339 - DNA, 1000 bp, mus musculus
ttttcctttttttgtcttttatttatttatttacactccagattttattccccacccttccaccttcccactgttccacatcccacacttcctccccacaaccctgtctccacgagtatccccccaaccctcacccagccagacctctagactccctggggccttcagtctcttgagggttaggtgcatcatctctgactgaacccagacctggcagccctctgctgtatatgtgttgaggacctcatataagctggcatatgctacctggttggtggttcagtgactgagagatctcaggggtcaagttaattgagactgctggtccttctacagggttgccctccttttccagcctttccctaattcaaccacaggagtcagcagcttctgaccattggttgggtgcaaatatctgcatcatcttttagctgattgttgggcattctggagtggggtcatactaggtccctttttgtgagtgttccatagcctcagtaatagtgtcaagccttgggaccgccccttgagctttattccactgtgggcctctccctggatcttcttttcctcaggctcctcaccatttccatccctgcagttcttttagacacgaacaaacatgggttagagttttgactgtgggatggcaataccccccttacttgaaccctgtattcctgctagaggtaggcactataagttccctctgggatgtcttaggatatggtgtcaactgctctgagtgcagcagattgtctagcatggctcaggatatggtgtcttcacaggagcagaccagctagcagtctgccccaggaaaaaggacagccagcagaaaggatcaggaggggcagaaaggagtggtggtggtggtggggctggtgggtgacgggtcctgcatccaccaggctcccagtgggcagctctgggactgggggcgggtgttcttaccaactccactgggtacatgagatcctctaggatgggtcacgatatg

SEQ ID NO: 2340 - DNA, 1200 bp, mus musculus
caataaaagactggtaatttgaatttatttaaattaatgactgtcaatagagatattagactaggcaggctgagaggaactttggagagtggcactacaatggaagctttttctattattattaaacaaataatatttattttaaaatatacaacttgatattgaaaatttttaagtcatcaaaatactttataacagttaaatgccccttaaatatacatatcttctgatgctaaaagtaatatgctttcaaccagttttttaaatctatttggaacactagacgtgatagaagtacaaaaaatgcccagcaccatcttcagagccattgccgtggagggccccagagaactctcccggagtcctgccaggactgggagatcactggcgagtggaatacaacatcagttccaaaaaacccagagggtcttgtgctagcaggaacagggacaaagaacgcctgctagaccagcagttggggttcggtctggaccgcgccagccctgtaccatcttcagtgcaatctcaactgagggctcaaaggtctccagaggactctcctcactacaggcaccatagcacaccagggatcttgaaatcattgccaggagacagagctgagacacagaccactgaacaccttccctgccaaaggagagtcagacaccagggagagggcgaacaccaggaatcaggaggggatctgagctccagacttctgtgcaccttcattgcaagaggagaacttgcctggagagaatgtattgaccacagggactcaggagagagttggtctcccaggagtgctgacagaggctaaagaatcacaggaggaacaagctccagccagagacaactacaaaatctaacaacagaaattaccagatagcaaaaggcaaacgaatgaatcttactaacagaaaccaagaacactggacatcatcagaacccagtacacccaccacagcaagtcccaacacatccgaaaagcaagatttggatctaaaatcatatctcaggatggtggtagaggattttaagaagggcattaataactcacttaaagaaatacaggagaacactgctaaacaggtagaagccattaaagaggaagcacaaaaattcctcaagcaattacaggaaaacactgctaaaaaggtagaagaccttaaagaggtaacacaaaaataccttagacaa

SEQ ID NO: 2341 - DNA, 1000 bp, mus musculus
caacaatgccttttctagacaccatgaattatcaaacaaaaaacccagtgctatcctgcctaccaactcccctgaaaacacccacaacactgataaactgcacaccatactctctgctccatttcctgcctactttccaagaagccttacctgtaccagtaataccaggtatgccccagcccaacctcttcctggcaactcccctgaaaacagaccaaacagcagcaaactgcaccccttaccctgcccccatttcgaaccatacaactctgccagttttcccaaggtatcctagcaccagggacaatgggtaagttccacccatactaagcccttgtctagccataaattacacccaatagcagtaagttgtaccacataatttgcactccatttcctgagctgtaactgcctgcattctcaggggcctgccagtaccagagacaaccagataagaacccaacccatgaccttgccttccatatttccctaaaacatacccatcatgcttaaaacatcatttttcactccacaaactgactgctgtcctgcaagtctgttgacaccagggaatgcaggcaagactgatactacaaaccccagaggcaatattagcacacagaacctcagagacctcacaagacaccaaactaagactagccaatcaccagaagacagaagcaaacaaacaaacaaacaaacaatcaaacaaacataaaacagaaaacaagaggaagaaattcccaaaacatccatacaacagaggcaaacttaaaaataagcatctaatactataataacagcaaaatctagatgcctaaagcagagtataaaaacacaatcaacaccagcacagcaatatggcattattatcagagcccacctatttcatcaaaacctggatattctaacatacttgaagtactagaaaacaaccttagatccaatctcacgaagatgatagtggcctttaaataaataaatcccttaaaaatacaag

SEQ ID NO: 2342 - DNA, 1200 bp, mus musculus
ttcccctttactgagacatagattcttcacaggaccaagggcctctcttcccattgatgaccgactaggccatcctctgctacatatattgctagagccacaagttccaccatgtgttttctttgatttgtggtatagttctaaggagctctgtcggtactggttagttcgtattgatgatcgttctatggggcttctgtacccttcagctccctgggtatttctctggctccagctggaataggattcttgcattcctgactctaccagagttctgcagaccccaatcatcccagactctgtttcattcttcctgccttggcctgcagagcacaggccacagaagcaacagagcttctggggcaaggtcctatgggcctacatctgcagccagcaggtggagctgatcctcagtcctctgtgcaccttccctgccagaggagaatttacctccagggagtgctcagaccacaggactaagaggagaccatcattttctctcaggtgtctctctaagatgggtccacacaggagagcacaggctgcggaggcagcagagtttctgggacagggccctatgggccaacatctgcagccaggaggtggacctaattatcagtcctctttatagcttgtctgccagagaagagtttgcctccagggagagctctgaccccaggacttaggtgagatcaccattttctctctggtgtctctctaaggcaggtccactcaggagtaaataggctggagaagcagcagagcagctgagacagggttctacaggcctccatatgcaaccaggaggtggggctgttcacaatccctctgtgcactggtcttaccaggagagagcagatctcccaggagtgctgacacaggctaatagactcacaggaggaacaagctccagccagagacagcaggaagatgtaataccatagattaccagatagtggaaggtaaacacaagagtcttaccaacagaaaccaagactacttggcatcatcagaacccagaagccctatcagagtgaggcctagataccccaacacaacggaaaagcaagatttggatttaaaatcatatctcatgatgctggtagaggattttaaggaggttaataaccctcttaaagcaacaagcatttgagataagttggcaggagccaagtgtaagaacagaagcaacagaagcca

SEQ ID NO: 2343 - DNA, 1400 bp, mus musculus
taaatttgggtatcttctctctcatctcttcctattattcataggtatgctgtcttcatcatgtcctgcatttcctgaaagttttgggttaggagcttcttgcacattgtattttctttgattgctttctcaatattgtctatggtatcttctacacctgagattctctcttctatctcttgtattctgttggtgatatttgcatctctaactcctgatctctttcctagattattcatctccaaggttgcctccctttttgatttctctattacttatttctatttccatttttagatcctagacagttttgttcagttccttcatctgtttggttgtgttttcctgtatttacttaagggattcatgtgtttcttctttaagagattctacatttatatctgggttctactgtgtttctttaaggtagttatttatgccctccttaaggtcctctatcatattcatgagatgggattttaggttgtagtctttcagggatgttagggtatcctgggcttgctgtggtgggagaacttggttctgaaggctccaagtgacaggggtttctgttgcatatgttcttgaacttgcctattgccatctggttatctccggtgttaattggccttgctgtttctgactggctcctgtctcacttgtgagcctgtaagcctgatggtgatggaccacttaggagtcaagctgtctctgggtacagaggtgtatctggagcactggctctgccctggagttgagttttgagtcagaagaatggtgtgtttccagcagggcagggaggatagagcctgcctccactgggccatgtgcaggtctaagttagaccaggtattggggcagagggtatttcacttctgatctggttcaaaaccttgttgtgtctgggtgtgggagggttttgggtaatcagatctgccccaggccatgttgtgacatcccctactccttgcccatctgttagaaaccctgattcccaaggattgaagggagctacctgagcccggtccatggcacttagacattaactctggtgataaatttaaattatgtatctcgactagggttacactcattcattctttctacctctccctctccctctttctttttcttttatcttacctctctcctgctctctcactctgactctctcttccattataatctttctaattaacagatgacaagagactggtgtcagaggattccatggtaataaagccacatcctcatatttccttcaaatgacactgaaaaattgtctcaggtgagagtaataaccttttgtggatatctcatactgaaatttaaatcctaacataaaagtccagagcaggaagggagagtttgtagcttccaggaacttagcttgtccttct

SEQ ID NO: 2344 - DNA, 1000 bp, mus musculus
ttattacctaagcagtgtaaatagctgtccaggaggtggaattgtccttatgatagagaacttgccaaggttttaacacatactaatactgtagtatgtaactgacccgtccagcaggtccagttattcgagggtctcgaggggacctcctcctaagaaccaaatggggagtagagagggacgagggccttgtgcgaataatgacacggagacgttctggaatgcatcaaagccccaaaatgtattagccaggcccaaggtttaaatacacaagcaaaaggggaagtgcctttcagcaggaggaatggggcagaggaaatgcacctcagcaggagggatggggcagcagaaagagaggaagtacttctcaacagaagggatggggcagcggaaatttttcttttggcgactacaaggggaagcaggaacttggtggtatcagggtacatcttgaggtcaggacatccagcgctgactttcttggagtggtgcatccggtggcccacttttgacccccttttcttctcgggaggagaggcccaattcagagatcaggacaatagtgttgtcttaatagctcccaacatgtaacaatgtgctccttttctgtaaaattttatgttttcaaaattgtagtgttaaaataaatctcttttctctagtcaaaattttgtacaacttgaaaaggacttagattacttctattttaagggaaaatatcaatcatctgacacagaaatattcaagacaacacccatcaagtattgtgcttttctacattttatttggtgtgtggtatgagtgtgtgtgtgtgtgtgtgtgtgtgtgtgtgtgtgtgtgtgtgtgtatgtgaatgtgtgtgcccacttcaatgccacaatgctcctgtgaatttcagaatacacatttccaatgttatccttctctttccaggggtggaactcaagtgatcaggctggatggcttctagttgaattgtctgtgcactccgctatctcaa

SEQ ID NO: 2345 - DNA, 1200 bp, mus musculus
ttgagagagtttggttctgatgatgtgaaggaactttggttactgttgcttctgggtttttttttttttttttttgagacaggacttctctgtttagtcctggctgtcctagaactcactctgtagaccttgcctcctgccatctgtttatctcaagtgcttgcttccctcaatatatctgactggagcctgtccttctctaatcccggttgtttcagagctcctcagaatccagctttcactatgatcctatgattaggggttcctgtgaacctgagattttgggagtgccagagttcttggcagtcaagcttcctctgagaccctgagatcctggtgtgaccaagctcctgggatcctggggtcctggggtcttgaattcctaagatcctgggcatgctacagtgcatggaagtggtgtctcctctggggactgtggggttatcttgtgtatttgaaaccaaggtataccagcactgatcagaaggaacctgagctactggtcaggcatggctcctgtgtccttgctcctgatgtctcaggccagtcaggattggtttagaacagatgttttgttccacccacccagtgatcctaagatcctggccatgttagggtgcctgagttgtggagggtcctctggggaccttgccaccctccgccgagttcctgccaatggtggccaggatctggtgctgaccagaagggacctgcgcccctggtcaggcaggtatcctgcgtccctgctgctggcagaggcctgttacaattggtttggaactgatgttgtgttcaactcaccagtgatcctaagatcctgggtgtgctagggcatctgcagtgtggagggtcctctaggtaccttgggacagtccaccaaggtctcgccccaaggccccactcttaagttatgtgaaagacagccaagagttcccagacagctttaagaatgcactggtcactgataacgaaatgaatcatttcttcccaagtcaaagtggttcttttccagatgtatggtccctctttgatatctggataaacgttatcagttttgaaggatagcattcttttttcccctcaacctaatcatgttatgccaaggctcgaaagtcccagtttatgcatttcccatatatgaacctgagcccctagaccagggcattcctaccctctcaagcagggggagttgtgtcccga

SEQ ID NO: 2346 - DNA, 1000 bp, mus musculus
tgatgcccagtggtcttgttttctgttggtaaggttcttacattttcttttcccatctggttatctctgatgttagatgttctagctgtctctggctggagcttgtccctcctgtgattctgttagcctctgtcagcccacctgggagtccaactccctcctgtgtcacagtggtcaaagcactctcttgcatgcaagctctcctcttacagggaaggtgcacagaagtatggaggtcagatccacctcctgagtcccagggtcagagcgctccctggaggccaattctcttctggtgtggaaggtgcccaaggatttgggtctcagctctgcctacaccctgaggatgaaggcccaaagtgaccctgtccaagcagctttgttgcttctgcagcccatgtgctcctctttgtagactggtctcagtcttcccaagatcctgagtgtgctaggtcctgccaattcttgcccaagatggcgtggagctgctgctgactggaatgaatctcagccaaagctctgtgggtttcctttgtctctgtccctgctgacacaagacctccattttgtttttgtttgtttgtttgtttatttgttttgaatatattttgatttccactcaccagtgatctcaagatcctggctgtgctagggtacctgcggtgtggagagttctctgggcaccttgggaccctctgccaagttcacgcccaaaatgccatgggctggtcccgaactgaatgaaccccaaccgttggttgtgtgggtttctcttgtcccttttcctactggcacaagaccctctgggttttttgggacagatgttagtgtccactcaccagtgattaagatcctgggtgtgctaggacacctgcaaggtggagaatcctctcatttacattttaaacgatacctccttcctggttacacctccaccaacccaccaccctttctcctaagcttcttcacctttgtctccatgagtatgctcctccaccca

SEQ ID NO: 2347 - DNA, 1000 bp, mus musculus
cgcagttctgaatcctccctgtaacagggggtcttcgctccttcctgaagatgttacttcccgggtttctggcacaatttgtgggattcctgacttgcctgcaagtaagacgccacaacaggatacttctgcaacacgtttattggaagagcatggactgcataggcgaaagaccccgagccccagaaatggcactgcttatataggcctaggagtgatgtgtctatacctgattggttatgctaccagtacctcattaatatgtgtcgggccaggcagtgactcggcaaaaaactcttatgcacatgtgcacattggttgtttacccataatcatgggtggtggccagtggtagccagcgccatcctgtaatggcgtttgcagcttcccgcaaagaagaagctacatagcttctgggatagactccgtttcaggctccagacatccaggcaccttccctgccagagaagaggtgtctgccccacctgggagggttctgctggggagcacctgggtgagacatcctggatcccgaatccctcagtgaatagtctgcataggtgagtgtgcagactacagaagctacacagcttctgggacaggcagaagcaacacagcttctggaacagaaccctttttgttctccagacatccaggccatccaggcaggcaccttccctgccagaggagaggcgttcacccaggagggctctgccagagcaccttggggagccatcttgggtcccggatccctcagagactagtctgcacaggtgagagtgtggactacagaagctacacagcttctaggacaggcagaagtgacacagcttctgggacaggcccttttttgggccttcgttttcagtaggaggtctgaacaccaggtatctgtgtaccttccctgcaagaggagagcttggctgcagaaagtactctgatcactgaaactcagaaggagatgcactcccaggtctgctgacagaggctaacagaatca

SEQ ID NO: 2348 - DNA, 1000 bp, mus musculus
acaaagagaatactcctccattgctggtagtagtgcaaacaagtacaaccactttggaaataaattttgcaggttttcagaaaattgagaattgttgtaaatctaacatccagctacactatttatgggcatgtatctaaatgataccctactgtaccacaagtgtcgggaatcaaaagggaggtccctggggaagagagtgaaggggaaagcccacaccccaccagggttccacctatgttttggtcagtcaggtgtggaagggctgctatctaccttccactcatccccggttcagtatctaagcctctgacccattcttcatggggtggcaaggggcagccctacctgggtgcccagggctactttgctaaagccccggtgagcaccagtgcttctttgctaaagccactgggggttttgggagagagggatgagggaagaggtttgcaacacctgtgagagtgagcacagcagatcttgatgagcagagattctatggttttagagctttattatagaaaggcagggaaaaagagagaagatagaaaagagagggggggaaaggctagaaagaaaaaaagagtaagagggagagaggagaggagaggagaggaggggaggggaggggaggggaggagaggagaggagaggagagaggggttgagagttaggggtaagagggagacaagtaagagagtaagcagaggctgaacagccctttttatggtctttactgttgctaggtaacaggagaggagtttagcctgaagatcagaaacttgggccattgcccatgtgacttctagcctatgcttctcttgtgggggctgtgagaggtggtaacttaggcaggagccagagttccaggagcataagggaatgccaaccgagtcttgtaggtgaattatcaccattttcggggttcagacctcagcttgactggagaccatcctgtctatgcatagcccaatgctccacacacaaggacacttggtca

SEQ ID NO: 2349 - DNA, 1000 bp, mus musculus
aaggaaatctcaatcctaaaggtttgccttggcagataaaatatatttatgcatgatacctaagaatagacacaaagaagaaatgttacaaagaatagaaaaatactgtggtgtggctcaagaagccataattcatggcacaatagaaatgagccaactctgggaaagctctccaaaaagatgagacagcaccatgctatcctagagtatggagttcatcaagttaacatcttcagaagagacacatcaggcagcgtgcactatgtaagtgttgggtaagaggccggatggcatgcttgagaagatgcaaactggagttttagatgtggggaaaggagaggacaggccagaatattgcattcgtaaagcttggtggtggcaaattggataaactctgaatgtcacaacaaatagctttatggacttttcatccatgcacttttctgtatgtttgttgtacaaacccacatgtgaaaaaaaaaaaaaaacatagatcaggccaaatgatcttaagcagcctagagaaatggctcagtggctaaaactgctttctgcataagcatgaatactagagtccctttcataataccactataaaaattagtcatgtgtggccctgcacactatcttgtaaccgtagagccatggagggaagaagcaagaggatcttagtggttatcagtgtaactccaggttcactggttcactgagactccttcataaatgaataaggctaccttcaaatactcagttatatgtacacctgtactcatataacacaaacaagcacacacacacacacacaccaatataaggaagcaatgtcagacagcagcttggaacattgatttatcatgggcagtgacaaataccaggttaactttctgttgtttctgtctccttagtcccaagtcttcttactctaattcacttcatttttgtttctatttaggtgacatttttcttttttctttttccttttttcttttttctttttttt

SEQ ID NO: 2350 - DNA, 1000 bp, mus musculus
ttttttgtttgttctccctctgaaaattccctattacccccctcctgctgctcactaacccacgcactcctgcttcatggctctggcattcccctatactagggcatagaaacttcacaggaccaagggcctctcctcccattaataatcaactaggccatcctctgctacacatgcagctagagctgagagtcccaccgtgttttctttggttggtggtttagtccctgggagctctgagggtactggttagttcatattgttgttcctcctatggggctgcaaaacctttcacctccctgggtactttctctagctcctctattgaccctgttctctgaccaatggatgatagtgagcatccacttctgtatttgtcaggcattggcagagcctctcaggagagagctcctgtcagcaagctcttgttggcacccaaaatagtgttggggtttggtggctgtatatgggatggatccccaggtttctgcatggtcatttcttcagtctcagcttcacccttttcttatgtaaacagtttatcaagggttatttacttattaagaaaaattaagtatccctctgcagcagccaaagcagtagccactgttgccttgcagccaaccaccaccatggtgaagatcctgacagtgaagatgcaggcatacccagatcagtcgctgggcaccagcaggttgcagaagtgagtgaaggtgttccagagcaacgccaactatgtggaaattttcatccagagcattatcttcaccgtagatccagggctgaggcaggaggccaagctggttgtgggtgggatggctgcttctacatgacagaggcacatccaactcatcatacttaccactgcagccaacgggattggttgcctggttattggacagaatggaatcctctccacctctgctgtatcctgcatcatcaagaaaaccaaagccattgctgggataattctgacagccagccgcaatccagaagggcc

SEQ ID NO: 2351 - DNA, 1000 bp, mus musculus
acaggggtctccagcttctgtccattggttgggtgtaaatatctgcatctgacactttcagctgcttgtttggacttttggagggcagtcatgataggtccctgtttataaagcacaccacagcatcagtaatagtgtcaggccttagagcctccccctgagctggatcccaatttgggcctatcactagatctccttttcctcaggctcttctccatttttgtccctgcagttctttcagacagaacaattctgggtcagatcttttgactgtagggtggtgtcttagtcagggttactattcctgcacaaaatatcatgactaagaagcaaggtgaggaggaaagggtttatttagcttacacttccacattgctatccatcatcaaaggagatcaggattggaaattaaccaggttaggaagcaggagctgatgcaaaggccatggagggatgttatatactggcttgattcttctgccttgctcaacttgccttcttaaagaacccagaactaatagcctagggatggcaccacccacaatgggccttcccacccttgattactaattgagaaaatgccttatagctggatgttacctccttccagcctagctaggctggctcagctggctcagaccatccaccactgaggcagagccacctgctgtgctgcttctcatcactctcctttgatgtgccactacctgctacctgcctgaggcctaaccagctctccaagatcttctggagttagctgcaaactgtgattttagcaggttcctactaaaaggctgatctgacaacttcaaagaaactttgcttgactaggaatgagcctcccctcttcttttttttttttttttattttattttatttttattaggtattttcctcgtttacattttcaatgctatctcaaaagtccaccatacccaccaccccccaatccactacccacccactcccccgttttggccctggggttcccctgtactg

SEQ ID NO: 2352 - DNA, 1000 bp, mus musculus
ggtgaacaaaatattcacaggagtaaatatggagacaaagtgtggagcagagactgaaggaaagaccatccagagactgtcctgttgtgtccggccagcagatcacaggtttgggttccagcctggaaaggcattttggaaacctggaagagaagaggggctgggctgcacgagataaggaaggaaccaagacaaagctctctgctcaaggttcaattttaatatcagcaaacacgctttataaagaaaaggggaagcccgtccctggccaagcaaagttcctttgaagtagataggtcatccttttagtgggaactcccgaagattgcagttcggtgttaactccagaagattcctggaagagaacctgttcagcctctggcaggttgggcctcaggcaggtagtggcacatcaaaagagcagtacagcaggtggctccgctcaagcagcagtggatggtcacagccagccttgctaggctggaaggaggtaacactgccccacctggggatccatcccatatacagtcaccaaacctgaacactattgcagatgaagatgccaggaagtgcttgctgatgagagcctgatatggctgtctcctcagaggctctgccagagcctaacaaatacagaggtggatgcaggcagccaaactttggactgagcacgggtgcctgatagaggagttggagaagggattgaaggagctgaggggctttgcaggcacatgggagatcaacagtgtcaacaggccagacactgcctccccccaccgagctcctggggacatgaccaccaaccaaagagtgcacatggagggacctgtggttctggtcgcatatgtgggagaggatggccttgtacataagtgggaggagtggcccttggacctgaggggattctgacgccccagtgtaggggatgccagggcagaaaggaatgagtgcgtgggtgggtggggtgccctcatagagacagggtgaggagggatgggat

SEQ ID NO: 2353 - DNA, 1600 bp, mus musculus
agggtggaccatgtagagactgccttatccagggatccaccccataatcagcatccaaacgctgacaccattgcatacactagcaagattttatcgaaaggacccagatgtagctgtctcttgtgagactatgccggggcctagcaaacacagaagtggatgcccacagtcagctaatggatggatcacagggctcccaatggatgagctagagaaagtacccaaggagctaaagggatctgcaaccctataggtggatcaacattatgaactaaccagtaccccggagctcttgactctagctgcatatgtatcaaaagatggcctagtcggccatcactggaaagagaggcccattggacacacaaactttatatgccccagaacaggggaacgccagggccaaaaagggggagtgggcaggtaggggagtgggggtgggtgggtatgggggacttttggtatagcattggaaatgtaaatgagctaaatacctaataaaaaatggaaaaaaaaaaaaaaaaaaaacctaggatagccaaaactcttctcaatgttaaaagcatctctgaagaccaaagtgtggacactttgccccttcttagaattgggacaaaagacccatggaaggagttacagagccaaagtttggagctgagatgaaaggatggaccatgtagagactgctgcacccagggatccatcccataatcagcctccaaatgctgacaccattgcatacactagcaagattttgctgaaaggactttgatatagctgtctcttgtgagactatgccagggcctagcaaacacagaagtggatgctcacagttagctattggatggatcacagggccccgaatggaggatctagagaaagtacccaaggagctaaagggatctgcaaccctataggtggaacaacaatatgaactaaccagtaccccctggagctcatgtctctagctgcataagtatcagaagatggccttgttggccttcagtggaaagagaggctcattggtcgtgcaaactttatatgcctcagtacaggggaatgccagggccaaaaagtgggagtgggggggggtaggggagtgggggggagtatggaggacttttgggataacactggaaatgtaaatgaagaaaatacctaaaagaaaaaaaaaagcatctctggtggaattgcagtgtagtggtgcatctacactgcaattgtgttaaaaacttcatggtactggtatagcaacagataggtagaccatatgactaaaattgaagacccagtaatataccaatacacatatggtcacttgatctataaccatccagtggaaaaaagagcattttcaacaaatggtgctggtataacagtaggttattacatagaagaatgtgaattgattcattgttatctccttgtactaaggtcaagtctaagtggattaaggaactctacataaaaccagagacactgaaagttatggaggagaaagtggtgaaaagccttgaagagatgggcacaggggaaaaattcatgaatagaacatcaatggcttatgctataaggtttagaattgacaaatgggacctca

SEQ ID NO: 2354 - DNA, 1200 bp, mus musculus
tgcaactttggcccttcagaattgagaagaaaatatgatcctctggttgtacaagctcactcctgagtatgtactgaagacacaggttttgtaaaaatttcattgcttttttagtgaaaacatgatgctttatctttcttgtgttgcaaggtcaagagagatgaaataccaagagcaccaagagggaaataaaacaaccagtgtgtgggattgatattggggttcactcattcgctctgttaaagatggatccaggagcagcaggtgtcagacaaggagaacagagagcatggaatggagttctgggacccttgtcaagatctagtcagtgacaggggtcagagcacatctattcacatgttttgagaagatatactatgaaggcccaggctttgcctttgtatggtgagtatattccctgcggcgttggagatctgaggttcttataaaaatttaaaggtctgaagatcattatcttcatggtacaagaaaagcattaattgagttcaacatgagagccagcttaaaacataatgagtcttaatttaatcttagttttaatatttgcaatatatatccatatacacaggtgtaaagtgaccatcacagataagagatggttaaaagttgaaccttatttacatttaccagcataacatgcttaaaagaacagggaaacactgctgcccatagcctgagcccatctcagcactcccatgcctttacatcagattgttgtggtagctcatgctcttcaagtctttttaataactatgcctctggctaatggcagcttcctggccattttggatgcttagtggtctatatttgggagaaagtcattgggaggaagtagcctcagatcctgtacacaaaggcccctggagagtaatttgtggtttaggcataggtacacagtctacagtttagaatgttggaatggaaatgatcataatggtgaagggcagagccgtgatggtgaaggactccaagtaggtacattcaaatgaacctctgcagttttcttgcagtgtgagaaaggaaaccagtggacagaagccagaagcacatgggatattatcaactggaggcacaagtctaagttcacctggatctatggccaagcaatgactcaggagaacacctgtcattttgtaactgttgactaggaactatctggacattagaaatgccatggtg

SEQ ID NO: 2355 - DNA, 1200 bp, mus musculus
attagcttattacttggagatgaaaatagcacatttaagctttattttatgcgtatttcttttttaaaagatttattttctgttttatttgtatgagtattcacttacatgtatgtatgtgcatcgttgaaggcattgaatactttggaactggagttatagattattgttagtcacaatgtgggtgctggtaactgaccctggtcctccggaagagcagctagtggccctcagcaccaagcatgcttcccatcccttcccaaccttatttctttctctacagtcctcagtatgagagtactacttttacaatgactttaaggttactctttagagcagtagttctcaacctgtgggtaatgatcccttaggggagtcaaaagtccatttataggagtcacctaagactattaaaaaacacatttacactacaattcataacagtagcaatattacagttatgaagtagcaatgaaaataattttatggttgggggacataaataattcatggtttcagttccaaaacaggaggaactatattgaagagtcatagcattaggaaggttgagaaccactgttgtagagaaagtaacacctgtgctatcctaaagataatcaacttaacaaggagacatctattgagtaccattgcatttggtgagggagacaatattagttttcagcacgcagtgtgttaaaaagcagtggcaaaggcaagcttttcacacaaaggtatactaggaagtcaccattttcaagtgctccaagagtgcattttgtctccatgtacacctacatgccagaagaggttatcagatcccattacagatagtggtgagccaccacgtgttggctgggaattgaattcatgcctcagtaacagcagccagtgttcttaaccactgagccatctctccagcgccatggtctaaaccaccaactgaagagtatacatggaaaagccatgactccagatacatattccagagaaagggcttatctgattgatatgggaggggaggtaggcttgatgcccaggtagggagatgctagaggattgaggcaggagtgtgtgagttggtggaggagcaccttcatagagacaaaggggaaggggaagagaggggatgggaggagtaaccgggaagggggatatcccttgaaatataaacaaataaaattatttttttttaaagtg

SEQ ID NO: 2356 - DNA, 1200 bp, mus musculus; identical to SEQ ID NO: 2355

SEQ ID NO: 2357 - DNA, 1000 bp, mus musculus
ttagctcattctgattggtaaataaagatgctgatagccaatggttgagcatggcagacaaaggtgggacttttaggattccaggctgaggagagagaggaaggaggaagaaggaagtccactatgtagggaaaaggagagggtgaggagagactccgtgcctgagaacagtggaaagtagaggcatagctaccgtagttgggcagccctctaggtccagagcagaaagatagattttagtaaataataacttgggattattggaagtaggtggattaactgcatggaggttaggaagtagccaaactattgcactaagtatatcaaagtataaagtctatgtgtgtatgtttcattcaggaacataaaccattggaggctagcaggaacccaccattgagatttatagataaaaaatattgctacagaaaatggcagacagaggtgggacatttagcattctcaagctgaggatagagaggaaggaagaaggagttatgccatgctgggaggtgaggagagactccatgcctgagaatagtgcaaagcagaggcgcagctgccatagttgggcacacagtatccaatgtgtgggacccacccacagtcttctgggctcctccaaattttgggaagaaagttttgtgggtggtttggtgaccctatccctccactgagggtcctgcctggctattggaggtggcctctacaggttccatactcccattgttaggtatctatgctaaggtcaccagcattgacttctgggctcctctcctatcccaggtctctgggaatgcctagagattctcccctccctgccacccttggcagctgcagatttccattcattctcttggccctctggaccccagtcctattttccccatctaatcctgcctccccagtccccccaccctctctccacttcagttccctccctccctgtgcctcctatgacattttgtttccccttctaagttaagtaccctttgttggg

SEQ ID NO: 2358 - DNA, 1000 bp, mus musculus; identical to SEQ ID NO: 2357

SEQ ID NO: 2359 - DNA, 1000 bp, mus musculus
taaatgtgaataagttcagtaggaatttcagctgaaaacattacccaaaatgggaaatgaaatatatttttaagccaacgatgccaattatttgaaaaaaacactcccacaaattctgaatgtaatttagggatggaaacttagttatcttgagataacaactggagcagggtggggcaggggcttctgtcactaaagttgttgcctgtctttgcaatctgttctccatctgggtggttgtttggcctcagtgggagaggatgcccctaaccctggagagacttgatgtgcagggtgagcgatttgtaggtggtgtcctcacatgtgagaggagaaggggaggaggaatgaggggagggactctgtgagtgaggaactgggaggtgggggcagaagtagggatggaaagtgaatgaatgaatgaatgaatgaatggatggagaaaaataagtactgtgatagcaaggctatttccttatttgattatatgtcattaagtagaaatttaaaagcaatcaccactacagtggagactcatacatagctaatgccatagggtttgtacttatttatttgtttgtttgttttgttgttggccttttctgtagcaggcaaattggcctcaaggttcagcttagcagttcagagtgtatattggtctcacagagtaccaagttcagtacccagtacctatgtcagctggctcacaactgctggtaattcaccaccaggaggtcacccattctgaccacagaggtgcctgcactcagaagcacaaacctacatccagagggatgtgctagtaacagtaacagtaacccaggcagtgcttcagcactagggacagcaccaggcagtgcactctgtcctgagctcaaagccttggagtctaaaaatacttaaactgatactatccacaagagaaaatagatgggaaattataaatagctgtgttaaaaatagcacacattttccaactcaaaaactagatctctgacta

SEQ ID NO: 2360 - DNA, 1000 bp, mus musculus; identical to SEQ ID NO: 2359

SEQ ID NO: 2361 - DNA, 1000 bp, mus musculus
gaaatagttaagcatgaaaattggtgtatctgaagcatttttatagtaagagagatgccatcattagtaaactattggtgtcatacctctgatggggctggattgagacactatcatgtgatccttttgaataatgtgtctttatttacaacacagaacagacgcaggctacagtgagctctctacttccctcttactcaacatccctccaaattagtaacacagcatggatctttaaatgccaacacttccttttttgctgtgcaatggagacatgtttgaatagttcagctgtaggaggaaatcactatgactaagagaattatggaagagtgagtttatttttgtttcacgttcaagaggcttggggtttatcatggcaaagaagcatggcagcaagcagtttgttcccagagcagctgagcaggtgtctaagaacgcacagccccaattacaggtgcaaggcacaaagagtgatctggaagtgacgtaaagctttaacttacgtccacctccagtgatattcttcctgcaccaaggctactactacaacctccccatacagcagatatactccaagtgttcagatactcaaatgtatggttgacccttattatccaagtcatcagagcatataaaagtggtcagatggagtaagcactgttccataagaggaaactgggatatggttaataagtcaaaatgaccagatgagaaaatgtttgaagacaaagtgtctcaatatataatttgatggttttagcacattaataatcacaatgagagtgaatacattcaaagagactaaagtatttcaaacatgtagaatgaagaagaaattgaaggaaagaaaatgtttccaaatgatgagcaatgattttgtggtgagaaggaaggaatgaaggaaggacatcaagtacataatccctagtgtgtgcatagtagactgttaataaaataattctccttctgcacagacctgagagttctccagtgtgta

SEQ ID NO: 2362 - DNA, 1000 bp, mus musculus; identical to SEQ ID NO: 2361

SEQ ID NO: 2363 - DNA, 1000 bp, mus musculus
ctgtgagcactacataggcatatagtatataaactccctgtttatatataaatgagaaacaaatatgtttccttggagctggagaggagactcagtgtttgaaaatgcttaacagccttccagaggcctcatattcaattatcagtagctagacaaggctcatcacagcatgtacacctccttgagatctggtacactcctctggcctgcacaggaattccccacatacatgtgggacatacacacagagaaacacacgtacacacaaaccttagaaatctttaaatatacgtatcataacatattgaagaccatcaaaattatactacttatttttaaaaagttattttctcttagagtataacagtggattaatacagaggaatagatgcaatcatatgtataatcattgcattcattacaaggaacacatattaaagagaagtatatgtacaaccatatataatttgtttgttcacatatatgtgtgtgaacatgtgtgtgtgcatgcatgtgtatatatatatatttattgatattaggtgacatatatgtataatatataagcaaaaggtatgcatatgtattcatatatatgtatatatatatatgggctaattatatttgatgttaattctgttctcctgtgaagggttgtgaacaaggaatgagtcaacaactcaggtgatttcctgtgaacctgcatcccaccttaatttgtaaaataaaggagtgctgatgattgggcagataaatgggaaggtggagccgaaggtggggtggaagttggggagagagaagaaggagaaaatggaagagggagagaacgcagagaaggaggaagaagaagaaaagtggagcagaagcacatggcctggagaaaccgcaagttctaggagttctcatagatgtggaagatggtagtgtagcagtagatctgcccaatctagatgcacagcatttattcatattaactgagttgtgttttcattgcccaggc

SEQ ID NO: 2364 - DNA, 1000 bp, mus musculus; identical to SEQ ID NO: 2363

SEQ ID NO: 2365 - DNA, 1000 bp, mus musculus
atcaaatttctatgtatctgtaattattaaaaataaatttataacattaccaattagatgaaaggattcaagaataagtgcagaaaggtcaagagtttgatctgacaaagtaaatgagataatggtaacttagaacagctcatcagctttttatgttatggacaatttgacacaaaatggggaaccagaagagacaaaagagtaactgtggagttatcatgcacagctgatcatttggttgaaagcatagaggcaaggaacgtggtacagttcctggcccagtgttgagggaagagtactcatcagtggtagttaatacaagaagctccagaagtcataaaatatcatttgatttgcagagctactagacaggtgagagcagctaatgggttaatcttggccaaggcagggctgcactttgatgagctgacaagcttcaggtattggacccagaggttacccagaagaccatagagctcaaggaagagtgccaggattttgcggacaacattggccagtttcagaaaactgtttttgatctaactgagcatattaatcagtttgacaaagaagcagagaatgagaaggtgaaggccattggtgctcagaacttgctgaaatctatagtgaagcagagagaaggccaactgcagcaactgcgagcactgttagcagaaaagatgcagctagaaaggtatcaggtggaatatgaagctttgtgtaaagtagaagcagaacaaagtgaatttattgaccaatttatttttcagaaatgaactgaaaatttcagttgtatagtaggaaggcaaaaaagcaccccaaccataaaaaaccccaaccttttaccattaaggtgggtgtgactgatgtatgtcatgcagtgtgttaagggggcagctggggaacagtgcacagccttggctactagccaggcagcacaggacctcacctcttgacctctcagaacaaattcattgtttgtaaatgttgatctatctat

SEQ ID NO: 2366 - DNA, 1200 bp, mus musculus
agcactctctgctggcaagctctcttacagggaaggtgcgcagatatcttgtttttggacctcctcctggtcgaagaagaaggcccaaaacagggcctctctcagaagctgtgttgctttggcagttcccagaagctgtcagcttatgtggtgcagactctcacctgtgcagacaaaattcctaagttccagggagtcctggaaccaagatggcgaccgctgctcctgaggctgaggctgcctcccaagccaggcggacacctgtcctctggtccggatggtggccggctgtctgcggcccgccaagggtgctgcctcagcggctatgtgcttctgcctgtcccagaagctgtccggctctctggcacactctctaacctgttcagactcggcatgattcttgaaatgataaacttttattattttaataaatgcagtaatgctttagaaattaaaattttctctctgacatgttcacaatttaagtaattcttgaaatgagctaagtgtttcttttgctacaaaaaaagtaaattgttctgtgttccactgtccttaaaggcaaatctatccccattactaaatagacactttccacctgaatgagctgaaaacattctcctgatgtcgaagggaatttatgttaccaggaggaagaatatgatcttgccaccaaattcaaattgatctcttccagagttggcaggtcctcctccccatgactctaattttaccagttagttcaggttcaggaatttgtgaagacccttttgtataccttcactgttgcgatttatcctcactaggatatgcttcacctcattcttttgatacaatgcaccagtgtcccaagaactaactcagtctattgttgcaatctgcattccctaatagtcaatctgagtgctattttattgtcagaaggtttagcatacaagatataattctaatcataactttttttggaaaagttaaggaaatggacctatttgacaggtaaggtccatcttgcttccagtgatgattcattttattatcaactaagctaggctactgtgcccagatgtgtcagtcactagtattctactgactccatcaacctatttttaaaacataacatttaaatttgtttattttaataaaatagctttcctctcattctataggtagatcctatccaatcaattgatggcacaaata

SEQ ID NO: 2367 - DNA, 1600 bp, mus musculus
gacctaagcttttcctcaggttcaagacccgtggaaaggcctgtatacttattttgtgtaccatatttcctctttgctcctactctctctccttgctttacttctgatagattgccctgaatttcatccagaattttcagccctgccttaaccacttgataacatgtgaaaaggaacaaaaaggctcctaacactagagaaagttcaaggccaaacatatcttgtaaagctatttcccactttacttctgatagactgtcttgaatttcgttagaaagttcaagaccagacttaccttgtaaagctatttcccactttacttctgatagactgtcttgaattttgttataaagttcaaggccagacgtaccttgtaaagctatacttacgggtaccctgttccccagctgaagagttctgaattcacgcagttgaatccttctcaacagtctgtgttgcgggaacacttcattaccaccattccccagctgaggagttctgaatccaggctggatccttctcaacagtctgttttacgggaacctttatgaccgtgacccgcagttctggttccggaatgagggatcttccttgcgccagtgatggtaaccgtcccggattttctcgtcccaggtcttctcgtcccgggtcttctcttcccgggtcttctcgtcccaggtcttctcgtcccgggtcttctcgtcccgggtcttctcgtcccaggtcttctcttcccgggtcttctcgtcccaggatttctcgtcccaggtcttctcgtcccgtcccgggtttcagcaccaactcttacacgcgttctcgaccggccaggaaagacgcaataaaccggaaccttctgcggcaaagctttattgcttacatcttcaggagccagagagcaagagagcaagagctctattgcttacatctttaggagccagagcgaaagagtgcaagagcgagggcaagagcaagagagagcaagaaagcaagaaaaagaacgagaaagcaagagtgcaagagcaagagagagaaaaagaacaagaacaagaaagcaagaaaaagaacaagaacaagaaagcaagagagagcaagaaagcaagaaaaagaacaagaacaagaaagcaagagagagaatggcaaaaccccgtcccttttaaggagaattatcctccgcctaggacgtattactccctgattggctgcagcccatcggcccagttgtcatcacgagaaaggcagaacacatggcgggaaacctgcccctgcacgtgtgcagattatgtttactacttagaacacagctgtcagcgccatcttataatggcaaatgtgagggcggcttcctacacctgccgtctactcctcttgggtgaatatgcttcctttttttctagagcctttacatgtgttgtcaagctgctagtatgtgctctctcccgtttcttcttggaggcactcagagctatgagtttccctcttagaaatgcgttcattgtgtcccataggtttgggtacgttgttgtttcattttcattaaactctaaaaagtctttaatttctttatttattccttccttgaccaaggtatcattgagaagag

SEQ ID NO: 2368 - DNA, 1000 bp, mus musculus
cataaagactaatttgcttaagtaatcaatgttggaatcagttcttgaccccagatccatggctagtttcctgggatcaagcagagtgacttacatttgtacgatgttttcctgttctttcttacattttttttttctgttgtaattgtgctatgaatgaggaaatggttttctcaactaagttcttgcagaggagtttccagcccagttgtgggcaggggcgagggggcgttgggtggttcccatgcaggtgagagtctttggtctggtctgtggctggagtgcagaaaggccttctggcaggaggatagaaatgggtcttcaggggaaagcctattccatcgttcaagcacagtgggccttgctgagcagagagagtcaatggttttagagctttattgtaaaaaggcagatagaaataaagaaggtaaaagaaagaggccatccatggccatgtggcaagaaaggttggggagggagtgaaaggaggggataaggagagctagagatgagattaagaaaggtgagagcttaagacagagagaagggagcaagcagccccttttatagtgggctggcctatctttcagttgcagggtagctgtgggaaggatcatacctggctattgtcatgtaactgtgagggtggagtctagctagaatgccaggagcttggggctttgtctaaatcactgatagtcataggattatgaagtttggggctatgtggtgtcagacacctgtctctgggaacgtggctcactgttctgtcccttgtagagttttctactggatctccagaccttgctcaaccaaaacaggctgcctttcacagtcccacatgcaaactcacaacctgagccaatgcagcacagatatccacatttgtgtgttggtagtgtgtgtgggggtgattttctcttaaaggaacagataaattattatccacaaaaggacttttaagtaatctcttctttaaagtgaaggtaaattattcctt

SEQ ID NO: 2369 - DNA, 1000 bp, mus musculus
ctgtatattgcttttactatgtttaggtatgagccttgaattcctgatcattccaatccttttatcatgaattggtgttggatttttttcaaatgctttctcagcatctaatgagatgatcatgtgcagggctgtgggtgtggggaaagagaggagtgggagagagcctgcatcctgtgagagttctagtgctctgggcagatagatgtgggaggactgtgcatgctttccatgcagcccccagtggccatctggctgtgttaagtggacaagtggcagccctaggtaccaggttctcagcatccagcatcctatgctggatatggcagagaagctgagaacagaataggatgccctacgatggcacttggccttggagaggaagggaacagaggtcaaggggagaggggactctgggtggttcccacgaaggagagagtccttactcttgtccatagctgcagcataggaagagcttctgtgtggttagatgcagctccttagaagaaagcctatctcatccttcaagcaaggcagtggttacagaccgtctatggtcttaaagctttattgtagaaaagcaggaggaaagagaaaagttagaaagagagaggagaggtcagccatggccatgtagagagaagagggaagagagagagagaaggaaggaaggctagagagcaagataggtaaaagcttagagagagagtgagatggagccaagcagcccctcttctagtgggctgggatatcttgctgttgctaggtaactgtggggaggagtctagccagaatgccagaagcttgggacattgtctacatgactgatggccacatgcctctcctgtgggggctgtgggggtggtaacttcgacaggagccaggggtccaggatatatgattgaatgccttccatcccatgtaggtggaaattgccacccaccgggcttcaagacctaagctccactggagacaaggctgtctgtgcatagcccattgc

SEQ ID NO: 2370 - DNA, 1000 bp, mus musculus
ttatacatatatctgtatagatagctatagatattcctacatatataagtataacctgcttagtctgtatagtgttacctgtgtgtatgtttttagggttggccatttgttattagataaccatgctttttcctgagatacagtctcatagcaaagtccttgggttcttgctccaccttctacaatgacccctgagccttcggtgcagcaggtatgttatagatatagccaatgtggctgggctccacaactctgcattttggttgtttgtggttttctgtaatggtctctgttgtgaagagaagtttctttgatgtggaatgaggattgcactgacctatggatataaggacaaatattcctaataaagttagggattatactggttttaaaaaatagtaattgtagattcccatctaagatccatgacttcaccagccctgggtggttggctagcttcctagtagtaccaagcaaaatttccctcctgttgagtggttcttaagtccaattagagagctggtggttaccaccaacgtatgtgtgccactactgcacgcttagggctatcatgtcatgtgatcattgtcatggttcgtaagtgttatagctacacaggagtgttcattgcttcccttctttgtaatcttgcattgcaacttctgataccttgaaagttagtctttagggaggcggctttcaggtaatgtctggctgagggctgattggcactgtgtctgaagtgcatgttgtcatcaagagggacttctcttccacctctgagaaaccactaagagcagaagaaacagcctgtcatgtttgtggagtctcttggatgaccctgaacaactcaaaatgagatcttctcatgcctggggttgggagttttgttagatggttcttgcctcttggataaaacgttgttagttcagatggaaaggtttcatttactctatatatgtgtatttatgcactgaatacatctgttataggtattttt

SEQ ID NO: 2371 - DNA, 1600 bp, mus musculus
tggtatgagaactttctaatttattcttggtggcatttagtgctttgcactttcctttttagctctgcttccatggtgttccatgaatttctgtttgttttgcttttattttcattgaattatagaaaatctttaattcattcctttatttcttccctgacccagagaccactgagtagagagatgctcagtttctatgactgtgtaggctttttgaagtttctatttttgagttccagctttaatccatgatggtctggtaagaaacaaggcattatttcaattttcttgtatctgttgaggcttactctaaggtcagttttggagaaggaaccatgatgtgctgaaaagttatacatttttgtgtttcaatgaaatgttctgtaaatatcagttaagtccttttgattcatattgttggttagcttcattatttctctgtttagtttctgtcttgatgacctgtcagttggggagactgtggtattgacatttctcactattttttttttcattttggcttttttaattagatattttctttatttacatttcaaaaattataccctttccttgtttccgctctgaaaatcccctattcccttccccctccccctgctccccaacccacccactcccattcccagccctgacatttcctattactggggcatagaaccttcacaggacgtagggcctctcctcccattgatgactgactaggccatcctcagctacatataccgctagagccacattcttagacgaatggatggaactggaggatatcatcttgagtgaggtaacccaatcacaaaagaacatacatgatatgcactcgctgataagtggatattagcccagaagctcacaatccttcttagaaggggaaacaaaatacccatagaaggagttacagagacaaagatctgagcagagactgaagataggaccatgcagagactgcccagcttggggatccatcccataaacagccaccaaatccagtcactatggcagatgccaacaagagcttgcagacaggagcctaatatagttgtatcctgagggcttttgttagttcctggcaaatacagaagtggatgctcacaatcatccattggatggagcacaaggtccccagtgaaggagctagagaaagtacccaaggagctgaaggggtctgaaaccccataggaggaacatcaatatgaacaaaccagtacccccagagctccttgtaactaaaccaccaatcaaagaaaacacatggtgtgacatttcccactattaatgagtggggtttaatgtatgacttaaactttagttatgcttcttttataaatctggttgcccatgtgtttgaggcataaatgtttagaattgagatatcttcttggtagatttttcctttaatgaatatgaaatgttctttgctgtctcttgtgattaattttggttgaaattatattgtattagatattagaatagctacttcagcttgcttcttggctccctttgcttagaaaacattttttatagccctttactctgagttatgcatattttttttttttgctggggtgtatttcttgtatgt

SEQ ID NO: 2372 - DNA, 1200 bp, mus musculus
gattatgaatgctactatcttaaagattgtattatataatctggagggtttttttttaatacagattcacactgtgttaagcaacagactatagcatcgtgtgtcttctcctctgctcattccccagtttctttctacattcttcacattagagagatgtgtgctaacacttctacactccattccacatctttatggctctgacctccaggtggctcttagccaacactattaacagcatggcctctgctgttaagagctggtgtatttgcctgtcaacttcctgtttcttaggatgaacagctaggtaaaatgagacagagcaggcttttagaaggctcttgacagatggacttcgcctgcttgtagcccaggtagaatcaataaaaacttgtcacacatacacacacaaaatcctgcctaaagtaatgagcactgacttatacaattttatttgtacttctacaaaatgtttccaggcagagttcagtatttatggggcaagtgcttgcctctggtgcttattttgtgagattatgaaaatgcaggttaaaatattgccaattgggtactttttcctcactttctgccttttactcgcagactctcttctcactatctaccttttacttacaaatgtgagagagtatgtgggcatatgcaccggcccacaaacacacatgcataaataagaacattagaatactctcttttgaaaatagatgataacgatcacacaatctttatgaataggtcagttccacctactgtgtgacttctttttttaattggatattttatttgcatttcgaatgctatcctctttcctggttttccctctgcaaacaccctccccatcctccccccatttctatgaggtgttccctcacccacccactcactcccacctccccaccctggaattcccctacactagggcatctagacttcacaggaccaagggcctctcctcccattggtgctcaacaaggccatcctctgctgcacatgtgcctggagacatgggtctatccatgtgtactctttgtttggtactgtgtgcttctaaccatcccagctatctcagttgtaaaatggaatgggtatcattaattgtgtagtatgttaatctttttgcaaatctatctccacatttagaaggaacactgtgtagatatatgcactattttaaacctacat

SEQ ID NO: 2373 - DNA, 1000 bp, mus musculus
gtaagcaagttatttgactcatgatgccccaaagtttcttgatccccaggttgagaacttgtgcatttaacaagtacattatttgaataattctgatgccatttctgagtattcattctcacgacgtttacagagaaaaacccttgtcaaaggcaatgttttccgtgcccggggccacagcgagcctggtaaatggcccttgtgtcttcatccctcccttcttcagtatattcctcactttttttattagatattttctttatttacatttcaaatgttatcccctttcctagtttcccctccaaaaatcccctattccctaccccctcttcctgctccccaacctacccactctcattactcgtacccaaggagctgaagaggtttgaagccccataggaggaacatcaattttcctcacttttatttccatccaattccacagctggagaaaaatctgaacagcaaattctcaaaagaaaaaattaaaatgtcttttaaagtgttcaacacaatttttgtgagtgctccataggctcagtaatagtgtcagtccttgggaccgccccttgagctggatcccactttgggcctgttgctggaccttcttttcctcaggctcctctccatttccatccctgtaattctttcagatgagaacaattatgggttagaggtgtgattgtggcatggcaacccatccctcacttgatgttctgtgttcctgctggaggtggactctataagttccttctccctacttttgggcatttcatctaagatccctcactttgagtcctgaaaatctctcacctcccaggtctctggtgcattctgggccccccccccatgtcctatttcctgaggttacctgtttatattctttctgctggccctcagggcttcagtccttttccctcacccaataccagatcaggtacccctgcaatgccacaagcaactgaaagagtcatatgcacatattttcacccaaccaacg

SEQ ID NO: 2374 - DNA, 1600 bp, mus musculus
aaccaggtgaaatcttcaaactccaagccccaatcccctgcctggtgtgtcctccagtaagtccagcaaccctgaggtctgtattgtcccctctgcgctccatattacaagtccacacttctaccttcaatccaagatgtctatagccatcagggaccgcccagtgagatctctgccaccattatctaattatctgtgcactgaccgatttgggaaaacccatcaggttaaaattctgccctgcccctccccgtgcactctatttctgtgggtaacagctcctagcagtgggggatatggagcttgaagtggccacctcctgtagctaggcaggactcccagtgtagggataaggacatcaacccacccacaaaagctttaacccaaaatttgttctgcctacaagtgcaaggacaaaggttgaatagaggttgagggaatggtccatcaataactagcacaacttgagactcatctatggacaaaatacaatccctgactttattaatgatatgctattatacttgcagacagtactattgtcctctgaaaggctccacctagtagctgactgaaatagatgcatagacctactgccaaacattagatggagcctgcagagtcttgttcaagagttggggtgggggtactatggaacccaaagaggataggaactcttcaagaagaccatcaattaacttggacccttgggggctcccagtgagcaagcaagcaagcatgggctggaccttggctgcccacacatatattgcagatgtgcaacttggtcttcatgtgggtctcccaacaactggagagggagctgtctctgactttgttgcctgcctgtggatcctgttccccttactaaactgcctcactgggtctctgtgagagaggattcctgcagtcacttgatatgccaatgtagggagggggaaggggctccagttatttggaaaagggaaggggaaaagttggaagggttgtgtgagggccgctgggagaatgaagggctgcaattatgatgtaaagtgaatagattaattaattaatgaaaagaaaaaggaattcatatatctccttgaattaatagtgaagcctcttttatgctttggaaaagtctcccaattcttgatgtttaaaaccttgtttcctctggtttgtcacagtccttcctcatgtcccttcccctttttctttttgctttctcctccagatcctccctcatttggccctcccattcctttcacataggaagctgacatgtaaactcctcctcctgcctctgttaaattccttgctgtagttttcactaaatgcattatcttcattatttttctcatgacactttaaacttgtttgtatgagtttattgcctgcatgaatgtatgggcatcttgtataggcctggtaccacagaggtcaaaagagcatgttgtattttctggaactagaattatggtgattctaagctaccaggtgggtgatgaaaaacaagctaagatactctgcaagagcaccaagtgctcttacccactgagtcttctctctgctctccataaatctgttttgttttcccagtttgtttttgatatct

SEQ ID NO: 2375 - DNA, 1200 bp, mus musculus
ttgatagccaataggcttgaaaagttaaacaacactggacaacgttgccccttggccagtgctacattcaacagttaggttaatggttattcaaggttcttcaaagcagtcttttccctggctcatgatgtggctattcatcattcaagttttaaattaaatgtcactttttcaaaaatcattttttcttcctaaaactaattttaagttagtagtatacagagtcatgtgtttcatcaaggtatattttttataaacatgtgactatactttgttctaattcatacacattctccactggccagggtacatttcttgaacacccatttttttattaatcattccatttgtctacatctcaaatgatattccacttcccagttatccctccaccaccaccacatttcacatctgccattcctctcccttttgcctgtatgagggtgctcccctacctacccacactctcctgccccaatgctctagcatcctcccaatgatggggcatcaaacctccctgggaccaaggaactcctatcccattcctgtcaggtaaggccatcctctgcacatgtatctggagacatggatccctccaggtacactccttgtttggtggtttagactctggaagcacttggtggttgggccagtggacattgttcttccaacaggattgcaatccctctccacttcttcagttcttctgccagctcccgcatcaggttcctttaactcagtctgatggttggccccaagcatccacatatgctttggtcatatgctagccagatctcccaaggaactaccacactaggttcctgtcagcagtcgcttgaccagggcaacagtgtgggttttggtgtctgcagacatgatggatcccgaatggacagtccatgtttggtccctctttcagtctctgttccatatttttgtccctgttcttcctttgaacagcaacgttggttaaaaaactttgagatggttgggtggtcccatccctcgaccgggaggtgtgcctatctactagaggtggtctcaacaagttctatctgcacatttcaactaaagtcatccccattgggtcctaggatcctcacatttctgtactgtctggaaccctacaataaatatccccagttcctcatccccactgctacctatttttgttcaatttcctgaccctctgtacctctc

SEQ ID NO: 2376 - DNA, 1400 bp, mus musculus
gttcttgtcatatatatctttcacttggttgtttagagtcacctcaaggtatgtaaaattatttgtggctattgtgaagggtgtcatttccctaatttctttctcagcctatttttcctttgatagaggaaggctactgatgtgtttgagttaattttatatctagtcactttgctgaagctgtttattagcttaggagttctcgggtggaatatttggggtgacttaagtatacagtcatatcatctgtaaataaagcctgaatgcttaaagaagaactatttatccctcccccgccccaagttgttataggaaatataaaataaatagcaatttcctgcactacatccagatactctcaggcccgttggtctttctgtccagttcctaactggtggagattctctgactcatatttcgaaaatctcttcacccagcaactactgccatgtctcatgccagccccatgcttcaaaaccatctcggcatttgtggtgcacatcaggaaaactcatgctttgctgctgtactttctcactggaagtgaatcaagctgccccatgaagaaaaacaccatacaaacttagctcagaaacaatgttaactcaatctatgggtgcaacaactagaatgctaatcttgtaagccatattaaatctaaattgtctactggcaaatcctcacagattcattatctaatctggaagaagctagtagctatatcttgtcttgtctctatacccatcgcccaaagcccctaattctctcctgctttctcttttcctctgtccaaccctgaagtcctgactacccatccagtgattggctcctttatttattataggatggtttagaagaagtcatcatagtatgtgactcattcctcactccagacaaccccctgggaaaatggaattaacatcaaaatacaaacaacaccagggccattcacaacacaaagggatatttattagcccctaagatttttttagactatggtcaaaatatcatgggctagttgtcatttggccatttatatatatattccataacatctttgtcattgcccaaaccaaatcaagtacaatattcaaatgcattcttagaaaactctgtttatattaatctaaatgctaagagtattatcatatatcatttaagacatgtagtagagatttagtgtattgttttttagtgtattctaaaggtccctggttcaatcccgggttttagcaccacttatcccgagctagtatctcaccagcaagaattcacttggacaaccggattcttctacggcaaagctttattgcttcatctgaaggaagacccccgaacaaggaaaatggtgctgcttatatacccgtccgtgtgatgtgtcagctcctgattagctgctc

SEQ ID NO: 2377 - DNA, 1600 bp, mus musculus
tccactgtttctatgagggtgtttcatttttattatattaatcctgccaatccattagcatgggagatctttccatcttctgagatctttgatttctttcttcagcgacttgatgatcttgtcatatagatctttaacttccttggttagtttcataggttttctatctcccggttgtttacctttgtgattcctttattgtttctatttccagttttagatcctggatggttttgttcaattccttcacttgtttggtagtattttcttgcaattatttaagggatttgtgtgtgtgtgtgtttcctctttaaaggcttctagctgtttacctgtgttctcctgtatttctttaagggagttatttatgtcctacttaaaatcctcaatcatcatcatgagatatgattgtaaatcagtcttgcttttgtggtgggtttggatatccagggctcactgtggtaggagtgcttggttctgttgttgccaagtagccttggtttctattgtgtatgttctttcccttgcttgacatctgcttttcttgacatctggttatctctctggtcttgctgtctctgactatggcttgtctttcctgcaagactgtgtgtcagtacttctggggaaccaattctctccaggaggatttggttatggattgctgtgtcacagggtcagctccagggctcatatggaaactggaagtatcctgtcactgtctgttccttggtttctgtatcctgatgaattgagtaaggtcccacttgtgccaagaatttgagtagaagtggtggtcttacctgtgctcacaggtgtgtcagccttctgggggactaacactctcctgatggtatttgggtagagagtgctgttgcacaagatcagcaatgggtactgtggcatagaatcatttctggttacagacagaaactgtaaggatcctgtcccaggcttcttctcatttccagttccctaagggctctgggtagatccctcagagcagaaatggtggtcttacctgtgctcacaggtatttctgcattccgggaaaccagctctctctggatggtatttggatgtgaagtgttgtggcacaggatctgacggtaaggctttggatgaagacacaacacacatttctttctagacatgcataagtcagtcttgaacagactggctgacttctggctaaatttaatataacttaaaggtgatatagaaaatacagtaatataattgaatactagacattgaatgttataacatggacttgctaagccaaagtgcccactgctgcagtaatggtaaaactacttatgatggtaccaaaaacctctcttagatattcattcaggtgggcataggataagcttcatgctggatattgtagacatgtttcacccttggctacaaaactcatagacagtaggttaaaaaaaaaaaaaaaacctactggtttgcagcaactccccttgaagttgaaaccttccaccttggaggtatgcttattcaaatgcataatgttaaaagacacttcaaacatcagtatcatttaagctgaagttattcaaaacaggagatatttgtggggaggcct

SEQ ID NO: 2378 - DNA, 1000 bp, mus musculus
ccctgtcattcccctacattggggcattgaaccttcccaggaccaatggcttctcctcccattgatgccagaaaaggtcatcctctgttacatatgcagctggataccctttgttggtgttttagtccctgggagctctggggtgtgtctgattggttgatattgttgttctgcctatggggtggcaaacccctttagctccttcactcctctgcctaactcctccattggaggagcctcatggttggctataatcatcatcatctgtatttgttgggctctggcagagcctctcagagggcagctataccaggttcccgtcagcaagcacttcttggcatcaaggatagtgtctgggtttgatgtctgcaggtgagatagatccttagatggggcactctctggatggcctttccttgagtctctgttctgttctttgtctctgcattttctttagattggaacaattcaggcttcatatatttgagatgggtgggtggccctcatctgtcaactgggggctgtgcctgacttctggctatggtctctatatgttctctctcccctcttttgggtattccagctaatatcatccttgttgtgtcctgggatcctcttgtttccctgtcatctgggactctctaatggctaaacccccagttccttatcccttcactgctacaaacctctattcaatttcctgaccttatggggggcacatagctccagctgcatatgtaacagagaattgccttatctggcatcaaggggagggggcactcttggtcctgtggaagcttgatgccccagtgtaggaaaacgctagtgcagtgaggcaaactgggcaggtgggtagaagagctccctcatagaagcagggggaaggagggaggagataggagttttgaagaggggaaaccaggaagggggataaaatttaaaatgaaaataaataaaataaccaataaaaaatggacactgaggaaatgaaaaaagagaa

SEQ ID NO: 2379 - DNA, 1000 bp, mus musculus
gtatgttgggttttatacattagaaaatattgaaaattgccccggagctccattgtctgaccatttcaaggccagtgtccattacgcctgcccaacagtaaccaaccagattagatccctcacttccatgcctctgcctttccccaagggcatgcctaggtaccctcagttacttgcatcctatcacttgatgtccattgtctggtcactgctctgccatcttccatcaggcaagccaaacaaggaacatttatgccaccccaacaaagtcaggccccttcccccatatttcctggacaatcacctgggaaatacccagatgccctaagctacctgtgggttgtcttcacaagcttcattgtctagtcaccactctgcctgtctccatcaagacaactgaacaacaaacatctaggcctacaagtaagacctgatacaccaagaacatccactcgcaagctgcccaacaggaatgtgctgcgtggtgaacattcagaataggactaacttaccaatacatgctacaacaagaacatccagccagggacaatcagatggtgagaggccataataagaacacaaacatgaagatctagggtaacttggcacattcagggcaaagctgtcccatttcagcaaacccgggatattctaagacaactgaagcaaaagaaattcaaacttataatcatgactacaagaattaatgattactggtcattaatatttttcaaaccagtagactcatttccccaataaaaagacacaaactaacagaatggattcttcattctgttgaatacaagatacatatctcagcaacaagggtagaaattactttagagtaaagggctataaaattttttccaaagcaaacagatgaaagccaaaagctggggtggccattctaatatcaaatgaaacagactttcaatcaaaagtaataaaaacagatgggtaaggacacttcatactcatcaaagaactagatccacccaga

SEQ ID NO: 2380 - DNA, 1200 bp, mus musculus
tatatatatatatatatatatatatatatatataatttgtgtctgtatatgttatatgtgtccatgtgggactttgaaaggcagactgttctctggttgaactaagttcaaaccttggatacccagcagattaatctgcaagggacagaaggcttgtttttggctcctgacaggaagccccagctccataattctgtggtcttcagtcatgtaggctgtctggactccacccccacagttacctgtaaggtagcccaacccactataaaaaaagctgcttgctctctcctcattctcttatcctcttacctcttattctcttgctcttactcttgctcccttgctctccctctctctcccttctctttctcctctctccatgtttccatgaccatcctctgcttctctactctctccctctctctgcctttctacaataaacaccttaaaaccaaggaccatctctgctcatctaaacccaccctgatggagtaatggagtatgtctttcactaacaagctgagcatttaacttccttacaggaggtctgcctgtgcaccagtcatggccaccagccaaaccaacctggccactgagcaagctaactgagcatgtcagactctctcctctctgcagcaacctgccagagctgtctccccctaccattttcccttcagcctccagtccagagtctgcccaagggtacattctcctcaacgtgcactggcatctgggatgtctgagagtgagaatctgttgttcttggcttccatgctgcccacggacctcagaacgggctcttccatggtgctcagcagtctgaggtgcccaagagttggagcctgacttaggcagttctatggggatcccagattttgccatttcctcacccctggagcaggatcctgtggcttctcacagttcagtggccacccagtagttccatgggctctttgacacagtcaatagatgagattgcttcaatgaaagcatatgccttactgtcagttgcttaatagaaaaacccatgtctcaagaaaccaagaaaattttttgattcttaagaaaatgaatctttgtaataccatgcaaactagattgtaatacttctaggcaatcattgtaacagttacagcattctatgtttttgaatttcaacatctttaagcctccctgatatgttttatacagcttatttgg

SEQ ID NO: 2381 - DNA, 1400 bp, mus musculus
cctactttcccatcatcttcccactaattgacctctacaaagtaatattgtgcttaatagattaaatatatatatatatatataatttgctttgttcactcctctgttggagacctagattggtttcattttagatatgaacagtgctgcaaaacaacatttgtacaaatatttccatgatatatcaaattggagtcctctggataaatgcccagaaataatatggataagataaaattagatttagttatttgagagttatttatactgatttctattatacagctttcttatttgaactatgtaattcaaattttaaaagtttgaaagaagggctcaacaagagattgggtaaacaggaggtgaatctatccaggcttaaaagcaaggtagattatttggatcactcattcactggaaatgtcaaaccttcccccaaaattctcaagagtgaaaaccatatgaaaattcttgaatactattgttgtgccctatttttaagccccaaaagaccaccaggatccaactctgatgcaaccacactagaatctctttattagaaactgaaatttagtgttacttacggctgaccctgatacagcaggacggtttgatgcagcagccccaaaccccccagggcacaaggatttataggaaatggcaagcaaccaaaggggtgtccagcctggcaaacatctaattgaatgactattgtatgttgacaagtgggtgctctgaagcaaaaccataaacaatcacaaatggtttgaaagtatatttgaaacaatcatactcattttgattcgctgttgctaggacatagctagggaataaatctggggtatgctcagtggaaaatccctagggtccttcctggtacttaggtgtagcttggtttcagctacaggtcaaattctcaggctcttttatttctaagatatagtccagtccctagatggagtagatttggccttagactgccatatccagggatccaccccataatcagcttccaaacgctgacaccattgcatacactagcaagattttatcgaaaggacccagatgtagctgtctcttgtgagactatgccggggcctagcaaacacagaagtggatgctcacagtcagctattggatggatcacagggctcccaatggaggagctagagaaagtacccaaggagctaaagggatctgcaaccctataggtggaacaacattatgaactaaccagtaccccggagctcttgactctagctgcatatgtatcaaaagatggcctagtcggccatcactggaaagagaggcccattggacaagcaaactttatatgcctcagtacaggggaacgccagggccaaaaagggggagtgggtgggtaggggagtgggggtggg

SEQ ID NO: 2382 - DNA, 1600 bp, mus musculus
ttatatcacatgttcctgttgtacaaccacttaaaaagtctcaattttaggcttcatatatatataatttctctgtatatgttatatgtgtccatgtgggactttgacaggcagcctgttctctgcttgagctaagtttaaaccttggataaccagcagattaatctgcaagggacagaaggcttgcttttggctcctgacaggaagccccagcttcattattctgtggtcttcagtcatgtaggctgtctggactccacccccacagttacctgtaaggtagcccaacccactataaaaaaagctgcttgctctctcctcattctcttatcctcttacctcttattctcttgctcttactcttgctcccttgctctccctctttctgccttccctttatcctctctccatgtttccatgaccattctctgcttctctaatctctccctctctctgcctttctacaataaacaccttaaaaccaaggaccatctctgctcatctaaacccaccctgatggagcaatggcatatatctttcactaacaagctgagcttttaacctctctacaggaggtctgcctgtgcaccagtcatggccaccagccaaaccaacctggccactgagtaagctgcctgagttattcagactctctcatctctgcagtaacctgccagagctgtctccccttaccatttttctttcagcctccaggccagagtctgcccaaggatacattctcctcaacgtgcactggcatctgggatgtctgagagtgagaatctgttgttcttggcttccatgctgcccacggacctcagaacaggctcttccatggtgctcagcagtctgaggtgcccaagagttggagcctgacttaggcagttctatggggatcccagattttgccatttcctcacccctggagcaggatcctgtggcttctcacagttcagtggccacccagtagttccatgggctctttgacacagtcaatagatgagattgcttcaatgaaagcatatgccttactgtcagttgcttaatagaaaaacccatgtctcaagaaaccaagaaaattttttgatccttaagaaaatgaatctttgtaataccatgcaaactagattgtaatacttctaggcaatcattgtgacagttacagcattctatgtttttgaatttcaacatctttaagcctccctgatatgttttatacagcttatttggcctcaggtatattttgaaatatatgtatatgcaaatatgcatgtaacaactattcataagaaggaggcaataaatttgaaagagagaaatgaagtgtatatggaaggtttagagagagcaaagacaaggtagaaatgatataattatattataatcacaaaaataaaagaaaaaataagtcacttcctacaatatagacatatataattgaaaataaaggtagatcctgaaatgtcatgtaaaatagtgaaaaacatgcatcttcatagcataaaatcagaaactcaagtacatgactgttgaatgaatcaaaccaaatttcttcttacagatattaactgaaaaaaattgaaattttacctgatacttc

SEQ ID NO: 2383 - DNA, 1000 bp, mus musculus
atatatatatatatatatatatatataatttgtgtctttatgtgttacatgtgtccatgtgagactttgaaagacagccttttctctagttgtgctaagtttaaaccctggagccccagcagattaatctgcaagggacagaaggcttgtttgtggctcctgacaggaagccacagctccataatcctgtactcttcagtcatgtaggctgtctggactccacccccatagttacctggcaacagcaaggtagtccagcccactataaaaaaagctgcttgctctctcctcattctcttatcctcttacctcttattctcttgctcttactcttgctcccttgctctccctctctatgccttcccttcatcctctctccatgtggccatgacaagcctctgcttctctacactctccctctctctgcctttatacaataaacacttaaaaccaaggaccatctctgctcatctaaacccaccctgctggagcgcaatggagtatgtctttcactaacaagctgagcatttaacctccctacaagaggtctgcctgtgcaccagccatggccaccagccaaaccaacctgaccaccaagcaagctgcctgagctagtcagactctctcctctctgcagtaacctgccagagctctctccccctaccattttcccttcagcctccaggccagagtttgcccaagggtacgttctcctcaatgtacactggcatctggggtgtctgagagtaagaatctgttgttcttggcctccatgctgcccacagacctcagaacgggctcttccatggtgctcaacagtctgtggtgcccaagagttggagcccaacttaggcagttccatggggacccaagattgtgccatttcctcacccctggagcgggatcttgtggcttctcacagtccactgcccacccagtagttccatggggtcctcgacacacacaatagatgtgattgcttcaatgaaagcatatgcca

SEQ ID NO: 2384 - DNA, 1000 bp, mus musculus
ttgctaacatagacaggtagtcataacgcttaattaactataacattattttttttctaaaaatcatcccagcaccatggaactttgtaatgtaacaagtaccttggaattccttttacttggtctctcagaggaccctgaactgcagcctgtcttatttgcactattcctgctcatatacctgctcactgtgcttggaaatgtgctcatcatcttggccatcagctctgattcccacctccacagcccaatgtacttcttcctctacaacctttcattgtctgacatgggcttcagcagcaccaccatccccaaaatgctgataaacacgcagacccataacaaatccataacttatgctgcctgtctaactcaggtgcctttcttctttctttttgggtgtatggacagcctcttactgactgtgaaggcctgtgactgatgggtagccatctgctattctctatactaccaaataattttgaacccttgcctatgtaaatgtttggtcatagtgtcattttttattagccctatggattcacaggtacacttcttcatggtgtcacaactaaaattttgcactaatttagaaatccctcacttcttctctgatggtacagagattctaaaacttgcatgtactgacattactatcatcaacatagccatatttcttgtcaacatcattgctgggtttctccctgccttaggaatcttttactcctactataaaattatttcctccattgttagggttctatcgtcattacagaaatataaagatttctctacatgtggattccacctgtcagttgtttgcttattttatcaaacaggtataggtgtgtaccttagtacatatatttctagttcttccaaggaatgtgtggtggctttggtaatttatacgatggtggttcccatgatgaatcccttcatctacatcctgaggaacagggacatcaagaataacctccagaaaatttttactcaaata

SEQ ID NO: 2385 - DNA, 1200 bp, mus musculus
gtgctcacttataaaccggtattagccataaagtgcagaacacccatgctacactcaacagatccaaagaagctaaacacgaaagaaggcccaaacaaggatgcttgaggaataaaacagtcatagggggcagatggtgggagggaactggatgggagaagggatggggagggaaatggaggagttttcaggatcaagtgtggagagagacaggggagactgccagagggccatgagaatgaatagaaaacttcagctggtgggaactggggatggctcacatcttgaggacttgccagagacctgagataggagaggtttccaaggatccttgtaggtgaccttagctgagactcacagcagtggggatatggaacctgaagaggctacctcctgtaggcaggcaggaatcatagtggagcaataaggacaccaacctacccacagaactttcaatccaaaatgtatcctgactacaaaaaatgcaggggtgggaaataaagcagagactgagggaatgttcaaccaataagctgcccaactagagacacatcccatagacaaacagtaatccctgacactattaatgatactatattatacttgcagacaggagcctagcatggctgtcctctgagaggctccactcagcagctgactcacacagatgcagagacccacagccaaacattgaatggaccctggggattcttatggaagagtagaaagggttgagggcccccaagggaataggaactccacaggaagactaacagagtcaactaacctggacccttaggggctctcagagactgaaccaccaaccaaaaagcatacagaggctggaactagcctcccttccacaaaaaaaataaaaaaggcccacatttatgtagcagatgtgcaactaggtcttcacgtgcatcccaaacaactagagtggagctgtccctatggctgttgcctctctgtgcaatccattcccttaactcggctgtcttgtatggcctcagtgggagaggaagcgcctagccctgcagagacttgctgtgctagggtaggggaatacccaggggcacctccactctctcacagaagaagggaaagagggatttggaaagaacttgggggggggggtagcatgagaagagggaacattgatcagaatgtaaagtgaataaataaagaattgaataaaaa

SEQ ID NO: 2386 - DNA, 1200 bp, mus musculus
ctttgagacagtctctctatgcagaccagaatggccttaaactcataaagatcacttgcctctactttacattgctgaaagtataggtgtgagccagcacacccactttctgtgtccctaaggatggaacccagccctttgtgtgcatattcaacactccacccatagagtcaaatctccagcctgcaagaggattttttaagttttatcacacttgttaataattgtgtgtgcccaagagcactcacatggagatcagagggcaactttcagaagtcagttctcctcctccatcatgtgaggcctgggcatggaattcggggccttaggcttcgtggctcctgcacttactgctgagccctctcatcggccttgaagaagattttgatccacgtttctaaaacagctccacgtctgaagctcctgggccaggcaggctgagtgccaaaaggtcgctcatgcctggaactggagcctgggtaaagtgcttactgcgtcctgtggcaacagctattgtagaaccacaatagcagccatccagacctggggcgaggggaagtgccacctgtcactagcagacaatcctcctgccagcagaggggataaaccatctgtggctctccttcaggccactctgacccccttgactggggcttatctcaaggcaactgtctccagcaccccgggaggtctggctgaggttgaggggcatctcctaggccccttctgttggatttacaggtactccccttccaagctgtttagacattaactctgtcaagataagccaacaccaacagacctgggctctatctcaggcacaccgtggaccagccctggatcctgggcttcttcctggtcctcactggcagccccttgggccatgctgagcctccctcatgagtcacccaggcagtgctccccaatttgactatctaatcactgagttcctcttgtgtctcttctggcctctaacaggtacttccaggtgacaccctcagccaccacacacacacaccgagccgtgaaggttggcagttctaagaacatcagtatctatgcccactcagattccaggagatacctcttgaggtgaccaccatggtgtgggactctctggtcaagaagacagtgctgtccaggagcctgatcattgtcagtggaaaatggcttcatggttcagatgcctgctccaatgga

SEQ ID NO: 2387 - DNA, 1200 bp, mus musculus
aggttctgtccccgtggggccatgtccgtgtccacattggagtggtttcatagtgtttgtctgcttcctgcataccttgcacttagcatgtgccagcacctctgaaagctctggggtgactagtgtgcatcaccacaccgggcttaaccctagacttccagatggcttccactgccatctgcggtggcagcccttgactgggagaaccctgaagaagctgtagttggtgttggtggaagggtggagtgctgaagggaagatgtggctgcggccttgcaggcatgaggctctgagttccatcctcatcagtcaaagagatgggtgtggttccaaactgagaactatttaaacagactcttgtcaacattagtgggagcctgccatctgagagccctcatctctcttctgtttggtctgttgtctttcccagcttcatgtactggacagattggggaacacccgccaagatcaagaaagggggtttgaatggtgtggacatccactcactggtgaccgaaaacatccagtggccaaatggcatcacactaggtatatctgaggggtggtctagcctgatgggggtgggcacactgaagaggacaaagtacatagttgagaataggtgataggtattaattaccctcttcccatgcagctggaagggtcactggattaaggcagaagccacaatgtagccctcagcttcctatgtagctagagagatcccccaaagctataccctttaccctaatctagtgacctgaattttttcctggcatgttttgaaactttctggaacattttagaatcttctaaagcatactagaatatttaggcaattgaataatcttatctcacctctggcctctccatattttcgtatgtgtttgtgcgttttagatctttccagtggccgtctctattgggttgattccaaactccactctatctccagcatcgatgtcaatgggggcaatcggaaaaccattttggaggatgagaaccggctggcccaccccttctccttggccatctatgaggtgaaccctgggaatgtgaggggtttgtcttatccattcaagccaagactgaggaaaagctcttgtctagagatttagaaagaagtattggaattacagctacttcatggagttgattgattgattgattgatgctaggagtggaacccagagttgattg

SEQ ID NO: 2388 - DNA, 1000 bp, mus musculus
attgtagcccaccctctatgcccagcccccctcacacagttccttcctctatctcccctccccttttcctcttagaagggagaggcctccctgggtaccaacccagcctggctcatcaagttactgcaggacggggtacacacgtcctctcccattgaggctagacagggcagcccagttaggagaataggctcctaggcaggcaacagtgccagctctcctattccagatatgggagacctgcacgaagaccaagcagtacatctgctacatatgtgtgtgtggggagggggagttgaggatgggggtagaggaggatggaggttgatggctagatccagccaccaaagtatgctctttggttggtggttcagtctctgggagcccctaaatcgttcagttttgttgactctgttggtcttcttttggagttcctatctcctccaggtcccccagtcctttccctaaaacttcaaaagactccccgagctccatctaacttttccctgtgggtctcttcatatgtttcctttcagctgcttggtggagcctctcagaggacagttaagttaggttcctgtctgaaggtataacaaagtattaatagtgtcaggaattggttcttacccatgagatgggtctcaagttgggccgattattggttggccctcagtttctgctccatctttgtctttgcacttcttataggcacaacagattttgggttgaaggttttgtgggcgggttggtgttcttatccctccactgggggtcctgcctggctacaagaggtggccacttcaggtttcaggataccccattgctaggagtatcagctagagttagcctcacagactccctggagcctccccaaacccaggtctctgacactgtctagagatttcattcgtcccacccacactatccactcccattctccatcatttcccactcacttccccagccctttctaccctgttctctctgcacctgattccct

SEQ ID NO: 2389 - DNA, 1800 bp, mus musculus
caaggtatgtgtgtcacttcttgtactcttggagttcttgcgccatgctgcatgttgatgtagtttaggcatcataactgaataggactgttggttgcctccctcctcagggaaggggaactcaggtcagttccagctcagggatctctgggttctgcatctcaagtacatggactgtgccaccaaaggaatggacatgggactggaaaagtgggacataaacaccagaaatcttggaatttgagatcagcaccaatagagctaacttcttccctagtttccatgcctgtttagaggcaggtaagcatgacctctaactaggcaatcacgggcagtcagacacatagcacagcatgtgaaactcttccccatgcaaatagaacatcatcagcatctcagcttcagccaatagaaagcatttaccaccaaaatcccaccccactccccaaggttcatatagtccctgttcacatggagtaaagcacacaagatatttcaccaaggaatgtataagactggttgtccctgcaagcctacacctgtggactttgaactggccacatggtcagggtcccactgctgtggagactcatcagatctgagcactggctcctgacatcactgctgtgctgctgcagccgctatgggaccctggccacttgcccctcagtggctacccaaacttcattacttttgtaactgttgtatcatttttggcattcctagctggaccagagccctattcatagcagactctgcttcaccttcctcagtctgatgttcagcgacatctgattatccagagtgaagaggcaggctacatactccacatgttctggactttgccctaggagaattatggaaaatgataaaaaccacactgtagaacagagtagatgagtgagttacactgaaaaacacaattcgttggaaacgggaattgtgtatatcaatgagttactaggagaaacatggaaaatgataaaaaccacactgtagaacagagttccaaacctttccaaaccttcagaggcaccctgtcacctcaccaggtcaggagaaacaaggaattacaactttccacctctggggggagccaagggcaacatcaatagcctccatgttttcaaatctcttaggcagccctggctaacaactcagaggacttctcatgtttgggtactggggattttgttagactcttggaaggagcccagtcagaaagagaaaaaagctcattaaagctatatatgtgtatttatatacaggactatgcatattaccgatgttttgatagctaatagtatgattccctgtggatattcaggcatccttattgttactttatcttgcttctttttgttttacttcctacccacttcctagagtcctctcttcaccatctcccttatcagatcacttgtcaccagtcactaccctcttttttgcttcccaaacacctattctagcaatagtcttgttttactttcctgagttttatagttaatacaggctgtgtcatcacatctgaagatatggagatgggagcctcaaatgaaacaggacacatggagtttgtgtttctgagtcgaggtgacctcatgcaacacgatctgttccagatcgtttgcctctatgattttatttttctttacagctgaatatattccatagttcatatgtaccacacttttgttatccattcctctgttgaaggacatttaggttgttttcatttcctagctcttgtgaatagagtataaatgaacacagccgagcaagtatctgtgaagtagggtg

SEQ ID NO: 2390 - DNA, 1000 bp, mus musculus
tggcagttccctatactggggcatagaaccttcaaaagaccaagggtctctcctcccactgatgactgactaggccatcctctgctacatatgcagctagagcaatgagttccaccatgtgttttctttagttggtggtttagtcccagggagctctggagatactggttagttcatattgttgttcctcctatggggctgcaaatcccttcatctccttgggtactttctctagctcattctttgggtaccttgtgctctgtctaatgtatggctatgagcatccacttctgtatttgtcagacactggcagaattctcaggagacagctatatcaggttcctgtcagcaagctcttgttggcatctgcaatagtgtctggttttggtggttgtttatgagatggatccccaggtgggacagtctctggatagtccttccttcaatctctgcttcacactttgtctctgtaactcattccatgggtattttgttcccccttctaagaaggaccgaagtataatataagagtcacggtgtctcttcacagcatgaaaacacggattttaaaacaatgtaccaaaatcaactccaacctttcagctacctggtaaggagagaggtagaaaagccaacctcaagggaaagcccactacctatcagctgaacaggcccactcccaaaggcacatttccacagcctatatttccactgcagtgcctgttaggactcttccctcagttcagggagattcccaatacctaggcacaggccacaccagtcagaaaaacagagaaactctgctgcagcaaaggcaagctactctcaagaaataagaacaagatcaacaacagacaggcagtgtggcatcaccagagtccagctattctatgacagcaagacctgaatatttcagtgtatctgaaacacaacaaaatgaccttaaaatcaactttatgaagatgatagagaactattaaagaagaaataggaaaaaact

SEQ ID NO: 2391 - DNA, 1000 bp, mus musculus
ccagaaccataaggatcaggcacatcacccagaagaaaggctgtgtgctaacccatattccccctaaccttcatgaattcattcctagcatgcccttccagatgggagccatggactgtgaaaggcttgttgaaggttggatcatctgaccatgagagcaagtggggagacagtgaagagccacagacccagaccctgcgagatgagggaccacagtcagcctcagctggtgaagggtagccccaagtgaagtaggaggaggaacagaatgttcttcatacatgaacagagaacccaggcaggacacagcatttacacaggcacctgcaacacatgatacctattctctgcaaccctgtgtgtggaaggcatcactggactatgtagttcagaacagaagcaagatgctgaccaagccctctgcccttccagggtcctggtcagattaggattgtaggaggcctatgctctgaggtgactgtggcatttcctgtgtaaatgaagcccaaagatgtataaaccattcacatacacgagcagatccagcgcagcttctccccagcaccaagttcttcccctacagcaatggaatgtcttgagagcatacatgaccaccttattgagcactaaccaagagacttaaggaacaaatagggtggggctgcatacatctgcacacatctggaaggcctagtgaaacaagagggtgaagcagtctacagaagggaaaatctgaactgtgtagcattttaacgtaatcttaaatattgcacagtctttcagaggcaataatgttctaccacatgcaccacagaaccagaaattccagatcttgacctgggcatgcccttctaccctgagatgcccagctaccctgccaagggccccactggccagtaccactatgtaggaggtacaaagatggcagcaaatggatatttgagacagacaacccactttgtcctcaacactctggtacctctttgcacattccattcag

SEQ ID NO: 2392 - DNA, 1400 bp, mus musculus
tgtggtgttgagaaagaggatggggaaagtaatagaatatatatgacatccaagtggaaagggaattaattgggtgtggaaggtatgggtggcaggaggaggtgggagaggggagtgggcagaggggatcagtggtgctaatgtgtgagaacactacagtgaggccccctactttgttattgtgaatgtcaaataatgatatatattattactatagctatatagtttatattatatataatttagtttttattccaatgcattgggatttattatatgatagccacacatctagcttggagaatattcaagtgcattcacaaagaatatatattctgatcacaccaatcaagagacatcaatacagacccacaatgttgtcctgttggcaaggatgggatgtcttggattaatgtatcatattgggattctttgatctgatggctaaactggttatgacttggaggtggacatgtgggtggcaggtgtgatcctgtacatccacttgtgtggcttatcccctctccaaagtcatgaggggacaaagacgaacatcatccaagtgggccagtttgagttcctctctccttactgggaaaacatttctgatgctgccaaagatatggtgagaaatttgctggtggtggaccccaagaagcagtatatggcccaccaggtcctacagcatccctggattgagatggttgggcatcccagcaaagtgaacccacaggagaatttccccaacagcgaaggtcacttccagagccagcacaagaaggttgtggagcaggtgtcataatccttcctgggtcatctgtctagcctagtctccttgaggacagagaagagaggggatgtctacaagcaaggctgagcaagaaacttctccacagaaccaaggaaggagaagaacacctggcatattttaaagcacgttagaaaagcaacttcctaatgttgaatgatgtaggatatttttagatttgtatatctgaagtctttaatagtttttggataagaattgccatgaatgaagaattttgataataatgatgaattctatttttctccttgtagtcacattcatggtggactccatgagtgtgattcacatcacttgagatccccccacccccacaataaatgaggtgatttctggcttttttttaatctcaataaaacacgacgaataacagagaggaaaaaaaagaatatatattctcctgccactatcttggatgttcttgtcactctcagttaggaccagtctgttagtttaatttggctcattggctttggttctggtccaaggttgggggactgcatatggtgatggccttcttcctggcagagtcctgaggtggcacaaggatcgacatggcaagagaacagcaata

SEQ ID NO: 2393 - DNA, 1200 bp, mus musculus
agtaacatacaaaggcagacctatcagaattatacctgacttctcagcagggactctaaaagccagaaggacctaggcagactcttgcagtctctaggagaccacagatgctggccagcccaggatactatacacaccaaaactttcaatcagcatagatggaaaaaaaaacccaagatattccaagataaaacaaaatttcaacaatatctatgtagcatgaaatattaaaaagcaatccatggtatcccagcaaggcactgggctggctagcccggcactggcaggcatggatggcctgttctcatctcatagagactctctgacccagagctctgaaatctctccacccagcttgctaagttctcactggcaggttgctaccacaccagccccatgcatccaaattttcatggccttttggggtacacttcttgcaaacccaggttttgccaccatacctttctctctagaacccagttgagtcattgtgtgaaggaaaaccacaaaaacttagtttagaattaacaggtaactcaaatattgggctcagcaactagcattctaatttataagccagtctaagttcaactcctctggtggtgaatcctgggggttctgccatctaaactggggacctcttgttagccacatattgtcctctaagctctccatgtcccaaaacaagtatcacgctcctgcctcccctcttcctttcaccgacctgaaagtcctgcctgcctactccagtgattggtcccctaaaatctttattcataaggagaaggttctgccacatatatatctataaatccatccctacagaagatactagaaggaaaactccagcccacagaggttaactatacccaagaaaacacagaaaataaataataccacaccagccaaactgaaagaagggaaacacacacacacacacacacacacacacacacacacacacacacactgctattataaacatcaaaatgacaggacttaacagtcattggtcattaatatctttcaacatcaatgaactcacttccctcaaaaaggcacagtctaacaaaatggatgtgaaaagggaacccatccttctgttgcttacaaggcatacaagaaaaaatacctcagcagcaaagatagacattacttcagagtaaagggctggagaaaagttttccaagcaaatagacc

SEQ ID NO: 2394 - DNA, 1200 bp, mus musculus
atttctgagctttttaacaaatcaacatacaaacacatacacacacataacacacacacagagagagagagagaggggggggagagaaagaaagagagagaagaagaagaagaggaggaggaggggggagagggaggggaggaagaggggaggaagaggaagagaagaggagaggagaggagaggagaggagaggggaggagaggggaggaagagagaggggagggaggaggagagagggcgagagagggggaagagagagagacctactaccctaatagagctttgagtggggcagtaaaaacagcaagctgagaatcaccatggtcacaggaatgcacaggtacagcgtcacttcctgatgatgtcactatttttgcttggtggaagagagagaagagaatgtcacctgtggatgattcatcttcgcagcagctggtttggtccaggtgtctggccccagggagaagcttctgtgtttggaggttgtggaggtgcttgccaggcagagtcatagactgttccactgagcatgttcagtgggccaccatgggaggattgcctgagttgggacagccataaactccactatctctggtttgggaaatatctcacttggtatcctcatttcattctttgaccctagagatttatagtttccagctacaggaaaggtccgtattttcatagcaagtggtaaaatatctctttgtcctttcaaagacatgagttccaagctgagaagctgtgtgactatgggagagggatcttctgtctgcatagtgcagctgtcagccttccctacagaagcggtaaggtgatgaagtccttgtggggacttcaagactccttttgtatcttcctggagtctgcacacctgacttgctcacggcccaattgattttagagattgacaatccgcacatactctgttacagaacccacgtggctggagcactggggagagcattatctccagcttcgctgaacttcccacatgtagcctttgaaatttttcccgctcaacggtctacccccctccactgcagccttgaaagaagatgtctgaaagtagtctatttttagtatggagctggttgtgaagagatcatgagtgggagaactggtttcagggaaacttgcatgtcctcaagctgccctttggttgtgtgccccacccccgcagccgtacccccccccc

SEQ ID NO: 2395 - DNA, 1200 bp, mus musculus
gaagttcagtgcatcatggcagagaaggtctgtggacacagtgatgggttgactagacacattgcctctgccgtcaaggaaagaaagagaggaatactgagtacaccaggcttccctgccccttcccacttttattcagttcttggcacacagcccacattgaggcctagtcttccctctacagttaaatatatctgtaaacatactcacaaacacacctaaggaaagtgccttagatggttctacaatccagtcaagccaacagtaaaaattaaactcacctataaagtaaataagtaaattaatgaaaaaaaaaggacagacaaacagatagatgcttaccctatgtatatatgcttctcccacgcctctgctgacctgaactttcagaatgaagttcacacttgtactctgggcagccttcttgctctgatatcagatggtgctagttagcagctatctgaacttgatacctctagagccagaattgaatggatgttcaccttgttcctaatctccgaagttcagatgcctttcacaatatgatatatactctgtaatgacacagtcaaaaaacacatgcatagcaaagatggtttctttcttaaccaggacatttcttacattgttgtgaagagaaacatgaagctttgttctgctgctacagaactaagaccttaacatccttgcatgtacacacattcacattcaaaactctccctctcacacagtgttgacaaggtttgtgtctatttcccctgtgatctccacaactccgagcccccctctcctgcacatggaggtcagcttccatgtagaggtgaagtggtaaccacttgatccttttgcagcagttgtccttggttcaaggtgggaatatgaagagttgatatattccaaggtaaatgagactcaaacagaatttgacacaggatgaattccttgccagcgccaaaggtggttgatgtgtctgccaaaaggacatccccctgtcttccattgcagtccaggcttgcagagcatgctggcttgttttggattgaagcacagttctgacacgatccaggaaggtgctgccagtcttggcatctgctctggagatatgtacagaagcagaagccaggaaaagaagtggcagggcctgggtctgtcgtctgccttgtttgcactggaattaaataaactgagactcatttaaag

SEQ ID NO: 2396 - DNA, 1400 bp, mus musculus
ttgaccaagtctcaaagcttatgtattcatctctctggcagataacagggattctttgaaaaataaacaaaatggctgttcatctccaatatttgaagcatccagcacagggctggtacacagcagatgcttaataactgttggttataggaatgtctgattgcctgactcacggctcctctggctcacattgctgtccaaagggacttttttttatccatgcgactcttccaaattttggcccctccctgatgacaaaatgcctttatggacgaaagtcttttcttcctgcttccagttggacaccgtcacgccaagtgagggaattcattcccagcttcagaaaccaccagccaaggaaatctgaggttattgcttgctgagaaaaataacatcagggtagatgagatcagtctaatagctctgttgcacttgccaacgggactgtgaaattcaacgaaacacccgctccttcctgtacccacccagacagccagaccctcagggtccatcggtccttcctgttgactggtcaaacatctctctctctctctctctctcacacacacacacacacacacacacacacacactcatgaaattgggcttgcactgttatttaattgctctttcccatgtatctgtaaggacagctgaggcctaaacaccggtttctggtaccagcttgccacgaacatctccaaatcctgggagagatgaatggcatcaccaaactagcccaagagtgtccactcttcagccactggaaactatccctgtacaccaaaacttgccatcgagcactaagcccgtgacccactcaccattgtatcaaagcttcaggcctcttccaagtcagccccaagtttagaaaaatccattcttgaagtcagatcataaaacgtgccgacaaataaaaagtctccggaaacatagaatggcaattgcagtcttggtcacctctctacactgggtagtcatagaatggcaattgcagtcttggtcacctctctacactgggtagccatagagttcacaaaatcgcaaccaacaggaaaaggaaggtgactcttgctgataggtcaagcctgcagtgtatagctgaggaaaacaaaggtcaggcagctaactttacctgcactcgcattgtattagccttgagtttatctcctttgcagctttgttggaatgccgaatttgagggtgacttcgtagtctttctagactgttcgcagcagtcctgtgtttgtctgctcattcagggactgactggcttagacactttccccacagttgaagaataatcctgctcttgacaggggttgcttatagctgcttctggtcatcttctgatcacgtgatcatgtggtgaagagaatcagcaagtagccgggtatgtc

SEQ ID NO: 2397 - DNA, 1000 bp, mus musculus
tctcattacctgccaccgttacaaattctcacttccctgcatattcacttggaactgagtcgcctaggaaacccgggaaacaaacacagaggaggaggagggcaggagctgtgggaggagggagtgctcatggctttggtcacgtagggaggtagggaacatgggagagggtggactggggcgtcagcttcaatgccagccagatggagtcctcctccctgcgcaagtgaatcagttctgtgtgggtcacctgagagatgcctgggcaagtattaggaagccccaatagatttattaagaacgaactaacctctctctctctctctctctctctctctctctctctctctctctctctctctctctcaggttttctgagaaataagcctaacttttaaccatactttctgaagccgcttagatacacaaaagtatgactaagaatgatggctgctacatctcgctacacaagtccatgaaacttagttacctgcaacccgtggatcacgtgtattaattcccaactcacagacccgtctgcccaaatggaaccacagtgtgaatgtttgaagcaaagctcactctgcctcgtccatcccagcctgtctccagccgttcagcttccatgaagcgcatccttgttccctaagggcctgactcattcaggaacctccggacccttcttcctcatccagggtcagttattcccattccatttccattttagaacatccctgctctcctctctattccctacagccaaccctagattctttcatggctggcttcacttgcctataatccatcggttgcaatgctactgaagctgtgattccaaaatggatcttatggaccagtgactgcctcggtagcaagatcctggtcctcagtcaggcatgtaaggttcttcccacccccatccacacccaaagtagaagtacccatatgtgtagttccttcaacaagtgagacaagagtctgtgcctttcagggatgtctc

SEQ ID NO: 2398 - DNA, 1000 bp, mus musculus
gccataattaatttgagatttatttttattggagaactcgagtctcgtctgaccttagccaaacaaggcagcttgagccgcccctggatgcgcttgaatgctggggaatatttctgcaggaaggctctgcaggagcgcctgctttgaatttgtttctcagacttcatccactcacagattgaaggaagatttagagcctctgtacgccctgcccgctccccacgctagttcttgccttagcaccgaccctgttcaaaactctacgtgggaggccgcagcgcctgcagagccgcgcagggggccaggccaggagggtctcagagacccgagccccagacaattggaaggcgaacccccagaccactaggcgtcgtcgagaaaaccccaagggagtcggagactgaccagagagcacaggatgacaggaggtggagaccagcccggtgtcgcgaccctcatccagtggcggcgccataatggggactatggaggtcgcgggtgggttcagcttctggaatctcagccaacccgacctcccagtagccccatacaatattctctccaaatacggaccagtatccttgaagcgcagcttcaggacctacatgccagaaacttatgggcagtatcactgtgcaggttcaggacctagcagcctccctttgagtgagtcaagggagaaggaggatgtcacccccaaaagcagcatgggcaaaatcctcaggctgatagagtggaggacagaaagaagagaaccctatcaggtttgtgcaggtgtatgtgtgtgtatcagatttcaaggaaacgccccatttgatggaataggaatgtaagtactgtgctattattggaccgcattattgcactgggtctctggtcttctccatccacctcctaactcagattccgcgtgtgtgaaagtttaggctggaccactggattcctctggactcttaacctctctgaattagtgtccctctctgcgcaatggccacagact

SEQ ID NO: 2399 - DNA, 1200 bp, mus musculus
tttcaatatgcccttgaaatacttaaaatagctacataacaaagcctgtgactatttttacaagtttatcttactgtgtaaaattattgtcattggtcggcatgatttaagatgtgtgtttgtgtgtgtgtgttcatgtatatgtgaataaaaacattttaggatggcttctgaacttaacagtatagcactgatatgcaggggtagttgcctgctagtatattctctccccttcccctaacactgcatctttagaaaaatagagttttcaaggtcctcatgatattcaagcccaagaaagcatgtctctgcatatgttctgactgtgagcttgggggttttgtgggactcctaagattaggagcagatgcatcctctgactctcttgcctgctcttggaactcttttcctcccactgggttgccttttccagtttggatttgagcgcttccacattgtcatattgtatcttgttttgtcctgtttggctgtcttgccttgaagccttattcttttctgaattagaaacagctggggtggctctgggagtcggggtggaaggcaagggggagtgaaaggaggggagactgtggttgcaatgtattttatgagaaaagaatttgtttgcatatataattttttttttacaaaaaaatggggataaaccaaaccaaccaaccaaccaaccaaccaaaaaaagtacaagacagttattttaaagccaatctgtaagtacctgcttattctacttgaggctttaaaatatcaggtaaacatataacaataataatgtgcttcattacaccacaaacataatttagctttagcagtttctcttcacgatgtattggaagaataatatatcacaaggctgccaggttttaggaggactagattaacctgggtaaagacgctcagttgaattacttgcttaaaacaaatgtaaacaggtgactttcaagtacaagaaatcacaacatggtggagacagaagtaccagatattagtactgtgtgcagttctctcctgggacaacataagaaacccttcttagagaagccattgtcaaagttcacattagaaaaagacttagattttaacaagtagttaatttaaatttgttctgcctgtagttgctaactgttggattttttttataatatcctcccttgtttttagatgaactacattttctttgaa

SEQ ID NO: 2400 - DNA, 1000 bp, mus musculus
agtgcctggtgtgggcacaaccaggcatttacgacaagacttggcacatacagagcctctcgctggtctcagaagggggaacagtgagaactaatcaccaatcccagtgagaccagtgagaaagtagcacgaagaaggaactagaaggcaggaaggcatctgtcaaaaatccattacttgatgtgttaacaagattgttcgggccccctgccattccattggttatagagacctgccctttccataaggacctgggggttctctttatgaacatccctgtagagagtcaagctcctaccagaacaccccaggactcctgcccatctctgcacatttcagggggaggcttcttctcactgcatgtctgcctgtgtccgatggagaagagagtcttttcacaatcgccccctggagctttccctctgataagtacaagtaaaagctatgatgctcacatccaagcaagaggactgtggtgggggttggcaggtaaaacgtggctctatgtgggacaggattcaccctgaattctcaaataccctacaaattaatatgtaagtgcatttaaatatagtgggaatctggctacaggagctaggttcttgatgaacaacagggaaatggagctagctgcaagggtcagatagcatcatgcagacatgtaagatgtccccacccccaccccccaaaaaggcaagaggcccatgctgaatgtagcttgcaaatgtcttaggaaggcatacctaccaacggaagccgtctttgcccacagtccaggttgaaagcacaacagcccctttctcatagtggtgagaaccacaggtatacatccctttgcttcagatctgtggatctctaatgtctgaaagtccatgtgacatcctgaccccaattcagtgaagggacaaataactttgcaaacaccaagtggctcttctaaaacaaggcctaagagagagactgctgacctcagacctaggaagaggccagagcaactctc

SEQ ID NO: 2401 - DNA, 1000 bp, mus musculus; identical to SEQ ID NO: 2400

SEQ ID NO: 2402 - DNA, 1600 bp, mus musculus
tgtgtatatatgcatgtgtgcatatatatacatatatgtatgcatgtgtgtgtgtatatctgtgtgcatacacgtgttcatgtgcatgagatgatgagagaaagaggtaatctaagtacagggcctagcacattgcattttatttaatttcatcttaactaacttggccatggatccagcccactgagatcagcaaaccagacgtttgcagttaccctcatcaccagcctgtgtcctatactcagcatccaccagtgctgacctcacctcttcacatgcacctgtctccctttgatccttaccattcaaggcgggcgtttatatgaatttcattacaggttaagcaacgggaggagggatgaattttcccaagattagaaatgatctgaacccaaacctagttccaatgcatgcccttaactgctagaatatatagccttgtgtcctcatccatattagtgaagaatgggaaggagagcttcagagactatactgataaagaaatagacattaaaagtgcagatgtcagtcagactctcactgtgtaactaacaatactgttttcctaaatatatcttgtcacacactataattttgaggtgcacactgaaggacctggaattatgcgagaaaactgaaaatcacggaaaatgagaaatacacactttaggacgtgaaaaatggcgaggaaaactgaaaaaggtggaaaatttagaaatgtcctctgtaggacatggaatatggcaagaaaactgaaaatcatggaaaatgagaaacatccacttgatgacttgaaaaatgacgaaatcattaaaaaacgtgaaaaatgagaaatgcccactgaaggacctggaatatggggagaaaactgaaaatcacggaaaatgagaaatacacactttaggacgtgaaatatggcgaggaaaactgaaaaaggtggaatatttagaaatgtccactgtaggacgtggaatataagtccagaaacctaagagactctgtgtgtgtgtgtgtgtgtgtgtgtgtgtgtgtgtgtggtgtgtgtgtgtgtatctataaacctgttaatacagcaaggtcgaaagaagcatttaaaagatttttctctaagcaaatatattgttatggtttgcatattcttgacccagggagtggcacgattagaaggtgtgactttgttggagtaggtgtggccttgttggaggaggtgtgtcattgtgagtgtgggctttaagaccctcatcctagctgcccggaagccagtattctgctagcagccttcagatgagcatgtagaactctcagctcctcctgcaccatacctgcttggatgctgccatgctctcaccctgatgataatggactgaacctctgaacctgtaaggcatccccaattaaatgttgtccttataagaggtgccttggtcattgtgtctgttcacagcagtaaaaccctgactaagacatgtatcaaccaaggccattgcatgagcagtttcctatatctgtctgtccttaacagctccccagactttaagattcctcttcctagggtaccctgttggtgctcagtctcagtttatatcccactttctcctga

SEQ ID NO: 2403 - DNA, 1000 bp, mus musculus
taggatagcgaaaactattctcaacaataaaagaagctctgttgaaatcaccatgcctgacttcaagctgtatgacagagcaattgtggtaaaaactgcatggtactggtacagcaatcaacaggtaggtcaatggaatacagttgaagacccagaaatgaatccacacaccaatgatcacttgatctttaacaagtcagctaaaaccatccagtggaaaaagacagtattttcaacaaatagcgctggcacaactggaagttatcatgtagaagaatggaaattgatccattcttatctgcttgtacaaagctcaagtctaagtggatcaaagaactccacataaaaccagagacactaaaacttatagaggagaaagtggagaaaagcctcgaagatatgggcacaggagaaaaattcctaaatagaacagcaatgtcttgtgcggtgagatctagaattaacaaatggaacctcataaaattgcaaagcttctgtgaggcaaaagatactgtcaataagatgaaaaggccaccaacaaagtgggaaaggatgtttaccaatcctaaatccgataggggactaatatttaatgtatacaaacagctcaagaagctggactccagaaattgaaataaccccactaaaaatggggtacggagctaaaaaaaaaagaattctcgactgaggaataccaaatggctgagaagcacctgaaaaaatgttcaaagtccttaatcactggggaaatgcaaatgaaaacaaccccgagattccacctcacaccagtcagaatggctaagatcaaaaattcaggtgacagcagatgctggcgaggatgtggagaaagaggaacactcctccattgctggtgggattgcaagcttgtacaaacactctggaaatcaagtctggcagttcttcagaaaattggacatagtactacctgagaagactcagcagtacctctcctgggcatatacccagaagatgttccaac

SEQ ID NO: 2404 - DNA, 1200 bp, mus musculus
ctgtatccccaccagaagtcctcaattgtggagagttatacttcagcatacttatcacatttttctgatatttttcccattaatttatttgtttattcattttacacccctatcactgcttccccttcctggcccccccttcatacagtcctccccccatcctttcttttctgagagggtggggtgcccctgattatccccaaccttggcgcatcaagtctcttcagagttaggctcatcctctccactgggaccagacaaggcagcccagttggagaatggattccacagacaggcaatagctttagtgacaaccctaactctagttattggggggttctcacatagagactgaaatgtttatctgctacattgctcagggctgtggtccagcctgtgtgtgctctttggttggtagctccgtctcttgagagtcccccaagggagcagtgtaattgactctgttggtctttctgaggagttactgttcccttcaatccttccccttactctttcacaagagtctctgaactctgtctaatgtttcactgtggatctctgcatttgtttcagtcagttgtaggatagagactctcagaggacagttatgcttggcttctgtctgtaaacacaatggagtatcaatattgtcaaggattgatacttgcatatgggatgggtctcaggttgagtaagttattggttggccattccatcagtatctgcttcatctttgtccctgtatttcttgtagacaggataatttttgtgtctaaagttttgtgggtgcattggtgtccttatccctctactagagggataagttcctgcctggctataggaggtggcctcttcaggttccatagcctcactgctaggaatctcagctacacaattcagctaagatcctccacactggctcctgggagccttcctgctcccaggtctctagcatgtcctagaaatgccccctactccaacccctgctagcttcagatttctattcattctcttgtccctttagctgtcttacctgtctctatgcatacctgatcttgacccactccccattcccctccccattacctttcccaccaagctccctctcttcatctgcttcctaagactattttattcccctttctaagtgagatgcaggcatcctcacttgggccttccttcttgtctatcttctttggt

SEQ ID NO: 2405 - DNA, 1200 bp, mus musculus
ggttttgttcatttccatcacctgtttggatgtgttttcctgtttttcttttaggtctcctacctgtttggttgtgttttcctgttttactttaaggacttgtaactgtttagcagtgttctcctatatttctttaagtgagttattaaagtccttcttgatgtcctctaccatcatcatgagatatgcttttaaatccgggtctagcttttctggtgtgttggggttcccaggactgggtgaggtgggagtgctgtgttctgatgatggtgagtggtctttgttcctgttagtaagattcttccatttgcctttccccatctggtaatctctggagttagttgttatagttgtcccccgttagagcttgttcctctcgtgattctgttagcctctatcagcagacatgggggacttgctctctcctgagtttcagtggtcagagcactctctgcaggcaagctcttctcttgcagggaaggtgcacagatatctggcgtttggacctgcctcctggcagaagatgaaggtcagaaacagagcttgtcccagaagctgtgtcactttggcctgtcccagaagctgttagcttctgtagtccacactctcacctgagcagactagtctcgcagggatctgggaaccaagatgagttcccctggtgctcctgcaaactatcctgggtggggcagacacctctcctctggcagggaaggtgcccagatttctgaagcctgaaatggggtctgcctcagaagctgttctctagggaccttgggagtgtctgccgacactgtgcccaaggtgaccaagtgctggcacagactggaagggcttaacctctcatttttaaaggccctgtattttaaagtagttcctatggtgcatatagaatattcaataatggtttaagtatttttgttggatataattctctgtgggtgtggtaatgggaaggataatattggtataaaatgggaagggagtaaggatgttgtttattatgctatacagaacagcatcacaattacttgtccaatctaagtagtaataattccaagagaagaatttttttatataaacaaagaaaaatgaaaaaaaatcaccattttttctatatgtctatctgagttctaacacttagagtaaattatctcatttaattaatattagatgaactgtgaattccatttacatttt

SEQ ID NO: 2406 - DNA, 1600 bp, mus musculus
caatctcccaaaagatttcctggtactctgcctcatagtcttactgttccgactttcctgatattccctgagctttaggtgcaggaattgtgctgcagatttataaattggaacttagaatcaaagatcaattgttctctacaatttgaccacctctagtgttcttcatctattacaaagagaagctttgataggtggtatgaggtgtacatattggtttggtacaaggataactatttagaacgcaggtatgaagagttacacttcattagtaaagtggtgattgtatgttctgctttagaatccatagcttcactagctctgggtattggctaggtttccagtatcacacataattccctcgtattgagctggccttaagttcatttaaacagctgctggttagctcctaggtatgaggtgctacttttcattgtaaggggtgtcttgccatgttggtcattgttgtgattcataggtgatgttactgagttagacaatcggttgtgaggagcgggtgtggccgtggccccaagatggcgcctgggactgctgcaaagtcttatgactggcacctgacttgctcatatccctcaagatagccacataccttgagctgcattgtgcagatgcaccacgacgtaagatcggatgatgtgacaaatgtagtcctgagccaattatctgtacctacgtggactggggtgagggggagtggactggaggggataaagggcgatggcagagagaggtcagggattctttttcctacacatttttgaagttcctgaataaactgtcttgagaaggacgtcgggttcgtcgcttattttctactggttggagatggtagggtagcgacaatcggttgattttcttctttggcaactcaaataacactttgtaatagaatggaagctagtcctccctgggtaggcttttgggtcagatcctgatcaattctttcacatcttctctttgaagtatgtggtatcttcatcaagctgcattattttcaacttcttggaggcaaccaaggacaacagcagtatatgataactttttggagtccactggattcccttggccaataattcaaaatgggtcctcctatttctggtattggaattttggcttgctagtctatgtcctttgggggaatcgttatcagcacagaagtgatcatttcatttaaattgtagatgtgtatgtataataataggcttatatgtatgatatataagtgtaagactattttcaactggaagttccctatttcaagtaagctatatgtattctcattattcacagtttttaaaatttccaagtccatgttcctctctgatgttattataactaataattatgctttttaacaaacaataattatggaacagatcaagctcacttgtgtttacttccttttcatttaatcccctttcccactattgtcctcttttagggaaaatagttttttcccatataatatatacggattacagtttcaccttccttcaacttctccaaattccttctcccctgccattcagatccaatccctttctgtctctcattagaaaacaacagacctctaaaggtt

SEQ ID NO: 2407 - DNA, 1400 bp, mus musculus
tcttgtgatcagaattcacacctaactgggagacaagtttgaaggagataaattagatgttcatggacaggagatgaaaagaatgcattggcacttcattaatttctctttaaagctttggttttattcagaaaaggagtaatggacttccaaaatggaatttattttcatatgagaacaggtatgctcatattggtgagaccttaaattaaatacttcttttctatttccatagaaattatcaaagaatgggcactgggaatcattctgcagcagttgtgtttgtcttggtggaattaacacagcagcctgaactcctgctgcccctcttcattctgttcctgggcatctatgtggtaacagcagtgggaaacctgggcatgatcctgctgatcacagtcagtccactgctgcatactcccatgtactatttcctcagcagcttatcctgtgttgatctctgctattccactgtcattacacccaaaatgctggtgaactttcttgggaagaaaaatgtgattgtctactcagagtgcatggcccagctctttttctttgtgatctttgtggtggctgagggctacctgctgactgccatggcgtatgatcgctatgtggccatctgtagaccattgctgtataatgtgatcatgtcctccagactttgctcactgctagtgttggttgctttcatcttaggctttgtttctgccttagcacacacaagtgctatgatgaatctgagcttctgtaaatcccatatcataagccattatttctgtgatgttcttcccctgctcaatctctcctgttctaacacacatctcaatgagcttctcctatttattattggagggttcaacaccttggtgcctactctagctgttgctatctcctatgtcttcatcttctgcagcatccttcacatcaagtcatcaaagggcaggtccaaatcctttggaacctgcagctctcatcttatggctgtggggatattctttgggtctatcaccttcatgtatttcaagccttcttccagtaactctctggagcaagagaaggtgtcttctgtgttctacaccacagtgatccccatgctcaatccattaatatatagtttgaggaacaaggatgtgaagaaagcattggggagattctttgtagggagataagtcttacttttggcaaatgatacatggagaagaaatttttctaatgataatatattctatatattcattttatctttcaaaatatacaacattctgtctctagtgctgagattaatttctgacaatcctgtgttttcaacaagctctatatcccagtgctacatccactatatagcttctaaaaattgctttaccatgtatcattgagatagtttttccagtaaa

SEQ ID NO: 2408 - DNA, 1600 bp, mus musculus
acaagcagactacagaagtgacatagcttctgggacaggcagaagcaacaaagcttctgggacagacccctgtttcagactccagacacccagtcaccttcccctccagagtagagatggccgccctggagggctcttacccccagagcaggtgagggagccatcttgtctcccgagtccctctgagactgaaagaaaataaaagttgagacctgtgattcatgtaatagcccaaagagttgtgagctttgaagcctgggactgaaagcatagcagaacaggccaggacatgcccaggcaggcctgtcattaagacattactgaggctgcttggccataaagataaagagaatgcaaagacatgtccggactgacccagcaccttcctatctcctgaccttctgacatggattgaatgttaaccagatgctctgctgttacctcgatctgcacatagagtctgctgatgttaaaataaaccaattgtgtgaaacctcgccaattcctccccaaccccagacccttttctataaaaacccctagctttcgagcctcgtggccaacaaccattgtctcctgtgtgagatacatgtcagcccagagctccgtcattaaactacctcatgtgtttgcatcaagacagtctctaatgattccttgggtgtgcactgaatagggaattgagtggaggtttcctcactaggttctttcaagaccagtgtgcacaggcgagagtgtggattgaagaagcaacacagcttctgggacaggccttgttttgggctccagacatccgggtacctttcccgccagaggagaggtggctgcccaggagggctctgacccccagtctgcacagatcagctcactgacttcggaaatttctgggacaggcagaagttacacagcttctgggacagacccccatttcaggctacagacagctgggcaccttccctgccagaggagaggcaaccacctgggagggctctgaactccagagcaggagagggagccatcttatgtcttgggtccctcggagacccaataagtacaggtgagcatgcagactgcagaggcaacccatcttctgggacaggccctgtttcaggtcttcatcttcagtagatctgaacaccacacctctgtgcaccttcccttcaagaggagagcttgcctgaagagagtactctgaccactgagactcagaagagagctggacttccaggaaagctgacagaggctaacagaatcacaggtggaacagacttcagccagagacaaatataacaactaacaccagagattatcagatggcgaaaggcaaacgaaacttactaacagaaaccaagaccactcaccatcatcagaacccagcactcccacctcagccagtcctggatacccctacacacccaaaaagcaagattcagattcaaagtcatatttcatgatgctggtagaggacctcaaggagggtattaataactcacttaaagaaataaagaacacagttaaacatgtagaagtccttaaagaatcacaggaaaacactgctaaccagggagaagtccttaaagaatcacaggaaaacactgct

SEQ ID NO: 2409 - DNA, 1400 bp, mus musculus
tatgtaggcctttgacaggaaatgaaaataataaattggtaattttgtaacttctgttttaacttttagtttcatttggaagagaagtacaggtcttctaaaaagaaatatttagtttttatgtgagatcaggcatcttcattgtagtatgatattaaactaatatgatatataaactaatatcatattagtatgatattaaactaaatacatattaatacataaaatatgtattttctatttctccagaaactttcaaagaatgggcactgggaatcattctgtaacagttgtgtttgtcttggtgggattaacacagcagcctgaactcctgctgcccctcttcattctgttcctgggcatctatgtggtgacagcagtggggaacctgggcatgatcctgctcatcacagtcagtccactgctgcatactcctatgtactatttcctcagcagcttatcctgtgttgatctctgctattccactgtcattacacccaaaatgctggtgaactttcttgggaagaaaaatttgattgtctactcagagtgcatggcccagctctttttctttgtgatcttcgtggtggctgagggctacctgctgactgccatggcatatgatcgctatgtggccatctgtagaccattgctgtataatgtgatcatgtcctccagactttgctcactgctagtgttggttgctttcatcttaggctttgtttctgccttagcacacacaagtgctatgatgaatctgagcttctgtaaatcccacgtcataagccattatttctgtgatgttcttcccctcctaaacctctcctgctctgacataaagctgaatgagcttcttctattcatcattgcaggcttcaacaccttggtgcccactctagctgttgccatctcttatgtctttattttctgcagcatccttcacatcaagtcatcaaagggcaggtccaaagcctttggaacctgcagctctcatctcatggctgtggggatcttctttgggtctatcaccttcatgtatttcaagcctccttcaagtaactctctggagcaagagaaggtgtcttctgtgttctataccacagtgatccccatgctgaacccattaatatacagtttgaggaacaaagatgtgaagaaagcattgggcaaatgtctggcagggagataagttttacattcaacatatgatacatggtagaagtgaattgtactaatgcaaataatttttttctattcatttttatttctctcttgaaatattcagcatatctctgcttgtggtactgggattaatctcagaggatttcatgttttaggtaaacactatacaatgtagctatatctaatatccatgtttcttttaaaaatgctgtaccatg

SEQ ID NO: 2410 - DNA, 1400 bp, mus musculus
ctgtctgggtttgtgatttctttattcttctgtttccagttttatgtcattaactgttttgttcatttcttttacctacttgattttaattttctatagtccgtcaagggatatcttaattttctcttttagtgcttctacctatttgcctcttttcttgtattcctctaatggagtttttatagcctccttaaaaggcttctaccatcttcataagatgggattttaggtcagaatattccttttcaggtatgttatggaatccaggcatttcatggtgagaaaagtagattgtaatagtgccagattacatgatttctgttgtttatgttcttgtgcttgcctcttgctatttggtaacctctggtgttaatgcacatgtatatctcttactggagcctccctggttggatgaagtagagttaatgacctgggttaggtcaggcctcctggatggcaggaagtgctgtttatgttgggggagtgggactcttgtgtccctcattagaataggcctcctctgtccctggttagagcagtcttcttatgtccatggttagggcagatgtcctgcgatcctgtttagggtgaacttcccaggagacagtcaggttttgggttccaagggtaggatcttccccagttccagatggaggtacagaataaaaggactatgtggcttaggcaaagcatgatacatcccaaatctgctggtctctgtgcagtggcagggacatggtttctgtgcttattgtgtcaaatgtttcaaatgtgtccctagttaaggctgatctccaggcaatatgtgtggtatgaaagaggggcagtcacactgatctatcttaccagggtgaaggtacatatcagaaagaagatggggctcctgtaaaaaagatagatcccacatctgctggactctacgaagtcccagttgaaatgggttagtgtgaaagaggtctcacctgtgtcccaaattatgtcagacatccttggagacaagcatgctatgggatgtggttgaagagacaggcagcagatctgtcccagagggaggttcagatctaaaggatgattggcctatggcagaggggatagatccactttctgctccgtgggatttttcagctgccttaggtattggggcagggatctcaactgtgtccctggttacagcagaccccttggacacggacaggctctggggtatttgaaaggggtaggcaagcccatcatctctgagtagaggtgcagatgggaagaaagaaatgtctttaatgacaaaattctaattcatttaggaagttattatgtgtacacaatcaataaatgatgcagagtttgaaagaatataagacagtacttatattttcccctagctaatgggtttctgcattgcaatc

SEQ ID NO: 2411 - DNA, 1400 bp, mus musculus; identical to SEQ ID NO: 2410

SEQ ID NO: 2412 - DNA, 1400 bp, mus musculus
tgagaatgatttagttaccacagattcaggatcctaactatgggcttactttagtgctttctttatagctttcttttgaactccttttgttcttcatccttctgtcatatcagcagaaaattatgacaagataaatatagttctgatcactatatattaactccctgtgctattatgtcacaccaaaaagattagaccaagatacatccttcaatatctctgagtctgcttattagctgttttcactatgtttcttatccttcacaaagctgaccctataaatgttagtctccatcatagaagctatattatctgtttctcaattatggtctatcaatgcttgtgggttttgaccaacttcatgtcattaactttctctgcatcccagttctagcactcttaattttgttcagctctgcttatgtcgcctgaatgcttgcatgccttggttcttggtggagcatttctcaaaactcactttgcattatttctcttagggtccctttgtcagtcacctcttaaaaagtaatgaatgctgagccaagggtggccttggtagggtcagaatgacatggttcctgcccctgggacaaggacaagaaggcatagacctccttgaatgtcagtggttgctgtgggaattgtacttgtttgtataataatgtacatagtttcttttgttgttggtttttggttttgaatttgtttttgttttttggtgtttttgtgttttggttttggtttttttggtttgtttgtttgtttgtttgttttggggtttttgagacagggtttctctgtgtttccctggctgtcctggaactcgctctgtagaccaggttggcgccaaacttagaaattcgcctgcctctactcccaagtgctgggatgaaaggcgtgtgtcaccacccccagctcatgtacatagttgcatgttcctccttaaaggaatgtcattcccattaatgttattggttagaaacagcagaagtctgagaactgaaggtgtggtgaatgtcttagcagggtggtaaatgctgggaccttcaaaacaatacttaaagatgtgtaaaacaactctaaaaacctgaactcaaaaacatataatctctcaaatctatgtaaaatataagaacgcagtataaattatatgaaagtctgcaggaatctaaaagaacaaaaacagctgcactgtgatccaacttgtcagaaagatactaaggaaagagatttaggaactggtgatcacaggagatcccacccagctaagattttgtttatgcttacaaaggcagacagatctgtgaattcttttgcaattaaaaaaaaatgcatgtgcttgctgtgtccatagaatcaagaggttggggtaatggaatgttaatttatgggaagatcca

SEQ ID NO: 2413 - DNA, 1600 bp, mus musculus
cctgtgatccatccattagctgactgtgagcatccacttctgtgtttgctaggccccagcatagtctcacaagagacagctacatctgggtcctttcgataaaatcttgctagtgtatgcaatggtgtcagcatttggatgctgattatggggtggatccctggatagtttttcatggccactttggcatctttatttctgaggctatagattctcgattttaccatggactcaaggatggtataagacatagtcaacacttttccttcgtctatgaagataatgctaggatgtaaccccaaaacacagtaacagccaaaatactggatctgcaagtgctaaaggctttggacctgccgtcagttgaagtactttgaatactttggaataaactaaaaatgatgaagatataatagctaagaatgcccagacatagaagagtgagattaaatgcactggactaataattcactgataaaagtactagaacccgagagtaatggtttaatataccagtcttgcaggaaacaaaaaactcttagcacaaagacagtgtgagctacggtacatagtaaacccctaccatatacccaaccacaatctaggaccagagttgataggatatgattaaattgtaaagtaaaggattgtggacagcaacacagaggtcatatgccactgcagccagcagaacacattttgcagcaccaaaagcacagaagtagtactgaggtatgcattcttagtagcagatgacactctactctgtcgcaaagttcagcagcattgtgggagtaatgacggtggacttagagcagtcaataaagagcagacggcttagtaaataacaacaggtgtgtgtagttgagaactaaacagaatggagatgagtgtgtccaggtttccgacaattgtgaccactagtaagttgaagaacagtagcaactgaagctctgcaatccccttctttttccaaagaatttgcaatcatggaaaagatgagtcatggaaagaagacatcatatagcttttgcatacttattgcttacactttaatagtggttattcattctactcagtccctcacaacctcagactgatacctgtgatttaatgttccactaatatcttgtgtctattcataatagtatttccgttgaagcaaaaaaattgatctcaattgaatgttcataagctttacatatacaatgaaatttgtcgtttgactgtgagtctgtaacttaaatcaggcatgatattccctgatagtatcacatgctttattcaagattcctttggccatctgtatcttttgtacttccctatgaattttaagattgtttttctacttctgtgaaaaatgtcaggaggatcggtactgcattgaatcaggatgctcattcacaaaattaacttctgtagttcacggccatggagtcttttccaacttctaatgtcttctttaaattctatatgcatagatttaaatatgtcactgtagagttccatatttcactttataatcagggtgaggttgtgatttggtttctttctctttcattcttcctcaccttccttcctcctttcttttattctttct

SEQ ID NO: 2414 - DNA, 1000 bp, mus musculus
agcatccttttctttcttccacccctgtaatttaaactcctctaatccacacacataataaatgtcaccaagaatttctttccacagactcccaggagctgattcatccatgaacatgacaaacaacactatggtgacagaattcaccttgctgggcatccctgagacagagggcctggagaatgtcctactcttcctgttctcaacattatatgcctgtgccttgctgggaaacttgctccttcttactgcagtcacctcctccccacgactccacacacccatgtactttttcttgagcaacctctctatctctgacatgggcttctgttccactacagctcccaagatgttgtcatatctctcaggaaggggtggggggatttctttccagggatgtgttgtacaacatttcttctatcattgtattggatgcgttttgtgcttcctgtacacagtgatggcctatgatcgctttgttgccatatgcttccctttgagatacacaatcatcatgaaccacagagtatgctgtgtcttggccacagggacctggatgagtggctgtgtgcatgccaccatcctaacttgcctcactttccagttgccctactgtggccccagtgaggtgagttattacttctgtgacatgcctgcagtgttactgctagcctgtgaagattcctctctagcacagagggtaggtttcacaaatgttggtcttttatctctcatttgtttctttctcattgttgtgtcctacactcgaattgggatctccatctcaaaaatccgctcaacagaaggcaggcagagagcgttctccacctgcagtgctcacctcacagccatcatgtgtgtctatggaccagtcatcgtcatctacctacagcccaaccccagcccattgcttagtgcaattattcagattttcaacaatcttgtgacacccaccatcaacccattgatctacagcctgaggaacaaggatgtgaaagca

SEQ ID NO: 2415 - DNA, 1000 bp, mus musculus
tataagcatcttttttctccacccctgtgatctaaactctaatctacatacacaataaatttcaccaagaatttctttccacagactcccaggagctgattcatccataaacatgacaaaccacactatggtgacagaattcaccttgctgggcatccctgagacagagggcctggaaaatgccctgctttttctgttttcaacaatgtatgcctgtgccctgctgggaaactttctcattcttactgcaatcactacctccccaagactacacacacccatgtactttttcttgggaaacctctccatctttgacttaggtttctgttccactacagctccaaagatgttgtcatatctctcaggatggggtggagggatctcttttcagggatgtgttgtacaacacttcttctatcattgtctgggttgcacattgtgtttcttgtacacagtgatggcctatgaccgctttgttgccatatgcttccctttgagatacacaatcatcatgaaccacagagtatgctgtgtcttggccacagggacctggatgagtggctgtgtgcatgccaccatcctaacttccctcactttccagttgccctactgtggccccagtgaggtgagttattacttctgtgacatgcctgcagtgttactgctagcctgtgaagattcctctctagcacagagggtaggtttcacaaatgttggtcttttatctctcatttgtttctttctcattattgtatcctacactcgaattgggatctccatctcaaaaatccgctcaacagaaggcaggcagagagcgttctccacctgcagtgcccacctcacagccatcatgtgtgtctatggacctgtcatcgtcatctacctacagcccaaccctagtccattgcttagtgcgattattcagattttgcacaatcttgtgacacccaccatcaacccattgatctacagcctgaggaacaaggatgtgaaagcagcc

SEQ ID NO: 2416 - DNA, 1000 bp, mus musculus
catttctaaacacctaagctaaactgtgaaacacccttctcagggccctcttcacttccttgttcctcagtgaatatattaaagagttgagcatgggtgagacaatattatttaatatctgcaccacagccccaagcagagggtttggtgtgcgctgcaggtagatgatgattacaggtccataggcacagagaatggcagtgaggtgggcactgcaggtggagaatgctttctgcctgccctctgctgaacggatcctcagaatggcaaccccaatgtgtacataagagacacaaacactgaagagaagcatcagagccagaaagccaacattgatgaaacccaccttccgggccaacttattatcagtacaagccaggggtaaaactgcaggaatgtcacagaagaaatgatggacatgattgggcccacagtaggttaactgaaaggtaaaaaatgtcaggatgccagactgaagacatcctatcaaccaggatactatgaccaagcccaggcacactccaggtttcatgataagcatgtatctcagtgggtgacatatggcaacataacgatcataggccatcacagagtagaggcatccttcagtagaacccagaaaatgataaaagaagagctgtgcaatacagcctctgtaagagatggctgggctcttgccagagaggtaaagtagcatttttggacaggttactgatgggaacaacatgtcaaaaatagaagtcccaagaagaaatacatgggggtgtgaagggtagatgaagaaactattgctgtaaagatgagtaaatttccaagcaaggtaaagatgtatatgaataagaacaccacaaatagtagagtctccagtccttgtgtctggggtattcccaatagaataaattcatccagcaatgtatgattttccatggggcaggaaacctgttttggatatttccaaacatgaaaatatgaatgtaaaggttaatactagtaacatatt

SEQ ID NO: 2417 - DNA, 1200 bp, mus musculus
agagacagagacagagaaagagaaagagaaagagaaagagaaagagaaagagaaagaaaaagaaaaagaaaaagaaaaagaaagaaaaagaaaaagaacggatggacagagaaaacacagaggcatagaggggagagagagagaatatggatgatgcagaaaattattatcatttctctgttttaaacttagaagcttctgacaatataatgagaagataatggagtctggaaacctttcgatgataatcgaatttatcttgactggattcccaaccaaaccagagttgcagctgcccctgttcctcctcttccttggcatctacctggtcacagtgttggggaacctgggcatgatcatcctgatcgtgctcagctctggcctacacacacccatgtacttcttcctcagcagtctgtccttcattgacctctgccattccactgtcattacccctaaaatgctgttgaactttttgttagaggagaacatcatctcctaccctgaatgcatgacccagctctactttttctctctttttgcaattgcagagtgtcacatgttggctgtaatggcatatgaccgctatgttgccatctgtaaccctttgctttacaaggttgtcatgtctcatcatgtctgcttctggttcacagtgggagtttacactttgggtattcttggatcatcagttcacacaggacttatgttaaaattgtttttttgtaagaccaataaaattaaccactatttctgcgatctttttccactcttggagctatcatgctccagtatatacatcaatgaactcttggttcttttcttgagtgcactgaatatcttgacacctgcattgaccatccttatgtcctacatcttaatcattgtcagcatcctccgtattcgctccactgagggcaggtccaaagccttcagcacctgcagttcccatatctctgctgttgctctcttctatggttctgctgctttcacatacttacagccatcttcagtaagttcaatgaaccaagggaaagtgtcctctgtgttttacactactgttgttcccatgctgaacccactcatctacagtctgagaaataaggatgtcaaatcttccataaagaaaattcttaacagatgaacgtggcagattcatgaatggagttgttgtcatattagaaaaaggtgattttgcct

SEQ ID NO: 2418 - DNA, 1400 bp, mus musculus
tactcctcttgttaaaagtcaaccatttcatataaatttagcattcttttcttatggctaacaggggtatgaatggaataagaaatcaacaattcctttggactgtggtgtctatacaatatatataaaataattctattcggtgttctccatcagtgaaaataatccatatgaaggccataatccatatgaagaaatgtcaaacacaagcatagtgaccacattcttcctctcaggtcttccccacccaccagtcctggactccatgctctttgggatcttccttgtgatttatattcttactgtgttgggaaaccttctcatcctgacggtgatcagggtggattcccacctccacacaccaatgtactacttcctcaccaacctctcctttattgacatgtggttctccacagtcacagtgcctaaaatgctgatgactttggtgtccacagggggcggggctatctccttccacagctgtgtggcacagctctattgcttccacttcctgggtagcaccgagtgtttcctgtacacagtcatgtcctatgatcgctacttggccatcagttacccactcaggtacagcagcatgatgggtggcagaatgtgtgccctcctggcagcaggaacatggttcactggttccctgcactctgctgtccagactacattgaccttccatttgccctactgtggtcccaaccagatccagcattatttctgtgatgcacctcccatcctcaagctggcctgtgcagacacctcagccaatgagatggtcatctttgtgaatatcggggtagtggcttcggggtgtttttttctgatttcgctgtcctatgtgtccattgtctgctccatcctgaggattcgcacttcagagggccggcacagagctttccagacatgtgcctcacactgcatcgtggtcctctgtttctttggccctggtctcttcatctacctgaggccaggctccagggatgctgtagatggaattgtggccgttttctacactgtgttgacacccctactcaaccctgttgtgtacaccctgaggaacaaagaagtgaagaaagcactgttgaaaataaaatatgggtctgtgcttcctcaggataaataatacgtgaggatgaatactcttaacatctgcaacatctgtgtttaaactgtgtggctgatgtcaccatgagaatttcaaagagctattcaaacgtctagtcctaatttttaatgaagtgactgataatgttttcgtttcttgataaatacttgtaagaatcccaaagaaaataccctgtgaacctgtctcagcagaaagaccacactcttacctggcttttgcaggatggggagcacgtcaggaaaacagtttaattttaatactttac

SEQ ID NO: 2419 - DNA, 1200 bp, mus musculus
gaaaaaaaccttcattataattctaagagatgtgttaatttctaggaattattaagagcagcaaggattagaattacatcttcaagggaaaggagctggcaagagctagttaaggtgagaatccttctcaagtaggcaggctttgaggacaacatagcaactctgaaatctatcctgggtgtttttcaaagtcccaggcaaactacagaacagcacataaggtcccaggccagccccaatgcaagaatcccattaccagagcaacatgaagagtccaaaggctcagaggtctatcctgtctgaactcagctgaccaccagacactggcttctgtttagaaacagcccttaacccaagtcttgcctgatgggaagactgaactattagtatttctttttcctgccatgagacatgctatgtgcactggggcctggatccctgtggacagtggcctgtgtgtgttgatctggaggcctgaaaagggaccaggcaattttgtggccaaggggagtatgtgctccaacacagtcctgctaagagcagcaaagcctggtgggaaacatcacttcagagaccagcaggctcacaagagaagagataagaaaaggaatgccgggagtgatggtgcacgcctttaatcccagcacttgggaggcagaggcaggcagatttctgagtttgaggccagcctggtctacagagtgagttccaggacagccagggctatacagagaaaccctgtctcgaaaaatcaaaaaataataataataataaataaaaatgaataaaattaaaaaagaaagagaaggctggatgtgatggcacaaacctatcccaactcttaggagggagaagtaggaggaggtggggcctgtattaatgacctatagaggacctgctatcttgaggcccaaccttctctggctctcctgcctctgcctaccaagtgctggggctaaaggcgtgccactgccccagcattgcattttcttaactatgtctttggaagaccacaattttttcacttttgttgaggttcaacctcaccaaggaatcacattacagattatgcctttaatgccataaatattttttagacatttaattgttttatgtttcacaatagttttaagtttgtttaacactttgagtttttttttaatgggaatgtgggataaaatacagattgacgtacatttt

SEQ ID NO: 2420 - DNA, 1000 bp, mus musculus
caaattatcaaaagagatacacagacttactctgtgcactctccatgagagccacacaatatacaagacccaaggaaggggcaggtttgacgcttatacagcccacgcctctgagcttaggggcctgtagaatctgagaggtgatggcaaggttttgtaaaagaggaagcagactgcaaaggaaagtcttcttattccacagcaatagagccctagctagggtttcccagaatgtgcacaataggctgatgaaccatgcttgtgagttcgtctgtttggtgagacgccagtaaggatgttaaaggctatggcttgggttcttcttgagtaacttccgttggtcagataagggaacttcactgaaagctcctctcaggcttctgtgggggtgaggtgggggagggggggcagaagtcagccagcctttgtttctcaggctgcttctgagcccttttcagtgctgcagcccaaagggctcagcatgcggtcgccatattgagtggttccttttcggatctccaacagacccacgcagatgaatggagagcagaggtgatggagtgatgctgagtgatgtgaccagtgttgctgaccatgatgacacacacctgtaatcccagcacctttgcttcacaggcaagcctgaactacatagaaagaccctgtatcaaaacaagcaagcaaattaaatgaacaagccaacacacacaaagcaaagcccaggaaacagacagagtttgggatacggaggcatttagaacgcagccagcagcttagattctcacctttgaatacattaagttggtaaagacaagatgcttctggaaatagcagtaacttacctttgcatagcagtggttcacatttgcatatcattaagagggtcttaactcacggtgactctctgaacagagccaaggcctacgttgtagccagtagcatttgagaaactaagaacctgacagacaagaacacctgattcaaaactacatggggctat

SEQ ID NO: 2421 - DNA, 1400 bp, mus musculus
cctttgtctgtcttcggcactgtccacacatgcaggtagctgcttgtcctcctggctggaagattcctttcaaggcacatcccattctgcctggcttggatgactctctgagtcccttggaagcttaccaggcctttacctcgtcttctgacaggcccagtacctgccgtggtcagaacatgctgtcagcagaacatgccgtgccggtctgctatgagggtaaaggggtcatgtcaaggatagacatcaaagagtcagaacacttggcaaggcgcttgtgagaccccatctgaccacaaagatattctctctcagcctggtcaggctgcccatgggtgtacccgtgctctcctggaccaatgtcccctcagtgccccatggagctcacctgagctttggacaggacacatggacaagtcctactccagaaacagatgtagaaccctttcaggagcatctctttctcatggatgctgtgatcttgtcttctttggaaaggaatgctttttccagaccaggtcccgggtctcacgattctagaacagggtctgtggtcccttgacattcttgagagtgctactgaggatgaggaggatgttatagtgaccagaggatgatgggagagggtccagtaccccctgggagtccaacagtggttcagtgacctactcagccaggtgcaaggcttccaatgagcccagggcttgtccacttacccagggcctacaaagtcccctaactctaaggccagattagcatctacactttgccctgccagcccttcctcccttctgctgggaagcaaagtatagtcagactgggaaggagcacaacaatgatttgggggtgacttagtttctgtggcgtctttacccacacagtgaagcaatggtagcatcccgtcttcagtccgcctgagttgggtgtaatgctttatttcagactgtgcattttgcacaaaccctgcccacatcccatttcacagatgaggcgtatggacctggtgctggcagctgttggttttagcctcgagcctctccatccctctgctgtgttcctctgtatggtccctagaatctgtctcacttacacctagaagagaccagccctgtacctgaaggttgcaaaaaatgccattgtagctgcctggaacatcactctccactaagaagaaggtgtctgagagccttgccactgccttgaccgtttagatgagcctgcctgatagacagagcctcagctcagggggcgtgggggagggaggaggcgagataggcctgggcctgttcccatttggaagctttctcagggactatcaggatgtccaggaaggtgctaaggtcccagtgggttggcccagtttctgctcagacctcacctgggatatgagagaacgaaga

SEQ ID NO: 2422 - DNA, 1000 bp, mus musculus
tgtagtttttaagactgttatattaatgtttatgttatgcctgtgtgtttagacatactgcctcagtgaaactatttttatagcttcttaaatttctaaaagatggtgtgttcttattctctcttctcccgctcctttgttctttgctattttctagcaatggtgattgttcccactagagaacttgctctacaggtcagtcagatttgcatccaggtcagcaaacacatgggaggggccaaagtgatggcaaccaccggaggaaccaatttacgagatgacataatgaggcttgatgatacaggtaggaaatgaggcaggcagcagggctgtctgattatagctacaaatgtctcgtttatttttcagacttattcgtgattatgtggaggtggggtgtggctatgcacatgtgtgtgcaggaggtgcctatgtttgtgtatgggggggggcagtggatcccctggttctagaattagtagctactgccaattgaacttgaattctttacaggagcaatatgagctcttaaccactaagccacctctccagtctctaagggtttccttttaggaaataactaaaactttgttggttgttttgttttgttgagacagggtttctctgtgtagccctggctgtcctcaaacttaatttgtgaactaggcaggcttcaaattcagagatttaccggcctctgcctcccagttacttttataaaaagcatatgctaccactgtctggccctaaaatacgtctttaattaactaagggactgagggtggattagtaggtaaattgcttgcatagcacatacaaagccttgattatttccccaccaaacaaattggagttagtgacacacacctataattccagcactggggaagtgaaagttagaggatcaaaagtcaaggttatcctcgcctacataatgagttcaaggccagcctgtggcacatgataaccctgttttaacaaaataaggaatcaaaagaac

SEQ ID NO: 2423 - DNA, 1200 bp, mus musculus
ccagctgcctgtgtgtgcctggctcacactgccgccaacacatccttgcctcgcagcctcccccacactgaattaggtggagtctcttgagattctcactgtccccttagcaacccagctcttcacaccccagggccatctccctcctgtccacaaactcctaaccaagatccactgcgggccactgcaacagacaccacagattctcagcacagagcttgcaacactcaatgtgaacctctgtcatccacacctatatcctcctccaacggcaacagctatgtgccaggcacagaacaggcgctcgcttgctcgtggcaggatgactgagtcctaggaactgacacctgcaaagggatcctaggctcttgtgctaggaagttacaacgtggcgaggaggtacaggcacacagcctagttgcttgccagcgtggcttggagctcaggagtactctgccacatctgagggaaggaagaggtgtgaaaagcaagagcccattcagagcacccagcatagtctggcacggaactcggcatctgtcactacagcattacactccgggctgatgtcacacagcaaggcagggatgactgccggagtgctgaggagggtgggaacggttccaggtaaggtgagcgcctggaggggtttacccacgctaatctaatgtgctttcctgttgtaggaaggaggagggcgcgggtccaaccggcaagccacacccaggtcctggtgtagccctaaacccatctcagcatttcctcctggccatcctccagtggtattgtgctctgccccccttcttctttccctggaaatagtaacagggaaacagcaaccttcgtacactctgtcccgcccacctatccttggtcttgtgcaatctgacttctgcctgcttgcatggtggaaacccttctctccacaaatctcagacccggagtcaaatggcctttgggccacatcctgcttgaccctctggtggtatctatcatggctggtgacaccttgggcttacaaatgtctgttcccttggctggcttccttctgtttccgctcctcgtctaaacgtggtctcctttgtttcacaggcatgaaccaagattgcctttgccaagcgccagcccagcacctggcgcacagtcagagccagcttcctgcttccttttctgcctctgctgctttctatcctgcctctt

SEQ ID NO: 2424 - DNA, 1000 bp, mus musculus
tagttcatgctgaattgtttaatagccaagttctgatgacattagcgttcactgttggtgcttctggccttccctttctgtagaggagtccagatgaatactgatgtacctcaagttgttggtccaactgccttgctgtgctggaaatgctgtaccccaatatgacaggcaggataggttaaacagctgaagcttactgcttacagtccagactgaggaacataagctcagaatggtgggaagctcagctgcattctgggacccatttccttagctggtgggtcgctgccatctccattctatcatctgacctcgttattgggcacacacacacatgggtggggaaatgaagctaccagctgtctgatacctcttattagggcacaaatcccccataaatgctctacccccagggccttaccttacctactttcttcccaaaggtcccattccaagtaccatcacattgctaaggtcttcagtttaagaatatgggggtagacaacatacacagtagctgccttaagctctggcaatgtgtatcactctaaaaacccaaacaattcctccttaggagatgtaggttgagaactggaagaaacactttactggatcggtagaccagaaccttacctgtacttgtctccacagagaatctttattcctatcattctgtttgacgtgccaagaagttacttagttccactgtattaacaacagccaaatatctgtttgagtcaggagcatctggaaggaggaagggagggccaggaagatatgtatgtgttcagcatctcctcacatctaagtcttaagtgacaggtttgttgcctggaaagtggaagtgggtgaagcaagtgctgtggccgccctgtggaattacgccgtggagcttgggcgtgaccacgcctctgcagtcacttcaaattagaatcagaaccttgatcagatgcactgctgcctttcttacacaatgaggtggacgttcgtccctagaatg

SEQ ID NO: 2425 - DNA, 1000 bp, mus musculus
gcagcgaagactagaaacgtagactgtgacccagacgctgtcgtctgctgtggatcttcattactgtacagggttatctgcaagtgaggtgtgtcgcaatgagattgaatctgtcgttaattctttatctgtaggcggctcagtatagattaccccacgctgtgcagaaagtttttggagtggaaaggtctcctccttcctcgttgccctaaacagacccgacatgtgaggtctgtctgttttatgtaagtggacaaatttgagatgtcacaggaggggaagcagggagggggtacgacagttctgctctgattatttctactctcaacaattccatccacctttcccaattggccttactgctcactaatgcaggagagagcaagtccgtgtgccgtgtgactgactggaggggacaggctttgtttaggttttttttacccccactttggttttggttctgggttgttttgctttgttttgttttcctttgttcttattaaggacggcagtgggctgtgtcctgtgtgtactgtatgttacagacaccgtcctgctgggacacttgtcctgctgggattcccagctcccacccccaactcctctcattccttcagatttggcttgacaaaggcaggaggtacaaaagaagggccaattttgttctggaaaggtcagagcccagagtcgaggtgggaaagtggcatatagggatttccagttacttaatcaaaactcaaaatgtgagtgtttctgtctttcgtgcactaggcctggcctcttacctcagccttaagaaccatctgccaaaaactactcatctcgcatgatggcagccagagcgcatagctactaaaataagtttccgtgaacatatcttacaccggagcctgaggaaagatagaggcgcaaaggaaccctttgcattctctaaagctaagtgggggtttgcagaagtgctggggtcatctagcagtagttctgaaggacagaacctaaa

SEQ ID NO: 2426 - DNA, 1000 bp, mus musculus
catgtgcttcagctacatcaaatttctcagggcatactgtagtagcatagctgggctttagtggagacatatcgtcttggctgtcattgattgtgtttttatgtcggtatctaggcatctgagttcaggatgattgtagttctaggttctgatatctggtcttgttgcgcaggtgttcattactggtttcctgctaccctttctgcttcttaggagagtgtggaagttgtggattgcctgctaggaatttctgagatccttccatgtgtgttcagtatgggtgctgtttggaatatttttcttggtttgggggaggagggcagacacttagggatagagatgagctgggtggggcagctgagggggttcacaggagagacaaaaccaggatgtgccaccaggatcttgtttagttccctgagaataagagaggtaggtcaggtgacagctactaatctactacagagctgccaatgagactgggaggttacatttggaggagaggagggagaggggatatctgagaattgcctacctggtttcctgctctgtgtccttccctggctgatatagccatcagattcccagagggtgcatgcaggagttggaggctgtggtggagatgtaggtagagttgaaaggaaggccatagcaggtggtttgctaaagatctgcggatgagactggggtattggatttggaaaaggcagaatgaaggtctgaaggtcatctacctgctcccctgatagatgattggtgggttccatgtaggtgttggcagctgatacatggaatgcaagagagaatttgtttatattttctgataatcattttggggttcagaaagtttcgttttgtgtgttctagtatttatctttataccaataactttgagtgtcccaagtcccctctgcccatatatggactggttatcactgccaggcctataagagttaagtgataacctttggcttctattagcttatggaagccattcaat

SEQ ID NO: 2427 - DNA, 1000 bp, mus musculus
atggtgtcatggttagatgtttggttttgagtgagtgagtaccctttactgctgccatgacaaactctttccccaacatacacagacatggacatagactgagttatgcagccctatgtgggcttcttgcctagtgtgggagggtgagttgcaaaggcatcttcctcttagctgcagcaggatgcctgctgttgagttgaatgttggcccctgaaggccctcccggatgctatagccttgtttagctgtgtgtatgacagttcattttccctctacagagaatctgcagctgtgcttaggagagttcctacccaggcttctagatccttctgcagaaatcatcgtcctaaaggagcctccaactattcgaccgaattctccctatgatctttgcaaccggtttgcagctgtcatggagtccattcaaggagtttcaacagtaaccgtgaaataagccgctcatggacagtcaagactcagtctggtctccggtcccctgcctgttatgtggcagtctgttgtgacagatttccctggacagagggattgggtgtctgagcgagattcagaccctcccccctctcgtgatgtgtgtttaagggattaaggataaagttgcacattttaggtacagaaccacaagagctatttcactgaagaaggcaggagccagtgcattaaggttttgaattatcctagaagacctgaactgcctttgtaaatctcccataacacttgggtttgtctaaacctcgtgccacttttaaattacccttcaggcaccagtctttgacagcaaaagggtgactcatcagaactgagccaggggagcagtttctagttattttgtcaagttcaggtgacatttaaaagtcctcagctaccagagattggtagtaggggtcttgcctggctcttgccagtgatgaaaagaggtgctggtgagcccttccttccacataaggctgcgccatgaagccgccaagggaaagctgcatcc

SEQ ID NO: 2428 - DNA, 1200 bp, mus musculus
ggtgactcggtcttaagcactggatcttgtgagaattggcctggtaactgagaagtctgtctccttttgctgtgttgggtggggattgaacacagggactgtgcattgcagacaagtactgtcccaccgagttagatccccatcccaaggagaaggcttccagtgactggggcactgatatcacttatggtgcagatccactggacaaaggtaaaacccatctcggggtggggggatctggtggagcagcagagattttaactgctcctcagaatggctacagtgtaaaacatgaattagtcattgatgggattctccgttgaatactttaaaactgcggttggcagcgagccacccacactgtgaatccatgtggtgaaagggtgtgtataatacaatcttgttcttgagacaaggcttcactatgtagtccaagtgggtcttgaactcaggcctgtgctgtcctgtctcttgtattgggagtacagatgagtactgatacctcaggaactcttagatatgcagtggtcagagaggtgcagatcaggatccctaacatctgtttgaccaaaccatagatgagctggatttggcacaagttctcatgtggccagggcccctgctgttcagcatgcccttcctgtttctgattgcctgccagggtcacttctagaaggagtctattgcagacctctgctacctcctgactttgatcgcagcccccttgctggtgagattgaatggcggtggggttggtaactgttcaggcgcttctctggttgagtcttctgttgcctccccttccccatttctcctcccttttcctgttctggccaaggccgggccaggatgaagttatgaatcaaagctcagttggatgcctgggtctttctgacatttgtaagtctcagagcatcatgggctctcctgagcaccagcccgcatgcctctgcaccatgctgggctacaggcaagctgctgctcactgtggctgatgaagatcctgctggcttctacaactcggccctaaaagttcctctacccttcccttctgccaccaccagacctgaagatgccactcctagccttcctctgaatagctataattattatcatggaaaacatcagggctgttcttgcccaaacccaattttaatatgggaggctctaccagttataactctagttagttttatctat

SEQ ID NO: 2429 - DNA, 1600 bp, mus musculus
agttgtgtgtgtgtgtccatggagactgaaagaagatgtcagatctccttggagctggagttgtaggctgttgtgagatgggtcctggaaaacaaactcagtactgtggaagagaaaaagatgctctcaaccatggaagtctcaccagcttccccctccaccccccattaaatcttaccgtgaacatctacagctagacacttaaaagacagaattggaacagcatatccactgtctcccaacaggctgtttgtaccaaccaagtatattggcagttttactccgtgtctttaaatagtctgcttttatgtcttaaatacggcaaggcacacctgatcatcctgatgtcgcatacttcatccagccaatccattatagttgttgttcgttgtttgttaatgtaaaagtgagatgggcaactttacacgacaaactatacacaccaaaactttttagaaggtcagtcaataagaagtttctaatgaatattccaaatatatcttagaaaggtgtcatgagttcactgtcctatctacatgtatgaaggtaagtgatcaaggtcgtagaagcatcatcaccttggtaacaattccgttactcttgaaatggaccagattaaggtggctcttgctctagacaagccatttccaagttggtttcctcctctgccacttctgtgggaagaacatactccaacaactgtgaggctgggcttggcacgtgaacagggcttgacagaaggcttccatgtccctcagacggtggtgtgaaaagtcttattctgtgtagtgtttatttaccccaacaaggggcaaatctatgtccaatcacctgtttagagtcctaaccccagtccagcccacaccagtcccatgtgtgtgaacttagcaccttactcctgtgtgtcaccgaaatttggtggctgtcagttatgcaaaaacacttcagtgataactgatagctaaaaacccagccaggtattgaacatgcagagcacctagggcaagccaaccctttcctgctttttgtaggattcttctgatctttctgggaaagtgactgcttctaaggtttcaggtgccagcagacaaaggagccgaccttattaaacttttcaccttgctcctgccattttggtctcacgtgatttttccaatcttactttctctttgttatagacctcagtcccagctcggtgcaagaggctaatggactgtagaacagcttttggctttgaaaatgtcagcctgtaatgagaaatggaacatagttattaacagagccagacacagatgcccacagggtaccatccttttacccccttccttgcacatgcagggccaagagattatcaacagagcttaaatagaaaatacgaatgcaatggagaagcttcggtggtttcttaaatgcttgctaaaaaacacaaattttgggcctctctttccagtgatggccgactaggccatcttttgatacatatgcagctagagtcaagagctccggggtactggttagttcataatgttgatccacctatagggttgcagatccctttagctccttgggtactttctctagctcctccattgggagccct

SEQ ID NO: 2430 - DNA, 1000 bp, mus musculus
cccgcttctaccatttgctgacaatcctcatctgttaaacacaatttcaccaatttccacaacggcatgatccctgctttaagtttgccgttctgctgttccctaactagatctcctttcagtttgttccaagaggcgacagttaacgatcctgagcaagcataccatggtgccacacggtctatctccctgacaaatctctctaaggtcttagtggcgaattttaggccacacttcttcaggacgaagcataaggcaactactatagaatgggagattcccatactgcagctgtccagtcctgaccgcgactgaaactggtcgctgtccaggcgctgtccaggcctgaccgtgactaagaaccagtcagcagttacagcggtggaagcaaaacgaaaccaaaaggaaaagtgcaatcaccgtgcaaacaatcaaaagggcttctaactctggagaaatttcaagattgtacataccttgaagagtcttttgtcccgcagttctggttccaccccgcgaacgagggatcttccttgtgctggtgtgatggtagttcccgggttcctcagcgccacttattgcgtcccacttgaccagcaagaaagacgcaacaaaccggaatcttctgtggcaaaagctttattgtttgcttctcaggaagaccccgaaccgggaaaatggcactgcttatatagcccgcagcgtgatgtttcagcacctgatatggcgtgacagttcctgattcgttgctcgcccattaccccactacttcaccccgagaatgggcagtgactaggagtgaattcacgctcgcacctgcgtacaaggcttgtttactagttaggcacagaggaggccagtgccatcttataatggcgattgctcgcagcacggctctccacaatcagccttttcagaactcaaagcagttgcccacagaaaccctgagtacgtgttaatagtattatgtatatactcttgctttccaaattctgcaaaa

SEQ ID NO: 2431 - DNA, 1800 bp, mus musculus
aactttcaaatcatttgctcaaatgcataaagtctattagaactaataacagaagtcagcaagctaagtctcttggtgataaatacagaaaaacccagtcattaacagccatttagtaactgcaaaaaatgtgcatgctaatgactggagcttcatcccccagaagccatgtggaaggcgagaactcagaagttggtctctgacctctgcacatgcacactgactcacacaaaataaccaagaagcgaaatataagtgatatcaaaggatattcggtgagcaaaatgtgcaaatgttttataagcatgatcagaggacagagaaaatctgggcaaatggtgaggaaattgtggttaatgcatatgaagtttccacatcaaagacacgagtccacccccacttatcccagttatttggcttgccaggctctgctgatagccctagtgggttttatgtagcatctccccgatactgaaaggtagctagtggtacctacacagagtcatcatctcctaccccaggttttcctgtttgttgttttaccaccttttttgtaaccaatggtggaactacccagtgcaatcttgggaaataagaattatttggcatttctgtctcattcctaacttcaaaaaaattatctgtaaatctttcccatcaaatatgatgcctgctgtgattttcataagggttttatagtttttggaactataactttaacttttgtggaagctagtagtcatcacaatgaatagattataaaaggtcttaatctattaatcacaaatttagttctaacccagaggtgggcaaggaatggctgttctggagggctataatgagctcacactaaggtgacaagtctttggatctacacagtctctccacagagctgacattctcctcagccagtctctgcagatgcggctcctttttaggaggccttgtttacagtcccccttgttggccaatgcacttcatgcacacagtggctacattttgtttattaaatattatgaggtatctcatagctaggaggctcattcctaggatgtgaggttgatgaggctgagtggtgggcaggacagcagccttcaggtgaaaggatggatagctgggaaacgccattaagaaaggaacccttggattgttaggatttagatctgaattatttttatatcctctgtatctgacatacacttatgtgcgacagattaccatacttaaatttaagtaatcaagaacacagtatggcacaatggagtgaagtctacaggtgaatcaaacacctagaataaccaaaatgtatatatttacaatgagactgactatatacttccttctatacttatagctacttgtaatctatgagctttcttacttagatttagaagaccagaaatgagacttttgaagaagtcactgtagcatttctttttattacttaaatacaaatattatgaattaatttttaagccagtctaattatgttatagaacattttagatactaatcattaagaaacatcagtacttaaggtatagaaacatcttgactattattagccattgatgtcttttatataatctgattaaccaacctctgtggctatctctagtcagagtaaatggagttacagtttaatttaactagactttttctttaactcaagttatactaaaatataaagagaatgaaaaaactcgaatctttcacacgttcgtttcctgtaagatagatgggtttagggtaaacaaacagtcatggtgaaaggtttgaccaaatgaaaggacactatat

SEQ ID NO: 2432 - DNA, 1600 bp, mus musculus
caacttaaaaaaaatcaatattgttcttcttaataagggaccagtggatagggctgtttccttttaggtgtcaacaaatgattagcctgtttctctagatttagagagttaaggggaaaataaattgtgcctcagggtagagagtctttttgaggcactatatgagcaacagagtatcaaatgagagcatcaaatgagagcatctttatgagttacgggtgggtatctgagacttgctagatttggactttggtacccagctctcctttctctcttgcctctgatttctcatatttcaggatggaatctgcacaactgtatttggaaagcaaataagttgtctagctttacccagatatcagatagcaacgctgcagtaagttgaatcataccttaagtttcattcatatctcatttagagaacatgtagatgaggctttaaataagggctttagagttgatccttgggaataagacttttaaggcagttgggctgttaccctttctccagttcttccccagagggacctacggccttttacaagggtaactgtacactggggaaaaggaaataatcagactttcaatagatcgcagcgagggagctgctctgctatgtacgaaaccccgacccagaagcaggtcgtctacgaatggtttagcgccaggttccacacgaacgtgcgttcaacgtgacgggcgagagggcggccccctttccggccgcaccccgtttcccaagacgaacggctctccgcaccggaccccggtcccgacggggacgacgcggggaccccgccgagcggggacggacggggacccggctatccggggccaaccgaggctccttcggcgctgccgtatcgttccgcctgggcgggattctgacttagaggcgttcagtcataatcccacagatggtagcttcgccccattggctcctcagccaagcacatacaccaaatgcctgtgatagagacatgagagggagggactgaaggtagaatcctatggactgaattgtgtctcctcatttagacgctgaaactctgaagtgcaatgagggcatatctgaagatacagctcacaaagagagagatacttaagtaagtcatatagtttgggacctgaatacaataggaccagtgtctttctaagaaaagatagccctcttagtgacactcatcacatgtgaggactcagagagactagtccttaccaaaaaataaccaacttacaactctgactttggacttctcagcttctagaaacataagaaaatcaatttctattgttggaccagtggtttcaattggcagtcaggtgcttgtccagcacacacaagaccctaagttcaattcccagcaacacacacacacacacacacacacacacacacacacacacaacctatttaagccacctaattaatctataatattctgttatggcagcctgaaaaacctgacacaaagtaactatttcaatagcttaccactgcagtgaatgtggagtaggtagatccttttcctttcaagtggacttgtgttgcaatattttaagagagaagccctactaggctactctaaattcactaata

SEQ ID NO: 2433 - DNA, 1000 bp, mus musculus
tgcagaacctcacaaaatagcaataatgaaaacacagcttagcagcatctatgtgctactgtagaagcagttgtcaaaaagaaatgaagctgcagatatagctcaatggttaagaatgttgcctgggggctggaaagatgcctcagtggtaaagagcactgtctgctcttccaggggtccgagttcaattcccagcaaccacatggtggctcacaaccatctatatttggacttgatgcctttttcagctatacaagcagatagagcactcatatatgtaaaataaataaatcttaacaaaaaaagagtgcttgcttgtggactccacctcttggtacagacccagcctagctcttccccatgaccctctcagcattgtcttctgttcaatctcctttcctttgtttacctttcttcagaaatactttctgccagggaccggcagtgaccacacttggctgggactcaggtgggcaggtttctctatccctcctgccccattatgatttgtccaaacttattcttagtcctgttgtaggagctccttttccacctgtctccagtccctaaggactcttgtgacagatccctgtccccagggacccctctcagcctttctttccagcctatctccattcctttctgtcacccaaggacctgcagaagcctctctagcaaggaccccacagccaccacacatgctgaggaggatcccgagagggcaacatcgtccagagaatgaaacaccaagccaacaaagacgagcccagatagcaataccaagaaacacctcagacatcataactctgacacctagatcccagtgcaaaaccacaaacaaaaaatgaacagtcaagactatatgcctcttctagaagcttgtaacattacagtgagcctcccccaaatgcaataaggctgaagcacaagacaacgacctcaaaatagcaattatgagtgttcaagtaccttaagcaggataaaaatcaatcccttgaag

SEQ ID NO: 2434 - DNA, 1200 bp, mus musculus
ctcttccccacctccaggagcctgcggttccccaccagcccccacaccctccacctccactgccgccgccgcctccaccactgggttcggccactttcacaaggcgctgggtggctccctgtcatcctctgactccccgctgctcaccccactgcaaccaggcgctcgctctccacaggctgcccagccaccacccccactgcctggggcccgaggaggtctgggactcctggagcacttcttgccgcccccaccctcctccaggtcaccatcatccagccctgggcagctgggccagcctcctggagagttgtccctaggtctggcagctggtccatcaagtacaccagagacacccccacggcctgagcgaccatccttcatggcaggggcctctggaggggcttctcctgtagcctttaccccccgaggaggcctcagtcctccgggccacagcccggggcccccaagaactttcccgagtgccccaccccgggcctctggctcccatggttccctgctcctgccacctgcatccagccctccacctccccaggtcccacagcgcaggggcacaccacccctcacccctggccgcctcacacaggacctgaagctcatctcagcctctcagccagccctcccccaggatggggcacagactctccgcagggcctcgcctcactcctcaggggagtcggtggctgccttctcactctaccccagagctgggggtggcagtgggagtagtgggggccttgggcctcctggaaggccatatggtgccatcccaggccaacatgtcactttgcctcggaagacatcctcaggttctttgccacccccactttctttgtttggggcaagagccgcctcttctggagggccccctctgactactgctgcaccccagagggaacctggcgctaggtctgagccagtacgctccaaactgccgtctaatttatgagctgggccctccctccctcttctttttcttgctcctttcttccttcaggtttaactgtgattaggagatataccaacaacaataataaccataaaaaaacataccccagaaaaacaaaaagacagcagaaaataaccaggtattcttagagctatagatttttggtcacttgcttttatagactattttaatactcagcactagagggagagagggagggagggagggag

SEQ ID NO: 2435 - DNA, 1000 bp, mus musculus
agttactttagggtgatgcctcagtttccccatctgtcagctgctctgtcatgctgttcaaatgattttgaagaaggctggcttttgcctgcaagctctggacccactaagagctcatggttgggagtggtttgcctctcgctgggcttggcctgcggaagagactgtgggttatgcactatctacagctgtgctcaaaatggcacatccctctgggttgtgaaggctttgcacgtctccttctgagacagattgtctcatcagaaataccaacatatctggatgatctgctaaaccagctaccagctaaatttgctgcctcccaaaatagttctgggatatctctaggacaggcccagccccaaacgcattcatgaaggcagccaagactgaatccagtactcccacaccctccaggcctacggctctgctgctctccagcccccaccccagacacccagtacccttgtccccagccctcgaccggctctcccttgaggagggacttaaagcctcaccacggcagagggatatagtattggccagcagtgggttcgaacaaactgcccatttcccaggaagatgcacatttgaacgtgcaatcaagtattaagttaaagaagataaattctagtggtgaattaatgtagcaagtagacattaaggaagggtattttgggatgtgatgacatccaagctcttctaaaattatatcacacacatgaatacagttggaacgtctacttccacagaggcaaccatctgacaggccttgcttggaggccccagacagcgcctatggctaggagccttagtgctctgcagagtccttgcatggactctccacagaatgccctcctggtacaagagggcccttccacggatcccttgtgtgtggatattcactctctttagccccagaagagcccctcttccttccatggctaacctctcagtacagattgatggatgtttcttgttagaaaaatcctgtgtgacc

SEQ ID NO: 2436 - DNA, 1000 bp, mus musculus
acttatgatcaaccccattttccaaaggaaactgttgggcacccttgctctcccagggctaactgatgtcagcagcatgagacaagccagccagattttctgtccacctcttcccaagtgcatctgaatgggccacagcaggaagagtggcttcaaatagcccccttaccaagtctcagggcttcctgtagggcagggctaaccagacctggcaagcaccctccctatcaccagggcatttttctgctgtgtacctttaggcctgagaggacagaattgaagtgacttggaaaaaaaaatgtggagaagccagagtgaccagtatttgccacacccttgcctgcacctgggtcccaagccctcatctacaacttccttaaggtggggctggagtgggcaggcagaggcctggggcctccagtccctgacctctgaccactttgtagaattaagcattcagagttttgctagctaaagtcccttctgataggacaaagaaggaaagaaggagactctaatcagatcacacaaagcctatctggctccatctctgaagcaggtggagaggaggctggctccaggcagggacaaaagtagcttggtgagaacctaggtgctcactgtggtgggggcagcaactggccttctgtgagtctcacaggatctagttaatgaactcttgtaccgaagacttgtcaccctctacagaagccacccaagggtgcttggtggctaatattttcaacttcacagcctctagaaacacccaggagacagacctctgtgtgtgtctatgagagagtttctgtggtttaactgaaaaaggaagagaggccattccatgggccggggccctggactgaatgcgaagaatgcgagccaagtagcagcgttcatctctgctccctgactgtggacacaatgcaacccactgccccatgttgtgccaccatgccttccttccctttcctggcgggttgtaccctcaaagcataatcca

SEQ ID NO: 2437 - DNA, 1200 bp, mus musculus
ccgatttggaaaaaccataaccccaaattgattccagcttttaagtacaggactcaggaaatagcagcaagccatggggcttagtccatttggtttcttcttcgcctcttaaaaatactgctgttagttttccttcctctttaaaaaacagccagttcgttattttaaattagccaagaatgagggctcatttcatgttggctcctcctacccttcccaagcccgtctgtgttttgtgacctcacctggcttgggctgccttcctcccagtgctacggacaagatggggtctgtgctggctgggtgattcaaggctactgttagcttggagcattagttcagactgtgaggtggactttggtctaggaattggttttattgtttgcttattttctctgtgagaaattgatgtgaagacaaagccttagattttaatagctcctctgtcctgctgcgcgcccacctgggctgtcatggtgtgaggaacattgtatgtagctggctgctatggagttagcactaaataaagcgttgtaactgaaagtggaagtgaggcaggattgccaatttgttaaagaggtcaaaggtcagtttcagacatgggcacagatctgttcctttaagagaaatgactgacgcttgggcaaaaatgtaaggcaggggttggagagatggctcagtatgtaaagttcttgctggacatacaaggatttcaaagaccagcacccactgctgggtgtggccacacaagagggaggcatggctttaggcatggttgcaggtgcactcataacctcaggagagtcacaggggcctcctggacaccagcatagccagctgaaggtttgatgagagacgctgtctcaagggaataaggtggagagcggtaggtgtcctctccagcctctgtgtgtatatacagtgtgcaagctgcacaccctagtgcacatagaacacactcattcttcacctctgaataaggtgaaggtggtggggatggtgtggggtaggggagcttggctgggaaccttttcagtcacctctcccggttgtaaatgtgtggtgcagggaccagcgtgttcctacggctctgtgaccatagttctgtgtgttctgtgaccatagttctgtgtgttgtaaatgtgtggtgcagggaccagcatgttcctacggctctgtggccatagttctgtgtgttct

SEQ ID NO: 2438 - DNA, 1200 bp, mus musculus
caggacagccagggatacactgagaaaccctgtctcaaaaaactaaaaaaataaaatcacaaaaaatgtaaaatgatatgaatacgtaaagcagttgataaccaaggacttttggctctcaaggacattagcccaggccgtagctcattctgatagccaggatagccttggggttgtgcatatgtggctgtggacagatctggaaatattccctcactgggatacacttacacacaataactcacactcacacacccacattacttcatgctttcatacactcccacaaacagtcacacaccctcacactcaaactcccactcacaacacacactgaagcacactctcagatgtacacgtgttcaaacacatacttaggtatgaactcactcatgcactcatccacatacacccaaaacacatatgtatggatgctgccacgtatgcaaacaacctcttgtgccctcacactcaagcacactgacttgacacccatgctaacactaacatccttgtttgcttcctgttgctgtgataaacaccatggtgagaaaaaagcaacccctgaggaagaaagggtttacttcatcttacagtcccaagactcagttgaccattgaggagagtcagagcaggaactaagcaaaggccgtggacagccaccactcactggcttgctcagcctgcctttttatacatcccagtactacccacagtgagctgggccctccagcatcagttgtcaatcaagaaaatacctcacggacttgcccacagactggcctgatggaggaggcaattcctcaactgagattccttcttccccgatgattctagcctgtgtcaaattaacaaaacccaacgaccacagaagccaaggcaggactccatcggggcaagagcctaaagcagaatctgtggagaaacactgctgactggctcgttctcggattcaagcctaggggatagtgccacccatagtggcctgaacctctcacaacaattaacatgccccactgacacagacccatatgaggcaattcctcttcccaggtgtgacaaattgacaattaggacgagctatcacgctcctgtactctctctggtgtgcacattcaaacacactcgtgtatacacatcctcacacactttcacataccgattcccatactccccaaactccaacgtgctcaccccaac

SEQ ID NO: 2439 - DNA, 1600 bp, mus musculus
ttcagcatttgaagttcaatccttagcaatgaagaaaaacaaaaaccaaaaaaccttagcagttttaaacttcacctaataaagagttaataaaattctagttaaacatacagtatattgaaaggttcaaggccagcctggcctacagagcaagttccaggacagccagggctacacagtggaaaaaaacaaaaacaaaaaaacaaaaagtgatacaggatggtattacatgcatattaccataaagaaaaaaatacacctgaatgattttactatcatatactgaaaaaacaagtattaagtagaaggcagaattttcataaacagtacaagttatttataccactatatagtcgagttagaaaatgtgtaatgttgaagcttgctattccatattctgcttgctctagtaaaaaaaacaaacatacaacagggttttttctttttctttttttattgggtattttatttatttacatttaaaatgttatcccttttcctggtttcccctccagaaaccccctatctcatcctccctccccctgcttttatgagggtgctccccctccaacccatccactcctgcttccctgccctggcattcccttacaccaggccaatgcaccttcacaggaccaaggacctctcctcccactgatgtccaacaaggccagcctctgctacatatgtggctggagccatgggttcctccatgtgtactctttggttggtggtttagtccctgggagctctgggaagtctggttgattgatgttgttcttcctatggggttgcaaaccccttcagctccttcaatcctttctctaactgctccattggggactccgtgctcagtccaatggttggctgcaagcatccacctctgtatttgtcaggctctggcagagcctctcaggaagcagccctatcaggctcctgtcagcaagcacttcttggcatccacaatagtgtctgagtttggtgactctatatgggatggattcctcagtggggcagtctctggatggtctttgtttcagtctttgctccacactttgtctcagtatctcctcccatgggcattttgttcccccttctaagaaggactgaagtatccatggtcttccttcttcttgagcttcatttggtctatgaattctatgttgggtgttccgagattctgggctaatattcacttattattataagtgtgttcttttgtgattgggttacttcattcacgatgatattttctagttccatccatttacctaagaatttcataaattcatcatttttaatagctgagtagtatttcattgtgtaaatgtaccacatttcttgtatccattcctctattgagggacatctgggttctttccagcttctggctattataaataaggttgctatgaacatagtggagcatgtgtccttattacatgctggagcatcttctgggtatatgtccaggaatggtatagctgtatcctccggtagtactatgtccaattttctgaggaaccgccggactgatttccagagtggttgtaccagcttgcaatcccaccagcagtggaggaatgttcctctttctcta

SEQ ID NO: 2440 - DNA, 1000 bp, mus musculus
ggtatgttcttcccagaggaaaactatctctcccatttccggttttcctcagttccctacaactctgcattttggttggttgtggttttctgccgtctccatctattgctaagagaaattcccttgaggagtgcttggctttctaacatggcttctggggtgttgaacacaggcttgtatgcatttgcttcactggtgagctctccccagcctctgactgaacctgagtaaccctcttcctcattccagctccaattgcctatcccatagggcatttatcttagaagacatctaactctaaattctgcctttgtccttttgagatataagcctttaaaaagcttcttgtaagttctatagtctagaaatgctttcttaaggacctaatatttatccctttgaagtgtgatcctcaagggccatagtgccctcgagcccagtctttgtgggagagtaggcacccaacttcaatgggcgccacttagcaagcccagtgacccggtcactgaagacgggcacacacttgggtagctccgcatttgacacctgacattcctagtactttcagctagcttaccccagggctgaagaacacttctgccctttgtttctttgtagttgagtttagacctcaattttgccattctcgagtacttcagtgcatacctttgtcctccaattgtgtgcctttactcagaagagtttaaaataagactggagagatgactcagtagataagagcgcttcctgctcttgcagaggtcctgagttcagctcccagttccaatgcctcagagctgcttgcaactccagcttcaggggatatgatgctcttgattggcctctgtgggcacttatacctatgaagcatgcatgcacatgcatgcatacacacatgcataaacaaatacaaatctaacaaaacaaacaaacaaacaaacaaccttaaaatagccaggtgcgccagagtgtgcctgtaacctagtacttgggaggtgga

SEQ ID NO: 2441 - DNA, 1400 bp, mus musculus
ctctggacttcatttgcccctcatgtctgcccatttttattacttagatgtttagggagtctttacttttagtcccattgcgttttgttgcaatgctcaataccagactgtaaggatggcagaaaggaagaacagacagccacttttctcaacaaggatagttcttgtaatattagcagtggggacaatttgcccctaaggccttctgaatttctagggtgtgtcaatgtaattgggtcatatctgcagtattgatattgtgtgttcaaacactctgcaagtgggttttaattaattaccgattatatttgctttcattataagagttgctgtcatacatatgtgtgggaatctgtgtgacatatcaaatcttgtctgatctcagggctgcaaccctcctttatccacacggagtgcactgagatcagcaattgactggtaatattaaaaatcttggtgacagctgccaatttccatagtttcataaagatcctttgtctagctggagattgggcgaatgccaacataatgtacagttcctccaaacccaccttagagcacaaactatctgcagattctcctcatcccacggctcacacccaacttacagagatacttactttatgcccttgcccttgcctctgtagttttccctggcctgaccaatgtgtgttctctgcagtcaaggacccacactggataccacttgccttggcctgcagagctttggaatgaagaagtgacagattataaacagaaaagctgggattgggtgggtcatgtgttttgatggagacataccagcagcagccgggaaactcagaacttattatatccaggcgaacaagatggaggtgtgctaagtaatcctgatagggggtctctggagggagcagtctcagcctgtattcatcctggaggaggaagctgcggttgatactttctgcacatgttgtcaacattcatacttcaacttggggaggacttaccattcctctaagcttgacccagggaccatcttgccattcctctagcctaatcgaggggagtccttgctattcccatgaatcactgcgatccttgacatggctgggctcgtgtcaataacacagattccctcaagacttcatcctctccccacattttctgggtcacttgaatgccccagagttaatcattcccagtttaaacaatatttagaatgttattttgtgatcatagttttattctcaaatgctgaatgattaatgtatgctaaattttatatagtaacctcttgggagaaattagaaaggacattttttgtgtgaaaatatttatacttcagttgaaaatctcaactaaaaatgaaaagatataggagaagcggaacttttagaataattgttggactaagaaag

SEQ ID NO: 2442 - DNA, 1000 bp, mus musculus
ctattagtgttctttaaatttattatttcttttgagtactctcttagaatgtatatctcatgtagactcctgttaccaattacacccacctttttgaccctgaacctctccacggagggactcaagacccataccagcaactccacccatatctgcaacctgcctaaggaacccatattacaactgtctttttgcatatactgtccaggtagggatctctaactggtgccactagccccatccacttgtgttggaatgccatttccccacccctaacctgggatccttggtaccctgacaaatcaactctgcccactcttatttatctttagataaataaatctagtctcttctctaaaaatacatcagattcatgcaggaaattatactgactcctctgaccccagcacccctactttccatggggagcgaaggattcagctctgcaaatgtttagaggaccatatgtcaggcatctgctctccaccccactcagttcttgcctttctctttagatactatatcccagactaatacaactgattagttgtattagaaaaagagaaaaagttgtattagaaaatacaactgattagttaacaattagaaaatacaactgattagttgtattagaaaaagagaaaaagttgtattagaaaaagagaaaaagtctagaaccctttctcaaggttcctatgacagactatgagaattcaccatctctacaaaatgtctgctcctaggtttagaaaccttatatagctttaactgaactgagattgctcctgaaagcatatttaatcatgaacactgaataggccaaaacctgaaccctaagccacatgtagctggccaatcatctgacaagttggagtagcaacaacaacaacaacaacaacaaaaattagaatttcaaatacctattcaacaaactagagacaatatttccatataaagaaagaggaccaaggactttacccagatgcccatataccatcac

SEQ ID NO: 2443 - DNA, 1000 bp, mus musculus
agaataaagtatagcccataagaatacgaaacacaatattctctgagagttgagtttaggaaactgagaatataagacaactggaaaaagtagtcttttaaatgctgtcataaaattgcaggttacagtgaggtattcagttgagtgtttcaaaggtgaatctgaatggacatgtgagacacttgagggctgtgtggaagaactcccgtgcttctctgtcacgatgggtgaattgtgtcatctatgagggatgaggtgcagatctgcactgtcactactgagctcctttctccgtagaatcaatgtccagtgtctgcttgcgacattaaccagcctcaccaggcttctccatccagtttgtgagtcttcatcccatcatcattctttgccagacctgtctttgttttggtcttctttgagacagtgatacaggcagagttttaggcaatacatccacacaaagctctctctacttctatcttagttaagtcactgttccaagtatcctttcagtggtccacacaaagcaaggaagtgcctctgaataaattctggttcccagaactaacagaaataaacaggttctgctgacactgattctaaaaattctcacaattctgtgtcacccaagtcattgtgtcataagctattttgaatctaagcatcttcatttccatattggtcaactgacacagcatacaagtcaataaagactggcttatgtcatattccaatataggactttctaactttcctaaaataaaattcaaatccttgcctaaccttagagaatgctcttatatgtttttatcccaggatggcaatgggatcttcttgcctcaatctcttgaacgctagggttactagcaagtgccaccattcccagattatttttttggttcttcctggatatcttaccactggcctaagatattcaatcatacatttctcagacccttttgtccccagatctttgcagttgctctttcctggtaatact

SEQ ID NO: 2444 - DNA, 1000 bp, mus musculus
tgtaaattattttttcttttttattaattaattaattaattaatttttttacactccatattttatccccccttccctgtccaccctctgactgttccacatcccatacctcttccccatccccctgtctccacttggatgtctccatgccccaccctcctgacctctaaactccctggggcctccagtctcttgagggttaggtgcatcatctctgaatgaacacagacccaacagtcctctactgtatgtgtgttggggacctcatatcagctggtgtatactgcctgtttagtggtccaatgtttaagagatctcaggggatgggggtggggaggggagttccagattaattgagactactggtcctcctacaggattgtccttctcctcagcttctttcagacttccctaattcaacaacaagggtcacctgcttctgtccattggttgggtgcaaatatctgcatctgactctttcagctgcttgttcgatattctgcagtacagtcatttttggtccctttttgtgagtgctccatagcttcagtaatagtgtcaggccttgggaccttcccttgagctggatcccactttgggcctgtcactagaccttcttttcctcaggctcctctccattcccatccctgtagttctttcagacaggtacaattatgggtcagagttttgactgtggaatggcaacccctccctcatttgatgccctgtcttcctgctggaaatggatcttataagttccctctccctactattgggcatttcatctaaggtccctccctttgattcctgaaagactcttacctcccaggtctctggttcattctggaaggactcccaacctcctgccttcctaggttgcctgtttccattcttgctgctggccctcagggcttccatcattttcccttacccaataccagatcaggtccctcttatcctgtccactttctctcaggtccttctctccctccccagactt

SEQ ID NO: 2445 - DNA, 1200 bp, mus musculus
tacaagatacccatgctataatctacagacccaagaaactgaacgagaaggaaggcacaaaggaggatgcttgactctcacttagaaatgggagaaaatagtcataagaggcaggtggagggaggggcctgggtgggagagggaatggagagaggaagtggggttcaggattaggtgtggggaaagacaggagagatggccagatggctatgagaatgaatggaaatttgcaaatgtcagggatggggaagtggagagcatctccaggaggagatagaggcctggcataaaagaggtgcccaagaatcaatgggtgtgacattagctgtgaagtccagcattagagatatggaatctgaagaggttacctgaagttcacgaagaggaacctgaagaggcaggacccccagtggagcaataggaacaccaacctacccacaaaactttctacccaaagtatatcctctctaaaagaaacacaggggcagggggtagagaagagactatggaatggccaaccaattaactggcccaacttgagacacatcccatgggcaagcaccaatctctgatactgtttatgatactctgttatacatgaagacaggagtctatcatgtatgttctatgagagaaggatgcagacacccacagcaaaacattggatggagtttggggactcttatggaagaatagggggaaggatttcaagccctgaaggggatagcaactccacaggaagaccaacagattcaactaacctggacctttggggctctcagagactgaaccaacaagcatgtatagattggacctcagcctccccacacatatgtaacagatgtgcagcttgatctttatgtaggtgagtcccaaacaacttgagcagtgactatcccaaaagctgtttcttgtccataggatatgttcttctagctggactgctttgtctggtctcagtggaagaggatatgcctaaccccacagtaacttgatgttccaggttggagagatacccagggggccccacctgctcagaggagaatgggaggggcaggggaaattgttagaggggatgacagggagggcagcagagagaaggatgtaaagtgaataaattaaaaaagagaatatggaagtcaggataatataataaagactgggaggaatataggaggaaaaagttacactaaggatgct

SEQ ID NO: 2446 - DNA, 1000 bp, mus musculus
aaagttgtgtggctagaaatgagaaatatcttgaaagagttggggaatggaaataatataaacaaaatataacatagaaattaaaattatttgtcatgatctctttacgatagccgtgtcagagttgacgagtagtagctcatcatctaaaagcagtgcttcccattttttccttagtgggaagaaaggttagaccccttacaggaccgagaaagaaaggccattaaggctaatcaacaacacataatgaatgctactgacttcctaggttttcctagggatgttttcttacatagttaagcttgtcaatgtcctgccgagatggagagcggtgtaaagaggggtaccactgagtactcagtagttgagattccttgtcagcttgatctgattttgaaatctcttaggagacactgctggtgtggctatgggagtacctccagaaaggcttaactgatgagggcagaggacccacctggatgtaggcagcagaattcagtgaactggggttccaagcaaaagacaagataggagaagcctcattggtgacagcatccatcttctttctgcttcctgactgacagtacagtttagcaggctgcctcacactccagctgccttgccttactgagcatgttaaactgcacactcaaaccacaagccagaataaaccctttctctcttaaattgccttaggcaagtatttggctacaacaataaataactatctataataattaaaatatttatcctttcttctcctttggacaaaatagtcatttaatagttatcaagaaagaaaggatgatatgttgacctcacttccaggtgcttattcttgccctcattttcctatgaaatgatttggtctcctgaagtctatccaaaggaaattaaatagatttataggaaaggcttcagtatagcccacaggtacaaaacccattgacccttaataaacggccagtagccatatcttctaaagcatatacagtgatct

SEQ ID NO: 2447 - DNA, 1000 bp, mus musculus
atcatcccttcaataaacattgagtgaattgtggcaaaaattgcaagagcccactttgcaatcaggaagcctactgtgaaacagtctctcttagaaatgactacatagatcttgggtgcccagattcctccaagactggtctgtgcagttgagagtatggactgcagaggctaacagcttctggggcagaccttgtttcagactccagacacccgggcaccttccctgccagaggagaggtgtccaccccacacaggagggctgtgctacagcatctgggggagccatcttggttccgggattctgcctagactagtctgcacagcggagagtgtggactacagaagctacacagatttttgggaaaagccctgctactggccttcatcttctaccaggaagcaggtacaattgccagatatctgtccaccttccctgcaagaggagaccttgcctgcagagagtgctctaaccactgaaactcaggagagagctagtcttccaggtctgctgatagaggctaacagaatcacgagaggaacaagctctaacaagagacaactataacaactaactccagcaaaaggcaaacgtaagaatcttactaacagaaaccaagaccactcaccatcatcagaacccagcactcacacctcagcaagacccgtgtactccaacacacccgaaaagctagacccggatttaaaagcatatctcatgatgatggtagaggacatcaagaaaaactttaataacttacttaaagaaatacagaacactgccaaagagttacaaatccttaaagaaaaacaggaaaacacatccaaacaggtgatggaaatgaacaaagccatactagaactaaaaggggaagtagacacaataaagaaaacccaaagtgaggcaacaatggagatagaagccctaggaaagaaatctggaagcatagattcgagcatcagcaacagaatacaagagatgaaagagagaatctcaggtg

SEQ ID NO: 2448 - DNA, 1000 bp, mus musculus
ataaatactgagacatgaaagcactaagtgcatcaaacaaaacggaaattaggttaaaagtctaacaaaagttttctagatggcagggtacaaggagccggggcttttggagtcacattgtggtgtccctgaccacctagtgccaagacgctgaggttagacgcggccaggtctccctgagccaggcaaacgcaagagcaagccaaaggggtgcccggatcccagccgcctacaggctggaaaccctggcacccagccgagccacccctcccccacagctgggttgttctgggacgtgtgctttagaaaccttagaaccaaacgcaaacagcagggtcctctagatcgagtgagcacccactaggggtcagtttctgcttgtcactcatcccccgcccacccacctcccctagctactggcagtttgaaggttggctcctttgtctgaaagtctgcctacccaacctaatctgctcaaaaagaaaagaaaggaaaaccagacgctcggggctggcagtgttggagtcttttatttcatgttgtcaccaaggtcacagtcctgacccaggtgatccgctgctgatcctgtaaaggtgtccatattctgaggttcctggtgtccagatgtcgggaatcctcttgtcagagctggatacagttgttgccctatccaggggactgatcgtcaaggaaggcggcagtgcaggtggcagtgtggacagcacactgcagagacaagcgcaaggagaccacacagcactgtacagaatagtggaagcagaataaacgagctggacctttaaagttcagaaacggacacacctcagaaggcaggtgtttctctgaagaagagaaagcacctgagaagtgcagagaaaacagaccaagcaacagaagcaggagatgaaagtcttttcctttcttgaactctgcagtttcacttgtcataggagaagtaaaagcattttaccttctgcctcaatggaagacaggagtaggg

SEQ ID NO: 2449 - DNA, 1200 bp, mus musculus
aatctggtgggctaaaagcctttctaattcatgcaggagctacaggagactaaacctgtagtctttagaatatttggggaccactcatggaaagtttgtctgtaaaaagactagtctctgggaagcagagatctgtaagaatgagtgaactaaaatctggtcaaaaacttcatgaatttgtaagaagagaacagacatcgtggagatgaagtttcagattctactttctcccacttaagctttgcttttcttgtttgtaaaatatgggataataaaaatttcataaagtaaaaaaaaggaggagggggaccctatttgctttacaattgcacagttttcctgagaccactacaatcagtatattctttttggtctgttcatgtttcactcatgtgtaggtatatcatacttaaagacactgctgaatgctaccagtggccaaaaaggtttcaccaaattcacaaatgaagcagctgagcaagataggtagatgaaggtttattgttcagtcctacccttcaggagaacaaatgcatagatttttgaaaagaaagtagggtgacatgaccaagccagctcagtcagccaaacagggtctcaagggagagagtgaagattgaacagaaaaagaaaattagacaatgttataacgtaactccagccactgctgagactgaagcgggtttatttttctccagcctgcttttatagcattctaagtacatgcaaagaataaggtcagttctaggtcaaagaacagagagggtaataaacaaaaataatcaagaaacaaacaaggcaataaacaaagtcccctggtattcagggacttatcaagatgattaagaccttgagcttaattctttgtcctaccccaatgtcaaactcctgccaaattcctagaaagcagctccaaaagctctccacagtgatgcaatgtatagcattggcataaaataatagtttttcttcttatccacaaatgttatatgcagatttcagaactcccaatggctacaaatataacattctatatgtgcagcagccttataagatctgtacatgttacattaattttcacaataaacacgacatcatcatcagtattatgattgtcactgtcatctccatttccaaatgaagacactgaagcactagactagaaaagagtgacatttcatgttatagatgggttaaaga

SEQ ID NO: 2450 - DNA, 1000 bp, mus musculus
tacctttcaaatgctatcctatttcctggtttctactctgaaaaccccctttctcattcccctgcctttgctcactagccaacctactcccactccccagtcctgggattctcttacactggggcatccagtcatctcaggaccaaggcctctcttcccattgatgtccaacaaggccatcctctgctacatttgcagctgaaatcataggtccatccatgtatactctttgattggtgatttagtccctgggagctcttggggtactggttggttcatgttgttgttccttcaatggggctgcatgctccttcagctcctttggtactttctgtagcttctccattggggatcttgtgctcagtccaatggttggctgagagtatccacttctgtatttgtcaggcactagcagagcctctcagctatatcaggttcctgtcagcaagcacttgttggcctccacaatagtatctggatttggtgtctatatatggggtggggctgactctagtctttcctttagtttctgctacatactttgtctctgtacctcatcccataagcatttcattcttcattctacaaaggaccaaagtattcatactttggtcttccttctttttgagcttcagttggtctgtgaattgtatgttgggtattccgagtttctgggctaatatccacttaaaagtgaaggtatcatgtgtgttcttttgtgattggattaccttgctcatgatgatattttctagttccatccatttgcctaagaatttcatgaattcattgtttttaacagctgagtagtattccattgtgtaaatgtaccacattttctatatccatttctctgttgagggacatgtgggttctttccagcttctggcttttataaatatggctgatatgaccatagtagaacatgtgtccttatttcctgttgaagcatattctgggtatatgcccaggagtggtattgctgggtcctcaggtagta

SEQ ID NO: 2451 - DNA, 1000 bp, mus musculus
atttatttattgattgatttattttacactacagattttattccctgtcccagtccacattccatacctcctccacctcctccatctccacgaggatgcccccacctcccaccccccaccaaaacagtcctctaaactccctggagcctccagtctcttgagggttaggtgcatcttctcttctctggctaaacacagtcccagcagttctctgctgtatatgtgttgtggacctcatatcagctggtatatactgcctggttggtgttccagtgtttgaaagatctcaagagtccaggttaattgagactgcgtgtcctcctacagggtcaccctccttctcagcctcttccagcttttctctaattcaaccacagggattaggagtgtctgttagctgggtgcaaatatatacatctgactctttcagctgcttgttgggtcttctggcatgtggtcatgataggtccctttttgtgagtgctccatagcctcagtaatactatcagaccttgaggtgtccccttgagctggatcccactttgggcctgtctctggactgacttttcctcaggatcctcttcatttccatccctgcagttctttcagacaggaacaattatgggtcaaagttgttcctgtggaatgacagccccatccttcacttggtgttctgtattcctgatggaggtgggctctataagttccttctccctgctgtgggcatttcatctaaggtccctccttttgaatcctgcaagtctttcttacctcccaggtctctggtgcattctggagggttactcccaaactcctaactcctgaggttgcctgtttccactctctctgctggccctcagggcttcagtccttttccctcacccagtaacagatcatgttcccttctctgccccccactcccctgcccactttccatcccaggtccctccctctctcccccttgtgattgctttctttataaaacagttaatttgtgtta

SEQ ID NO: 2452 - DNA, 1000 bp, mus musculus
acccccacccacacacccactcctcaaccacctctttagaatcaccctatgctggggtatcaaacctccactggacccagggcctcccctcacattgatgtcagacaaggccagcctctgatacatatgtatctggagccatggaggcctccatgtacacttcttggttggtggtctagtcctgggaacactctgtggtctggccaacctacattgttctttctatcagttgcaatctccctccgcacctccagttcttctcccagatcccccatcagggtccctgagctcattctgatagttggctctgagcatttgcatctgcattagtcagatgctggcagaacctcccaaggaaaagccacgccaggttcctatcagcaagcacctcttggcaacagcaacagtgtcagggcttggtgtctgcagacagaattgatccccatgtgaggtggtcactgaatggcccttactttaatctctgctccattttgtttttatttttttaatttttgtccctgtctttcctgcgacaggaagttttctgggttgaaaattttgagatgagtaagtggccccatccctcaactgggggccatcctatctactggagggtgtctctacaggttctatctctacttcgctgagcattttggctaacatcatctcccactgggtcctgggaacctctcacttccctggtgtctgggatcccccaatggatgccccaagttccttatcccccactgctacatatttttatttaatttcctgacccagtgtacctctctccttctctgtccaatacctgatcctgccccccttttccctccccctcctctgtccctcccagggctccccatccctccacctcctgatcatcctgtgccccccatatgcaaaactgaagcatccacaccctggtcttccttcctcctaagctccatatggactgtgggttgtttcgtgggcactactgagcatatacccaaaagatgct

SEQ ID NO: 2453 - DNA, 1000 bp, mus musculus
caccctggggcctccagtcttttgagggttaggtgcatcttccctgactgaacccagacccagcagtcctctgctgtatatgtgttgggggcctcaggtcagctggtgtatgctgcctggttggtggtccagtttttgagaggtctcaggtgtccagattaattaagtttgctggtcctcttacagagttgttcttctcctcagcttctttcaggcttccctaattcaacaacaggggtcagctgcttctgtgcaatggttgggtgcaaatatctgcatctgactctttcagctgcttgttgggtcttcctgggtagggtcatgctaggtccctttttgtgagtactccatagcctcagtaatagtgtcaggccttgggacctccccttgagctggatcccactttgggcctgtctctggaccttcttttcctcaggctcctttccctgtaattctttcagataggaacaattataggtcagagatgtgactgtgggatggcaaccccatccctcatttgatgtcctaaccccatccctcatttgatgtcctgtcttcctgctgaaggtgggccatataagttctctctccctactgtctaacatttcatctaaggtccctccctttgagtcctaggagtctctcacctcccaggtctcttgtacattctggagggtcccccctcctatttcctgaggttgcctatttacattctttctgctggccctcaggacttcagtccttttccctcatccaatactggatcaggttcctgtcttccctccactcacctacctcctccactttccctcccaggtccctccctccctccccacttgtgattgttttcttctctctcccaagtggggttgaggcattctcacttgagcagttcagattgttgacatttttgagttctatggactgtgtcttgggtattctgcacttttttttttggctaatattcacttactagtgagtatataccatgcatatcctt

SEQ ID NO: 2454 - DNA, 1200 bp, mus musculus
tgagccaatagaaggactagaattcttctgagtcacttttaaaagtgtgtgatggtacagcccttttggaaaacaatctacaagtcatctgttcagttaagtcttcacttactatataactcagtaattctcactctactgtatttatcactaaatgaaaacatgagtctgaacaaatccatgaatgattaaattggatagaagctttcgttattgttgcctgaaacttgtcttggtaataccttggcttcatcagaaggtgagttgttataattaattttggtccagctacaggcccaaagtgggatacagcgcaaagggggttcccaaggcctgacactattactgaggctacggagagctcacaaaaaggaatctatcatgactgccctccgaaagaccaacaagcagctgaaagagtcagatgcagatatttgcacccaaccaatgggcagaaggagctgaccctgttgtggaattagggaaggctgaaagaagctgaggagaagggcgaccctgtaggagaaccagccctctcaattaatctggacccctgagatctctcaaacactggaccaccaaacagacagtatacaccagctgatatgaggcctccaacacacatacagtagaggacttccaggtctgtgttcattcagagatgatgcacctaaccctcaagaaattggaggccccagggagtttagaggtcagatgggttggaggtggggcattcatgtggagacagggttgggtggagaggagggaggtatgggatgggggcagagaatggaatatggagtgtaaaaaaataaattaaaaaaaaccacaactaattttgggccatacacagtggaattctacaaacagtagggaaaaccctaacatagaaaacaagctaaaaaaatatgccagtaattgtagccaggcataagagcaaacacaccattgtgctttttgtcaatatgcagaactagtctccagtgttagaaactaagtagtggtaggctgattgggtgcagctgactacaaagttttgggataacatcctgatggtaatggggatcttttgaattttgtcaaacttcattatcttaagatgggtttgtattattttatgtaaatttttaccaaataaagattatagaaatgtttttaaatgtcatttatgtctggcacaggtataaagttaaatatttt

SEQ ID NO: 2455 - DNA, 1400 bp, mus musculus
gtctagcttttcaggtgtgttggggtgccctggagagggcgaagtgggagtgctgggttctgatgatggtgagtggtcttggttcctgttagtaagattcctgcgtttacctttcgccatctggtaatctctggagttagttgttatagttgactctgtttagagattgttcttctggtgattctgttaccgtctatcagcagacctgggagacagactctctcctctgagtttcagtgctcagagcactctaggctggcaagctctcctcttacagggaaggtgcacagatatcttgcgtttggacctcctcctggccgaagaagaaggcccaaaacaggacctatcccagaagctgtgttgctttggcaggtcccagaagctgtcagcttctgtggtgcacactctcacctatacagactaagttcctaaattgggcggagacccggaaccaagatggcgtccgctgctcctgaggcacagggcttctgagccaggcagacacctgtcctctggccgggagggtggccggccgtctgtggcccgaaaagggtgctgcctcagcagctctgtagctcctgcctgtcccagaagctgtccgcttctgtggtgtacactctcacctgtgcagactaagttcctaagttcggcctagtcccagaaccaatatattttcaaatgtttgttttgtatctactgatattatcatgtgcttttctttttcaaacattttatatagtgagttatgttaatttttgatatataactagacttgaatgcctggagtaaatgttaaattccattttaaacatattaaattttacttgatcgtaacttgttaaggatttttgtgtttggatttctactcataaaacataaggactctgggtttcatttgagtaatgtgtgtgtgtgtgtgtgtgtgtgtgtgtgtgtgtgtgtgcgcacgcgtgcacgcgtgtgtgcatgcgtgctgtgtatacagggtcttgtgtatgttaagatgtgtatatgcatgtggaagtcaaaggacaacctcaggtatcctcagcaatagcatcaacctccttagattcaagcactctctttagccctgaacttagaaattgggctaattggcctgtcagagagcctccaccatcctttctctcagtccctctactactagaattccttgcacatgtctccattcctagctcttttacatgggtttttaaagaatcaaattcaaggctttacacttgataagtacggggtttactgacttggagatcagcctagcctaggctttcagttgcagtttccttgaattttcttttttttaaaatattttttattacatattttcctcaattacatttccaatgatatcccaaaagtcccccataccctcccccccc

SEQ ID NO: 2456 - DNA, 1000 bp, mus musculus
aatcctaccccagcctcccaagctactgggactacaggcgcgggccaccatgcccagctggttttgttcatttccatcacctgtttggatgtgttttcctgtttttctttaaggacttctacctgtttggttgtgttctcctgtttttctttaaggacttgccacactttagcagtgttctcctgtatttctttaagtgagttattaaagtccttcttgatgtcctctaccatcatcatgagatatgcctttaaatccaagtctagctttttgggtgtgttgggggtgcccaggacttgttgaggtgggaatgctgggttctgatgatggtgagtggtcttggtttttattagtaagattcttatgtctgtttttctccatctgataatctggactcagttgctatagttgtctctggttagagcttgttccttttgtgattctgttagcctctaccagcagacctgggagactagctctctcctgggtttcagtggttagagcactctctgcaggcaagctctcctcttgcagagaaggtgcacagatatctggcatttggacttgcctcctggcagaagatgaaagctcaaaaaagggcctgtcccagaagctgttagcttctgtagtccatactctcacctgtgcagactagtctcggtgggatctgggaaccaagatggctcccacagatgctcaggcaaagccctcctgggcagggtagacacctctcctctggcagggacggtgcccagatgtctagagcccaaaaaggagtctgccttagaagctctgtggctcctgcctgtcccataagctgttagcttctgtagtccacacactcacttgcacagactagtctccacaggatcagggaacaaagatggctcccgcagatcctgcctttatatgttacttgacatttttccattactgcttttaataatctatctttatttagtgcatttgttgttctgattattatgtgtcaggaggaatt

SEQ ID NO: 2457 - DNA, 1000 bp, mus musculus
gcacacaagctacataggggccagaagaaggcactggatcccctgggaactggagtgacagacagttttgagccaccatgtgagtgctaagaactgaacctggctcctctacaacatcactgtgcttaaccactgagccatctcgccagccctgatacacagtgtcgatgcaagaagtttcctagagatgtcaacggatcttgcatgaatagttcacaatgttctgaatatatccaggtactgcaactagaaacactgctgtttgtacttctgacatgttgcagggagagcttcagtgcttagctggatggtagctggtaaaaaccatgacttggtccctgcttgatttattgctggtccccgtcctttgcacttagatttattattgatagctgtgatcacacgatccctggtaaggagctgtggcccgttctgaactgtgtttataaatattcttagactgacttccagcagcaattggtctatgttgctgaatctgtttgagatctgcctcagatgcagtctcttgcctgtaagctcttaatgatgattacacctgctaagtacatcatctttcaggggctgtaatcttcccaggagccttgccacttactaggtatcagcaactcctgacactatcttttgtctgaacttcaactggccactatggaggtttccacacatccaccctcagctgctgcttcccacacagctgtgtttatggggaaccattgtaaggaaagggggctggccagtgaagcaactaactgctggagcgtctcaagggcagaaagtcagtgatacctgtgagttccaggtctcactctgcaaagtcgggcacagccctctgtagcttgatacctggcggagcccagacttggccagcttctgtgaggcctcttatacacagacagccacggtgtctttcagaagacagcaatcagcagaattgtttgagagattaatcggagttccctttgtgatgctagagatctcttgg

SEQ ID NO: 2458 - DNA, 1000 bp, mus musculus
agcttagctcttcaggcttcctgccaaaggtctttcatcacagtcgcctcaatagctaggtttcttatttgtgcgtgatgctctttgaggtaaaagtttcactgtgatacttctagctggcctggactttgcaccattaaccttgaatctgaattaactccagatctgcctagctctgcctcaaagtgctggtatataaggctcataccaccactgtgctatccctgatcccaaagtctttaagcttagtcttgaagttgaggaaactacctcccgagagtttgattaacacctggacataatggtaaatcaggaatttattgtatatgtatggactacactagtgagaccataaacaggttacagcaggactagaagcctctgcatggaccatccctgcctatggagatcaggctggccttgaactcacagaaatctgcctgcctttgcctcttgagtaatggaagtgaaggtctgctccagcatgcgcaggctgcagatgacattccttgggtttggtggaagttactgttgtgatcatactttagaaaaggtgaaggatttaccttgttataggtatggctacactgcggccccgacagcccaggatgactttgctttaaccacacacagtctccaaatgctaacaaagcaacctcattgtttgggttttgttattaaaacagggtctctaagtaacactgcctgctctagaatgctctatgcagaccaggttggccctcaaatctcagagatccacctgtcttcttcccaccacacccccagtgctgtcatcaaaggcaatggccacctgacttggttccctgtagaatcctccaaacagacaagggtgacatggaaatttatattcctgataacttcagttcctgagacagggattgatgttgtgaattcagtcagggatgtttcaataaattatccaatgcctataaaaaaaaaaaaaagattggtcactagtacaagctacttccttccactc

SEQ ID NO: 2459 - DNA, 1200 bp, mus musculus
catgtgtttgcccatagacaacattgaatgcacaatgaattttgaggtgaactgtctcaggccgctgtcctccatttgcataagcacacaattgtcatgaaccccagcctcatgggtgctccatcctgaagcaataaagcactcagtgagtgcagctcaatagccaaaagaattgaaaaggaatcccatgtcctgtttctagaggcccaggatcccaattcaaagtccagcacagctttaaatcccccattgtgcccaggtgcctttcctgcagctctgccttcacctgggctacccatctgacctctctcccatctgcttgaagtgaacttggcccaaacactgctatcatagagaacacttgccatcataagttaatatagtaattgtatgagagatagaacaacatccaagatgttgagaagcacgagaggccatatttaaaagacactagtcaaagaggcctgcctaccaccatgaggcatgggtgtggggaagacatccagaggccggcctgtcctatggtctgcccacacactacaacatgcaggtatgtggtggatggatgggagagaaagagaagtgccatgaagagaggtagaactggagacttgagggtagtgaggaacagcctgatgtaagtagcttctgatgccatggcctgaagccatggtaaagccctggcccaggctgccactgagggccatgtctgggtctacggccatgcagaagcaggggtttatgtcaatgtctgtggcccatgttaccaccaaaggccatgtggatatccacatctatcccacctatgaacttctggagagcatgaaggagcccatcctacaggtccaaagctataggatctctatgacaacaggatggatatccaagaggagtcccagtgaaaagccagtattgatagtgtagcagaagccagaagccctgaatcagacggatgacttattgcaatgaacattagcaagtaaagatgtttggacaaaagggcgtactatgtgacacactatgacaaactgcagcttccacaacaagatggtggtggtggtggtggtggtggtggtggtggtggtggtggtggtggtgatggtggtggtggtggtggtgatgatgttttctttgggggaaggttgcaaaagcagagagcaggtatgaaggcagatatgaagggacagggaggtgagtggg

SEQ ID NO: 2460 - DNA, 1200 bp, mus musculus
atgtggttatttgaccatcttttttttaccgtttcctacttaccatcatctagacagtatccttttgagtaacttctctagtggtcaccctgggaatttaaaaatacatacagtcgatttcaaatgcaaaactgtttgttcccatggcagatgagagaaatggagagctgtccataccagggacagctctcagagagggtggcacccttggcctccctcaacccaaaggccatgtcatgataaagccagttaaacttctgtttccctgcaagaaaactggcttctcggaaatcacgtgactggcggtccgctaacctagctgaaaggcttggaaggccccagcccccactgttgcacatcctcccttgtcctttctcctcctctctgactcaagctttctaatgtagaccctctctttcaataaacgaactgtctcccggatgtttatgcgcaccatactcgctgcggcaggaaaccctgtcccccagttcctccgcatcctgagactaaccagtgcacaacggcccatgggggacaagggacctacaagaaaccctttagtttgggggattctcgtggtggcggtggcaattttggaccaggaccaggaagcagcggggtggggggtgcggcagggggatgtgatggatacggaagtggacgtggatttggggatggctctagtgggtatggaggaggacctggaggtgccaattttggaggtagccctggttatggagagaaggatatggtggtggaggatcgggatatatcgggaccaggatgggggctacctacggaggtggttatgacagctatggaagaggaaattgtggaagtggaattataaccagaaagcttctaactatggccagtgaagagtcgaaacttcggtggtatcaggaacatgatcggaccatatggtggagggaactgtggtcctggaggaagtggaggaaatgggggctatggtggaaggagccgatattgagcttattggtataacttattgatacaagtagaaagtacttaccgtgggcttcactgtgtaaataggaggggatgagagcccagaggtaacaggacagattcagggtatcgaaataactaagttaaggagagtcttatctcagtatgcatgaatatgcagtgatacggcagacgacaccagaggagatgcagggagacagtttgtgaatg

SEQ ID NO: 2461 - DNA, 1200 bp, mus musculus
gatcagatttgtcaatttcctgtttgattatggttttctgtatttctttatatttattcctttcctctttaaaggactttatgtgtttgattgtattttcctgtatttgttcaaggggtttgtttcctctttgaatgtctctaccatcttcattagattagatttttcttgtgatacaggtgtgttaggatattcctagcttacttagtagtattgctgggttttaatggtgccatattgcccttttattttgttttgtttaaagctttatttatttatcatttgtaagtacactgtagctgtcttcagacacagcggaagaggttgtcagatcttattatggatggttgtgagctaccatgtggtttttgggatttgaacccaggaccttcagaaaagcagtcagtgctcttaaccactgagccatctctccagcccattttttgttttttgtttttggtttttgttgttgttgttgtttttggttgtttgttttgttttttcttatgctgacctttacccatcttgttattatttgttttttcaggcctaatagtccctgatggcagtaggcctctggggttgcaaatagagctggttggcccagatggcactaggcctcctgtgacgctgacagagctggtcatccctgatgacttcaagcctctgggtgtctgagtggcagcaggcctacagggatacagtcagaactcagggttcctgatggctacaagcctcttggattgcaggtaggaatgtggatcagtatatggagcaaagaggggatgaggcagaccttatggctgctgggcttgctggggaacacagtggtcagggaattcaggcatgaggatttcatctggttgtctcaggtgactgtaggcctccagggatgcagtcagcgctatattccaggcaataaagttcaaaagggacaaagtggaacttgctgctgctgagtttgctgggttcactttacatcactctattccttcttctccccaatcaaactcatcccagattctcccttcaaatatattatctcttctgttataactattgttacataaagataaaactatgtaatgttgctcttatgtatatatgtgtgtttagtgctgttagtttggaattaaatcatctatgaggggccccactcctggagaaaactgattctctctacacattgattacctgtag

SEQ ID NO: 2462 - DNA, 1000 bp, mus musculus
aaatgcacaagcaaaggaggaagcacttctcagcaggagggatggggcagcggaaaaagaggtagtacttctcagcaggaggggtggggcagcagaaatttttcttttggcaactacacagggaagcaggaacttggtggtatcagggtacatcttgtggtcaggacatccggcgctgacttagggctggaacaatctgtggttgttctcggaacagtgagtcggtagcccgctatcgacccccttttcttctcggggggagaggcccaattcagagatcaggacaattgtgtggtcttaatagctcccaacatatttcttaaagggattcattcattttctctttaaaggcctctataatctttacaagattgtatttaaggccatcttctagtgctttggctgggttaggctatcccccgggcttgctatagtaggataggtgggctctgatggtgccatattgctgtggctctttttgactgtgttcccataatgtgctttagccatctggtttttccttatgttggctggatgttcccaatgccagcaaggcccctcgggaaggctaggagagctgtgaaccagaccgtggaggtcaggggacaatacacagcttactacctatgttacctgagccctaggtggaatcgactggcaagggaataatgggaaaggattccataacaatcttggaggtcccaaatgtctcctaggaatggcagagcatgctcagagccagacaatggaggtcaggagacccagaacaactcatccatgctggctgtgttccagggggaccctattcatctagctggacctcaagtatacctgactggcaagggatttgtggcttgggtcagtttcaaatcttgttgttcctgaagcccccactcagtccaccacataggatcaggatgcattgtgggaacaagtttccttgagaaggcaggtcaaacccagaaccagacaatggaggtcagggaatcaagcataactt

SEQ ID NO: 2463 - DNA, 1200 bp, mus musculus
aggacttcccatgaaactttgaggtttaaaagataactctacatggtaaaccataaggaaaagctcatgtatagcagaaatgctctttgttaaatatcagatgtttgtcagaaatgagttttgttaaataccagaggaatttaggtagagtctggtgactgaactcagagtgagtgttccactggatccagatcggtgaacatgactgttgttgagttttcatttttttccctaatcatagcttttacaagtcatggagaacatatagtattgcattaactgagctgggaaatacagaatattgttcaacctcctatttttcacctttggctactatattatgtggggagcgggtgtggcggcagtcccaaaggcgccagggactgcagctaagtcatatgacttgcacctgacttcctcatataagacacaaacatcttgagtgctgcgcaggtgtaccaggatacaggtgaatccaatttggtggagatttgcccctgctgccctgattagctgaagctgcatgcctggtgaggtggcgtggcctgctgtgcgtggatgggaactgaaagtataaaagagtgagaggcccaggctagagggaggattattattcaagagaggattactattagtggggagatataaaaacaagggagatataaaaacaagggagatataaaaacaagggagatataaaaacaagggagatataaacaggggagatataaacaagggagatatataaacaagggagatatagaggaagaagaaataggactgaataaacatgtgcagaaggatcctgtagcagcgtcgttcttcctggcctgttgagcgcgcgcaacaagtggtgccgaaacccgggacaagaaacatcttcaggcacaagcgaagacctcctgctacaggaaggattcagaactgcatcacagggaagaaggggttaataaaggttcccataaaacagactgttgagaaggatctggcgtggattcagaactcttcagctggggaacggtactaatgaagagaaagaagaaagatgaggactgaataaactgctgttagaaggactggtggtcgcatcgttcttgctggtcgagagcaggcgcgacaattggtggcccgtacggggaaccgactcccccaccgagttcagaactttcagcagtcagtggttgctggcagggtaagttc

SEQ ID NO: 2464 - DNA, 1200 bp, mus musculus
gtgtagagagaatcagttttctccaggagtggggcccctcatagatgatttaattccaaactaacagcactaaacacacatatatacataagagcaacattacatagttttatctttatgtaacaatagttataacagaagagataatatatttgaagggagaatctgggatgagtttgattggggagaagaaggaatagagtgatgtaaagtgaacccagcaaactcagcagcagcaagttccactttgtcccttttgaactttattgcctggaatatagcgctgactgcatccctggaggcctacagtcacctgagacaaccagatgaaatcctcatgcctgaattccctgaccactgtgttccccagcaagcccagcagccataaggtctgcctcatcccctctttgctccatatactgatccacattcctacctgcaatccaagaggcttgtagccatcaggaaccctgagttctgactgtatccctgtaggcctgctgccactcagacacccagaggcttgaagtcatcagggatgaccagctctgtcagcgtcacaggaggcctagtgccatctgggccaaccagctctatttgcaaccccagaggcctactgccatcagggactattaggcctgaaaaaacaaataataacaagatgggtaaaggtcagcataagaaaaaacaaaacaaacaaccaaaaacaacaacaacaacaaaaaccaaaaacaaaaaacaaaaaatgggctggagagatggctcagtggttaagagcactgactgcttttctgaaggtcctgggttcaaatcccaaaaaccacatggtagctcacaaccatccataataagatctgacaacctcttccgctgtgtctgaagacagctacagtgtacttacaaatgataaataaataaagctttaaacaaaacaaaataaaaaagggcaatatggcaccattaaaacccagcaatactactaagtaagctaggaatatcctaacacacctgtatcacaagaaaaatctaatctaatgaagatggtagaggcattcaaagaggaaacaaaccccttgaacaaatacaggaaaatacaatcaatcacataaagtcctttaaagaggaaaggaataaatataaagaaatacagaaaacaataatcaaacaggaaattgacaaatctgatcaagaactgaaaat

SEQ ID NO: 2465 - DNA, 1400 bp, mus musculus
aggatcaagggcaaaaaaatggatgaaacagaagttaaaagaacaatgcaaagaatcaatgaaacaaagacttggttctttgaagtcataagtaaggttgatcaaccttaccctggcaaataaccttccttctgctgcaaaacatttcagaagctcctttgcccactcagaaattgactgctgtctctttagtgatgcccatggaagataatcccattgatttattattcctttctgtctgttttagtgttagtgagtgaataattctaaccctgtatgcaagctctgcccatggcccatgtggggtggtgagggatgactgcaaatgctctccactgacagtgaacttggtcttctctactacatcttacatgcggttctatgggacagaggaacagctctgtgtagacagtctaggagggctatgaagcctgcatttctatgtcttggctattccatctttgccatatggcatactaggaaaattatttaaatactctgaacctcctgtcttgatctagagatgttaaaatctaatttatagggcaatggggggtggggcattaatatgatgtcacattaaaagccagggcatcaagtaacagcttgtagttgggactgtattgctactggttaggaaatgtattaagtgtgtaagttaaattgggaactctggcagcacctaggagcttgaacccattcaccatttgttccagctttctgttacatttgggagattactcccttatttatccgtcctgcacttgctagttttatgatgactaatggctgacatttacagaagcttttccttgggtaaacccaaaaaggcacatcgtcgcccttagttctcttaacctgcctttgtatgagacactgtagatgcaaacatttcattgaagcttttggccttaaatgtcctgtccagggtctccttgccaaaagatggaaggaagactggaatcaagatgtctatccctttctctcatgttctagtgctaataaaaataagtcttaagaaaattgaatggtccttgcttccacctggcttatggtatgctgaatcatgaaacattttattcgttggtttccttaatgattactgtcatttttattgtttgtattggggggcatcattgacaatattttcattggccaactatggcctcaaagtcatgacctgggaaacagcagaaatcttcagagagaagagagcactactttggaaaaagtaagtagctagcaagaaggtgccatagcagaggatggttgccttcaggggtacagtcttagagaatgcttaatcaaggttctaaaacatgttagggcagatttaagtggctactctttatgtgtcttcttatccctagctccctcatttgaagttgcttggtgtttct

SEQ ID NO: 2466 - DNA, 1000 bp, mus musculus
ggtttgaataggtttggctcccataaattcatgtgtttgaatgcttggccaatagggagtggcactattaggaggtgtggtcttgttggagtaggtgtggccttgatggagaaagtatgtcactgtgggtttgctttgaggtctgctatgcttaagctctgcctagtgtgtaaattcagtctctataactttaattttttcagagcctacttttaatgatgcttaacttgacttaataatacttaatgctttaacctctcttctagcctatcacccaccagaggtagtggaaaagaaaggatatgggggaagtggatctgtctagaaatggttcagccaggcctcagcagaattggcacaagtcagcaggagggaccagggccaataggaactcaaagagttcatggctgtgcctttcagtgaagtgaaaatcagtgaagacctgaggccaacaactgttgcagctagctctacaagcaagctcaagctcccatcactgttcattgagtgctatttatactccctccaaacatcatgtgtcttccacgtgtcttgcctctgcacagtccatctttcttaggtgacatcactctgccaatcagcccaatacctcagaagcatcaagaaactgtagcataccactagaaggtttttggtgtgtatctttctatggagtcctgacaactgaaactcaactatgaaatgtaaggcagaccaatacttgtgtgtccttagcaaagaaccattaatcatatgtccttttacatgcttgctttatcagaacagtctttcacctgtgtctgtttcagcaaaacgtcccttcatgtgtttgccccagcaaaataccatccaacataactgaatttcctaagaactcttttaagtttccatttcaagtcgcctcctggctgccttcagatcaatatttagacctctcagcttctctagcatcatgtctgcctgcatgctgccttgatccctgccatgataataatggacc

SEQ ID NO: 2467 - DNA, 1000 bp, mus musculus
tgttaatcgccatccactatacgcaaaaacttctttttaaaattaattattttatttatttacatttcaaatgttgtccccattcctggtctcccctctgcaaactccatcccatttcctctcttctttgcctctgagagggtgctctcccacccacctacccactcctgcctcacccctctagcatccccctacactgggtccaaaagcttccataggaccaatggcattccttcccattgattccagaaaagccattcctctgctacatatgtagctggagccatgaatccatccatgtatgctctttggttgatggtttcgttcctgagaactctggggtttggacacaggaccttctttgatgaggtagagagacacattaatctatgtgtataactaagtcactgggggtccgtttaatactacatcatatccagcagaataatagcagtatattttctcttaaggtttatgacctgtcttagccacaggttcttggcctgataatgttgacacgtatggattttgacttacaaaggggcaatttataaaggagagcaattaattgggtttatgattacagatggttagagtgcttgatgatggagggaaggaggcacgatggtaggagcagctgagaggtcacacttggaacagaaagctgtgggcaaaaagcacacctggaaaggtatggatctttttaaagcttggcgcccacctccaagtgacacactttatccagcaaggccacacccctgaatcttccctcaacaatctccaaccggagatttattatttaattgccttagacttatagggggcatcttcttcaaaccaccacgtgagatctggcgattgtgattatgttaatttcctttttgttgctgatgttttcatgcttcgctgatattacaacccagcttggttagccttccatcatgcaccaaagaccaggacctttccaggattcctctaaacctttagcaacaggatgagg

SEQ ID NO: 2468 - DNA, 1400 bp, mus musculus
cgagtttcaagaaagataaaaaggctaccttctacttctgactactccttaattcccgtgcaatctttaccagcatagccttttttgtttatcataaacatatttcattttgcacgaaactttcatttttaaaatatggactggactagaatgattgtaaaaaaatacttatttcacaaaactgacaacctatgtttgatcctctaaactcaagcaaaagtgctaaagttttcctctgatccacatgtccacatgcacactatacacgtaaaaataatacatttaagaattaagcaataaaataaatagaaacacatggactacctacctatcattatctgttagttaactatttacatctatgttagccacatctttttaaaccttttttcttagcttgtaaattattttatttcctgacttaccaatttgaatgcagaaacatccacccacacaacccctccccaccccccacccccccacacacactgggtgggcataactaagctccttggtcagctatctttcccatatggacatattcgtttcttgtaaaaagggaaacaaagcaaagcaacagaaatatttacctttgcttcttcttggcttgccatggttctgaaaaggttttctctgtctgtctcataagaagttcgtgctccgtggtaatatcgccagcctgtgtcactgcactgccagttgagcagggagctggctcagctgcaggtgcagcagcttggtgttaagggtgcatgacaagtttactcatgggatatttctccaatataagggcatacagacacaaactcagggacatgtaacggctaagaaaagtggttgggtgaagatggatttagaaaaggagaaaaggagtaaggaaacttagtgagaagcagttgttcctttgcagtctttagtgggaacaagtatgcttgccttgcgagttgcggtcactgtacaggcgtcgctttcttatagaaggggaagaattttagatgttttcctgggtggctgggaacagtttgtctggctgtcagaaaaagacacacgtgaagacagctattctaactgtggatttcgttcttctcttctctgactgggtggatgagtaagcaaacatcgagttgctcatttctataccaaagataaagaaatttcaaaggaaatgaagtagtttcaccacgcccaacctccaaattctttgcatttgaaaacaaagactcatgcatgttttcacacacacacacacacacacacacacacacacacaaacacacacacaaacacacacacacacattctttaccatttattgcttaaataagtatactgtcttaactggagaattttaaagtgctttctaacttgtgtgtccttttctccatccaggaatctctttt

SEQ ID NO: 2469 - DNA, 1200 bp, mus musculus
gtggtgagtcttctgtgttatccaagtgaataacaggttaaggtgatagcctatcagatcatatgattgacccaaggcacactatagcagaatgatcaaatagtttttgttgttgttttggataataatccaatgttcagaagacatgagataaaaaaaattcagttcttttaagtagtgccttgagctgtcattttggaggctacaagtctggcataccagtatgggatggctggtattgcagtcaattaaattatttaataaagtgtttttattttctaatctccctctcgatctatctatctatctatctatctatctatctatctatccatctatctatctatctgaaaatgacagatgtttttggtagaaagaacagcagagttaggggtccgcccggcccgggagcacattgcctgagcattggcagcagacatcttggttctgggaccctgctgagagtattctgcacaggtgagtgtgcggaatacagaagctaacagcttctgggacggggggagccacagagcttctaaggcagcccccttttcgggccccagacatccggccacttcccggccagaggatagtagtccgcccggcccaggagcatttgcctgagcacggcagcagacatcttggttccaggaccccacctacagtattctgcacaggtgaaagtgtagaatacagaagctaacagcttctgggacaggccaaagcaacgtagccgagggacaggtcctgttttgggccttcatcttcggccaggagggaggtcctaatgccaaatatctgtgcaccttccctgtaagaggagagcttgcctgcagagagtgctctaaccactgaaactcagaggagagatttagtctccaaggtctgctgatagaggctaacagaatcacctgaggaacaagctctaaccagagacaactaaatcaactaactccagagattatcagatggagaaaggtaaacataagaatcttactaaaagaaaccaagaccactcaccatcaccagaacccagtactcccacctcgcccagtccagggcacaccaacacaccagaaaagctagacctggatctaaaagaatatctcatgatgatggtagaggacatcaagaaggacattaataactcattcaaagaaatacaggagaacactgctaaaatggtagaagatcttaaag

SEQ ID NO: 2470 - DNA, 1000 bp, mus musculus
tggaataactgggtctccaggatccagagatgcagggacccctgcccagccagtgacactggttatttccggtctgagcctgtgccctgagcaaacctggggcactctggctctgtttctacccactcctacaacacccagaaggagcacgactcccaggtactctgaaacacttagtatcacaggtgggtaggccacaacatctgacccaacacctagagtaactgggaccaccaggatccatggacaaaggaaagtttgcatgaccagtggctcaggttccttccagtttcaacctgcacccagagcagacctggggtggttgttctgaacccactcttacaacacccagagggaccccaactcccaagtgctctgaaacacccaggatcagaggattacagaggaatcttgactcccaggagatgagaaatacccaagagtgctggagctctgacagtcaggatctcaacatctttcccaacacccagcctaactgggacccccgccccataggaaccaggaaacacaaacctcatccagccagaggcatggattctttccagcttgcacctgtgcccacaggaaacttagggctctagacctgcacccaattctgcaacacccagagaaaaacttgactcccaggagctctgacacaacaggatgtcaggagcttggtcacaacaggatttctgaatcccagagggagctaaactaataggacctctgacacagccaggatctcaggaccacaggatcacagaatcacagagacagctaaactccgaggagttctgacacaactaggaacataggagggacaggctccagtcagagactgcaagggcatgtaggactagagataaccagatggcgagaggcaaacacaagaacataagcaacagaatccgaggctacttggcaccatcagaaaccagttttcccactacatcaagtcctggatttcccaacacaccagaaaagcaagatttggatt

SEQ ID NO: 2471 - DNA, 1000 bp, mus musculus
ctgtccctgtccctctccttctccctcttcttcctcctcctcctcttcctcctctttttcttcattctgctttagttctggttgtcttggaactccatctgtagtccaggtgatcctcttgcacctgcctcccaaaagctgggattaaaggcatgcacaaccactgaccagctaggagttcttaatccaaattcctgtttgagttttgtcctaatactaaacaacaacaacaacaacaaatagaagacaaacagacaaaaataaaaagcctttttatttgttctttgtgaatttcaagtcttgttccccagtcccactcatctccctattcccttatactcatcttctgccctttcaacaccatccacaaaagaaaaaaaaaatcgtatgtggaagctatagtatatatcacagagtgtcccacaatataccattttgtctacactttgctagcatgtgttcattgcaatgagtcattggtctggtttgaggcctctggcttctgctacactacaatactggaacctcggtggcacttctattgaatattccattgttgccttgtgccatggagatcctgtagctttggttctataggactaggcctttcatgtgttccaagagctcataggtggagtagatgttgggatgttccaattcaaagcactgaatctgggcctgccagctctcccatacccacaccaatgggcaatctctccaatactgccccagctagctcattcaatgccacagccagcaagggggcaaagccagttctttctctcaggccctcaaggccacccacaccgcatcaacagggccagctcttttgttctgctcaggcgaggtatggggcctggtccccaaggcccctgcacttcttaatgatgattatgtttttacatgtattgcttccttgtttactatctgatatgccccatctcttaaagaaaacagattctgtgcctcatttgctactataccttaggtttagattaac

SEQ ID NO: 2472 - DNA, 1800 bp, mus musculus
cagataaagatttggaagggtaataatatttaaaccagtgggatattagcatatatatgtaaaccattactttattggatttattttctgtgttggagtgattgacagctctttaatatgatttcataaatagtggtggaaagatattcagaaaaaaatcaaagtagcttaaagatattcctgagcatattttatttaaatatgtcctaaaatttggtggtaagcaatattatctgacaattaaaaaaatctgactataaaaagcttcattcttgaaataatatttgactgtttctagcacaagaataaaatggacattaatgttttctgatgaaaataacattattttaatgcttgaaacaaagttggcttctcttaagtgtcattttttttttttttgcattcttatagtaagtccacatgtaagattgggaacaattcttctcttccttatagttcatacttaggaacaggccctggttagtctattgtggtcactgatcataaaattatctcttcctttgtcaactatcagggattacaaggagcagtgcaacatgtcgaagtctggaggaagtggctaggaagagtgatgagaagaaaggcttttttttttcttgagtgagaagaatgaaattttattttaaagagacttatttattattttatgcatatgagtgtgtggtccacacgtgtgtttgtgcatacgataccagaagaggagaccagattccatggcactgtagttagagatggtgagctgctgcgtgaaggctggtcatcaaacccaggtcgtccgtaaacgaagctagtgctttaaatccagcagtggctcagccttctctctagcaaccaggaatccaatcttgtgagaacctgatgcttgcccgactaaaagcaggagacggcaatcctgatatttacttatacctggaactataatgaatgtaagccaatggaagatgatggagaaatgtagatatgtgaatgatacatatttaattaatgaatctgaaattcttacttgctcagacaattaagacagtttctgttttgtttaaagtagagggaaaatggatctgtaaatattttactggaaaaactgaaacagattactcttttggatttccacatttaacactgcaacaaatgaacatagctaatttgatttcatgaacagtgattcaactttatcatgtctatgacaattgaattaatcaaaacccataaattacgagggtagaataaaatgtattattttgtaatattttaatttaaaattctcattaaaagaaaatttaaaataaatccactttcagaaacattattttataattttataataaaattcagttgtcgtttttctcaagaattaaaatttgagtatggactttggataatactgtatcatttatttaaaatattctggtgtttccagtcattcaaatgttcatttggagacttcaaccaaggattttgcttgcctcaagaagcagatttaagatcaaatctctatatttatgatgaaagagaagatagccataaaattaacatttaattccctaaacaattattatatccctaaacaattagttcacatacttttctggtgtctgtaaatgaatgattttaaaatatgactaataagtaaatgggggaaaagactacattacttaggaattttattaggctgtcaatttaaacactcattcctcaggcaaagtgcaacttcacatttaaataaatgtatattaaacacttcaaattgatagcatcaagtcttccctggggtatgattca

SEQ ID NO: 2473 - DNA, 1400 bp, mus musculus
tcacctgctactccctctcattcattctatctacctaccatctattaatctgtcatcatcaaatcattatatgtagatatatatatatatgcatatatatatgtatgtgtataagcttttatgtatataaaatctaatctaggctcctggtatataagaaaatatggaatatttatattctgaatctggcttaattttctcaatgataatctgacattgcatttatttttattaaacaacataatgtcactctaatttatggctgaataaaactgtactatgcatgtatatttcttttattatactttaaaatatttgtattgacatatgctaattacatttaatagtggctttcatttggcattgacatacaaatatataatattttcacctttattgaactcaaatgaatacagataaaatataagaattttcacttttatgtaaaacttaatgaattgttcaaaccaaacaatttttctcttagctacttttctcattgctgtgaccaattcccggacaagaagtaaatgagtaagggtttggtttacaatgccattatgaaagccaaggcatggtggtagggacaggaggccagaaagtcatgttgtaatcacattttgccactagggaccatcttccctcaaaaaggctccgttccctaaaggtttacaaccttcccaaaaagcagctgaagaacaagctcatgtaccaggaaatgggatctcatcacccacccctttgccatccctctctccctcccttctgcctgtagtcaccagttattctcctacaggaataaccattatcttgaccagcatagatatttcttataccaattagctgtcaatggaaaatttggttgatctatagtttgactattatggacagtgctacaataaatagagacatgcaaatttctctgcgatatactgacaaaattctccaaatacgtagttagtggtgatatatttggaatctatgggaattcaatatttaggttttgaggaagctccatagtgatttctattgtaactgcctcatttccatcagcaaggtacgtgcattcattttcttttgcttatcacctacatgaactgtttgttctcttcatgatggccattccaaccaaggtgagagtgaatcactaagtgggtttaatttgcatttataaaggatagttgttaaaacaatttctgctcaggttatatatccatttattgattttcattattcattttagtaaggcttctttttgagatttttaatatgttctagatattaatcccatcagaagcacattttctgccattatgtaggctggtggtctctctattgtttctttatctgtgtggaaggtttttggtcctgtgtatttctattgatcttttcagaaagcc

SEQ ID NO: 2474 - DNA, 1000 bp, mus musculus
acgtaatgcttggctctctgtgttccaattcaccctaaagtgtgttaccaggggagaaaagaaggaaggcggagctagaggactgttaacctgtctttccagattgctgactcaacagcttaagtttcaattcctgttacagttcaccggtgtttgtgacgacgggcctcacaaactccagtattctgttacagttccatcccttaaacaaaactgagaatgatgaagttgatttcctcatgacatctgtaaacgagcttgcaatgaccagacctcaaatatactttattcttagccttgtgcctattctcgggctaattaggctttggatggacaagtaacagacaagcagagaatctagaaaaacaaataatagcaaaccattttcccagggagactccatgagctgagctctctggctcatgctccagccatgactcggattgacagtttatgcctcaggacctgaattcaaaagctgttgtgcccttattgagagccccaaaagaccaccaaggagccgattctaaggcaatcacagctagggtctttattcaagctcgagctcgggccacactattgtcactgacacagcctgacaggagggtgtagcaccccacccccctgagtccagtctcaaggaagcatctatagaggcaagcaagggagcgagggcatttccagcttggcacacgtcagattgggcgggggagctattaatggaatttgttgacttttaaaatgattggctggtgctgggagccaaaccataaactttcataagtaaatatctttaggtacaactgtaacttctgctttcttcctgattggtggttgttagggagtgacctggaggccaatgctaggtccaggccaggtgtttaacacgttcagccttaggtgaggttctctaagatggagcctgaacccaagacggagttggtctgatctctcaaagcaacttgtaccaagtgctatgtctttatcacatttactcagg

SEQ ID NO: 2475 - DNA, 1400 bp, mus musculus
ctcttccatctcttgtattctgttgctgatgcttgcatctatagttccagattcctttcctaggttttctatatccagtgttgcctcactttgggttttctttatagtgtctacttctctttcaggtcttggatggttttattcaattccatcacctgtttggtcgtgttttcttgcaatactttaagggatttttgtgcttcctctttaagttcttctacctgtttagcagtgttctcctgtatttctttaagtgagttattaaagtccttcttgatgtcctctaccatcattatgagatatgcttttaaatcagggtctagtttttcaggtgtgttgaggtgcccaggactgggtggggtgggagtgttgcgttctgatgatggtgagtggtcttggtttctgttagtaagattcttatgtttgtgtttcaccatctggtgatctctggagtttgttgttgtagttgtctctggttagatcttgttcctcgggtgtttatgttagcctctatcatcagacctgggtcactagctctctcctgagtttcagttttcagagtactctctgcaggtaggctctcctcttgcatggaaggtgcccagatatctggtgtttgaacctgcctcctggcagaagttgtgatccactcacagaggtcttaagatcccgtggatggtcctgtgtataccttacaggtgtctgtagactccacgcccaaggtacccctgtgctggcgtggaccggaagggagttgtgcccctcctcaggccgggttttctgctttcctaattaatgcattctcaggtccctcgagattggattggagcagatgctgtgttccactcatcaggggtctcaagatcccgtggcgtgtcttgtgggtagctggaaggtgtcagccgactctgtgccctatctaccataataagcatatcttaatgatagctttaaaattctttgggaaattatcttaatccatggtttcatagaaaattactgcttaattttctcatatttgtgaatttttcagcctctttcctgaaattgattttcagtttcatcccattgtttggggagtgcactggtatggtttcaatcaacttgtactactttgtatatgttctgatttcaatcttcttaaatttattaagactacatttaggacctaataaaatatctgtcttacagaatttctttatggccttaaaagaatggtgtcttgttgctgctagatgtaatgtttaagtcattcaaacccaatgctagatgatctgtatgctgttgatgatgattgactaaagtcctgtgattatcatcatcatcatcatcgtcaatataatcaccaccaacaccaccatcatcatcagttgtcaatttgcctgataatctgatcctaa

SEQ ID NO: 2476 - DNA, 1200 bp, mus musculus
gccttaggctttctcagatgttagcatggaaaagcttgcctgtggaaactcctccatgacaggcaaacaagggcagtttgtcgacttcttaaaacacaagcgaacctacttttctataaggcagacccaaccctaaagaccaatagcttatttgatgctgccctctagtggttgaacacactatcgctcgctacattgttttacttaaagaaaaataagccaggatggctggaatagtccctaaccatttagacttaaatttgtaactgcagcgacccccatttttaatttactgacatccttctccaaacacaacatctggtaggactgctgcagaggccataggaaacgccccttactaaggccgctcagtctcttccagggaatagagtggccagagcccctgtgtctacctaggctggactcaaggcagactatttagaaaagcattctcctctcttggaagactcacgcagcccatgtagggaggcaggactctcactcggctgacacatctgaagtcagccccaagggtatcctcctgctgagggtaccgcagccctgaggagttctgttcctcttggtgaccctttcctcacggatgctcatctgtcccagctgttagccaggcctcagcagctaggagggcctggtcatgcctgtgtattcggctgattcctcatggacagatttgtgactgagctagctcctggtaggtgtgaacacagggctacactcctgatactcagttgcaagtcttgagccatgaggatcgggctggcatcccactagccactactttaccctgtgtatctgcagctacattctatctaacacatcagggtgacctacccagcctgggatgctgaacccgcctcgaggggctttctgaagattcagcgaggcgtgtatccccacctttcctgtcctagttcttgggttctgaaaaagggatttaccgaagacttcttccaagtctaattctgctgagcctatgatgaaagaccttcgatcaggtgtttagtagttttcttggaaagccatttattattgctaattattaccaccaggccagcagcacaggcctgtactcaggaggctgaggcaggaggaccttgaggttacggtctgatgggaggctaaggccacctgggcacatcactgagctcctcttttgaaagaggaacacggttgtggatg

SEQ ID NO: 2477 - DNA, 1200 bp, mus musculus
gcaaacagaaacggaacaaaagggccgtgagtatcacagagctagagatactttctaggttggctgacattattcacaggtctccaatgataagatagccaagaaaatcctctaaaatacagcaaatgcctacttctcaatcttggcattaaaaaaggggagctacttagacacaagtagccgttgctttgcaccatacaataaattattcacgactgaaatagtgcagtgacttcaggatcctgagtgtggtctttcacaacaccgagttgtgtaagtacaatgtgcacgggccagccgcctcgctgcttcccattctcagaggcagaaccagccctgcctgcggtggaggagctctccatggtgcttactcacatctgctgtctcgtctaacagtggtaaaggttttctggtttctctctggatctacctgcctgtaacaatggcagtcgcacgagccaccgctcatctgtttttccactttggcctgtgcagagaccctcaagtatttttctagcttgactgtccagttagcctagctctggagcccttacagcggccaaagttcattttgtaggagagctcactgacatactctggacaaaaaagttaaaattcctcagattcaagtcccaaacatgatgttgttactttaggaccactcctcacaaaccatgcccttactagtggtttataaacaaacgtcaaacttctaaaatatgatgaacaaacttcactcttatatttaaactaaaaccaaaggaaggcaaatttctgcttagaggccagctgggtttaacttcgcggagttttctaattacggctaactgcccgcacaagagaacaaatcaataagcagcaacaaacaggaagaccaatagaacacaagtgtcaagaactgaacaataaaggctctggtcccccttgagttccttcttgtgtaaggcatgaggtagagatcaaagttctttttggagagaggtaccagccccaaggttcataaaatacttgtaaataaccactggataaatatataaattcatataaattcaataatcaaaaagcaagcagttcaattagagagtgagtataaaaagacacaaacatttccccttattccatgaaaagacttcagcattgctcttcattaagaaaatcaatacaaattaaaaggatgatacagtatcagtacacagctat

SEQ ID NO: 2478 - DNA, 1200 bp, mus musculus; identical to SEQ ID NO: 2477

SEQ ID NO: 2479 - DNA, 1400 bp, mus musculus
caagcacaacattgagtagaagcagagagaatagacaggcatgcctcattttcttctgtttaccatgagattggctactgatttatcatgaaggatgttggattttgtcagaggtctttttgtcatctgttgagatgatcatgcagtttctttctttgattgatttaagccatccccaattacacttcatgttaataattttatagactgtatttttgatactgtatattaaaatagcttgctttttagtgtcctcttttttttctccaaactgcacattttgtatttcttctccatttcctctttttcactgtagccccatataagagttactggttataacctttccactggttccatgttttactttcttgaaatttcttccattaaagaaactagcctactgctttttagtttggctgcctgagaattctcagggcatgggcaaaaagcattcagattcttttacaaaataacacacaaatggcttctagcccaattgctaacattctttccctctgaaatattttgagttaggcctctccttcctaaatttctttccgctctactgacttccagatcccttctagaatgatctgtcaagtattgcttacattattcagctgcttttctaatctaaaggtctaaagtctttcacatctctgcaataaaggttcttaatatcaacagccccactccttgtaccaatttctatccaaatttactttcggttgttagaacactacgacaaaaagcaacttggggaagtaaaagtgtatttctttttatacttctgggtaagcaaccaccagggattgctgccaattagcctcctcttatatagcccaggaccacatgcttaagaacaatgccgtccatagtaggatagtcccacctacctcaattaccaaccaggaaaatgcctaacagacattcccgtgggccaacctgatgtaggcaacttctcaattgaggttcttttcttaggtgtgtaaggttgacaattaaatgtagctatcagaaactacattgaaactatagtcaaaataaagagaattttaagaagtatgtgtgtgtgtgtgtgtgtgtgtgtgtgtactgtatgtatgtatgtacatgtatttacttttctgtgcacagatgtatgtacttggaagccaatgttggcatcatttgtcttcattgatctctctctttcggtagacattgagctcattagttcatttagactgactgtctagcaagctcctatgatccttgatcgctacctctctagtgctggttttagatctaggtcaccatgactaggcttttatgggggtctgaattcaagttcttatgcctttgtagtaagcagtttatggattgagccatttccccagacacccaaattgggaatt

SEQ ID NO: 2480 - DNA, 1000 bp, mus musculus
accgtcctgcatggagcctgggtctgaggacatgatggactgtaaagcaattgcaaaggaaagaccatcaggtagggagtgcaatgaaggtctcaatggcatcctggatgacacctttggggtaggtggacctcggtagacatactgcctcactgctggagtgactaagacatccaaagacacagcaccggcaaagcagcaccttctggggactgtggggggtttcactctacactcagtcctggtttctgtgtttggctaggagtctgtggtttacagacgcatcactccagtctcctctttcatcctcacatgggcagtctcccaatgatactgtcttcgctcttcaagtcctctctcccctaatctctctctcggtaaagatgacagttatatcagactaggtaggggcacacaataatgccttcattttaactcaactggttctttaaaaagaaaaaaatgtttctgtgccagaaagacgcctcagtgggtaagggtgcttgctgccaagcctggtgacccgagcttcacctcatgacccacatgatagaaaacagatgaccccacaagctgtgttctggccctgaagtgtgcactgcggcacatgcacctaccaagtaaagaaataggatgtaattcttaaacaaccctatctccaaataaagttgtactcaggtattgggagattaatcttggagttattacagttcacactgtaataagaatctgtctttctttctttgcccacacgacaacaccaagtgtcattgacaccaccaagtgtcactgaaaggctgcatgcaggcttacatgcacatcctgtagtgagtgatgtgcctctgcagtgagggatggtctctctgtgaggctggtgcggctctcagcgcagccatgtttgagatgagttgggagcacaggcactaagggaggaccagctccaacgttgacgtcactggtgatcgcctgtcctccaatcaggagcaagggcaccaactcc

SEQ ID NO: 2481 - DNA, 1000 bp, mus musculus
acttagaaaagaaagcgtttaattgaggacttgcttcagtttcagagggtgatccatggtcatcacggcagggagcaaggcagctggcaagtgggcacggcactggcgcagtagctgagagcttacatctcccacacccacaaggcccatcgagaacgaattacctcaaagccagtgacacacctcctctaacaaagccatacctcccgacccttactaaacagctccatcaactgtggaccaaacattcaaatgagccagtaagggccattctcatttaaactgccacagaaagtaattgaatttggttttagtgactttcaaaatgctgtatgcatatttaaatgcttttttaaaacctttaattttttttcacttactcttcatagaatatttaaacattgttgttgttgttgttgttgttgttgttgttgttgttgttgttagatgaagtcttagtgtattgtcttggatggcctggcctggaactcactgtgtagtatctacctgcctctgcctttgcctctgccttctaaatgctggggttcaaggcatgtaccaccttgcccacccttcatagaaaacttaaggagaaagaaaagaatacagggtacataaaaatcaagtataaccaatctattattcacttctgtcttagggttttattgctgagaagagacaccgtgaccaaggcaactcataaagaacaacagctcactggggctggggctggctgaccgtttcagaggttcagtccattatcaccacggtgggaagcacgcagtgtcaggcacacatggggctggagaaggagctgagagtttgacatcttgatctgcaggcagcagaaggagactgggcagagcttgcacagatatatgacctcaaagcccacccccacagtgacacacttcctctatcaaggccacacctcctaattatgccattcctcatgggccaggcattcaaacatgtgagtctatgggggccaagcctattc

SEQ ID NO: 2482 - DNA, 1000 bp, mus musculus
tcacatgtgttcaaatgctccaaccgcacttcctgcaacgtcatcaagcttacctgggggctggctgtcaagctggacagcgcagagcagtgctccaccactgaagaggacgtagcgggccagcactgacctagcccccaccccaccctcaccccagagcacttacctggagaaggcctgcaacctcactgactgctaactcacttgctctctttgacgtcagtacagggatcattgtctcattttcaacattagggatcttttgaaatcgtgcaacctaagaacaaaacaaagaaacttacttgaatatactagtagaatggagtctagaatgaaaatctaaaataatcacagcaatttcttttccacttaaggaagtatattaagatcgattgtgagtatctaagacaactcaatactgacattcttctttcaaaaccatggacacctgctaacaccaggtttaatacaaactcttcccatcacatagtttaaaggcactgtttctttcatttctccagcaacataagactcaaaacagatgcttttctctcaactcctgatgaataagcacaatcataatcctataaagtcattatgttaattccaggacaagagctctaagctctctccacttagctgctcccctgttcacttctcttttccagaaacctggctacacttccaaacatctcgacagcaagcaagtctaaaaggtaattctcacaccaggagaaaacggagacgctcaagagaccagccaagcagaggtgagagatggcacaggttagttggcgggttcggaacatgcagaggaagtcacaggaatggtagcaatgatagtcatttcattcgcttttataaacatgcatatcaaaagtgctcatcacaattctagcaacaaaatccattcagatttgtcttcagtgccagctgagattccttacagacacggacctgcagctacaggctcttcactactcaaactgagaacttttgc

SEQ ID NO: 2483 - DNA, 1800 bp, mus musculus
aatagtactgtcctaggcagaggaaatctcaagtgcaaatggcagaggtgggagagagtaaagtctccctacagacctagaggaagggactggagggagagattcaggcataagacagacaggaaaagtagaactcagattaggtgatgagaggactttaaccagaatcaggatgggttttagccaaagccactggagtattttaaacagagaaaagtacaagtagatggtttaggaagattccctgggttgaaatacggaggctgcggtgggaggatcgagagggcaggtggggagggagaacaggaagcccgtgttaggtaagagagaggtcgctgttggaacagggaatcactaaatgaggggctcaggaaggtttgctaagatctgtgggatccagttaaactgttgggaattaaaatcagaaactgatgagctggagtcattcatgggggttgggggaaaggacagggcttcagggctgctttctagagtggccactgagtggtaccattcgtgggaagaggggaaggggttgaatactgtgtgggactcgttgggggctgcagcatatgtgcagttcaagttccttgtggacagtcagagatccagaatggggtgctcaggagagacctgagggtgcagataagaaagtcatgcttaacaaacgatggctaccacagaggggactggaatgtcgtgccagaaggtggaggagccagcttcaccttcatgagcacatctgaaccacctctatgaacaacagaatgggattttgtggtatttctctagttatggggttacagcaagctcccttctgctcagagatcacaccaagacgaacggctctccgcaccgaaccccggtcccgacgcccggcggggggagaccccgcgccgccgcggggacgacgcggggaccttgcctagcggggacagatgaggatccagctatccagggccaaccaaggcttcctcggcgctgccatatcggtccgcctgggcgggattctgacttagaggcgttcagtcataatcccacagatggtagcttcgccccattggctcctcagccaagcacacacactgcctccctccatgttccaggacagtttcctaaatgccaacagggatttaggagcaaagtcaggaccaagaattccacggagccagacgcagtgaaacagctttagctacccgcagaattctgttctctagtctgaaagcaaggattccattcttactatttgactccaatggtattgaaaagatggctatagatcagtagagttgagctacccgaaccttccatgtgcactgaaatagcagcaagagtttccccaaaagcagaccctgaacaagagctcacatggccctgtgtcctagttcactttctgtttctgtgatgaaacactctgatcaaaagcaacttagacgatgatgggatttatttggtttgcacttctgggtcatagttctttactgaaggaagtcagggccagaattgaagcaagaactatggggaagcactgcttcccagtttggtcaatgacttatactcagatagcatccctatatagcccaagtgtctggctcctctccccccatgcctagggattggtgatacctccagtgggtccttccagatcaaccatacatcaagataaatgatcacagagttggtctaaggccaatcctactgaggcaattctttggcttaggttactatagattctgttgacattgacaataaaaaccaaccaggacaacaggaagtgactcctaaaagcatggaagcaga

SEQ ID NO: 2484 - DNA, 1800 bp, mus musculus
ggtttcctctgagcccacctccaatacttccacctctacgaagcccttccctaagcatattctccaagttgggggtctgatgtctcttctggtttccatgggcccctatgcagaatcaaccctgggccaggctcagctggccatcccctaggccaccttgggaacaggatgagttagttctgtatccgtctgtctgtgtgaactacactcgtgaggtattgcctaggtccctagagggttgtcccctttcacacggtgctgctccctgtctcccccccaccctgattgctcccctgcccttggctaggctccagccagagaaggttctggtcactcttgttcaaaaagatctgccattgcctcagctaagtggaggggtctggaagccacgctaattgattaattaaaccctctcggttaattagctacattcctccagggaaagaagtctagagctgagccaaagcctagttgggactgggggaggggttcattagctagggtcaggcccagcctgaagcttcaggcttgatggttggggaggcagaggagaggggagggctggagaggtgtgtagagtagttctgggctctggagccagctggtccacctaggggggtaggagagtgggggggtggggggggagaagaggcctttagctttgtcctggaccctgagctcaatcctgagcatacacactgtgagctagagactaggggttagttagccccgaggaagagagaagcagaaaatccaggagcagagggctgcatctggcaggataaagcccacacagggctggggggatccaggcaatcctgtccctgctgctgcttctacaccttcgggggaggctttgaatgcctgcacctgaacataaatctgggctgggggggggggggggcaggctgcagcaggtttgcagcagaggcagcacctgatcaggtttaggttttaaagagtccaggggcggggcttggagaaacaggagaagggtgggacctggcgcagaggggcttcaggcacccatgcagcaaggacacccatccggtctgagaatagcatcagataaactcccactgcgttgcctagggacacccaagttcttcctctggttctctttcctcatcggcaaggagccatgggggtggtgggtggggaggaggtgcccctgaggccacagccttgggatatgaatgtcacccagtatgtttccttgacccaggacaaagcaccttcttcacctctgcgctcgctctcgtggcgctgagatgcaccagctagggaagtgacatgcccagcccccaaggataagcattcaggaaatgcagaattctggttccagggtcgcagagggacacctgtgtctagcctggctcaagaggaagagggattggccatgggtcagaggcagaaagcccaggacatcccgagcagccacaggcagcaggcaagggctacagccttggcaagaagcctgccctgggctggtcctccagctccctgagtggctgcccaagtgggaacaatgaccctttcacgtcacgcctcctccagtcacagcaactttggcgccgcaggacaaaggggccatttcatcattgttggattggatcaacagcctgcgcgacagagctctgctgccccccacccagccaggcccaggactctgtctggtccaacctcatgggtcccagagaccctcttgatccttgtcttcctttttctgacttactgtgagaatgctagcccagcttcccagcctcagtcttcccgtgtggaaagagggtacggcagtgc

SEQ ID NO: 2485 - DNA, 1400 bp, mus musculus
gtacccaagaagctaaagggatctgcaaccctataggtggaacaacattatgaactaaccagtaccccggagctcttgactctagctgcatatgtatcaaaagatggcctaggcggccatcactggaaagagaggcccattggacacgcaaactttatatgccccagttcaggggaataccagggccaaaaaaggggagtgggtgggtaggggagtgggggtgggtggctatgggggacttttggtatagcattggaaatgtaaatgagctaaatacctaataaaaaatggaaaaaaatagaaaaaaaaaaaagaaatattagcaccgatgatttaattaaacctaagtgtttgtatagtcaaaaataggcagggagtcaggcacacaccattaattcagcactctggaggcagaggcaggtgcatctctgactttgaggccagcctggactacagccagtgctcttgacagccgagtcatctctccagccctggccagactttcaatttttctgcaagctccactgtaggaaagtcttcctggcatcgaggtcagctctgcaataccgagaagggtggaaagcaccaggaagggcaaatgatgcaacaacctgagcacctactatgctccctctcacaccaacccacaagtgtctagcagcatttctgtgcaaggccatggttcctgccatatcaagaattgtcttcaatcatcctggctttcacaatcctggtttctgactggctccccatgcccagaggccaggcctgctgggtgatccactccacacagggttcttggaagatgaggagaaggggaagggaagagagcagaagctataagttccacactggcccctcgtgatgtggaaggtggtgatggaaggacagaaactgggagccagaggacatgggtccttgctgggactcagtgtccctataccaaactatagaaggaacccttctacaattagggcctctctattgtaagctgatttctttttcttttcttttcttcttttttttaatgtgttacaaacctttgtaaagataattcatgccatttgtccaaaaaaagataggttttcaggacttattatattgtacccaataaatctttgagtgtataagttgagtcttcactatatcacatgatgtattcatgatgaaaaacattgagagtcttgctacatatctgtcttctagtcttctatttgacaatattctttctttttttttagatttttttttacctttttttcacttttttttttttttttttttttttttttttttttttttttttttggtttttcgagacagggttccgaacactcctccattgttggtgggattgcaagctggtacaaccactctggaaatcagtctggcggttcctc

SEQ ID NO: 2486 - DNA, 1000 bp, mus musculus
gtcatcacagaggacttaacataggaggggccactgcacgggtgtgtggctccagaagaggcctgtgaaagtggctttaaagtttccttagcttctagccggcggcctcagtaaatgggattaaaaggtcaggagggggctgggcataccttgcagaccctgtcggtcaaaaggggcgttgactttggccgcaccagcagtgcgagcagcacctcaaggttccccagctccagcaggaaggcggccaaggggtcttgcactggagaaccctgaagcagggttagcaacagctccagggtgcccaccacctgaggatacatggaatgtcaccctaggatgggttccccagctggcctagacacctctcacccaagcctcaccctccccaacctccagcctacctggccatcgtcaccggtagctgccaaaaagttcaatacaacctgcatgtcttccaccgagaagttcctaaccaagaactcacgcaccagacccaaaagggaagtctgtactgtacgcaggtcgtctgccgctagggggcgctcgcgctgcgggctggcaggtccgacaagcatagccagcgagtaggagaggtaaaatcggggtggggtgggatggggaaacaggcaggtaagctggggcagaacgtcatcctgtccccaaaccaatctctgctgagccggacctccaacatccgccagggcccgccagcctaacctgtagtgcgtgcgcagagcatcgaggaggaactgaactccgtacttcttccgaagtttctgtctgtgctcacggaccatgctagacatgtactggatgtgacctgggtggacatcagcagaaagcttcttcacgccctccagggcagggctctgccctctatgtcctctcagattatagagggaggctgtggcttctcgccctgcctgccctgtacccaggcctctttcccaagcccctcacctacccaggcgcacagcgaagtcactgagggtccagaggt

SEQ ID NO: 2487 - DNA, 1000 bp, mus musculus
gcactataaagtgctacaccaaaacaggggatttttagttgtttcaacttctgggttatcttcatgtcaaacattgtggactgcattgtgggaggagctgttggccacacaacactggaaaatgcttagttcaataaagctttggagcattattgaacacaagactgtctcagagtaaattgttacttttctctgacaaggagaagccccaggaaaggaaggcttgcttggctcagtctgcaggtacagtctgccacagcagggaaggaggcagggaagcagtgggctgagtctcagtggtgaggccactggacacacacatccacagccaggaagcagagagctgaatgcttatgctatgctggctttctcctgcccgtgggctgctgggcctcctctctcccattaggtctcttttagatgagtctaaatacagtccaattcacaaggagatgagctaccacacagagcagtctctattgtgcaagctgatttgactgtggccactctgattttgcaaacctatatgagtgtggccactctgaaaaaggcctcaagggtcttctcaccagggacaacctggggaatatgatgattgtaacacaggcaggaataattgcctgtggagtttgtattaaattgcacaccagttaagatgctaaagaattttgtaagaggcatcggatttaatgatcacacttataataattctgctagctgggcaccattaacattcccatcatatagggaaggaaactgaggttatgactcttcccccaacctacaaactaactagcagagacagacttcagaacctacacttctgtgtagtctcaggcactgtttcccatgtggcataaagacggtgtcactgtctgtggtggtttgaatgagactcctccatagtcttgggcatttgaatacttggtctccagttggtggtgctgtttaaggaggcttaggggtgtggcctaacttagtgaagtgtcaggacaattag

SEQ ID NO: 2488 - DNA, 1200 bp, mus musculus
gtataaatcaagggtttgtacaaatgaaaaacaatatctacaatgcagaaagtaaaagcccttcaataataaccgatgaatgatttcccatgcaacatgtttggaaaactgtttagttctagttttggatgtaaaggcaatgtgcaatacatgcctaagttcatgaaactatacagacattcctccatgtcgatcccataagttccaaagagcctgcaaagatggctgctattcagagtaattgtcagttttggaatcacagtgttggttgacatttgggactagctaaagataacttgagattctttgtatttcataaaacctcagtggtgtctctttaagtaagcctatgacccaatcacgtggtttccaccacacgtatgatatgctctgctcatgcttcctccgtcagcagcctccacacagacagaagacacacccctctgcatggggcttttccatggtttttcttccaacacttcattaatgagacaatttttgttcagttctatagtattaatttatggactttgttttaattctaaactgtttctcagtggtaataaacttataaaatgcttagaccccaactgtaccttatctatatcggtcttacataaagaatctcggggcagcaaaggggagagacatggtgtgcatataatcaaattactttgtatgaaatttgtcctagctagggtttttatttctttgatgaaacaccatgaccaaaagcaatttggggaggaaaggattcattttggcttatatttccatatcactgttcatcattgaaggaagttggaatagaaactcaagcagggcagaagcctggaagcaggagctgatgcagtggccatggaggagtgcttcttactggcttgcacagtcagctttcttaacaaaagcgaaccacgaggccagggatgacaccactcacagtgggctggaccctcccacgtcagtcactaattaagaaaatgtcctacaagttggccttatagactgacctcatggagacatgttctcacctgaggttctccgtcttagacagctttagcttgtgtcaagttgacataaaactaaccaacatgaaactctcaaagaattaatattttttaaatattgctagagtagtatattcaatgattctaacttctattccctattggaaatcccagtgtatttcaggatatgaat

SEQ ID NO: 2489 - DNA, 1200 bp, mus musculus; identical to SEQ ID NO: 2488

SEQ ID NO: 2490 - DNA, 1200 bp, mus musculus; identical to SEQ ID NO: 2488

SEQ ID NO: 2491 - DNA, 1200 bp, mus musculus; identical to SEQ ID NO: 2488

SEQ ID NO: 2492 - DNA, 1200 bp, mus musculus; identical to SEQ ID NO: 2488

SEQ ID NO: 2493 - DNA, 1200 bp, mus musculus; identical to SEQ ID NO: 2488

SEQ ID NO: 2494 - DNA, 1400 bp, mus musculus
  misc_feature (1382)..(1400): n is a, c, g, or t
ttgacatttttaaacatatgactctgtgggcttactgggaagttctttgggtctgaatcagatttgggtagactcagcagggctgaaagatgcaggagtcagagcagcaagtgggagaggggtgaaggacagattcttcggtgtctagtcattggctacctattggtagtaggtcactaccctccctctccagcataattcaatggatgtatttgcatgcacattgcaagagtccagtgtcaagaaaggctaagcatggagatgtcatttggtgggttttgctccattcctttgttgcatgtaagtctccaggagggtctggctttaggatgggagaaaagagactttgactgttcatagtagaaataacaagtcacttgcttagctgcatgggagctagatataattagggaagagttggagcgatcactagaattgtttagtgataaacattgcttgttctcaaaaacattttggataaggaatacctaactccatagcctcatggatgtggacacttgtttcccaaacagtgatgtcatagaacccttaagagatggaatttcactggaagaaatttgaggttgcctatcatagccctacttcctgtcttatctctttgcttcctgcatgtggatgaaatgtgacttctctgccttctaactaccagcgtggcctcgcactgatgggctttatctcctagctaccctccaccccgacactataaaccaaaaaccattcctttttttggtattgttcgtggtggtggggtgttgttttgtttttttgagacagggattctctgtatagccctggctgtcctggaactcactttgtagaccaggctgaccttaaactcacaaatctgactgcccctgcctcccaagtgctggcattaaaggtgtgtgccaccaacgtccggcttatcactttctgtcctaagtaactttgagtcagagtatttcatcacagcagtggaaatcaaactagaacatcagttaaaacaaaatctccaccgtgtctaagttctggggctaaaacttaaatgctattaaaatactgaagtcaggatagccatatttaaaagcatggtgttgagattctgagggggcgccatcttcagctccagataaccggccacctttttggtgagagcacaggggtccacccggtccgagaggtttctgcctcaggcttcgcgggagccaccttggttctgggactccacggaggccaggctgcacgggtgagggtgtggaatacagaggccagcagtttctgggacaggcgagctccagagaccttctgaggcggcaccattttcggctccagacaaccggccaccttcctggccaaagcaacacagcttctgggaaagatcnnnnnnnnnnnnnnnnnnn

SEQ ID NO: 2495 - DNA, 1200 bp, mus musculus
ttcacgaggctcaatggggttcctcccatttttgtgcaatatggaatcagggagaaaaaaaaccctcaggctttaaaagaacttccgcacttgcttgctcgctcgctcgctcgttaatgctgctgatttccctgctgcagttagttctgtttcctgcaccttgtaacatattccacagtctctaggattaatcaaacgagatgaggggatttataccctgctgtgagccgagagggaagcttaacagtctcccaaaataatatcatttgacattcagagccattaggcaaagacggcaaagggcatttgtgtttcagactgatttgtgttcagcgggtggcagaccccttcctgtccccttggcagctacagggcggtgacctttctcactccagagatgtgattgccttcacaccagaaatgcccagcaaatctcaagttagctccgtcccacgctagccctgctggccttttacgaccattgtggcgttcccggctgacaactctctaagaagaggttgctgtgcagaattaataacgtctgagctggccctctagttggtgttcacgaaattaacaagtaccgctttggacaatgacaaaagtcgcaaaatctgagcccagaggatgaaaaggatttggacagcttctgctctgaccccttcgattcccaaattaagggaactgggggtcagagaggggacggggctcttgtttccaggatctgagagcagggctggaactgtgttttctcacattggcagcatcaatgggtaacagaaatcctgtgtgcgcagctatgataagatgtaacagcgaagaacggaaaggagcaccaagtctcgaagcagggtagagcggaagccttgggctcctcagcctccccagctagtgtggagatactctgaggaagccccatccctgtggaaacagttagttacctgacaactgctggtccaggtacatgtctcacacttcaccttctctactgggaacagacaagccttgtcaactgacagagggtggatgaccctcacagccttcttgtttacaaaaggaaaacaacagcaaaggtggtcttagagaccaaccagataatgaaaatgagcgggcatcatgagtcccacaaagcatttcagccctgcagcagcatcacaatgtggttcagcaatattaaccccaccccagcctggatgagga

SEQ ID NO: 2496 - DNA, 1000 bp, mus musculus
agacggtgacaggaagctgctggtgctgtcctctggcccctgtgtgtgcacaaagcatgtgtacctacacacaggtgtgtgcatacagcacacacatgcacacactcggaagagaatgtgtgtgtatgacacatgcacacacactgagccactttcgagtgctcggtggccacactgggcagctgactgtgcactaggcagggctggtggagaacagttccgtgatcagagagagctccgctggacagagctggctcaagtatctgtgctgctaatggtttctaagccaggaatttcccagtgtcgtggttttgaagatgcttggcactatttggaggtgtggccttgttggaggaagcgtgtcactgtgggcatgggctttaaaactcttgtcctagctgtctttagaacaagaggtagacttctcagctcctcctgcaccatgcctgcctggatgctgccatgctcccaccttgaaccgcagaacctgtaagccagccctgattaaatgttgtccttataagacttgccttggacatggtgtctgttcacagcagtaaaaccctaactaagacacccagtgtctatttaatctcttgaactatataacgcctgtgtgggtttcttttaaaaaagtgaaatggacctttctcctccctccttctctccttccttctttccctcattccctccctcccttcttgtcttccttcttccctcttcctctcgcctatgagctctggtgctctctagggctgtggctttaagatcttggctgttgtccccctgtagttaccttgcccatgtgacaggaagagagctaacttacctgtgacatgacatctcacgcattggagttgtgtgtggagtagcagatggttgtgagctgccatgtggtgctgagtatcaacctttggagagagcagtcagtggtcttaacctctgaactacctcttcagctccataccttgtcaggcagcaatggggtgagtacagagtg

SEQ ID NO: 2497 - DNA, 1000 bp, mus musculus
aggaatccctgtgaaatctaccaagaataaaagcctctgtctccctacttgacctacagatcagaggtagaggtgggctgtgtcagggctgcaaactcgcatctgcactgtgtacagttaagatgtctggatgcatcttgtcattttcccatccctggttgacatggggtcttctggttccttgcctctcctgagacttgcatggcctgaagactctctctcctcctgggtatttccaatgcccaaggttaacttgtgaagctgctaagggcgggaaatggggaagtaggaccagggaggtaaggctgcagggggtaagcactgtggagggagaggtccccttaagccttagggtggcctatgacgtgtaaggcctcagaaggatccccaaggtccatgggaaccatagtcattactgagaatagactttctgcctggccttttagggcagtggtgcaatttggatttgatttttatttagacgaagtaaaggattgtgacatttcttgagcacctgcatttacagggcaaaattcatacccacagcacagccattaaagagattgcactggacacaatgaggatttattgttgcagaattaagaatggactctgtgctaaaggaaaaataaaggttctccgattatctttgaagctcttttgccagtgccaaagctgccccctgctggtggctcggctcattgctttgttcctggatggaaatcgacatgcagagctgtggactagccctgtggagacaatgtacagagttgcaggataaccaccatcaggaccaatcaaggaggcagtgcagggaatttgcaaaggataaacctgctatttctcttcccatcagtatacatgtgtgcctctatgctcctcctgtgcatgtgtgcctctgtgctcctcatgtgcatgtgtgtctctgattctcatgtgcatgtgtgtctctgtgctcctcatgtacatgtgtgcctctgtgctcctcatgtgcatgtgt

SEQ ID NO: 2498 - DNA, 1000 bp, mus musculus
taggagatggtgaaggccgcagccgaggcaaacttccccaccacagccagcacagtgaccaccgtgggaagatctggaggacgagcaggacagacacacacagagaaggacagccatcacctaagcctcaacacctccgtgtctactcaagtgcctcaccatctatacccacaccccgggaaacttagtcctgaagagggaagggcaatggatctagccatggcagggaggaagaggctgggaaacagcctggtacctcctgggatgaagatgataatgatgtacatgatgccagccagagtcagagtacacagctggctccacttgcgacccagcttctccatcatgaggacactgaggaagcggccaggcatttccactgctccaaatatcagctgtgtcacatagatatccaggccaaagtcccccacttggaagctgaggctgtagtacaccagactgtccacaaacctacaaagtacccaagcatccttgtcactgctaggtgtacatcaggtcacacccaaaggaacatcctggcttaatgcgttcagaccaggagacgtgggtcacctgaggagaaaccgtcacagttagagcctgtgtccacccctccagtgacacacagcagaagaacacaagtgccttctgggtctgtcctaacagagggacaaggtcctggacacttaccagacagctatgagaatcagagtcaccttcctgaggtgagggtgtctgaaaaggtccaaggcgttccccgaggggcctgtcttctcagggaccagctacaagaagggcagagtgaggggccaggactcaggcatggagattggcttgagttggggtgtgccttcacctgctcacaggtacctggttcaggagctccggggaaagtggccggccgttcaccaaggctgccttctggaccagttgtttggcctcttctgtccttccttgggacagaagccaccgtggagattctggcagaaccctgtcaacc

SEQ ID NO: 2499 - DNA, 1800 bp, mus musculus
ttactctaatctcagcacttgagaatctgaagtaggtagaccacgctaagtctgatgctagccagggctatatgataacactctgtctcaacaaaaacaaaattccagtgggacaacagagttcctatcttcatggatcttaaagaccagagagagacagaagaaagcaaaagaaggaaaagaataaacatgaacatatgtgctgtggaaagtgccagcattacattccaccctggaggctgagaagcagtaaatctcctgaaggctagccagcaagcctggccccgctgtacctgtgccaaacctggaccacaggaggcccatgctcagaaagaatgcttagcgtgagtctgagcaccctcacagcctgcctccctgtggactcccctcactctttctgttctttctctcctcagatcaacaacaaggcctgtggcaagatccctgtgccccagcatgttgcccaggaccaggacaaagtccatgaacttgttctccagagcgagctaggcatgaagctgctgcaggggagaagcatcaagaaggccttcctctcccccaggactgccctcatcaacttcttggtgcaggagtgaccagggcttctaggaccctccttctctgcccagatcaagggaaggaatgttaacgtgggaaaaaaggcaaacatcagggacattggcctttgtgccaggaccagcaggagtcagcaggaggcctaaggcgagctcagggaggacagaaacctcccgtggagcagaagggcaaaagctcgcttgatcttgattttcagtaggaatacagaccgtgaaagcggggcctcacgatccttctgaccttttgggttttaagcaggatgtgtcagaaaagttaccacagggataactggcttgtggcggccaagcgttcatagcgacgtcgctttttgatccttcgatgtcggctcttcctatcattgtgaagcagaattcaccaagcgttggattgttcacccactaatagggaacgtgagctgggattagaccgtcgtgagacaggttagttttaccctactgatgatgtgttgttgccatggtaatcctgctcagtacgagaggaaccgcagctagcttgtgtctccagtgtcttttaccatcacaggccctggctctgtgctacctccctagaatacctgtggttcatcaccttcagctcacactccattcagacaatgctcacttaggcctacaagcaagggagaggcttaagcacaaggtctttaagcttgatactgtgcctggtctcaatgcctagaaattccaacttaactgtcgctatcataaaggattttaaatttttttacaagtgagaacctagcatgtcaaggtcctaggttccatctccaacacgaaaaaagcaaggcaactctaccaaagaaactaattacatacttgtattcccaatatgtgagaagctgaggaaggaggatcatgagtttaaagccatccttggttacatgagactcttgtctcaaagaactaccagggatcctaatggacaacaaaggttgaaaaccattgaattaataaatgttgtgaaccataatttctacccagtccttcttccttcattttcatctcatctgggataagtttagcccagtaccgtgaggaagtagagttggaagagattaggactagaagggaaggcagggctacaactctggagaggtgatttaagaggatcctcaagacacaaatgacagtcccatgacacacaggaagcacatgagggttaaagtgagggttttttgtttttgtt

SEQ ID NO: 2500 - DNA, 1400 bp, mus musculus
aaaaaaaaaaaacaaaacaaaaaacaggtgcaaacctagactacttataaatcactaaactctcaatcaccatggatggagaaaacaagatatttcaagaccaaaccaaattcaaaaatatctacccacaaatctaggcctacagaaaacaataaaaggaaaaccccaatccaggaaggatagctatatccaagaaaacttagaaaataaataattccctagtagcaaaaataagagaagcacacacaaactctctctgtgtctgtctctctctgtgtctgtctctctctgtctctctctgtctctctgtctctctctctttctcacacacacacacacacacacacacacacacacacacacacacacagagggcgaggataataacaagaaaaggatgaaaataacaggaaataccattcactgttcattaatacctctcaacatcaatggactcaattccccaataaaaggatacaggctcccttccagtttccatctgtgcaatggagctgcccctgtgccacaacactccacaccccaatcctgcccagagatagcttatctcccagttgtgctgacacaactaagctcactggtcagaccaccactactgccccaatacctgacccaagtggaaccagaaaccagtgaggagttggagacaggatacttgtgatttccatctacaccccccctctcccagagctgatcctgtgccatagttctctgtactccagtcccacctggagatagcttgtcttccaggagtgccaacacacctaaaattacaggactgttgatacacccaggctaacaccctcataggagaaataagctccagccagagacagcaagaccagctaacacaaaaaataaccaaatggcaagcacaagaaaataagcaatagaaaccaaggagacttggcatcatcagaacccatttctcccaccacagcaagccctggatgctctaacataccaaaaaaagcaaatttctgatttataatcacatctcatgatgctgataaataattcccttaaaggaatacaggagaacacaggtaaacaggtagaagaccttgaagaggaaacacataaattccttaaagagttacaggaaaacacaatgaaatagctgaaggaattgaacaaaaccatccacaatctaaaactggaaatagaaaaaaaaaaaagaattcacaaagcaagacagccatggatatagaaaacctaggaaagagatcaggagtcatcgatgcaagcatcaccagcagaatatgagagatagaagagagaatctcaggtgcagaaaacactgacacaacagtcaaagaaaatgcaaaatgcataaaaatcctaactcaaaacatcctggaattccaggacataaataactt

SEQ ID NO: 2501 - DNA, 1000 bp, mus musculus
tctacatatctaagtcctcattaattgcctatagctctttatctagacatgggacaccatgatatttcctttatctacaacggcaagttgttataattttccagttcttatttaagcagccacatgatttagatccattgttgtagtttccttataacaattagaagacaatcactcagtagagttcttggtccttcagatgcaatctttacaattttcttgtgcagtgtttctttagacttcttgcagaggagttgaattgtgataaagaaaatacagctatacacttcatgaccagttgttttctgcattttggtattttttttccttttttaaaaattagatattttcttcatttacatttcaaatgttatccccttccctaggttccctccttcaattgcccccctcccagtgctcctgaacccaccatgtcccacttcctggcactggcattcccctatactggggcatataatcttacaggaccaaggtcctctcctcccattgatgacctactaggccattctctgctacatatgcagcctgaaccacaagtcccaccatgtgttttctttgattggtggtttagtccaagggagctctggaggtactggttagttcataatgttgttcctcctatggggctgcaaaccccttcaactccttggtactttctctaattccttcactggggaccctgtgcttcatccaatggatggcttcatccacttctgtatttgtcaggcactggcagagcctctcaggagacagctttatcaggctcctgtcagcgagctcttgttggcatctgcaatagtgtctggatttggtgggtttttataggatggatccccatgtggggcagtatctggatggtcattccttcagtctctgctcagacctttgtctctacaactcattccatgggaattttgttccccattctaagaagcaacaaagtatctccactttggtattcttgagtttcatgtgtttt

SEQ ID NO: 2502 - DNA, 1200 bp, mus musculus
aaattataattcaatattaagaaagcaaacctccagattgattttcagcatggttgtaccagtttacaatcctaccagcaatggaggagtgttcctctttcttcacatccttgccaacatgtgttgtcacatgagaatttgattttagccattctgattgctgtcattttgatttgcatttctctgatcactgaggtctttgaacatttcttttgatgtttctcagccatcctaaattcctctgttttgaattccctgagggccaacagaaagaatggaaacaggcaataggagtaggaggttggaggaaccctccagaatgcaccagagacatgggaggtgagagactctgaggactctcacctcccatgaaatgccctacagtaaggagagggaaattatagagcccacctccagcaggaaaataggacatcaagtgagggagggggttgccatcccacagtcaaaaccctgacctataattgttcctatctgaagaattatagggatggaaatggagaggagctggaggaaaagaaggtccagcaacaggcccaaagtgagatccagctcaaggggaggtctcaaggcctgacactattactgaagctatggagcactcacacaaagggatctatcatgattgccctccaaaagacccaacaagctgctaaaagagtgagatgcagatatttgcacccaaccaatggacagaaacagctgacccctgatgttgaattaaggaaagactatcataagctgaggagggtgaccctgtaggaggaccagcagttccaatctggaccccggagttctcttatacactggaccaccaaacaggcagcatacaccagctgataagaggtccccaacacatatacagcggaggactgccaggtctgtgttcattcaaagaagatgtacctaaccctcaagagactggaggcctcagggagtttagaggtcaggtggggtggggtgggggtggagacatccatgtggagacaggggcgtggggaggaggtatgggatgtggaacgtcagagggtggaccggggagttgagggaaaaatctggagtgtaaaataataaataataaaaaagaaagtgattattttgaataaaatcaaacaaaaatatgaacagattatgaaaaaggaagaggaataagaattggtaatttcttacaatggacatgtc

SEQ ID NO: 2503 - DNA, 1200 bp, mus musculus
gttggtggtgttgctgatggtggtagtggtggtgatggtgaaattttttgtttatttgtttgtttgttttaataatggttatcacagttatcctggatacctagtggaattacaattttcctgacaagagcccagaggattcaatggcagaaaacaaacaaacaaacaaacaaacaaacaaacaaacaaaaaaccaacaaacaaaaagaaaacttaattatggttgggagtctatgttgccctcacacctgaaactgccaatacatttttcaggtaggaatcagggcttaatggcagtaaaagtagctacttatatagggaaactaaaaagtcctaggaagtagacagagaaaaaaaaaatactggttagggcagtaggtgaggaggggaatggagatgaagcagagactgagggaacaaccaaccaatgactgccccaacttgagacctattccatatgagagaaccaacctttgacactattaatgacactctgctatgcttgcagacaggaaagtagcataactgtctcctgagaggtttcgtccagcaacagatggaggcagatacagagacccacatccaaacatcaggtggaacctagggagtcttgtggaagagtagcgaatggaagtgagcaaattggaggggtcaaggacaccacaagaaggcccaaagagcctgggccaccaaccaaggaatgtgtaagagttgaacctaaactccctatacatttgtagcaaatgtgcagcttggttttcatgtggttcccctaacaaatggaactagggttgtcttggtctctcttccctgccattggatccccttcctcactgcttggactgtctggttgggcctcagtgggagaggatatgcctagacatccttggactagatgccccagggtggagtggtatccaagagagtctctccttctctgaggagaagggagcaatggagggatggacttgtggtggttggactgggaggaaaagagggaagatcctgtggttgatacataaagtaagtttaaacatgaataaacaaaaagtaaataatattgcatatgatattgatttatagaatcttgagtatatttccatcaatatctcatatgtaatatctggagactttcataaagtaataatactgaatttcatttgataatgtcgtgaaaattatatgattttttttcattat

SEQ ID NO: 2504 - DNA, 1200 bp, mus musculus
acattttctttgattgttgtgctgatgttctctatggaatcttctgcacctaaaattctctcttccatctcttgtattctgttgctgatcctcgcatctatggttccagatttctttcctagggtttctatctccagcgttgtctcactttgggttttctttattttttctacttccctttttaggtcttatatgattttgttcaattccttcacctctttggttgtgttttcctgtatttctttaaggacttctacctctttagcagtgttcttctgcctttctttaagtgagttattaaagtccttcttgatgtcctctatcatcatcatgagatatgcttttaaatctgagtctagcttttcgggtgtgttcgggtattcaggacaggaagaggtgggagtgctggtgctaatggtgagtggtcttggtttctgttagtaagattcttacgtttgcctttaaccatcttgtaatctctggagttagttgttatagttgtctctggttggagcttgttactcctgtgattctgttagcatctgtcagcagacctgggagtctagctctctcctgagtttcagtggtcagtgtactctctgcaggcaatctctcctcttgcaggaaagttgcactgacatctggcattcagacctgcctcctggcagaagatgaaggcccgaaacagagcctgtccagaagctgtgtagcttctgtagtccgcactctcacccgcatagactagactctgagagcttgaggaccagaaatcgctcccccaagtgctcaggcaaagttctcccaggcggggcggacacctctcctctggcagggaaggtaccggcatgtctggagcctgaaaaggtgtctgacccagaatctgtatcgcttctgcctgtcacacaagctgtgtctcttttgtagtccacactctcacatgtgcagactagtctctgagagatcctggaaccaagatggctcctcaacttgcttttgatcatcatagaagccccataaacagttgccaccaatgagtggcccaacttgccataagaggtatttaattcttgacattgcctcaatagctagggagcagaggctatccatccctgatatagaggatagaaccaaatactatgaataaataaataaataaataaagtcaatgaaatgatacctaatgatattctgctatgcaga

SEQ ID NO: 2505 - DNA, 1200 bp, mus musculus
gttcttgtacatagttgtaaaactcctcaagaaagcattagcaaattgaatctatcaacacgtggtataataaaacaccccaagttttgttcgagtatattaacaaatttaagataaataaaatgactgtgttaccagccatgaaaaaatgctgtaaataaaaaccatttgccaaaattttagaattaaggataacttttattttctgtgttttaaaactttttagacatatttattttacatatatgagcgtattgcctggtgtgcatggaggtcagaagaattcactgagttctcaggaactagagttctgaaccatctctcctgcaatggcctggcttttaagttaaaaacgtattctctctctctctctttttaaaattttatatttttgatttttgagacagggtttctctgtgtagccctggctgtcctggagctcactctgtagaccaggctggccttgaactcagaaatcctccagcctctgcctcccaagtgctgggattaaaggcgtgcgccaccactgcccagctaaacatttctgctctttggtccactagatgtgaccttagttctgagtttgaagtctcactgggagaaagtcaggcagtgcttaagtcatactcatattttccatgtaacttttcttgaaaaaagatgtaggcagatgcgtaggtacctaaatgtgatttgccagtcaggacagggcctcgtagcctcgagaacagcagtgagctgaggtgagagaggtcagctgacccaagctaagccaataggaatcgcccaggctgagcactaagtttgaaaaggaaccgttgacctcagcctcatctgggttccgggactccgcgggacctaggaaattagtctgaacaggtgagagggtgcgccagagaaccggacagcttctgggacgggcagaagcacagagccgctgaggcagcagcctgggcgggccgcagacaaccggccaccatccggaccagaggacaggtgtccgcctggcttgggaggcgacctcagcctcagcagcagcggtcgccatcttggttccgggactcagcagaacttaggaaattagtctgaacaggtgagagggtgcgccagagaaccggacagcttctgggacgggcggaagcacagagccgctgaggcagcagcctgggcgggccgcagataaccggccaccatccggac

SEQ ID NO: 2506 - DNA, 1400 bp, mus musculus
agagtctcattcagagcatttataccaggattaggttctgggttggtaagcaagcacgaaccacctgaagttagttttgtactaacaggcccataacactaaagcaggactcccagtctcacgttcaaaagggatccatttcctcaagtaaattctatctcttctccctgatcatttctcaccactttcagttttttcaatttttccagtttgtttttactttttttcctttttttttttttttttttttttttggacagggtcatactatctatctgcaactgacctggaatttgctatgtgaccttgaactcaggtgtcccctttcctctgccacctgagtgctgctggcattgaagacgaatgttcccatgtcttttttttctcactgttattttcatcttgtaaaactggcaatgttttcattacattcatacagatgcaggaaggtgaatccagtgccacatctgcctgcctccctccctgcctgcctgctaccactctccagtggaatggccttggactaaccctctaaacctgtaagctagccccaattgagtgatttctaagtttcactagttatgttgtcttttcacagcaatacaacagtaactaagagaggaagggggaacaggaagagtaggagcataactgatttctttccccaatggggagaattctaccttgtgctttattctctacaactgtccctccatgaatcagagaagcctagatattcctaaatggcacattttccttattcatttgatttctatttctctaacctccataggcaaccaaatacctgtctctgactctacttctatagaatctgatacaagataacaaatatgcttctcagtatcaactcacctggacccccagcatctctcagacactgagccaccaaccaggaagcatacacaggctggtccaaggcccctgacacacataacagaagaggactgccccatctggactcagtgagagaagatgcatctgaccctcaagagactggaggccccagggagtggggaggtctggtagaatagtggtgggggagtggggacatcctcttggagacagggagaagtggggtgggggaggaggaatgggaggtgggatagtcagagggtggaccagaagggggataatgactgaactgtaaaaaaataaaaagaataataattttttaaaaaacaaagatgcttctgtgtagcaagcaattgtgacagaatgttattcttatcaggcagtatctcagagaatactgaaagtgtcaagataagattgacgtttgtatttacctcataacttgggagactttgtgtttccattactctgtggtttactcatatttttagctacttaaattctccaaaagacattgaaagtgataa

SEQ ID NO: 2507 - DNA, 1000 bp, mus musculus
ctaatgttcccttttctaattcagtctgaaatctcatgaacttctgcacaaaataaatacagtggtagtggtgggaggggttggtggcggtgcagatctgtgtggttccagcactcaggaggcggagaaaggaggattgctgggagttgagtccagcttaggctacattgcaagattttgtcacaagaactatttaactaattacaggtacttctgcagggtccaaagtgagggccaaactcagttcttattgttgggactttgtttgttctgggatcttatgccatgccagaccttgggaagatgttgaagacaatctgccattacaatattaatgaggaatattgttcatctgtcatttttagattggcaagcttgccgtggcttccaagtacacagaaatctttctcaatatcttcagcctcaagccttgcattctggtctggcagatgaattaagcaatggttcctctcaagggtctcacctggaggctaagggaagctggactcaggtcccagctgccttctcacccacttcttcaacccaagggacagttcctttttaaccttagggattaaaattccttcaagggggctggcgagatggctcagcgggtaagagcactgactgctcttccgaaggtcctgagttcaaattccagcaaccacatggtggctcacaaccacccataatgagatcttataccctcttctggcgcatctgaagacagctacagtgtacttatgtagaatagtaaataaatctttgggctggagcaagcagggactgagcgagcggagttgaccagagtgaacggggccgaccggaatgagtggggttgacggagtgagcagaggtcgtaaaaattcaattcctaacaaccacatgaaggctaaacaaccatctgtacagatacagtgtactcatatacataaaataaacaaacaaacaaataaatctttttaaaaacagtccttcaattccacaatttcttcaagct

SEQ ID NO: 2508 - DNA, 1400 bp, mus musculus
tgagaacatgtacaagaacaactcaccagctccagagctgaccacaattaacacgaggaaagtaataaaaagaacagactggggtctcctagggagcatgaaggacaggcacctagcccaggcacaccatacagagtacagtggtcaagacactttcatccctccttcactagagtctcacctgacttctgtctgagacaaggcccagtctctggctgcagcacgggatggcaaatgatttatacaaagcccaaggacacacaggcagcagtctgcaggctaaggatgcttccatcagaagcagagtggacgaggtttcagaagctccaaacacagatgatgagtggcttctatgtcacaggaagggccagagaagcctggcacaggtaatcaaagaggcttgtcaccacccctgaaggcacatgtttgtcagtccctctcaaggggtaggcagcaaaggaatccaggggagaggtcagcacacagcattctgggccagagccacacaagtggcagacctgagacaagaccctgcttctttctccacatccccagactgccttatactaggctgccctgccatctgttatggcttaccaatgcccactcccagggcctctgccttcaaaggaaatgtgactttcagccccagccatcaattccatgcagagggagagagacccactcaatctgctcaattcataggaggttcctcttagcagttcctcaactccaggaaagtcagctagggagtaggagagcctgtagcagaaaggttgctccagtatttcatgagtgccaggggagggccacatttggttttgccaagccaggatgatcaatgggccagttttacaaaagtgccagctagctcagggccagatgtgatttatgtccatctaaagcctgcctgagtatgttgatggtgtcttgggagtaaaggtccaaatgcctaatatgcttatcagtgagtacaggcccatagcctgatgaagacccagagtgggactaccctttccttatgagggggaggggagaacaggagtaagcctgcagctttactctgtaccagagatagaagctggaattcccaaagctccagcagaaagctctgtcctgcttacatgtggaagcagagggtagggtggcctgctttgccccggggcagaaactccaaggggctctgctcatctgcctccaggatcagttctcccgccatactactgaagtagtgcaaagggccccttcctttgctggagtaagaactgagggaggcaagatgcccagtggctgtgagaagattgaaaaggagagccaggcaaagggactcctggcacaggatgagcaaaagagcatgtgcgtggtaaaatccacaaaaaatttcagccttgagtcctatg

SEQ ID NO: 2509 - DNA, 1800 bp, mus musculus
ccaagaggttctcacaaaacctacaacctccatcccaagagcctgtgtctgacagagctggtatgagaaaaggagacaattcttccccaggttttagccagactttgagtacacaatgggatagtgaggagcccagtgaaagcaattagtgatttggcctgtgaccctctagcacaatgttttgcaggtccagttggacatgacatgttttcattggaaaggcacatttatagtacctaatgacagcccatgtcaagtggcatattggttttgtgtttgtttgtttgtttgtttgttattggtagacatacatttttgttatgtatattcttcatttacatttcaaatggtatcccgaaagtcccctataccctcccccctgccctgctctccttcccacccactcccacttcttggccctggcattcccctgtactggggcatataaagtttgcaagaccaaagggcctctcttcccaatgagggtcaactaggccatcttctgctacatatgctgctagagacacgagctctggggagtactggttagttcatattgttgttcaatctataaggttgcagaccccttgagctccttgggtactttctctagctattccattgggggccctgtgttcaatccaatagatgactatgagcatccacttctgtatttgccaggcactggcatagcctcacaagagacaactatatcagggtcctttcagcaaaatcttgctggcatatgcaatagtgtctgtttggtggctgattatgggatggatccctgggtggggcagtttctggatggtcattgtactggctaattttgtgtcaacttgacacagctggagttatcacagagaaagcagcttcagttgaggaaatgcctccatgagatccaactgtaaggcattttctcaattagtgatcaagggttaaaggccccttgtgggtgggaccatctctgggctggcagtcttgggttctataagagagcaggctgagcaagccaggggaggcaagtcaataaagaacattcctccatggcctctgtatcagttcctgctccctgacctgcttgagttccagtcctgacttcctttggtgatgaacagcagcatggaagtgtaagccgaataaaccctttcctccccaacttgtttcttggtcatgatgtttgtgcaggaatagaaaccctgactaagacaaattggtaccagcagaatggggtattcctgtgacaacctgaccatgttttggggaggactgtggaaggactttggaactttgggcttgaagatccatccgatgttaaaagctctgtcagatgttgtgtaggagcttggaagataatgttgagaacactgcggaagatggatgtctggtttgtgaaatttcagagggaacattaaagacttttttcagggccattgctgttttgattgtgaagattctgtagttctggttagctggggctgaagaatcagctgtgattaacaagataccagaactattaaagcaaaaactttgcattactgggactattgatgctggttagctggagctaagaaattagtggtgattaagaagagaccagcatcattgaggtgacatcttcttggaagtgttttctgaaagcacagaggctgtgttccagagatagccaaggttgtaccttgtgctgtggctggacttggtaatgtgtaagagtcacccaggtggtactggttttgaaggcatgaaggggtcacacagagcagctgaggctcggcactgtgagaggccatggaaggccat

SEQ ID NO: 2510 - DNA, 1400 bp, mus musculus
tatgacattcaaagaagagctaattctaacactcctcaaactatttcacaaaatagaaaccgagggtctactgccaaacttattctatgaagccatagccaccctgatttctaaaccacacaaagattaaaaggaaaaggaatttaaggacaatttcttttatgagcattgatgcaagcatacttaataaagtactcacaaactgaatcttggaacacatcaaaaacctgatccatcaagaagaagtaggctagatcagtggcccaatacctgcccaaatgtaacagcctagttacctcccagaaggtccaaagtaaccaaagaaacaggggactctcttcctcaaatttccacacaggctggaacatgtacacagcccagctgacaggggacttaccccccacttctacctcaacccccaagctccactttccttcggcaccttttcctcaccagggtcagatcagtagcccaatacctgcacaaatactacagcctggaaacatcccaggagctccatagtaaccaagggctcaggacatcttaagtaaaaggggcacaggatttctgaagtaaccagagacacagaaggtctaacctaaccagaggcactggaagcctactctaatcagaggcaacactgcctgtctccaaggagatcagccctaactcagattacagagctctctgcctccaaggagaccagttacaatcagagacacccgggccaattaacaccagagtgaaccagatggccagagtcaagcagaagatcatatgtggcaagcccaatgcaattgggcacaatcagaacccagttcttccaccagagcaatccctggatactctaacatgactgaaaagcaatatagtggcctcacttcccatttttgaagatgacagatgcctttaaggaagatataacaaactccctttaaagaaacaggaaaacaaaggcaaacaggtagaaacaaacaaatcccttaaagaaatactggaaaatatgagagagcaggtaaaggagttgaataagacagtcttagaactataatttgaaatagaaacaatatggaaacaacaaaatgtggaaacccaggagatggacaacttagacaagatatcaggagttacagatgcaaatattaccaacagaatatgagagatagaatagagaatcctaggcatagaaaatacaaagtgtaaaaagcttcaaacccaatggaggtgcttgagaatgtacctaaggagctgaaggtgtctgcaaccctatgggtggaacaacaatatgaactaaccagtatcccggagctcttgtctctagctgcatatgtagcaaaagatggactagtcagccatcaatgggaagagaggccccttggtcttgcaaactttatatgtcc

SEQ ID NO: 2511 - DNA, 1200 bp, mus musculus
tcacatgctgattatatagtgcactctatagaaatatccattcaaatgcccactgccatcactgcattatacagaaacacacattcacatccccacaagtgtccttcattctacacaaaaacacattcacatgcacactgccatctctgcaatctacagaaacacatattcacatgcccactgatatctttcactctgcagaaatacactttctcatgctcattgctctcatgcactctacagaagcacacattcatatgtccattgcatacttcacagtacagtcacatatactcacatgcccagtgacacactgccctctgcagaaatccacattcatatggccattgccaacctgcactctacagtaacaaacactcacatgcccactgttatcctgcattctacagaaatattcatttccatgtcccctgcatggtgtactctacagagacacacactcacttgccttctgccaagagtgcactcctcacaatcacacatttacaggcacattgtgtactgaaacacaaattcacatgtccactgctcttcttcattctaaagaaacacatattcacatgcccactgcaaatgtacattttacagacacacacttccatgaccactgcatactgcactccacagaaacacttattcacatgactggtgcaatcaatgcacccaaaagaatcacatattcacatgcccactgccatcaacgcactctacagaaatacacattcacaggcccactggatacttcactctacagatgcacacattccaatgcccactgctgtcctgcactctacagacacacattcctattcccactgctgtcctgcactctgcagagatacacattcacactcctactgcctacttcactcttcacaagcacagttcacatgccgactatgtagtgcactttgtagaaatatacattcaaatgccaactgccatcacatcattctaaagaaacatatattcacatgcccacagctttcctgcactctatacacaaaaatattcacatgtctactgccatcactgcagtctacagaagcacataatcacatgcacactgttatctttcagtctacagaaacacactttcccatgtctactgctcccctgcattctacagaaacattcatatgcccattgcatacttcactcttcagtcccatatacaca

SEQ ID NO: 2512 - DNA, 1200 bp, mus musculus
actttgtgcctacttcctggcaactttatgctcacctctattttatccaaggtccttcccaaactcctgggttactttgtgcctacttcctggcaactttatgctcacctctattttatccgaggtccttcccaaactcctggggtcccaagtttcactcaccatgaacttaccctgccggcaaccactgactgctgaaagttctgaactcggtgggggagtcagttccccgtacgggccaccaattgtcgcgcccgctctcgaccagcaagaacgacgcgaccaccagtccttctaacagcagtttattcagtcctcatctctcttctttctcttcatcagtaccattccccagctgaagagttctgaatccacgccagatccttctcaacagtctgttttacgggaacactttattaccacctttccccgtgatgcagttctgaatcctccctgtagcagggggtcttcgctcgtgcctgaagatgtttcttgtcccgggtttcggcaccacttcttgcgcgcgctcaactggccaggaagaacgacgctgctacaggatccttctgcacacatttattcagtcctgtttcttcttgtttatatctcccttgtttatatctcccttgtttttatatcttccttgtttatatctcccccttgtttttatatctcccccttttatatctcccctgtttatatcgcccttgtttttatatctcccttgtttttatatctcccttgtttttatatctcccccttgtttttatatctcccctgcttatatctcccttgtttatatctcccaataataacaatcctctctcgaataataatcctccctctaacccgggcctctcactcttttatactctcagttcccatccacacacagcaggccacgccacctcaccaggcacgcagcttcagctaatcagggcagcaggggcaaatctccaccaaattggattcacctgtatcctggtacacctgcgcagcactcaagatgtttgtgtcttatatgaggaagtcaggtgcaagtcatatgacttagctgcagtccctggcgcctttaggactgccgccacacctgctcctaacagtccccagaggagataccacttccaggcactctaacaaacccaggattgtaggaccccaggatcccaggggcttggtcacaccaggatctcagaggaa

SEQ ID NO: 2513 - DNA, 1600 bp, mus musculus
gtggaaatgagagaatgtgtgtttctgtaaaattctttattctgtagtgatgttaatatgtttttatgtaaagtgcagtatgtagtgtgcatgggaatgtgttctttttagaatgcagtatgacagttggtatgtgaatatgtgtttctgtagacttcatggatggcagttggcatgtaaatgtatgtttctataaagtgtagcaatgcagtgactatgtgaatatgtatttctctagagtgtagtatggcagtggtcatgtgaattagtggtttttttggaatgcaggataaaagtaggcatatgaagttttgtgtgtagagtgcagctttgcagtggtcatgtcaatatatgtttctgtagagtgcttgatatcagtgggcatgtgagtggaggtgcctacagagaccatcatgtattttgtagttacacattttacagagttcagatgtgagaaatgtgcctgtgagtgtttttcctggggagtagaaatgggcacagtaggcatgtgggtcctgatccctactgatgccacaacttggcagtgtacttgtgagtccatgtaaccccagagcagagttcagcttggaactctgagtgtatgtgcctgcagtttcatggtggtgagtaagtggcttcagttgcacaaggcccagttcttgataaacatgtgagataagatgcctgctgacagaggacataggtgggcattggacatgtgagtgtgggtgctggtagagaaaaatggatgctatggatatgggactgcagtcacatatcaattcttgagctgggttgtcgacatgttactgcagattccttcacaggccagacagtcattggtttgtgagtacaggtgtctctagagtacagagaggtgcagtgggagacttcatgcaggggtatgcagagatcagagggaactgagcatgtgagtgcaagtgctatagagaccagcaaagggctgtgtgtgtaggcatgtagttgcctgtagaatccagggaagagctgtaggtacgtgagtgcaggtgcatgcagaggaaagagaaggcaagtggacctggagcccaggtgcctgcagagggcaagtgtgactggaaatgggtatagaaatacctgcagagaacagagaggtcagcatgtgagttcatgttcctcctgaggacaggattgcagtttacccatgagtgtatatgtctccaaagttcagaagggggattttggcttgtgaatgcaggtgcctacagaagcaagggaagggaagtgtgcatttgagtgcaggacccttctgagggctaagttaagcagtaggtatttgaggttccatgcctgaagatgccatgaatgcagtgggcatgtgaggacaggtgctagcagacaccatgaggacaatggccttgtgagcatagtgaagggccatgaccagaggtgggcagtagacatgtttgttcagattcatacagaagccaagtagtcactgtgtatatgaatgttgtgtatggagtgccagaaaggtgtaattggcaggggaggctgggtaagtgcaggggcataggtcatgttgttcatgtacctgcagaggccagaatggactggttgc

SEQ ID NO: 2514 - DNA, 1600 bp, mus musculus
tcttgcactctggctcctgaagatgtaagcaataaagctttgccgcagaagattctggtttgttgcgtctttcctggccggtcgtgagaacgcgattaataacacagatctctgagttcaaggtcaatctacagagcaaattccaggacagctaagcttaagcagtgacagagtttgaaaacagaaagctggtgataatgtaattgaagggggaccatgctccagctccagcaaacagcagaactcagcagctttcgtcatgtgtctctgactttaaagtcaagaatagaagagactattgggaaatatcaattaatgctggtaagttcgaactaagaaattagcagtgattatgaagagaccaacatcactgaggtcaaatcttctggcaagtattttctgagaacacaaagaagttgtggttcagatatatccaaggttgtacctcatgcttcagctgaacttagtaatgtgtgaaaatcacctagatagtactggttttgaaggcatgaaggagtcatggagagcaaatgaggcttgacattgtgagaggacagagaaggccattggtgaaagtgcagccacagttgcaattgacagcccaggactggaggagtagtgtaaagaagttgagatttggcaccatgaagggagcctatcagtgtcttttgttgaagcctcgttacagtagaacatcccagtgtgtttgggaaaacagtatcatggtatgaccaccaataacaacagcagcagtggaaaggagtcaacagaaatgctacagaaggcagagctggagatgtgaccctttggaggagatgagatgatcatctatagatcccagacattggaacaagaatctgtaaacttgagaggataggtgtctgcccagcccgggatggatttgcctgagcatcggcagcagacatcttggttccaggactctgtgtagtagtgtggactacagaagcaacaaagcttctgggacaagtcctgttttgggccttcatcttcagccaggagggaggtctgactgccagatatgtgtgcaccttccctgtaagaggaaagcttgcctgcagagagtgctctgaccactgaaactcaaaggagagagctcttctccaaggtctgctgatagaggctaacagaatcacgagaggaaaaatctctaacaagagacaactaaaacaactaactccagagattaccagatgttgaaaggtaaacataagaatcttactaacagaaaccaagaccaatcaccatcatcagaacccagcactcccacctcgcccagtccagggcacaccaacacacctgaaaagctagacctggatttaaaagcatatctcatgatgatagtagaggacttcaagaaggacgttaataactcactcaaagaaatacaggagaacactgctaaacaggtagaagaccataaagaggaagcacaaaaatcccttaaagaattgcaggaaaacacgaccaaaaaggtgatggaattgaataaagccatccaagacctaaaaagggaagtagacacaatagagaaaacacaaagtgagacaacactggagatagaaaatctaggaaagaaatc

SEQ ID NO: 2515 - DNA, 1000 bp, mus musculus
tctcctatattatcccatattcatgcccaagcatcccaatgggtctgggttatgatattaaacccatgagacttctctgcccttgctcactcatctcatcgtcttcttgtttaacactctctctctctctctctctctctctctctctctctctctctctctctccatatgtatatatatatatattatatatatacacagtcaggttgatgggttcttgttcttacttctcctccttccccttccccaaattcctctttcttcttacatggggtgcccccattggaggccagactttggtacacaataaattccagactgggaaactgtcccacctccatgctggaatttgtaactggcttgatattgagtaggtcttgtacagcagtcacatcatttccagaggataccagaaggtacaaggaaagagtctgatgcaggtgtagcaacccgggatttgcacagtgcttttcccaatcctctggctcttgcattctttgtactccaccttccttgatattccctgagtttgtcccatctattgttgaatcctcccattcatttcttctaagcactttgaacagtaattcatctctatattaattactgcccagttagcacaagaagcttctctgcctttggttaggagcagcactaacctattgatataaacaaatatatttagaaggcattttaataacatgactagttaggaaaacatcaatcagtaggttctttcctaggacctttgacttccctagccatgggtttcgaccatttttaaaatgacaggcatgaattttctagtgtggaagagacctcaagtacaatagaagaagagttggttaacccttataagctgtctaagcattattgcagtactggacacaccttgcatggtaggtcattgttaactttaatttttttcaaatcttattttcaatgatactctttaaatgctttatcctcccttctatcccaccaactaccagaggtagta

SEQ ID NO: 2516 - DNA, 1000 bp, mus musculus
ttgtgatggcatatccaggacttgctatggtgggagagtttggttctgatgattccaagtaaccttggtttctgttgcttctgttcttatgcttgccccctgccatctgtttatctcgagtgcttgctgccctcaatatatctgattggagcctgtccttcctgtaatcccagttgattcaagaatcctcagagttcagctttctctggaatcctgtgattctgggatcccgtgaacctgagattctgggtgtgtcagaattcttggcagtcaagcttcctggagaccctgagatcctggtgtgaccaagctcctggtatcctggaatcctttgaatcctaaggtccttggcatgttacagcacctggaagtggtgtctcctctggagaccatggggctgtctgctgtgttcaaaaccaaagtattccagcactgaccagaaggaaccagagctgctggtcaggcagggctcctgtgtccttgttgctgctctcacaggcttgtcatggttcatttggaacagatgttctgttccacttgccagtgatcctaccatttaccagtgatcctaggtgtgctagagcgccttcagcatggtgagtcctctggggaccatgggagtttgcactcaaggtggcctggagctggcaccgactggacggtacctgagtctctggccaggcaggtttcctggcacaggcccattatgattggtttgaaacagatgttgtgttccactcaccagtgatcctaagatcctgggcatgctaggatgcctgcagcatggagagtcctctggggaccatgggaccctctgcagagttcatgccccaggtgtccctgagatggcaccgaccggaaaggcataaatagatctcttaaggaaatacaggaaaacacaatcaaacatgtgaaggaaatgaaaatggataaaatggtccaagaaaaaaaatgaaatagaaaccataaagaaaacatacatggagacaaccctggagat

SEQ ID NO: 2517 - DNA, 1000 bp, mus musculus
tcatggtgtgttacacagtacacccttttacacaaacaacttcacttgcaaatgttcattgcaatgagtcattagtctggttccaggcgtctggcttctgcaacagtattaatactggatcctcacctggactcctcttggatattctgttattctgtgtcatggagatcctgcagctttggttctacaggactggctccttcatatgctctagcatgtcatagctgggttagatattggggtggaccaattcaaagccatggtcctgggcctgggtggtagctgagttagtcaggtgagtggtgtggggactgggccagctctcttgtttgttacagcctgcaaggggctggactggctctcctttactcatgccaccagagctggatctccagcattgtctaggtgggcatggctggtaaggagctgggccagctctcccccacacatgccttctgggcatgctcacccatgcctaggtcacccgggccagctctactgtactgcccaggtgaagtgcggggcctctctcctgaatgctgtagctggtcctccttttctgatgtccttacagcaaggtctctcacattgtccaggaaaggaacagagccagctctcccaacagctgatgagaggcagggccagcttttcacaactcttggatatcaagatgtccctaggaggcagtgcagaccagggatgtccacatgatctttggtggtaacatggaccaaggacattgacacagactcctgctgcttcagagccatggacccaaacatggcccttggtggcagcatggtctggtaccttaccatgaacttaggtggcaccacaggctactcacatcaggctattcctcaccacccttgtgtttccagttcctcctctcttcatagtgcacaaaccactctgtttctctttcactcccaactctctactgcacacttgctcatcataatggtgccctgagtgccacacagcagtgggcatgcctctg

SEQ ID NO: 2518 - DNA, 1200 bp, mus musculus
tttgtttgtttgttttgttcctgaactccttatgtgatttcttctttttgttctagaacctttaggtgtgttaagttgctagtatgagatctctctaagtttttccatgtaggcaattaggtctatgaattttcctcatagaactaccttcattgtgtcccataagtttggatatgttgtgtattcattttaatttaagaagtctttgatttatttcttgacccagttttcattcagcagacaactgttccgtttccatgagtttgtaagttccctgttgttgttgacaatcagttttgatccatgatgatctgttccaggaaatatttaaaaagaacccgcacattcccatgcttgagcctctgccctgaaggcctggccagccatgtattggtgggcaatggccaacctgtttatatctcatggagactctctggcccggatctcccaaaacgtctccacccagctcactaggtctccactggcaagttgctaccacgccaaccaagtgcttcaaatcccgcaaggcctttgtggtagacttcaggcagctttgctgccatacctttctctcttgaagctggaagagccacagtgtgaaggaaaacacaacataaacttagttcagaaaggacggtaactcaatctctgggcacagtaactaaaatcctaatcttgtaagccttattaaatctaaatcctctgggccttattacatctaaatcctctggtgacgaatcctgatggatccaccactaaaacctagagacacttgtagctacattttgtcctcacactgctatgcctgtccaaaaggacctaactctctcttcctttctcttttcctccttccaacccggaagtcccgcctactcgcccagtgattggcttctttattcattagggcattggttcacaagaagtcacctgagtacacgactcactcctcatctgcaacccctcccaagagagcagaattagcatcaaaatgcaaacagcaccaggcccatccacagcaatggtcaaataggatatcaagtgttatttctcctcctcctcctcctcctcctcctcctcctcctcctcctcctcctcctcctcctcctccttctccttgtatcctttgagacttgcttcgtatctgagtaagtggtcatttttggagaaactccatgaggtgccaaatagaaattatatttt

SEQ ID NO: 2519 - DNA, 1000 bp, mus musculus
tggtatgtactcactgataagtggatattagcctcaaaactcacaatgcccatgatacaacccacagaccataatggagcttaggaggaaggaagaccagggtatggatgcttcagccctgaattggagtgggggacagaggatgatcacaggaggtggagggggacctggaagggagagaagagggggaggaaataagggtgcagtatcaggtactggagaggactggagagaagtacagagggtcaggaaattgaataaaaatatgtagcagtcagggatgaggaagtggggatagccagtggagggtcccagatgctagggaaacgagaggctcccaggacccagtgggaatgactttaaccgaaatgtgcagagaagagaagatagagcctgtagacaccatctccgtggccctgggtcgagggatgaaaccacccacccatctcaaagtttttaacccagaaatgttcctgtccaaaggatgaacagggacacacaaaaaaaatggaacagagactgaaggaagggctattcgaggaccaccccacctggggatccatcctgtgtgtagacaccaaaccccaacactgttgctgttgccaagaagcacttgctgacaggaacctggtgtggctgttccctgggaggttcagctagcaactgaccgatgtagatgtggatggttggagccaatcatcggactgagcttagagactccggtgagtgagctgggggaaggactggaggagcagagggggactgcaacctcataggaagaacatcggctggacggaccacccagtgctcccatggactataccaccaaccaaggagtgcacagggagggatccatggctccagacacatagacacatatgtagcagaggatggcatcaatgggagtggacacccttggtcctgtggaggattgatccccagcgaacggggatgctcgagcagtggggcagaagtgggggagtaccctcataaagtcaga

SEQ ID NO: 2520 - DNA, 1000 bp, mus musculus
ttgcaatcccaccagcaatggaggagtgttcctctttctctacatcctcaccagcatctgctgtcacctgaatttttgatgttagccattctgactggtgtgcggtagaatctcagggctgttttgatttgcatttgcctgatgattaaggatgttgaacattttttcaggtacttctcagccatttggtattcctcagttgagaattctttgtttagctctgtatcccattttgtaatggggttaaggacttccttctaagcatccctttctttttcagaagtactgtcttcccaggttcattctttagggaggaattgccttaattctgtctcgtctccttcctcaagagccttcaggaacctgtgatcagctcctcatctcttctttctaaatgaaagtattccccattcctacttgtggctacaaggttgggagaagttaggatgtaaaattatggagcagaagtcagctcaccacctgcttcctgtttttttctctgcaacacagattgaagatggaggcaaggcagccttgtctcagaagatgcggactggtgatgagctggtgaatatcaatggcactccattgtatggctcccgccaagaggccctcatccttatcaaaggctccttcaggatcctcaagctgattgtcaggaggtaaggcacaggcatagaggccattgaaaagtactctatcattatcatcaagaaaacaggtatttcatctgtgcagaatagtgcagacaactaaagaagaatggacaaagggcctttggttcatattttgacactgctgtacactcattgcatgcattcatgtaaatgcttcttcagaactcatttgttcttctgaggactcagtgactcaacacatgcaaggcacttccactctgggctcctggagctcaggcttcccttctcagtggtcgttttcctgtctttatcttatatacataccaaagcttctacatcattgttattattaaaaagtgatt

SEQ ID NO: 2521 - DNA, 1000 bp, mus musculus
tcagtttggaaaatgtgaaccagcagactaaactcattagtagacagaacaaatgacaactcctaattgagaaaaatctgtatttgagataagcttaaagggatattgttccaaagatgtaaaaatgattatatatttaaagactttttacaaatatagaaacattacttatcttctagcaaagtagataagagtaaataaaggcagacagagaaaagtaatcagagtgtgaatgaattatataatgctatctattttggacatgattttgtcacattcccacatgctggtaactattttctttatcaaataagcctgtcataagaattaaacaattagtaaaaatcttttataaactgttacatatttcacaaagtgtagtctggtatggaagcaatctcagtcttcaagaccttgcaggaatggcactcagaagtcataaacctgacattgtctctgccacgctcagcaactgatgttcccctcacttcagtaaaaggagtaccgtggtggtcattaaagaggtaactctctgccttaggcttattctcagagaataaggtgtttacaacatggtggtcacatctggccctcaagcaggcaactgacccaacctctttcaaatggtcttgccgctcagagaatgaagttcaaagtctttccatatgctttgttttctgtagatgtctctggctcacactcctgacggcttcctaggcttcctgacacgcatcctaggctcaagctcggtctgcttataaactatgacacctcattgctcggggccctcccggtctgaaaaggtctccttcagtatttcctcacaaagctgaatccactttatactacaatatcaactcatatttttcactcattcagatgtagtccttcataatgttaataacactttctgtgaaaaacagtctcggacttttgatgggaattacattaaatctataagttgctttttggtaggatggccattctcacaatatttatc

SEQ ID NO: 2522 - DNA, 1000 bp, mus musculus
aacctaccaaaggacatagtttatattcccctcttcccctccctgttccctttcccacccaggtattgaggggaacaggattgaagccctgagggtcaccagaaagagtgcaagcaggcaacctaggaggtaaggagaccctctagaatgtaccagagacctgggaggtgagagattctcaggtctcaaagggaggggacattagataaaatgccctacagtggggaaagggaccttgtagaatccacctccagtaaaataacagggcatcaagtggaaagatggggttgccatcccacagtcaaaacctctgacccagaattgctcctgtctgaaagaactgcagggtcaaaatggagaaaagcctgagggaaaggaggtccagtgacagctcagggggaagccccaaggcctgacactattactgatactaaggtcagcttataaacaggagcctagcatgactgtccagagaaaggcccaacaagcagctgaaagagtcagatgcaaatattggacccaaccaatggacagaaactgttgacccctgtggttgaattagggaaaagctggaagaagctgaggaggagggcaaccctataggaagaccatcagtctcaactaacctggatttctcagacactgagccaccaaccaggcagcacacaacagctgatattaggcccccaacaacctgtacagcagaggactgcagtgtcgtgactcaatgagagaagatgcacctaaccctcaagagacttgaggtcccagggagtgggaggtctggtgggatggagggtggggggaggggagtagggacatcctcttagagatgagtggggaggaattatgggatatggaacagtcagagggcagactgggagggggataaatactggactataaacaaagattaaagaagaaaaaaaagagcatagtttagcagtatacagtgtagagattgctcatttaatacaggttgcatggctgtgtggaaccc

SEQ ID NO: 2523 - DNA, 1000 bp, mus musculus
ccatggctaatggcagaaaggaaacaagacaacccaggtgcctgtcccctaggtctgtggactgacttggttgtcagtgtatgcttctcagtgaggacctggagaagcagggcagggcttacttcactttcaaggatactgaattaactttgtcaaaattcaaatgctgaaatgtaaccccagtgacccctagctcacatgacgctccttagagattgaactctttgggagaggttatcatgacggtgaggttttcacaagagaatcaacggccttctcaaaaaaagagagcagagagcttgctaatgctatcaccccacaaccttggaaataaaaaaacaaaacaaaacaaaacaaacaaacaaacaaaaccacggtgtgacattggccaatcagctaaccatgtagagggagacacttctagatcctgactatcctcatatccttctcttgaacttgcatctctcatgactgctaggaataactgcctgttgtttcagcaccctagactagggtgttttgttatgatagcccgagctgactaaatatccttctacactctctcctacaccattagtaatgaatgacaatagtatatgccatcaaatctactctcacttctgctaattcttttgctcaagaaaaaagtctcaaatgacgttgagatctttgtttttcttctttatcctttctaggttgtattcaagtgaccaattcaagacatttgcagtttcatgtcctctattcctaaggaaatagaggaattgccgatagggccacattttcctgatttccacctggaccttctatttctcccacaagcaagttttaaagtagaataaagctgcaacgttcccagatgaacattctgggaagtaaagcacaggagaggagctttgagatcggagacaagaagaggaagagacacttaaaagaatcgagagtcagtgtgactaaagagatgatatgtcttcccaaaagtgtggaagtagcaagaaag

SEQ ID NO: 2524 - DNA, 1000 bp, mus musculus
aggatcaagtatgaattctaattataggtatctacaagtgtttggaggctttctacctgaaaggtagcgatacaggcatggcctgttatccaaatggacagatccttgcactagcctacagcctctgggtcagtgtttctcactctgtgtgtgtgtgtgtgtgtgtgtgtgtgtgtgtgtgtgtgtgcctgtgtgtgtacctgtgtgtgtatcttgtgtgtgtacctgtttgtgtgtgtacctgtgtgtatacatgcacaactcataggagaattttcaggtatcctgcgctatcattgtccaccttattactttgagacagactgtctcactgaccctcaagccaagctggcagccagcaagtttccaatgattctcttgatgcccctccccaacttcccccaacacacacacacacacacacacacacacacacacacacgactaggggcacaatcaagcctggttacatgtagctttttacatgggtgctggggatttgaacttagaacttagtgcctgagccaccccatctatttacacaattgctgagattcctcatatagagggccaagatgaaagaggctgcagctagctttgaaggcctctcttcaatatactcatattcttgcagggtcatctcacagatgaagcgggataaggttagtgtcttcatgctagcatggatgcactaaaggaaacaagaagaatggttagcaatcaattcagaaaatcagtcgcaggatgaagaatctctttcaagttatctcatccctagtccacatggctctctgcttgaacaatgtactacttctgcccttttgcagactcctgcctacaaaaatgcagacattctaggagaagcttatggtactggcatggcgggggagggggggttgagatctttaaggctcctaaacaaccaagtgactcttcttgctatagtagtcatcctttgatgggtcacagtctcctaactgactctgcacatagccctaca

SEQ ID NO: 2525 - DNA, 1000 bp, mus musculus
gaatgattaaaagttgtagtttcttttctattggtgtgataaaatactctcaacaaaagcaacttaggggaagggctgaaaagctggctcagaggttaagaacatacactgctcttgctgaggacacaaaatcagctctcagcaccatgtctggctctcacaaccatctatataactccagctccaggggatctgaggccctcttctggattccacacagacttgcactcatgcacataaccatatacagatgcacacagagacataattaaaaataaaatcaacatactttcaagatttattttaagtgtgtgtgtgtgtgtgtgtgtgtgtgtgtgtgtgtgtgtgtgtgtttacaggtccccacagaagccagaggtatcagaacatagagtttgggttacagtccattgtgagttgccccacatgggtgctaggcagatatgggtcctcttagaagggcagtatgtgctctttatggctgagccatctctccagcacaaaataaaatgagtattcctttttaaaaacaacttaaaggaagaaagggttcattattttagctcacagttccaagttgcagtccattgtggtagggaagtcaaggcaccaggagcctgaagcagccagtcacactgtctaaagacaagggcgaggactgcgtgcatggcagtgctcagctagcttttcccactactactaggaccccgtgcctagggcatgatgttcctcagtgaacagatcttcctactacaactaattccccaggacatgctcagatcctccccctggtgattccagatttatgtatcaagctggcagctgaaactgaacatcacagtgttggagaagatagagaattgtaacctgagttcaagtttatacagtgtactaatgtaccaaacactccatggtaccctagtaacatatgcatgtttatccttttattcctaagtgctgttaagataaaacgtgtaagaacatattgagtgaaaaaagg

SEQ ID NO: 2526 - DNA, 1000 bp, mus musculus
ggctgcacagaatcaggaagactcaaagaggaggcaaaagggttcggagaagaagcggaaacactctcccgaccggtaggagctaatccactggacttgcatggtataaggtggctcaaggagtcaaggcaaagcagggcatagaagggactgggaacagcagtaggggcaggttttacagcatggcttttaaagataggccagctacaacatgagtataacaagctaagctagcttctggctttctccacagacaggatggacctgtgcccaagactgagaaagcagcccctagaaacaagcactggttgcacagggacctacgtgtgcggttcattgacaaactacacaagagtggccgctattataacaccaaggtatgattccccaccaccggaggcccctccttcacccaggactgtaccctctaactttctttttgtttggttggttttttttttttgtttgttttttgtttgctttgagacagggtttctctgtgtagccctagctgtcctggaactcactctgtagaccaggctggcctcgaactcagaaatacacctgcccagccaccctttaactttctaacatcttacttctattcatctctctagatgacaattgaagatgtcctgagcccagacacatgtgtgtgtcggacggatgaaggccgagttctggaaggtaaatcgagctactatacctgggatgttcccatcttagaggatgataaagaacgggtctatttgaggagctggagcgatggctcagtggttaagaaagagcactggctgcttttccagaggattcaagttcaattcccagcacccatgtggcagctcataactgtctggaactccagttccagaggatctgtctgccgccctcttctgacatctgtgaacagcaggcacacacatggtgctacaggcataacatgcaagtaaaatactcatgcatataaaaaaatctaagccgggcgtggtggcgcacgcct

SEQ ID NO: 2527 - DNA, 1200 bp, mus musculus
ctgtgtagccctggctgtcctggaactcactctgtagaccaggctggcctcgaactcagaaatccacctccctctgcctcccaagagctgggattaaaggcatgcaccacctcgtccggctgtgcttacctttcttgttcttggggtaaggagccagttcctctctgcgatggtggcgtcggtctttgccctcttcccggtctgccttgtcaaatgcccgctctcgttccctgtcccgatctctctctctatccactttgtcgtagttgcgctctcgttctctgtcattcttctcgtggtttcggtctgccttctcgtggctcctgtctggcttctcatgactacgatctgacttctcatgatttctgtccaccttttcaagattccggtccgacttgtcctcagcatctatggtaacacacaaatcctgaagcctctctcttacacatatggtctctcttcagcctctctccgagactgcaagaatcactaaagcatccctgcatctgccaactcacctgcattattgttcctgactttcttggcggatttggtaacgacaaagttaggatcatgtggtgagagccacgacacaaggtctgtctccacattccaatagtaagggagtccgctgtgggcagtgagagggagggagtgtcagctcagatgtcccttataccacctgtcacctcaacctgcgtccagatctgcttcatggtcccacatgcacatctcgtccctctcgacccacagtaagagagaacacaggaagggcaaggccaccatgttgtccatgaagtccatcccaccatgttggtaggctcaccaagaagggtcaaacaccttgtaccagctcggtggcagaccctctatccgggtggcctcatagtcaacaggatcatcatcgtagtcttcagcaataatctcttcctctggctctggaagaatggggaaggagaaaagcagttgaattacccgatagtgatggtgtgtgtgtgggggttctcctcctattctcaggcatggagacatgactgaccactcacatctacaccaccatgcagggaagacagaagtacatgctcagcgttgataatcttcaaaaatttgatatccaatcaattcctgagttcagataccatgtggcattgtattatcccaacgtatttcaatgaaatggcttggaacagtaggggggtt

SEQ ID NO: 2528 - DNA, 1200 bp, mus musculus; identical to SEQ ID NO: 2527

SEQ ID NO: 2529 - DNA, 1400 bp, mus musculus
gcatcacttgccaccaaatgtatcttctggtgccagaaccgggttatatctaattgtgttgttggccatgggaatccctaaataacccagttgggtgctaagactacagactgcatttcacaatgagagcaaggcttactgctgaagacacctgcacaactcttctccctcttcccagtgttatctctgtaaaatatggaaaaataagtgtctgcatgtgtgtacataggatggcatgtgactgcattaggatgggatacaggacagtgtgcattcaaactgaatgtggtatatgtttgccactcactcattatctataataatatgcattctttattcttattgtagaattttatgtgatatgccttccagataatcctgcaaatgaaatcctgtccacctggccatggcatgtagaagaagaaaggagcagattgtaaccttctcaggcatcttgagtgaaaaacatatcatttttagtgatgagggttcagatgtttgttggatacagcaggcaaggaaggcagaaatcacaatgttcgaatccatatgtggaaaatgaaaactttccttctatagaagacaagcatcttatcttccctcccccaataccagatcaggttcccctctgtccccccacgcccctcaccattcaacctttcctcccaggtccctttgttcccaattgtaatagctttctgagggtcagcagaaaaaatgtaacagggagataggaggttggaggacccctccagaatgcacctgagttctgggaggtgagagattctcaggacccaaagcgagggaccttagatgcagtgcccaagagtagggagagggaactaatagagcccacctccagcaggaagacagggcatcaagtaagggatggagttgccatcccacagtgatacctctgtcccatagttgtttctgtctgaaataattacagggatggaaatggagaggagcctgaggaaaagaaggtccagtgacaggcctaaaatgggatccagctcaaggggaggccccaaggcctgacactattactgagggtatggagtgctcacaaaaaaatggacctagcatgactgctttctgaaagacccaacaagcagctgaaaaaaatcagagacagatatttgcagaaaacaaatgaatagaagcacctaaccactgttgttggattagggaaggctgagagaagctgaggagaagggtgatcttgtaggaggatcagcagtgtcaattaatctggacccctgggatctctcaaacaatggataatcaaacagacaggatacaccagctgatatgaggcccccaacacacataaaagagaggacttccgggactgtgttcaatcagagatgatgcacttaaccttcaagagactggag

SEQ ID NO: 2530 - DNA, 1200 bp, mus musculus
tcattttgcattttgcattttctttgattgttgtgccaatgttctctatggaatcttctgaacctgagattctctcttccatctcttgtattctgttgctgatgctctcatctatggttgcagatttctttcctaggttttctatctccagcgttgcctcagtttgggatttctttattgtgtctacttctcttgttatgtatagtatggttttgttcatttccttcacctgtttggatgtgttttcctgtttttctttagggacttctacatatttggttgtgttttcctgtttttctttaaggacttgtaactctttagctgtgttctcctgtatttctttaaatgagttattaaagtccttcttaatgtcctctaccatcatcatgagatatgcttttaaatccgggtctagattttcaggtgtgttggggtacccaggactggctgaggtgggagtgctgggttctgatgatggtgagtggtcctgttttctgttagtaagagtcttacgatggctttcaccatctggtaatctctggagttagttgttatacttgtctctggttagagcaggttcctctcgtgattctgttagcctctatcagcaggcctgggagactagatctctcctgagtttcagtggttagagcactctctgcaggcaagctctcctcttgtaggaagggtgcacagatatctgccattttgaccttcctcccagcagaagatgaaggcctgaaacagggcctgtcccagaagctgttagcttctgtagtccacaatctcacctatgcagactagtctcagagttaatcgggaatcaagatggctacccctggtgctccggcaaggcctcctggatggggcagtcgcctctcttctggcagggaaggtgcccagatgtctggagccggaaacgaggtctgcctcagaaactctatggcttccgtctgtcccagaatctgtgaacttctgtagtcctcactctcacttgtgcaaattagtctcagcaggttccggtaaccaataccatgctgttttaattactctacctctatagtaaacattgaagttgtgaataatgagacctttgacagttcttttattcttcaggactgttttaagtatcctgtgggttttgtgtttccatatgaacctgaacattgtccatttaatgtctctaaagaattgtgttac

SEQ ID NO: 2531 - DNA, 1400 bp, mus musculus
ttgaagttctcctgggccacgtcatcacggtcaaagtagactgccatcgacatgtacacgtaggaggcatagaggcgcagctggatgtgggtgttgatagcatcctcacactgccagtcatagttctgccgcactcgagagggcgcttcggccatggcgggcgcttgagctgtacaaccacagactcagcgattccccacccgctcacagggggcagggcgtgagcaaagaacacagtcccacagtcccaaagtacctcagaacagatgatcgccagagcagctcaaccgctaggctgcaggcagtgatccaaatggctgttcctgcccaccgaccacagtatttgagcgccaggatttataggaagaggcggggcatcaccggaaatgagggttgacacccaatcacgacagggtttaagtcccagggcaaatgggagtggtgggcatcagcggaaatgagtgttagtgcccaatcaagatgtggtctcagcaggagggcttaagggaggggggggcatcagtggaaaggagggttggggcccaatcatgacaagacatggtttcggcaggatggtaatgggaggggtggggctttagtggaattgcggtttggtgcccaatcatgacacggattcagcctcaggtctaatgggagaggagggccatcagcagaaatgagtgttggggcccaatcatgacagggattaagccccagggctaatgagagtggcgggcctcagcagaaatgagggttggtgcccaatcaggacagggattcagccccagggctaatgtaaggggcagcgcatcagtgttaatgagagttggtgcctactcatgacatggattcagccttagggctaattggaggagtggggcctcagccgaaatgagggttggggcccaatcatgacagggatcagcccgaggacaaatgggaggggctgggcctcagcaaaaatgagggttcaagtccaattatgacagggattcagtcccgggctaatgggagaggcagggcatcagaggaaatcagtgttggcgcccaattatgacacggattaagcctaaggataatgggagtcagggtatcaggagaaatgtgggttggagcacaatcatgacagggatttaggcccaagggtaatggcatggacggggcatcagcagaaatgagtgttggtgtctagtggtgacagagatgcagccccagggctaatgggaggggctgggcctcagcagaaatgagggttggggcccaatcgtgacagagattcagccacagggctgatgggaggagctgagcatcacctgaaatgaggattggagcccaatcatgacaggggttcagcctcaggactaatgggagggccggggcatcagtggaaatgagtgttg

SEQ ID NO: 2532 - DNA, 1200 bp, mus musculus
ggcactgtgatgcacaatgcactgtctttcactcttagttttttatcatgtcacttttgctaagacttggccagtttctttttctattattttttctttctttctttctttctttctttctttctttctttctttctttctttctttctttctttctttctttctttctttctttgctttttgttgttgtttgtttgtttttgttttttgagacagggttttttctcatgtagccctggctctcctggaacttgctctgtagagcaggctgtccttgaactcacagagatcctcctgcctctgcctgattaatgagtgcttcgattaaaggcatgggtcatcactacccagctttattggtttttcttttcctcaggaaccagcttttttgtttttccttggagcctcaagtctttacaggattaagtttttcttctcccactgaggccgcacaaggcagtcctctgctacatatgtgtctggaggtctcagaccatcccgtgtatgctctttggttggtgacttagtctctgggagctcccaggcgtctgggttagtgacactgttggtcttcctatggtattgccatcctctttagctcttttaatccttcctctaactcttccataggggtcccaacctcagtgcaatgattggctgtaagtatctacatctgtctcagtcagctgctggtagagtttctcagaaaacagtcatggctaggctccttctgcaagcacaatatagcatcagtaatagtgtcagggtttggtccctgcccatgggatgaatctcaagttgggccaatcactggatgacctttccttcagtctttgctccatttttgcccctgcatttcctttagacaggaacaagtctgggtcaaaaaatttgaaggagggttggtgacccccattcctccactgggtgccctatctactggaggtggtctctttaggttccatcttcccactgttgggcattttggataaggtcatccccattgggtcctgggagcctctcacatcccaggtctctgggactttctggaggttccctccactccatgttttccattgttgtaatttatttttctgctttgtttttctcttccttttctttctgctggaggtgggagctcagcttaatgatatgggagcattctttctaactaatgctgtacattttcctcttggcatc

SEQ ID NO: 2533 - DNA, 1200 bp, mus musculus
catatacttctggtctgttttagccaccacacttatatttttttttctttatttacatcccaaatgctgacccatcttggacctccctcctagaatctctctaccgtcttcttctcctctaagaggggggatcccataggtatcccctgaatactggcacatcaatctctgcaggattaggcacctgctctcccattgaggccagacaaggcagccctatcagggaatatgtaccacagtcaagctacacctccaggagcacctctactccagttgctgtggttaccacatggagatatctgctacctatgtgatgggggccttggttcatccccaagtatgctctttggttcgtggctcagtctccaagatctcccagcagtccagcttagttgactcagttggttttcctgtggagttcctttggggcccacaatctttcccacagctcttccacaagagttcccgagccccatcccatatttgtctatgccactctgcatctgtttcagatggctctgaatggagcctctcagaggacagttatgttagtctcctgtctgcaagcataacagtaccattactagtgtcagggattggtgcttgcccataggctaggtctcaagttgagtcgactattggttcaccattccttcagtctctgtttcatctttgaccctgaatttttttagataggataaattttgggttgaaaatcttgtgggcatgtgagtattcttatcactcccctggggatcctgcctgactacaggagctggcctctttaggatccatgaagacattattaggcatcttaattaaggtcacctgcattgacttttggaagtctccccatcctaggcctctgggacttccctcacctctccactccaccccgaccttccagcagctgcagatttccattcattctcctggccctctgggcctctttcctgtctctccctatacctgtcctgccctccatttcgctccccctcccctcttccacccaggtccctcccttcccctgtctcccatgactattgtgttcccccttctaagtgagattcaagcttcctttattgtgccttccttcttgtttaacttctttgaatctgtggggtatgtcatggatatactgtgttttatggttaacatccacttattagtgactacatactcgggatgatattttctagt

SEQ ID NO: 2534 - DNA, 1400 bp, mus musculus
cagctgagggaggggcagtgtgcacaacctgttatttaagatgcgtttaggccccagcggccacagttcagtgtttatgggattagagtaagtggaaccctttcctacagcaggaaagtcccttgacaggaaaagtgtatcactgactggccagtggtaaatgcctggatcccaccattagtgacatattcctttgtttattaatgccaccattttgaggttacaatttttttttgagtgaaaatgtcccagaggagtaacatgtgaagacctgacagtttttataagtgagtgttttgggtctaattccagacagaaagtgaacattggctttctgatgggagcactgatgcccacagaggagaagggggatggaaggaaggggtgggaacaaacatggacagctgggccattcttagaaatgtcttttattcactggtgtggtattggagcttgagttaatgactttgcctatgtaaggcatgtgctccaccacagagctatgtcttccccccttcacctagttctgatgctttggaaacaaatctcctgcatgtgcatgtgcgtgtttgtgtgtgtctttgtgtgtgcatgcatatgtgtacacgcgtgagtgcacttagagatgtgtgtgcatgagttgtgtgaagttcagaagtcaacctcgggtatcactcctcaggtatcaccttatttttggaggcagggtctctcactggctagaggatctctggtgaggcaaggctagctagcctgtaagttctgcctttctctgccttcctggtactaggattatacacccacacctccattatcacctttttttaaaagacttattttattattatacataagtacactgtaggtgtcttcagacacaccagaagagggtgtcaaaccccattacagatggttgtgagccaccatgtggttgctgggatttgaactcaggaagagcagtcagtgctcttaaccactgagccatctcaacagctccattctcacctttttatgtgggtgatgtggatcaaaatgagggcctcatgctcacatgacaagcactctaccaactcaagccctcgcctcagtgttttgacattccttccagtaaccagtggggtcttggtactctcctgtcgaatcaggaaagcaggcttaagtcccataaggacgggcgaagcgcctctttgcttccctctaaagctggctcatgcaaggtcaggcagcttcttcctgctgttggggcacttgctgttcaagctccacttctctaagtctggatgcttgaaagaccattctggaagatggtagtggataaacctgccttgtcagctatgatccctacctggcttctaggtagataagcaaaccctctagaaccttctctaccagccaaatag

SEQ ID NO: 2535 - DNA, 1200 bp, mus musculus
gtgtctgaagacagtgacagttgtactcacatatgaaataaataaatcgtttaaaaaaaatctttaaagcaaggatcctgtaagcaaggatctaagcaaagattaaccccttccttctctgggcttcgtctcattctgttaggtggtctgacaagtccttagaactgtgtgaaatctcttgcttggagccaagttccccctctgatggtgccctttccttctcacagcatgaggttgctggggagtgggggtgcggtgttcctgtttcttttgggtcagttatttcaacagtccagtggtcagatcgagaatatctgcattctgctaggcctgttagagtttcacaaattttcccttcatgggaaggggggtggtgctggggggaagggtcgctgtagcaggggcagggaggagcaaagctgttcactttgtggtgcctaggatgcaaagagagattaggaggggtcaggacaaaataccttccagagacacgcccccaggggctcacttcctccaactgcgctgtcccgaatcgcttccatgccctctgaaaatagccccagaaggcaactaggcttttaacacatgagtctgtggggacattttatattcaaactgcaacaggggacagtgactcctttcacagagtcgttataagggtaaactgaagtcacgtgttcaaagaatgcctggctgacgtagatgagtatttcattaccgcaatgtaatagccagggcggggtattcatagaaagaaacgtggtttatttaactctcagttccggaggctcaagggtatggtactgttaccagctcagccctggaagaggtctctcagctgtctgacgtcatagcagatggcagcgacaggagcactcataggtcgtgtgatgagaaaccacagcaacactgaccatgtggggtcagattcaaccttttagaataatcctcttgcaaggactacccccagtcattccccatcaacataggacctgccatctaggccccatctcggggaagctcctgctgtttccattttgtcacaccggggaccaatctctcaacccaattaacctttgagagggacagatgacatccaaggcacagcagcaccaaacaaaagcctctcttgctgtttctgtaagcgtggttattacaacctccattgtatttcatgtaatcctttttaatgcaaatatg

SEQ ID NO: 2536 - DNA, 1000 bp, mus musculus
tgttaggatatccagggcttgctgtagtaggcaagttttgccatagacatgccatagtgctatagcttttgttgactgtgttcttacgctggcctttagccatctggttgtccctggatggtcctggtgtagcaggtctcagtaagggggtctaacctggatgtttccagggtagtagtccttgggtgggcatccttgagcttgacaatggtactcaggtgacagtgcatgtctcagggcagctgagtatgccacagggaattggggtaggaagggatctaacctggctattcctggtgtatcaggcctggcagatctgtggctggacaatggagttgggcggacaggggattgggtcagggtcaggggtggtgtgaagtgaagatctaacctgaatgttcctggtgcagcaggcctggtgaacatgggcagggtcatggccagactatggagctgggggttgggggtcacagcactgaatctttcagttttgttgttgttgttgttgttgtttttgtttttgtatttcaagataaggtttctctgtgtagtcctggctgtcctggaactcactctgtaaaccaggctggcaggcagattcacctgcgtctgccccccgccccaagtgctagaattaaaggtgtgcaccactacccagtgaagttatgaatcttagaggcacatctaacactgctgctttgctagaccagcataattcctaactacattttaaatcttatccttatatgaacagagaaccatagctaccacccctcatcaaagaagcttctttttacagcaaatgaagtccatcacaggaaacttcagctggacacaatgggtaaatcaatgaggtcatggggagcccagcctcaatggatacatttacatgatggttcctgcatctgtggctcagggaacttcaggaggaaagggtctaagggccaggatgaaaaaaaaaaaaaaaagaaaagaaaaggaagaaagaaaagaagaaaga

SEQ ID NO: 2537 - DNA, 1000 bp, mus musculus
tgattgaagatagtttgagttgaattttcatttttatgcagcttaaaaaacattaagtgggatcttccctctgagcccagcacaggctgctaagggccccagagttctcttcacaccgcaggaccttgggatcacctcgggattatgggtgagtggaacgcaacatcagctcctaagaatcgtggagggtcttgtgctggcaggaacagggacaaaggaaccccacctgaccagaggttgggattcattctggtcagggctacccctgccagcttctgcgtgaaccccagccaagagcgtctaggaaaccagaagattctccatgctgcaggacccctagcacacccaggacctcctgatcacctgagagcacatgggcaatagaagcaacagagcttcttggtcaggccttcatcctcagtcaagaggcacagctgagacccagaaccctgggcaccttccttgccagaggagagtcagcctacagggagggctctgaccccaggactcaggaggtggatcagagctccagacttctggacacctgccctgcaagaggagagcctgcctgcagagagtgctctgaccactggaactcaggtgagagttagactctcaggagtgctgacagaggctaacagaattacaggaggatcaagctccagccagagacagcttgaacattaacaccaagagataaccagatggcaaaaggcaaacataagaatcttactaacacccttttggttggtgccaggactgggtcaccttgtgcacggagtcagcagacacccccatggtccgtagaggactctccaggtgatcttaggaccactgaccagatagctccatgctcctcaaaggagacaccacttccaggcactgtaacatgcccaggatctttgacaacatgatcccaggataaaaggagtttggtcacaccagtatttcagggtctcagtggaacttgactgccaagaactctgacacacccagaatc

SEQ ID NO: 2538 - DNA, 1000 bp, mus musculus
tgattgatgacatttttataatcctaccaatgctggccagtttcttccatattccttggggaggtggagttgtaaagaacagaaactgaatcagagggtgaatggtgctgatgttggctctccatgacaaggctccaaattatgtttatccctaagataagccgagatagagtatttttaccttacctaacactgaaaatacactcaaagtatcattttaatatgaatacatgttgaagatttattaacttattaataagaaaatcagtaacatgttaaaaatgtctggacatccgggtaccttccctgccagaggagagctgtctgcccgggagggctctgtctgagcaggtaggggagccatcttgggtcccggacccctcaaagactagtctgcacaggcaagggtgcggattacagaagcaacatagcttctggaacaggcagaagaaacacagcttctgggacagatccagtttcgggcttcagacaaatgggcaccttctccaacagagaagaggtgtctgcgtggaggagctctgccagagcaggggaaggggacccatcttgggtccaagatctctcagagactagtctgcacaggtgagagtgcagactatagaagcaacagagcttctgggataggcagaagcaacacagcttctgggacacactgtttcaggccttcatcttgagccaggaggcaggtctcaatgccagatatttgtgcacattccctgcaagaagagagcttgcctgcagagagtactctgaccactgaggctcaggagagagctggactcccaggtctgatgacaggggctaacagaatcacaggaggaacaagctccaaccagagaaaacaataacaactgactccagagattacaagacagcaaatggcaaacataaggatcttagtaagagaaaccaagaccactcaccatcatcagaacgcagcactcccacctcagccagtcctggataccgaaacacacct

SEQ ID NO: 2539 - DNA, 1200 bp, mus musculus
cactgtcaaagaggtcaggacattatcagggaaagtattgtatgagatggcacctttcattgacagtcaacctgctaggtctcagagtgtctaaatatccaggaatgagctcaacatgtactattgaaagatttttggtggttagataaaaccaacattcttcagtgaaactggttcccatctgtgaaaaggactcatttcccttacctctggcagaaaggatatatggctctttattgacacttgcctgtgactgcatatcaaaccccatgctggcctccaggctccctcaccccagtccccattgagtccttatttacaagtactttttacacatttcaaagcttcctcactggtctactggacctccccaccatcagctacttaccctccatgtaaccactattcatttattctctctctctctctctctctctctctctctctctctctctctctctctctctctctcctcctcctcctcctcctcctcctcctcctcctcctccttcttcttcttcttcttcttcttcttcttcttcttcttcttccctttccccaccactacctctatctccactattctctcctattctcctaaccttgttcagtctgctggccatgttcagtctactattttctctctctgctccacactcttccagatgcctctggctgtatttggtttcttacgaacaataaaaaaccttccttaataatgaagcagtaataacaacactttttttttttactcctccccctcacatatgaaaatgtccatggtaactaactgctgtagatgaaatgatcttgaagcattcattaagaatcttcaataagtgctaaaaagaataaacttactgtccacttccccacctcccgaccccatccccgaacttgggagcattgtgctgccctgagttgggaccttatctacttagaggtcttggccctccttaaggtgactcatgatgctcatagaggacaccactcagcttagtcctctactcactcttcctgtttcctgagagcctcttattctcacaccccctcggtgattagtctattcttgctgaaccttccctgcagacccagagttgttcagtccaccttagctattaaatgctatttcttcagctgcttactgcttctggttttccttcagtcatacttactatccatagtaaatttgctacggta

SEQ ID NO: 2540 - DNA, 1200 bp, mus musculus
tcttcttcttcttcttcttcttctttaattaatcattccattcgtttacatctcaaatgatatcccacttcctggttacccctccaccacctcccatcccacatccaccctctcacctcccctttgcctgtatgagggtgttcccccacccacccacactttcctgccccactgctccagcatctccatacgctgggaagtcaaactctccaggatcaagggcttccctcccattgctgtcaggcaagggtatcctctgctacatatgtatgtggagccatggaaccctccaggtacatttttgggttggtagtctagactctgggagaactgggtggttaggccagccttgttattcttccaatggggttgcagtctctctcagctcctccagtccttctgccagctcccccatcaggttccctaagctcagtctgatggttggtttcaagcatccacatctgcattggtcatttgctggctggaccttccaaggaaccaccacactagattcctgtcatcaggcgcctcttgaccacagcaacaatgttgattttggtgtctgcagacatgatgggccactaggtggagcaggttcccattggcccttccttcagtctctgctccattttttttttttttctccttgttcttcctttggacaggaacatttctgggttaaaaactttgagatgagtgggtggccctgtcccctgactagggactgtgcctatctactggaggtagtttcaacaggttctaactccccattccttgtgccttttggctaaagtcatcaccattggggcctgggagcctcatgtttccctggtttttgggaccctccagtggctatctccagttcttcatccttcctgatacatatttttttgttcaatttcctaacccctctgtgcctctctaacatctcttccagtttctgatattgccccctcatttcctccccttctctctctctctcccacattcccctctccctccagctctcatgatcatcctgttcccccctcaatgcaggactgaagcatccacgcccaactcttaagaggaaaacatttaattgggtctggcttatagtttcagagattcagtccattatcataatggcagaaagcatgccagcatgtaggcagacatggtacaagagaagctgagaggtctacatcttgatccaaaggc

SEQ ID NO: 2541 - DNA, 1000 bp, mus musculus
tatgtgcttctacctgcttagcagttttctcttgtatttcattaagtgagttattaatgcccttcttaaaatcttctaccactatcatgagatatgattttaaatccttgtcttgctttttgggtatgttgggggtatccaggactccttgtggtgggcatactgggttctgatgatgcccattgttcttggttcctgttagtaagattcttacttttgcctttcaccatctgaaaatctctggtgttaatgttcaagctgtctctggttggagattgatcctcctgtgattctgttagcctctgtcagcattcctgggagttcaactctcttctgagttccagtggtcagaacactctcttgagtcaaactctcctctttcagggcaggtgtccagcagtctggagctctgatctacctcctgcgttctggggtcagaactctccctgtaggcagactctcctctgttaaggaatgtgcccagggatctgggtctcagctctgcctcctggctgaggttgaagacctgaaaggaccgtgaccaagaagctgtgttgcttctcttgcccaggtgctctcaggtgatcaggaggtcctgggtgtgctaggggtcctgcggtgtagagagtcctctggtgccctagactcccacggccgggttcacgcagaagatggcagggctgtctgagacctgaatggatcccagcctctagtcgggcggggttcctttgtccctgttcctgctggcacaagacgctccacaattcttcagagctgatgttgcgttctactcacctgtgatcccgaagtgatcccgaggtcctgtggcttggagagcactctggagccccataaacactttttataagggccttaaaattttaatatttatactttattacagataaaaaattgctattagtaaccgttttagcaagatatcagtgtataagtccaagtacattattagtgaatgctgggggtctttatccagagttta

SEQ ID NO: 2542 - DNA, 1400 bp, mus musculus
ttccaaattttagtaaaattgctttgagtttttctccgtttaatttgatattggctatatgtttgttttaaactacttttattatatttaagtatatcccttatatatctgatctctgagacttttatcatgaagtattgttggattttgtcaaagtcttttcctgaatctaatgatatgctcctgtgttttttttctttcagtttcttcatatggtagattacattgatagatttttatgtattgaaccatccctatatctgtaggatgaagcttacttgatcagaatggatgatctttttaatgtgttcttgtatttgtcttgcatgtattttatttttttgcatctacgttcatatgggaaattgctatgaaattctctctattgatttttttacgtggcttgtgtatcagggtatctatggcctcataaaatgaacagagcaatgtaggcacgtttttgcaacctacttttaataaggattcaacttctctaacccatcacccagcagaggtagtggaaaagaaaagttattaggatatggggaagtggacctgctcagcaatcgttctttgagggtgagcttaatcttctttcgccataattcagtcctgtagcaagcaccaaacacaacctagaagctgcagatgactcctctaggcaggcaaataataggcatgaaccagcagctacagtccagtcctatcagcgagcagacaacagcagctgtatttcaatcctgaagaaacagtcaggcttgtcaactggcctgagatgaggccacagaacctgcatgctgctgtaggaacctcatgagcagttcttgggcaagctgttttcaatggcagtattttcacaagttgtgtttaacaacactttgcatgtctttagtagaaagtaaaggcagagcaagccaaaccaaagctcagtgcccatctcccactgtctgtggggtcttatttatattcttccatcaagagtcctttcacttgtctgttatatagaaatatcttttcacctgtgtctacttcaggaaaatggtctttcatgtttttgctttagcaagacatcctttcacctgtgtgacccaggaaaacaccatctggcataactaactttccaaaagatctagaagtttccacttcagagcaatattcatttggcttttgattttgtggagtaatttgagaagtattgggttaagattaactattcttcctttcttcctgccccttttcttcttctgcttgagagattttaatgattgcttctgtttcactaggtgttataggtctatttaaattgtttatctgatctccatttaagtttggtaagtggtacctatcaagaaaattatccatttctcttaaaatttctaatttggtgcagtacatgcttt

SEQ ID NO: 2543 - DNA, 1000 bp, mus musculus
gggacttgtggatgctaagcaagaagcctatgctgaggtacatccacattcagctcaaccttttattttgatacaagttctctcattcaattgcctaggctgtctttgaaattgtattccttgtgcttatcttcctaggtaactatgactaagagactgggccatcaggacaagtctgatctcctattttaaacacattgttttagtagcttttttttctataaatgaatagtgcaaaatgattttttttaagtaaatggaagttgccaagtgtggtgaagtatgcttgtaactgtggcattgcggaggctaaggtaagaatggtaaagaagaggtcatagtgaaatcttgtctgaaaaccctaaattaataatctgtgaactagagtaacaactagtctagcaagatatatgtatattagtgaaatactggcttgaagttcttgggcataaccagcagctttctgatttcactccacaagcaggtattcacacctggtacagtaaacctagtcaagtatacaaagttatgaaggtcatatccctttgggggaaaaaactgctattgttgttttgctatatggacacagcatgaaacagccttttcaacatatagtatagttctcaccccacatcaaatgttgcttattatagtgtacagaggttaacacagatacaaccagtcaaagtgtacagaatgactgtgaagtgctcaggccacaatatgacatctatatcaccactccctccaagctatagggattattgtagaagaggcaacataagtattgtaagacaaagagatcaagaaatactgctttgaaataatttcctctgaataggacaagtctattgctttcatgagttcattgcaactctggctgcctgtgcacaaaatcaagacagtgcaaaatctgcacaagatcaaaccaggcaatactacagcaaacatgaaagaggggttcacacaatcccaaccttagtttaagagttgtggaaga

SEQ ID NO: 2544 - DNA, 1400 bp, mus musculus
tgtcctggatttcctggatattttgagttaggatctttttgaattttgcattttctttaattgttgtgtctgtgttttctatggaatcttctgcacctgagattgtctcttgtattctgttgttcatgcttgcatctatggttcctcatttctttcctaaaatttctatctccagagttgtccccctttgtgttttctttattgtttctacttcccatttcagatcctggatggtttattcaattccatcacctgttggttgtgttttcctgtaattcgttaagggaatttttgtgtttcctctttaagacttccacctgtttagcaatgttctcctgtatttctttaagggagttattaatgccctttttaaaatcctctaccagcatcataagatatgattgtaatctaaatcttgcttttctggtgtgttggggtattcagactcactgtggtgggagtactaggctctgatgatgccaagtaatctttgcttctgtaggtgagattcttacatttgccttttgccatctggttatctctggtgttagatgttctagttgtctctggctggagcttgttccttctgtgagtctgttagcctgtgccagcacttctgggagatcatctttctcctggctagaccagtgcacagagggattcagaaaagccctacctcctggctacagatgtagacatatatgaccttgtcctagaagctctgttgcttgtgctctcctgagagtacctgcctcagagagacactggagggaaaatggtgatctcacctgagtccttgagtcagagcactccctggtggcaagctctcctttgtcagggtaggtgcacagaggactgaggatcagctccaccacctggctgaggatgggggcccccaaagtaccactgtggtcaagaagctccattgcttctgtggggtgtactctcctgtgcagaccagcctcagagagaccatgcattttgaatattagccctctattggatgttgggttagtgaagttttttttttcctcaatctgtatgttgctgatttatcctattgattatatacttttccttacagaagcttttcagtttcatgaggttccataaacagatccacttctccagtatcctttctcttgcaatacctcttgtcagtggtagggtagaagggaggtaaataatttaagaaccctcattaaaaataggctttaaaaaattaaagttacacttcttccttccctctcatgcattctttgatattgtcatcactcacacacaaacacacacacttaaatctagacttgatcctagcttttattattttacttacacaatgatttctaatcacatgtactatcatgcaaattttattatagttttattttctgctgaat

SEQ ID NO: 2545 - DNA, 1400 bp, mus musculus
gtccctgggagctctgggggacctggttggttgatattattcttcctatgggcttgtaaaccccttcagctccttgtgtccttcccttaactcctccatgctcagttcaatggttggctgcaagcatacgcatttgtattagtcagggtctggcagagcctctcaggagacagctatatcaggttcctatcagcaagcaatttctactcttataacaacctgtattcttccttctttgccacaagttgtagaaagaagagcagataaggcatcatgttattacacagtgatcgatggcactgcacaatggacattggtgagttactcccctctgcttagttaaaatggatgttgtgaggaaggccttccatcgggagattagaaatggctcattaacttggttccgggactccgccgaccttaggaccttagtctgcacaggtgagagtgtgcaccacagaactggacagcttctgggacaggcagagccacagagccgctgaggcagcacccttttcgggccacagacatccggccaccctccccaccagaggacaggtgtccgcctggcttagaagccctctgcctaaggagcagcgggcaccatcttggttccgggaatccggggaacttaagaaattagtatgcacaggtgagagcgtgcactacagaactggacagcttctgggacaggcagagccacagagcctctgaggcaccacccttttcaggccacagacatccggccaccctcccgaccagaggataggtgtccgcctggctcggaagacctctggcataggagcagtgagcaccatcgtggttctgggactccgccaaacttaggaacttagtctgcacaggtgagagtctgtaccacagaagttgacagcttctgggacctgccaaagcaacacagcgtctggggaaggtcctgttttgggccttcttcttcggccaggaggaggtccaaacacaagatatctgtacaccttccctgtaagaggagagcttgccagcagagagtcctctgagcactgaaactcagaggagagagtctgactcccaggtctgctgatagacggtgacagaatcacaagaagaacaatctctaaacagagtcaactatagcaactaattccagagattactagatggctaaaggtaaacataggaatcttactaacaggaaccaagaccactcaccatcatcaaatcccagcactcccacttcgcccagtccagggcaccccaacacactcgaaaagctagacccggatttaaaagcatatctcatgatgatggtagaggacatcaaggaggactttaaaaactcacttaaagaaatacaggagaacactgctaaagagttacaagtccttaaagaaaaacaggaaaac

SEQ ID NO: 2546 - DNA, 1200 bp, mus musculus
gtccaaatgtcccaagaggaggcatgctcctcttttcccagaagtcctagtaaggtgagaggtatcaagctaatctcatttcctgcattctgtagccatccgtccctcgaagattttctcatgccttctataaacttcacatctacctctgccccttctcatgaatccccatctacattctatctttgtctcaaaccagtgccctgatgacattagtatgtagttctttcagataacaagggagggtgagagatctcttcaacagactactggtacaaaggctaagaaattcttcagcactagaattcttgaagagacttgagaaccagttctgggtttggtcgttcaagagctaatgaatgagaatgcaaatttgacagtaccagagaaagcctcaccatgccccaacagtgaccaggttcataatgaagaccatgccagctcatcaaccgcgagtggatcttatgcttgcttgccaccctctgattatctcaagtgctccctgatgtcaatatatctgattggagcctgtctttcctgtaatcccagttaaggtagaacttctcagagtatagctttctttgtgatcctgtgaatttggatcctgtgattctgagattctgagtgtgtcagagttcttggcagtcaatattcctctgtgacactgagatcctgctgtgactaagcttctgggatcctggtatcctaagatcttgagcttgttagagtgcctggaagtgatacctcctctggggaccttggggttctccactgagtttgaacccaaggtagaccagcactgaccagaaggaacctgagccactcgtcaggagtggttcctgcatctgtgttccagttggcctcaggcactcccagttctgttggaacagatgttgtgttccactcaccagtgatcctaatatcctgggcatactagtgtgtctggcgtttggagtgttctctagggaccatgggactgtcttctgagttcaggtcactgaaattctcttttttgttgttgttttttttttttgtgtgtgtgtgtgtgtgtgtgtgtgtgtgtgtgtgtgtgagtgtgtgtgtggtttaggtatcagattaattgtggcttaatagaatgtattagctagtgccccttctctttttattttatggaatagtttgaggagtgttggtattggctcttcctttgcaggtata

SEQ ID NO: 2547 - DNA, 1200 bp, mus musculus
tatatatatatatatacacacacacactgaaacatatatagtttgttatgtgtcaattttatttaaataaatcctgctaacaaaataagatagaaagtaattttcaacacaaaaaacgttgtcaaaaaaattgagctgtaagaaatggatatgtaacccagtgataaagcacttgactcacacatatgaagccctggcttccatcataagcactacaacgtatgttgatgtgtgtgtggtgtctgcatgtctgcctggtcatgtctggaggtgtccaagcaccaggagaaggctacttaggggaggcagaacacagtccttaataggagtcctgcccatgcttttctgagtgagaaacagcgaggtatgggatagatgttgtggttcccagattcctgtgtatccagatgccactggagacatcagggagttgagaaaggtggtaggcaggtcaacacttacctatgctccaggcaggaagtgggtggagggatggggactaaatctgtttggttcctagtgagtgcatagagagtacaaagaggtgaaaagagagaaggccttctctgggagatttaggcatggctcttcaggatgaagcactcctcccccagatgatccttgatgaaggagacagtccttgcttgtccaaacttgcttgatctgctgacagatcttactcatagtgaaccagggattaaataacttttgtggaagtaatgcccaggaagggaagctcattggccaaatacttagggcttatctagatacctcattaatatggagaaccccaagtttttatgctacatgactaattgccatgtgagtctcagtggagtgtcatggttatgtgttccagatcaggtagtttggcagggagctgacctcacacataccattctcaattctgagatttcccagggtttaggctgcctcagccttaccagttcttctgtctggtggtacagtccacttgctccacatgtgtgtaaatgtaacttttattcagctaatgaaattgtcatcttggggggttactgctgaataagctaccatttcctttttctctttctttctttctttctttctttctttctttctttcttttctttctttcttccttttcctgagctctggagggctgattcacttcagctgttctggctgaaattcctctccaagctgactgattccatctgt

SEQ ID NO: 2548 - DNA, 1000 bp, mus musculus
tagttttaagccatggaaagaacagttctctttggattttagaagtaacataaccatactatttgctcattaattccacaaagctgtgcttttcagggcagggacatagttaagtattagagaacttgtttagaatgtgcaagactggtgtgaggtgaccacagggtatcccatatcagggtccttttgattaacatttccctgatgactaaggttgtttgcagccccatggggggagcaacattgtcaacaggccagaccccctggagctcctggggactggaccaccaaccaaagagtacatgtggagggacccgtggttccagccacatatgtgtcagaggatggccttgttggacatcagtgggagcagtggcccttgggcttgagggggttcgatgccccagtgtaggggaatgccagggctggaaggcgggtaagtagatgggggagcatgctcataaaggcaggggtggggggatgggatagaggatttccagaggggagacctggaaaggggataacatttgaaatgtaaataaagaaaatatacaataaaagaaaaaaaaaagaatgtgcaagactctgcattgaatctatagtatgcataggtaggtctgtaggtatgtatgttggtaggtagtaggtagatagttagatagatagatagatagatagatagatagatagatagatagatagatagaaagatagatagataggatcattgaatgaagtttagaataataattatcaaattgttctacagagttgcaatctttagtataagctctcattgtcatttctcttctgaaccatcagacctaatgatttggaagtgtcatggcagacagagatgataacctctacgtaaataatttgagcataagtctcttaagatttaaattttttaacctttgaaacagtcttttatagcccaggctctttttgaacttatgatcttttatgaagattattttagccaagagtttgatgttac

SEQ ID NO: 2549 - DNA, 1800 bp, mus musculus
tatagaatattattcaataggtctgaagtagagactgaggatttatacttttgaacacctgctcaggtgattatgatgaatagagagatttatatgttatatctatacataatgatttgcatggtactccttttggctataattttaaatatattccttcaatttttgaaccaaagtaatctaaatgcattgctctgagtcgagagtgtatctcagtggtaaagcacatgttttgcatgtgtaaagtacagtgttcaatccctgtcactcatacaaaaaagtttttaaatttttagtataacatcattgccttctatatatcttctaaaagttttaattttagtgaaagggaatggaaagatagttttctggcttacttgtgaaaaatttgtctttgactcatttaataatatgaaatgcagtaaatcacatattttattatgtttttattatttatgattaaaagtgaaactacactgaaagttaatttttaagcttagctctactttagtaaagattttattatatgtccagaaaatcagttaaatatattaagcatattaggatactgattggcatttatcttaagagtatgtattgctatgatgagacaccatgaccaagaagcaacttgggggaaaaaggtttatttggcatacatacactccataacactgttcatcaaaggaagccagggcagtaactcaagtagggtaggactctggaggcaggaactgatgcagaagccatggagagtgtggcttactggcttgctccccatggcttgctcctcattgcttgctcagcttgctttcttagagaaccctggaccactagcccaagagtggcaccacccaccatggtctgggtccttccccattgattactaattgagaaaatgccttatagctggatctcatggaggcatttcaccagctgaggctctttcctctctgatgattctagcttgggtcaagttgacacagaaccagccactacagaaatattcttacttgtcttggcaatactcttaactgactacaaatgactgaattactgctcagaatcttttgtaatgtgatagcctgccatatttttttgtggcacagaaaagaaaatgtcatactggactgagcataaaatttgactcaacacataatgagcatctactatagacaaaatgctcagaatagtaaatgtttaccttcccattacttaaatgaatgatagtgaaggaatctgcagctcattgagctttggcttcatcttttcaatggaaaatttagattagacagagaaaacaagtaagcagtagtcttgagactcctacctgtatgttagaactttaatcatgcattttctaactgtcctagaattaccatatccactttatattatgtgacatcgttcatgagtgagagttgtcttctttaaagtcttgcatagcaatagataactgataatctcacctcttcttgacttaattttttgtacttatgtgatagttctaagagttatagcaatagtgtgtgcatgacaatagcaagagtgataagcttacaatttcttttacactatttagagaaagtggacttacattttaaaaatattttctagtgaatctggtgatataaacttatatatttttattttttattaatactgagcttgattgttgcacctacatatacactcacatgtgtatacttttaacatttgtctcatctggtcttaatgcttgttttatggatttgaattacatcttttacctcattttcataaaaattgtattgattgctc

SEQ ID NO: 2550 - DNA, 1400 bp, mus musculus
aaatgagttaaacttgtaaaaataaagaatataacagtggtactagaggtcttataggtatggatgttagggcagaggaaatggggaaatgagtcaaagcatactgtggggctgtgaaaggcagcctgttttggttgaacaaggcttgctctggagaccaagtagaaaactctatgagggacataacagtgagccatgttcccagagacaggtgcctgacaccacagagcccacaactccatagttctgtgactatcagtcacacagacaaagccccaagctcacacagttacctgaccatagccaagtatgctctgactcacagttacttgacaacaacaaggtagcccagcccactataaaaggagctgcttggcccctctttgctctcttaaaccctcacctttcttactctcatatctagccctccttctctctctcccttcccccctctcgccacatagccatggctgacctctctctttctttctgctttctctctttcttcctgtctttctacaataaagctctaaaaccatagactgtctctgctcatcaagacccgctgtacttgaatgatggaataggttgccccctaaagagccatgtctaacttcctgctggaaggccttcctgcactccagccacagactggactcctcatttgggaaccacgtggcacctcctctcttccttccctctcctccctttgaccctggggatgaccaagctgcccctggggcccccattttgttttcagctcttccgtggtgcccagtggcatctggaatgcagagactgaaaacctgttatctctggcctcagtgaggcccacagacctcagactgccccttatccacccctgcgggctggggtccgtggcttccccacagctagacacccaccaggggcacatggaaagcatgcagtagtcctcccaagtctgcctgcccagagtacgggaactctggtgggacacaggttttttcccactccctttattccttcacacctggtgccctacaagtcagaaagatgggaagaggaagtttttggttttgtttgtttgtttgcttatttgttttttgtttatgtttttgttttttgtttttgttttctgtcttttgtttttgcttttgcttttgttttctcaagacatggtttctctgtgtagccctggctatcctggagctcactctgtagatcagtctggccttgaactcagaaatccacctgcttctgcctcccaagtgctgggattaagggcatgtgcctccactgtccagcaaggagaaagttttgagccctgatacataccatgatctccctggttgataataatgcattaaaaacaaacaaactaaaagtaatttcaagtatgttgacacaaaaatgtcaag

SEQ ID NO: 2551 - DNA, 1400 bp, mus musculus
tggatgtgctttcctgtttttctttaaggacttctaccggtttgtttgtgttttcctgtttttctttaaggacttgtaactctttagcagtgttctcctatatttctttaagtgagttattaaagtccttcttgatgtcctctaccatcatcaggagatatgcttttaaatccgggtctaggtttttgggtgtgttggggtgcccaggactgggtgaggtgggagtgctgcattccgattatggtgagtggtcttggtttctgatcgtaagattcttatgtttgccttttgccatctggtaatctctggagttagttgttatagttgtctctggttagagcttgttcctcccgtgattcttttagcctctataagcagacctggaagactagctctctcctgagtttcagtggtctgagtactctctgcaggcaagctctcgtcttgcagggaaggtgtacaggtatctgcacctgcctcctggcagaagatgaaggcctgaaacagggcctgtcccagaagctgttagcttctgtaatccacactctcacctgtgcagaatagttttggagggttcctggaaccaagatggcttccccaggtgctctggcaaagccctcccggggaggacacctctcctctggcagggaaagtgcccggatgtctggatcccgaaacagggtctgcctgagaagctgtcctctagggaccttgggggtttcccccgactcctcgcccaggtgacccggtgctggtgtgacctgaagggtcttgtgaccctgattaggccggattttctgcttccctaatgctggtcccgtgcaattggactggaatagaagttgtgttccactcactggtggtcctaaaatcgcgtggagagtcctctcgggaccttgggggtgtccgctgactctgagtccaaggtgacccagtgctggtgctgacctgaagggacttgtgaccctgatcaggccgggttttctgtttccctaatgctggtcccgtgggattggaatggaacagaagttgtgttccactcacaggtggtccaagatcgcatggagagtcctctcaggaccttaggggtgtccacctcttgggaccttgggggtgtctgccccacatatttcgtcagagaattttctccaggaccacagccacacattgattctccagactctaaggattcattaggtggtttttgatctatgcattgtcaactactcacagctggattaggattattgccttttgtgttaaatttctaataatggggtaataaatgatcacaaacatgcaataatcctagttcagttgtggtgctgggaactgaactagggtcttcagtaagagcaggaaattctcttaaccatggagccagatgggcatatattttc

SEQ ID NO: 2552 - DNA, 1000 bp, mus musculus
ggtattggtttccatagctgtgaagagacaccataaacaatgtaatgcttataaaaggtaaacatttaattggggctggcttggtatcagaagttctgtccattatcatcatggtgggaagtatagcattttccatgatgacatggtgctgaagaaagagctgaaagttttacatcttgatctgaaggcaacaggaagagacattccacacttcgagtagcttgaaaataggacctcgatcttccttctgagcccagcggaggccacgaagggctccagagtgttctccacgccgcaggaccttggcttcacctccagatcatgggtgagtggaaagcaacatcagcaccaaagagggtcttgtgccagcaggaacagggatggaggaaccccttctgacccattcaggtcggggtcagccccaccatcttctgcgtgaagctagccgagggcgtctagggcaccagaggactctcagctccacaggaccccctagcacatccaggacctcctgatcacccgagagcacgtgggcaatagaagcaacagagcttcttggtcagggactcatctggccttcatccacagtcaggtggtggagctgagactcagatccctgggcaccttccttgccagagggaattggcctacagggaccccaggactcaggaggtggatcagagctccagactgatggacacctgccctacaagaggagagtgctctgaccactggactcctaagagtgctgacagaggctaacagaatcacaggaggatcaagctctagccagagatagcttgaacactaaaaccagagattaccagatggcaaaagcaaacataagaatcttactgggtgtggtggcgcacgcctttaatcccagcacttgggaggcagaggcaggcagatttctgagatcaaggccagcctggtctacaaagtgagttccaggacaggcagggctatacagcaaaaccatgtctcaaaaaacaaaaca

SEQ ID NO: 2553 - DNA, 1000 bp, mus musculus
ccaccatgccacccacagatctgctctccagtacacaacacagacaggccatagatacctgcttgccaccatggtaatgcagcatcgatggaagatgtcacccaagggcccaccagccacatggccagcctgcagtgggagtcacccacagtatgtggtggccggataggtgggaaagagaagtgaagcagcttgagcattactaacagacttggaaatggagattcaagggtagaaaggtctcttgtgagtggccaaccttgtcctaactctagctgccactgaaggcaatgtctaggtccatggctattcagcagccagggtcagtaccatgtccatattaccactagagaacatagggttgtctctgaccagggcagccaagaagaccacatggatgtccaagagctgttcataactggccacacttctcactggatgcagcactctgaaggagctagctctgcatctcacccaggaagcacagtgctgacagggatggaggtgagctgcccaagggtatgagtgtgggagaactagacctgccacttgtctgcacatttgcagtggggtggcatagacagaaaggtgaattctacccactacccccaactgctgccacctccagcagtcaggaaagatgcccataggatcataagctcaggagacctagccttgttccttaccagctacagtacttgggagagcaggctttgtatttcacctagacagcacaacagagatgaccctggagtgggggatgcagatgagccaactgggaagttgagagcatgggagaactggccccaccactcctctctcataaggtaccatgggcagggtacaggaaactcatattctttgttcatgggctccatgagaattctgggttaaatttcctggtgtgacagagtaggaaaagcctaagaataggctcattcagtattttagattacttcatttgttttggattgctttaattttcaaaatgggtgtgatt

SEQ ID NO: 2554 - DNA, 1000 bp, mus musculus
ttttggaaattggaaaccatttcttttcttttcttccttttctttttcctttttttttttttttttggttttggttttggtttttcgagacagagtttctctgtgtagccctgggtgtcctggaactcactctgtagaccaggcgttgaactcagaaatccacctgcctctgcctcctgagtgctgggattaaaggcgtgagccaccactgcccggcttggaaaccatttcttaaggttggaaaccatttcttaaggttgaaaccttaaacctgaaaacagtataaccctgtttttcattggatagaacaccgctgttccttttgatatgatgccattgctgactgctttctatatgttcccccgcccccatttgtagaaggcagtatcttttctttctttgttcctttttctactacttgtcaatttttactttacccggtgatagatcaattgatttatgtgtctgtttaataatagttaacttcactctacctgtcaaattttgtttttacatttgagatttgtctgagttcgatgatatgttctacatatagaaagcagaaaaaaatgtctgaaatacttttgtatttatgaaatatgtttggaaacttactaatggcttgtgtatgtggcaataagtatgccctatacagaagtgttagagcaattacaagtctcttaagtcacaattttctttcttagatgttttaagagcacaactcagttctaattaaaaagtgactattagtatttactcatgacttaaatttgtagttatatttggtgttaaattgcaactttatgaagcagtcagtatatctaacttcaccttttaaaagttatgtttgaaaataacattttacgggctggtgagatggctcagtggttaatagcactgactgttcttccaaaggcccagaattcaatttccagcaactacgtggtggctcacaacgatatgtaatgagatcaacatcctcttttggtgtgtctgaata

SEQ ID NO: 2555 - DNA, 1200 bp, mus musculus
cacaagagacagctatatctgggtcctttcagcaaaatcttgaaatattatatgcaataacaccagacttttattatccatttacttatcttatgggccagtatttactacttttctgttgttgtgataaaatactatgaccaagacaacttacagaagaaaggatttatttggctaatagttccagagggatgagagtccatcccagcagagaaatgtggcaacaacctgcctgttccaggcctaacagctgaaacaggcagttgagagctcatattatcagccacaagccggagacagtgcgagtgaactggagtggctcaaagctctaaactccagtgactacttcctgaagtgagaccatgctttctaatcctccccaaacagggagacaaagtaggggaaaaagtgttcagatgcctgagcctaaagggggttgtttcttattcaaactcccacagggcccaaagaggagtcaatgctttttagcaagaacaccttctaatgtctgttagtaagatagcatctggaaggaaagaggagcccgaggagaatctgaacaaacaaataagcctctggatatgtgtcttagttgtggtttctaggtctgtggtaaaatactatgagcaaaagcaactaggaggaggaaaggatttatttcatctcatagctgtggggaagtctggccagggacctggaggcaggaactaattcagaggccatggggaattctgcttacttgattgctctccatagctcattcagcctgtttccttataccaccaaggaccacccaggagtggtgccatgccctgtagtatgggcttacccacattaatcttcaggcaagaaaatgtaccacaaactggctgttggccagtctggtggagaggggggcattttctcaatcagggttccttcttccaaatgattttagtccgtggtaagttgtcattaaaaaactggccagcacagcatgcacatagaggactatctaaattaggtaaactgatgtggggagatccagcataagtgcggatggcatcatgctatatgctgggctgaataaaataaaagaatggtagctaaacatcaacattcatcaccatctgtatccttactgaatgcacctcctgatcttctacaatgccttttttgtcatgatagactgtatttcttggacctgtaagccaaataaac

SEQ ID NO: 2556 - DNA, 1000 bp, mus musculus
tgtaatttaaagtatacacagttatatttatcttaaaattttaaaatgatataaaagtttcttcacacaagtattcactatacaaataggattttggtgttttagagatttttcaagtctcaactttccttctacatttttaccttgttttcaattttaggatcttcataagacattagcagtattggatgagtatgggataggatggaaaacttcaaaaggaaaaaacagaaaaccaacattagtaagcataagctttatggtaaaagtgccaattgaactagttcttagttataactctctctctctctctctctctctctctctctctctctctctctctctctctctctctctctctttctctctctctgcatgtgcatgtgtgtgtgcgtgtgcgtgtgcgtgtgtgtgtgcgtgtgtgtgtgtgtgtgtgtgtgtgtgtgtgtgtgtgtgtgtgcagattctcgtggaggccaaaagagggtatcagatcctctgaagatggagttacaggtagttgtgaacttccaagccaatgagtgatagaagtgtatcttggaacctctagaagagtagcaaatgtccttaatggctaagctatgccttcagccccagtaacagttctgtttatttcatctaacctgttcagttatctcttgcattataaaaagctaaacattgatgatacaaaagaatttccataaatttttaggctagggcttggtgtggctgagtcatctatgctccccaatgactaaggtctaagttaacataacttgaatgaggagagaaatcttgctgcctctcaaatgacaacaaaagggacaatgtcacaaggttcctgcctctggagcagaggctgcaggatgtgagtctcctttagtgctgatggttgccttaggcatatagcttgtttgcatgatattgtatatactttacttcatgtttctccttttgggagcattcttcctgtcaaggttattggggagttttattt

SEQ ID NO: 2557 - DNA, 1200 bp, mus musculus
tagcctccttgcccttttgagagtactctggattggggaggggatgccactgggaaggtcatagagataactgatagacagggctgtggggcttcggctcaaagactaggggatcttggcatacctgttagggatgccatctggtctttcttcgggcacactgcacactgcccattctgcaagcctgtgtccagagcctctccattttctttcacaattagaggccttggtggagtgcctggataatcagcatctggtgactgggcaaggagttgctgtgacagctcaaactcaatgatcttcctttgcaacatatcccgctcaaacttcacttgcttcaggtgctctttaacattgtgaagctcagagaccacttcatcacgttcctcacgcagccgttgcaagtctgtggccaaagtccaggtggctgcctcatgctcttctacctggtcgtgcagctgctgaacacgttgtaactgtttttctctctgtctcatagcaaccctgactcctagggccagagcactccaggcacaggccctcttgatggaacgtggtacttgggtatcaaccactacagacttcaggccatcttctatatctttccagggccgtgaatggaaggtcaggtagaagccagggccaccaccattctgtgtcacctcttcattgatgaacagaaccacttcgcagtggctgaaaccactcttggggtcatcaatatccaaggccatggtcaaacctgctcaaaatagtggactgcaatgggctcacccatcaactcagtgtcttgtccagccctgggtcctagcgcctccctccttcctcccctgcctccttacactgaagccctgaagtcaccgggccactcataccaactcctcccacacaagagattaacatgccacatcataaacatggtctatgaggcctgccgcatggcctgcttgaaccaaaatgcagtggaagagatatttcttgcttttctggcaagttgggtgtctgctctttaaagtacgccatggtagtacaactgttctgggaacagcagtgaatccgtagtttcctgagagtttctgaaaggtagcaccctatctgcaccctatctggcatggattttttttcctctttctccctttctccatcctccttctcttcctttcctccttcttccttctctctttccttccttccttcctt

SEQ ID NO: 2558 - DNA, 1400 bp, mus musculus
cagttttacttatttccttcaactgctatgtttttcttggctttctttaaggaattttgttcacttccatcaattttgtttttcctttctttggtttgtttaagtcatttcctcatttcttctttaaagttctctatcatcttcataaactaagttttaaagtcatttacttttccttcagttgtgtttaaatatttggggactgatgtagtaggatagctgggctttggttgtgacatattgccttggctgttgttaattatttctttacactggcatctgggtttggggtgattataggactaggtgcagatttctgagtttgtcttatttgggtgggtgtttttgttttccccttagtttctgtttcctctctggtcttctggctggcatggtttctggtcaagcaggtcatttctgccttagtttggggctggtcacaattacaaggaggggtgggaagattgggaagagtgtgagagacacaaagggagtgggggaggtccaagaataggtggcctacctggatttcttggaggtagagtagcctctgatacatcagtggatctttcacagagttgggggctaggacacagcataaaggagtgatggaatgggggtagggtagcagctagagactaatggatgtcttcaattaaggtggcttccctgaagttttggaggctggagttttgtcttatacatttagatttattatccattttgaggtgtttttattgtttgtgttatggtttgaatatgcttgtcccattggaactgctactattaggaggtgtgtcccttttgtagtaggtgtggccttgttggaggaagtgcctcactatggaggaggacattgaggtcctatgctcaagttccacccagtgtggaagagaccctcctccagactgcctgaggaagacagtctcctcctggctgacttcacatcaggatgtagaacacttggctctttcagtaccatgtctgcctgcatgctgccatgcttcctaccatgaagataatggactaaacctctgaaactaaaaaccagtctcagtgaaatattttcatttataaaagttgccttgatcatggtgtcccttcacatggtgtctctaaccaagacaatttgggttttgtctgtttattttgctggcttgaggtaaatttaattgctattttacataattttcattcatctatatgtgccactgttctaccaccatcatttgaaaatattattcttatacacattggaatatattgctactcctttaaaaaattagttaaccataaatataaaggcttacctttactcctgaatgccaattatgttggtagtctatctgcctaccctttgccaataccacattatcttgattattctagtttttggtggt

SEQ ID NO: 2559 - DNA, 1600 bp, mus musculus
ttttcaaaccattccctaatacccataaacaattcttatgctaattcttttattcccctcttttttcatccatcttagatagtgcttttcttttatccaaattctcacatatatacatccacagtaaaaaaaaaaatcatctttagctaggcaggctctggctgttttaaaccaatcatgaggagtcataagcaacttaaatgtcaggggttcccataagggatccgtattttctacattgattttcataaccaccagggaacattgtaataatttttcctgcatagcttcattgaatcctctggtttcctgtggtattttattacatttttaagcatcttgtgtggagtcacttatgtttaaatctacaggagtaagccatttatggttatgatattatgttgttgagataaatttttacccaagattcataattattgtttcttaagctgtctttcccaggctctttgaacaacgggtatcttaattttctttctttttaagtacatgtttaacccttagattcaccttatttcatcctgattatgtacagagatgtacacaagtcagagctaatggctcttggcataagctgggcacggatgacagccagaaaaagcagctaggccctgatggcacctagtatcagcctctgctggtggcagtaggcagttaagccagagctgatggctcctggcataatttgtgcaatgatggtacccaacgaaagtgactgggcactgattggaacatagtatatgcccttgataatggcagtaggcatgtaaaccagagctgaaatccgcctgcctctgccttccaagtggtagaatcaaaggtgtgcggcaccactgcttgggctgaagccattgttttaaatatctgagtagtactgcattgtgtaaatgtactacattttcttcatccattcctcttatttataatagccagaagctatgaacatagtggagcatgtgtccttgttatatgttggagcatttttgggtatatgcccaggagtggtagagctgggtcctctggtagtattatgtccaattttctgaggaaccaccagactgatctccagagtggttgaaccagcttgcattccaacaacggaggagtgttcttctttctccacatccttgccagcatctgctgtcatcttagtttttgatcttagtcattctgactggtgtgaggtggaacctcagggtagttttgatttgtatttccctgatgactaaggatgttgaacatttctttaggtgcttctcagccattctagtttcctcagttgagaattctctgtttacctctgtaccccattttaaaataggattatttgcagagcttctgggcggcgccatcttcagctccagacagccggccaccttcctggtgagagcacgggggtctgcctggcctgagaggtttgtggcacaggcgccggcgggagccttcttggctccgggactccgcggagggcaggctgcacgggtgaccgtgtggaatacagagtgccagccgtttctgggacgggcgagagtcgcagagcttctgggcggcgccatcttcagctccagacaaccagccacct

SEQ ID NO: 2560 - DNA, 1200 bp, mus musculus
ccttcatttgtgttttctttattgtttctacccccacttttaggccttggattgatttattcaattctgatacctgtttacctgtgttttcctatatttctttcagtgagttattggtatcctccttaaaggactttattatcttcatgagataggactttaggaaagaatcctgattttcaggtgtgttggtgtattcagggtttgctatggtgggaaaactgtgttcggatgatacccatgcattttgtcttctgttacatatggtcttgtgcttgtcttttgtcatctggatatcgttggtgttttttgatctgggtgagtgtatgaaatctgcctctttttgtccctgggttgcttcaggtctcctggtaggcctgtgtccctggctatatctgaccacctttggggccttccagctggaggcttttcacaggggcagagaagcttctgatctgttgctctggctgcagtagatctcctggaaggccttcagactgttgggtctttagtggagcagtcaagctgttgtccaactgtgcttagtgcagcctttcctcaatttctctgagaccagtggatactcagctgctctcagtgcagagggtcctcaacttctcaactgctctgagtgcagtgggtcctttaagatggattggaatatggagtcttcaagggagcaggccaactaggggtctgtcccagcagcaaagaaccaggtgtaaggggtgagagggatggaaggaaggtgagtggtatttgggagggcaggggttttggtgtgtgatgggtcctgagtccaccaggctcccagcagcagctctggtactccaggcagggggtgtgtgttcttaccaactgctctgagtgcagcaagtcctctagcatggattaggatatagagtcttcatgggagcaaaccaactaggggtacacacgagcagcaaggaccagccagagcttgcgagaattgtattgagtatttttgcatccatattcatatgggaaattggtctgaagttctttttttgggtctttgtgtggtttaggtataagtgtaattgttgcttcatagaacaatgttgcagtgatccttctgtttctattttgtggaatagtttgaagagtattggtattatgtcttctttgaaggtctgatagaattcttcactaaacccacctggtcttggcctttttttt

SEQ ID NO: 2561 - DNA, 1000 bp, mus musculus
ttacctgtgttctcctgtatttctttaagggagttatttatgttctccttaaaatcctctgtaggcttcatgagacacgattttaactccacatcttgcttttgtggtgtgttggggattctaggacttgctgtggtgggagaactggcttctgatgttgccaagtaatcttggtttctgttagtaagattcttgcatttgccttttgccatctggttatctctggtgttagatgttctagctgtctctgactggtgcttgttcctcctataggtctgtaaacctctgttagcactcctggaagactatctctctcctggcagaacttgtgcacataggactctggaacagcccaagctgtgggtgcagatgtttgactagaagtgtcctgtcccagctgctccactgatcttatgctcctggtcaaacctactccacacagttattggagagaaagtagttgtctcacctctgtgcccaggagtaaaaacactcctgggagaagaggtccctcctggtgggaaccatgctcagcaggctttggaacagcctcagctagtgggtgcagatccagaagtgatttgttaatgaaccaatattattggtgttatgtgtgtgattgaagttcaatgtgtttgttacagttatttgcatccaataagtgagtctggattcaatatcattccaatacagaaaatgacttttgagtattatttgaacctagttagttagttagttgatattcaatgatgtaatgtataaattagttgtgaagaaaagtctagccaggtgtggtgtcacacgcctttaattccagcactcaggaggcagaggcaagcagatttctgagttcgaggccagcctggtctacagattgagatccaggacagccagggctatacagagaaaccctgtcttgaaaaaaacaaaataaatctatatttaatttaatatatcaagggaataaaaatgatgcgaaatgcctttgacatacattttg

SEQ ID NO: 2562 - DNA, 1000 bp, mus musculus
cgggcgggcacctgtcctccggtccggaaggtggccggctgtccccggcccacacagggtgctgcctcagcccctctgtgcttccgcctgttccagaggctgtcaggttctctggcgcaccctctcacctgttcagactaatttcctaagttcggcaggtcccggaccaagatggcgaccgctgctgctgtcccctttcagctttttaaatccttcctctaattcaactttaggggtccccaagttcagtccactggtaggatttatctgtatctgtctcagtcgctactggtagggcctctcagaggacagtcatgctaggctcctctctgtaagaacatcacagcatcagtaatagtatcaggccttggtgccctctgatgaaacggatcccaagctggaccagtcattggacctcctttccctcagcctcttcagcctttttgtccctgcagttgttttagacaggaacaattctgggtcaggaattttgagtgtgggttagtaaccctgcccctccacttgaagccctatctatctactagaggtagactcttgcagttccatttccccagtgttgggtattttggctgaggtcaaccccaatgaatcctgagagtgtctcacctcctgggtttctggtactctctagagtacctccccccttcccactccccaaggctgcatatttacatacattttcttggcccttttggtttttctcctgtccttcccccatcccctatatctgatcctgtttccactttccactccctcttctcccacccaaattcctccctccttctgcctccataataatttccttcccccttctaagtggggtggaaagatgctcacttgggcatttctgtttgaatagaacagcaatggcttgtgctgtaagatcgagaatcaataaatgggacctcataaagttgcaaacttctgcaaaagacacacagtcaataagacaaaaagaccaccaacagattgggaaagg

SEQ ID NO: 2563 - DNA, 1000 bp, mus musculus
gatgatgacctccaggtccatccatttggctaggaatttcataaattcattctttttaatagctgagtagtactacctgcaattctttaagggatttttgtgcttcttctttaaggtcttctatccgtttcgcagtgttctcctgtatttctttgaatgagttattaaagtccttcttgatgtcctctaccatcatcatgagatatgcttttaaatccgggtctagcttttcgggtgtgttggggtgccctggactgggcgatgtgggagtgctggtttctgatgatggtgagtggttttggtttctgttagtaagattcttatgtttacttttcaccatctggtaatctctggagttagttgatttagttgtctctggttagagcttgttcctcaggtgattctgttagcctctatcagcagacctgggagactagatctctcctctgattttcagtggtcacagcactctctgcaggcaagctctcctcttacagggaaggtgcacagatatctgacgttcggatctccctcctggccaaagatgaaggcccaatacaggacctgtcccagaagctgtgttgctttggcctgtcacagaagctgttagcttctgtagtccacactctcacctgtgcagaatattctcggcaaagtcccggaaccaagatgtctttcgctgatactcaggcaaagcgctcctgggccgggcggacacctatcctctggccaggaaggtgtccagatttctgggtcccaaaaaaggggctgcctcagaagctctgtggctcccgcctgtctcagaagctgttagcttctacagtctacactctcacctgtacagaatactctcggcagagtcctggaaccaagatgtctgccaccaatgctcaggcaaagcctactaatttcttcctgtcaagcaaggagggatcattggaaagtgtagtaaaccactgtagaaacgcaaatggaactgtttttagacacagatcatttg

SEQ ID NO: 2564 - DNA, 1400 bp, mus musculus
agacttgattgatcttggccacagtttctactagaagcctatataaggatatagaagtagggaacatttgattttgcttgcttgtcctggtcttgataggacatcaatttctttactggcattagagcctgttttttggcattccagtatctactgaaaactgactgaaatatttagtgtcttaagatttctgttgctgtgaagaaataccataaccatgcaactcttataagaaaacatttaattggagcttgcttacaagttcaggggtttagtccattctcctcatgatgggaatcatagtagtatacaggtagacaggttgctgaatatgtagctgagagttttacattcagatcagcaggcagcaggaagagaaagtgacacagggcctagcttgagcatctgatgcctcaaagcccacctccagcaacatacttcctccaacaaagctatacatcttgaacaaggccacacctcctaatagcatcattccctatgtgcttatgggggctattttcattcacatgtggtttacaaccacatccagccttgtgatctgagcaacttctggatcattgggttttccattgatagcccaccacttttggattagttggaccacagcctgtaagtgactgtagtaaatcccctttctaagtatatagccacacacccatctcaaaaacttttgacccagaattattcctgtctaaaggaaatgtagggacaaaaatggagcagagactgaaggaaaagctatccagagactgacccatcttgggattcatcctatgcgcagacactaaacctctgccgtattgctgatgccaagatttgcttacagacatgagctatgtatggctgtcttctgagaggctctaccagcacctgactgacagatgcttacaaccaaccattggactttgcccagggactcctatggaaaagttagaggaaagaataagggagctgaagaggattgcaaccccataggaagagcaaagctatcaaccaaccagagccctcagagcaaccagggaataagccaccaaacaaagtatatacatgggtgagtccgtggctccagctacatatgtagcagaggattgccttatctggaatcagtgggaggggaggcccttggtcctatggaggcttgatgccccagaaaagggggatgatagagggtcggggtggggctaggtgggtgggtgggtgagcacactcttagaggcaagaggggaagggtgggggatcatggaggggccactggaaagggagacaacatttgaaatgtaaataaataaaataattcataaaaataaaatacttttggttaaagacaaaaaatatttaaaaaaaagaaaaagaataagagattcattttataagttctg

SEQ ID NO: 2565 - DNA, 1000 bp, mus musculus
ttaataattcttctattacaaaagtaattatccttgcatttgggtcatagatatgtatacttaaagtgttatcttggtatatttttcctttatgaatatgaggaatccttacctgtatcttatgattaattttggttgaagtcaattttcatagataatatgatggctataacagtttgcattttagatccacttgcttggaaaatgttttacaaccccttactctgaggtaatatctatctttgatgttgagatatgctttttgtatgctgtagaaggatggatccagttttcacatctactttgttagcctgcatctgtttttccttaccttatatattacattctgcagtttaacttagctggcaaggagctaacatctaggcctccctcttccatctcatcctacatatccctgaatgcatcctgagtatcattatctaacagcatccctattagtcctcaccaagagttctcaagcacaaatagttgggcagaaaccgagcctataaggcacggatgtccaaacataagaatcctctcttttgtggaaaagaagactgcctaactggtgtagtctgtgattagtgcaaagaaaaagggaaggggtctggtaaggattctggttcctatatatttcagtaaatactgaacatggagtaaactggaaagagaaattgcttgagcttcatcactggtacatgagaacacaagtatttagtgttcgcaagaatccaaatatccccacatttggcctgtcttctgtaggtgagcatattgttgaaagtttatgggtacagcttccttgtcatacctaggagtactaggcatgacatttagcagtaggcatctggttctctggctcttacactgcctcccctacagttttccttgggactactggaggtatagcattgggttttggtctgccatagtcagttgtcttctgaattttgaccagttgtggattctaacaatagtttccatctactgccaagag

SEQ ID NO: 2566 - DNA, 1200 bp, mus musculus
aacccacatactcctgcttccttgtcctggcattctcctacactggggcatcgagccctctcaggaggaagggcctctcctcccactgacttccaacaaggccatcccctgctacatatgcagctggagccatgggtctgtccatgtgcactctctggttggtggtctagttcctgggagctctggggacactgttctgcccatactggtattccttctatggggcagcttatgctctaagatcaagaatagacaattgggttccggttggggccacccctgccatcttccttctgaacccagaggaggcctctaagggctccagagtactctccatgccgcaggatctcgggatcaactccggatcatgggtgagtggatcacaacatcagctccaaagaatgtcagagggtcttgtgccagaaggaacagggacaaaggaaccctgcctgactagaggctgggatccgttctggtcagggccaccccccacccatcttccttctgaaccctctgacggccaccaggggccatagagtactctccacgtcacaggaccctgggatcacctcgggatcacaggtgagttgaacgcaacatcagctccaaagaattgaggagagacttgtgccagcaggaataaggatggaggaaccatgcccagtcagatgctgggatccattccgaggacatctaagtcccaagaggactcttcatgccacaggacccctagcacacctaggatgttgtgatcacctgagagcacatgggtgacagaagcaacagagctttatggacagggtcccttagggccttcatcctcagccaggaggcagagctgagacccagatccctgggcaccttctttgccagaggagagttggcctagagggagggctctgaccccaggactcaggaagtggatcagaactccacacttatggacacttgccctacaagagaagagcttgcctgcacagagtgctctgaccactgggactgaggggagagttggactcccaggaattctgacagaggctaacagaatcacaggaggatcaagctccagccagagaaagcttgaacattaacaccagagatttccagatcatgaaaggcaaacataagaatattactaatagaaacaaagaacactgggcatcatcagaacccagtacgcccacaacagtgagtcctgga

SEQ ID NO: 2567 - DNA, 1400 bp, mus musculus
aaacagatgttttaatttagcatttgggatcttcaaatagggcagaatcaaattgatatcgcctaacaatttctgaaaatcatttaaagtatgcaaggaactaaccctcaactgtatcttttcagtccaaacggctgtaggggcgatccttgctcttaaatagaacactattttcaacaaatctctatccccataaggtaatgggcagctcaagcacatatggttgaaacatctcgtcatgcccttccttaccgttccaatggagcatcctggcacttatgtctgggctctttgcatagcccaggccttgtaatatttgttctgactcttgaatcggccatccttttggccagtccttaaaccaaaaggcaataagaaaaattacccaaatggttagaaaaagaaagtaatccatagactgtccctattacctcgtattttcactaccctcttactttcactttctcgtctccagagctggagagccttattgtctcttactgagagccttattgtctctttaccaagagcctaattgtctctttactgagagcctaattgtctcttaccaagagccttattgtctcttaaccgagagcctaattgtctcttaccgagagcctaattgtctctttaccaagagcctaattgtctctttaccgagagcctaatcccaaccccgggatggtgagttacttactgtactcatcctgtcgacagaccctgactgcagaaagttctggacctcttcagtggaggagtcagttctcaggtttcggcaccacttgttgcatccaacacgaccagcaaggaaaacacaaccaccggttcttcttaaagcagtttactcaggcagcttctctcttcaaatcccccacgccttggggtacaagcgtttttatccactcaagctacaaccatgcctcaaccaatcaccacaggtcacatcacctcaccaggcaggcttgctcagccaatcagggattaagggcgagccatccacctaatatgggcttgtttactgcctggcacagattttcatctggctggccagggagtccagaatggcttaccacaattttctaattatacacacacacacacacacacacacacacacacacacacacatatatatatatatatatatatatatatatatatatatagcttcaaatgatataattatatttttgttacagataagcattacacaaaaatgtatggtgttttttcatgtgggtgttgattgatactatgtacatctagctaaaaataataattgtaggttctcacctatgtcctatgacctccggagatattgctttttgatcaaatttgcattatgaatcatggttcatctcctgtgtagtgcgccttgaatccagttagttgcctaa

SEQ ID NO: 2568 - DNA, 1200 bp, mus musculus
tttgaagaagtcacaccttatgctggatatccttggatcatcccatggtgtttggggcacacagacctaccacataaatagctctttatttttccatcctcatttttctctccttcattcttgtctcttacaatctatctctacatgtgtacctagccccagacatgagtatgtgactgtttacagaggacatagaaagtcttaaagtgacttagggactttggaaaaaacggaagacagtgaagtatcttgagtgatccttagtgattagagtggggtgtgatggagctgtgggctggggaaaagagggagattgtcacagatctcaagtttcctcattatgattgcatggctatgtgcaggagatggttcagatgggggcccaaacccagggcgtggcaggcatgaaggcaggtggtatggaatgtttctccttttgctatgtcctcatccgcacataagattcttgggcttcctgaattctcaacaattgttgtgaatgtaagctgctgccctctggtggtaggcgggttggaagacatgctacagcatcaacctggacccagatgactgggtgcctgaagactcagaccttaatcaatggaaaaaagaatcaaaggtattggcagatattcttatctcctagcatactcctggctccagcttgaaaaattgaataaacctgcctgtgctttgccctgaatccaccccattctggtagactgaagctgtctgctctcccaggggcccagctgaagttgctggaattcacccttttgacatttgttcatcttcccttaccctaatctctcagccacaaccaactctctcatctaccagcacagggttctcctgggaagactgggggacaagcatctttaaacttacagcattcttgtggtctgaattccaaatgtttgctcactcatggcaagcttggcagctgtacagcaggtactttattgtaaatgatgtagtcataagccaggtatctcggccctgagaacaaaaaattattaatctgagtcaagctctctgataggaaaatggaaattccactaccatatagatggactttgctataatttttactactctgtccactgcatgtatgtatgaacgataaaggttgcatcttaccactagaagagaggatagtaaaaacaaagagaatttattaaactttctagaggctatttg

SEQ ID NO: 2569 - DNA, 1000 bp, mus musculus
catcctttttttctacattactgaaaaagaggggtttgcccttggagttttaggttatctactgggaccttcttttgcacccatagcatacttgatagcatacttgtaaaaacaactatatctaaacatccagggataggtgtaagaccccaactcaatgtgtttcttagacccctagaaaggaagcccatcttggagttctttgttcttttgccttcagcctgagagaaagatgaccactgggtaacccacccaggcacctgacccatagtgtaagggaccaagaatgtttgcaaaaagatagcctgtaacctttccatgagagatgagctgtaagtcaccatccccattcttatgatgttaactcagcttccccattctttaacggaccaagaatgtttgccaaagatagcctgtaacctttccatgagcgatgtgctctaattccccatccccttcttatgtttacttggcttccccattctttttggtcttatcctcccctcactttgtggtttattctttaaaaccctcaactgcaactgctggggttttatctcctctgcccctgtgtgtgttatgagcttggcctcagcatgctgattcccgaataaacctcatgcaatattgcatcaaaaatggtttctcgtgtgttattgaagtgacggctcatccaaggacttgagcgagagtctccccgaattgggggtctttcagttttggggatcatcatgggattttgtggccaccccatttctcaaagacccttcttggagggaagattctgtttttgtctatgtctttctcttccggctgtgtttgaatttggtactttcgatttcagtttgcagtcatcagagctcgtgagagcaatgaactccttgtccaggatggaagggagggttattgacagacatgtcaggggataactggctgccaccctgggagatgtcccaggagttctgagggagctccagggatgcctggagatttcccatct

SEQ ID NO: 2570 - DNA, 1800 bp, mus musculus
agcaccatctgttgaaaatgctgacttttttatactggattatttttagctcccttgtcaaagaacaagtgaccatatgtgtgttgattcatttctggttctcaatcccattccactgatctacatgcctgtctctgtaccaataccatgtagttttttttttgtttgtttgttttaattacaattgctctgtaatacaacttgaggtcagggaatgtggttccaccagaagttcttttattgttgagaatagttttcactatcctaggttttttgttactctcaatgaattttcaaattgttgtttcttttgagataacccccactctagttcttcaggacccgcatgaagaacaagctgtacatctactacccttaagctgagaggcctagatccagcctgtctattttgttagttacttagaagcagaatagttaatatagtttgttgttcaggagctttggctttattcttgtattatttgtttttctctctcatagaactatacacttagcatgtgcacactacacattcaactcccaaagtgaattccatcaaatctccaaactcacaggttatcaatgagtagtctgtggggagcgggtgtggcagcagtcccaaaggcgccagggactgcagctaagtcatatgacttgcacctgacttcctcatataagacacaaacatcttgagtgctgtgcaggtgtaccaggatacaggtgaatccaatttggtggagatttgcccctgctgccctgattagctgaagctgcgtgcctggtgaggtggcgtggcctgctgtgcgtggatgggaactgagagtataaaagagtgagaggcccagggttcgggggagatataaacaagggagatataaacaagggagagatataaacaggggagatatagagaaagaagaaacaggactgaataaacgtgtgcagaaggatcctgtagcagcgtcgttcttgctggcgagttgggggcgcgcgcaagagttggtgccgaaacccgggacaagaaacatcttcaggcacgagcgaagaccccctgctacagggaggattcagaactgcatcacggggaaggagtggttaataaaagttcctgtaaaacagactgttgagaaggatccggcgtggattcagaactcttcagctggggaacggtactgatgaagagaaagaagaaagatgaagactgaataaactgttgttagaaggactggtggtcgtgtcgttcttgctggtcgagagcagacgtgacaattggtggcccgtactgggaactgactcccccaccgagttcagaactttcagcagtcagtggttgccagcagggtaagttcacggtgagtgaaacttgcgaccccaggagtttgggaaggacctcggataaaatagaggtgagcataaagttgccaggaagtaggcacaaagtaacccaggagtttgggaaggacctcggataaaatagaggcaagcataaagttgccaggaagcaggcacaaggtaacaaaaggttcccggctttgggacaagttaaggttcccggtttggggacaagttaaggaactaagataacctcagtgtagtgatcaatagatcctcgctgtgtagttatgcttttttcttctattgaccctttgtgggtaggtctgatagttttggtcttctttgttctgatatatggactctgttactgtttgaaactgtgtgtagaggcagtcaagacaggtcagaaaatccttacagagcaacaagaaagtatgtcgaaagaggagaagggcttaaaaagaa

SEQ ID NO: 2571 - DNA, 1400 bp, mus musculus
tcaaaccaatgacatcacataggtgatagagcgacctacagaactgttgccaagatgaaagctaccatgttcccagaatacacttggctcacctcccacctttacctgtattacatcattttccatataaataaggggaacaccccccctctctttcttttccccctcttctctgtctgccaccaccttgtctctccctctcaataaaacctcttccagactgcctgcagttctggcacatgactttaatcccaccacttgggaggtagatgcaggcagatttctgagttcaaggcaagcctggtctacagagtgagttctgggacagccaagttgccaagttctacagagacaccctgtcttgaaaaacataacaaaataaaacaaagaaacaaaaatcctctctcatttgtaattgtcttggactagtttgttgttgaaatgagacctgctgacacaagcccctttctgtctgagcagcactggggtaactagggcgcacagtctgctgactaccgccagctacccataacacctgccaagcgatcttaagtcttctggtgagtggaccacctcatctactccaatccaatcgcaagggacttgagactgcattagtcagggaagcaaaaacccggtctgagtaggggcacaagccccttttggtctgagcagcaccaggtagctaggttgcacagttggctgactaccgccagatacccacaacaccagccacgcgatattaagaattctgaggattgggatctgtcctgcgcgggagtgcttcacctgagcattggcagcagaaatctcggttactggaccccgccaagtgtatcctgcacagacagctggccattttcccggccagaggatagggatctgcccggtgtgggagcattttgcctgagcattgacagcagacatcttagtccaggaccctgccgagtgtaccctgcacagacatcttggttccatgaccctgcccagtgtatcctgcacagctccagagaataccagatgacgaaaggcaaacgtaagaatcctattaacagaaatcaaaactactcaccatcatcagaatgcagcactcccacctcacccagtccggggcagaaatggatggtactctacccaattcattttatgaagccactattactctgatacctaaaccacagaaagacccaacaaagatagagaacttcagaccaatttctcttatgaatatcgatgcaaaaatcctcaataaaattctcgctaaccgaatccaagaacacattaaagcaatcatccatcctgaccaagtaggttttattccagggattcagggatggtttaatatatgaaaatccatcaatgtaatccattatataaacaaactcaaagacaaaaaccac

SEQ ID NO: 2572 - DNA, 1400 bp, mus musculus
ttgttctctctccctgtgatgttcttatgttacctttctttctgtgcctttccagcaaccttgagcaagctaaatcagaccttgttttcccacagttgcctagcccacatagggtgggttcttccaacctaggtgatatctatagtcctgccacatatgcagcttcctgcaagaaaacactacctgctgatcagctgaggttgttttcctgaggagattctggcaaagtgagggatgagttcccccatttaaattaagacttatgaattaagcattgggccttgatcaataactttgtcttggtctcatttgtctctcatcccatccatccccagctctccttccaggtacccacttctccatggatgctggcagctatatcattcctgtgttgttctcctgagatgggtgtatcttctgtctgactcattctaacaaaccttgctctaatttgttagtcttctctcaatcaaatgtcacttgcaaacataatggtttccttctacaaattaaacttacctacattgtttgctattaaaggtgtaagggcctgtctatattctagagagatcatacagtaatctagaatatctactttccagccagattatatagacccagaaaaattttagctatgatctcttgccagagcagccatgttattgggtatgaacttatcaaaagtcaaattggggagccctctcaaccagtccaagcctccggagcagcctgcgattcctgagggacctctattctcctaccacctctcctctaccttcatcagacttgtggatgatagaggatagcttccattttcccacccaccttctctgcttgctgaacctcatgggccaagccaagctgccttgaacagcctgctatctgagagagcctcctactatcccaccacctctcacccccttcatcagactcctgaaccattcctgaaagcttcccttccctgacccattttcattgctatcggagccctctgggccaaaccaagctgccctgagcagcctcttatctaagggagaactacattctcccgacatgtctccacccaactccagcaaacctgatgttcctgaaccatacagaccacaggtccagaaacattaaattcaaggacactcatcagaggtctgcaacaccaggtccattgaggttaaccccctcccaaaacctactacaacaagaacatgcaggcaccaaaaacgtccatatggctaaaggcccctgaaatgacacaatcaacaacaaccagagtaatatgacacctccaaagcaccgccaattcactacagcacacttggatattctaacacaagtgaatcgcaagaaaatgaccttaaatccaatcttctaaagatgatagttgcctttaaacaggaaacaaa

SEQ ID NO: 2573 - DNA, 1400 bp, mus musculus
ggcaaatgtgggcgcggctcccaacacctttccactgagttcttagttcccgataactcactgctgatcctaagtgaatctagcacgtggatttagcactgttccagcttagcctgtaccaaccttctccagtacaaattttctttaattctttacttcttccaaggagctctaaaccagcagtgtttcttccaaatgtcctctgcctatcccaggcgccacattgggcaccaaattgtaggggccggcctggggctctcatgtccgggtttgagccttgaaggcatcttggaactgaaagaaaagagggagcctaggcgggtcaagaaataatggaaccaagaaaacaactcagggttcaaatgtttaatggcagacacactttataaaagaggggggaggcccattcccaccaattcatgcttggagcctggaactagctgcaggtgatgacgtgcaggatagagcaaagtctccagaatagatcaggggggcttctcagcaggtaacagtaccttgaagagaaacagcaacagtggctgaacaatagagtgatcttgggcagaaggctccaccctagataatctccttagtggcagcaaggtcaagttctggctcaccctgcttcaggcttgtgggatactacaggtcagaaaacagatactcagaacagacatgtcggctggcatgcacacattccagaggggatctccttacctccaagtcagttctcagatgagatgggtggttgcatttcctggccaatgcaccaaatgaaagacccacaaagtgaggactcccccacattcttactcaggagaggagaaaccccaaatcactcacaagaaatggccttgatgcaaaccgcaagagaactttttatttcaggcacgcttggggcccacagtcatacaccacacaggggtagaggactgtggacccaggtagctggaaaaggggctatttaaaggaaaaaaaaaaacacaacccaagggggtagggagggtgttattggaaaatgccgaaaataccagtaaaaaataaaaagggtgttctaaaaatcacaaggagaaactccctgcttctcaagattgttctcaagattttaatctaacttttgtggtcagccagttcctggaatagggtcactgaatcgggctaacctacattcttggtgatagggggtctgaattttttccttgtctttcactgtgtactggtccaattgatcccaaggcttatttactacttcaatagagagcttctagatagatgggacagtaccctctattgaacaagaaggaaacccttcatggtgggtgctcagggtttcattgctcttgggactaggagtggctggagtggctactggcacctcttccttggtgctacaaggtcac

SEQ ID NO: 2574 - DNA, 1000 bp, mus musculus
ccaaagacacaggggactctctcacccaaatttccacacagtctggaacatgcacccagccaagctgacaaggtacttacccccccacttccacttcaaccccccaagctccaatttccttcgggacctattcctcaccagggccagatcagtggcccaattcctgcccaaatactacagcctgcaggtctttcaggagttccatagtaaccaagggcacaggacatcttcagtaaaagggttacaggatttctgaagtaaccagagacacagaaggtctaccctaaccagagacattggaggcccactctaatcagagacaacactgcatgtctccaaggagatcatccctaactcagattacagagctctctgcctccaaggagaccagttacaatcagagacacctgggccaattaacaccagagtgaaccagatggccagaagcaagcagaagatcatatgtgacagaacccaatgctatcgggcacaatcagaaccaagttcttccaccagagcaatccctggatactctaacatgactgaaaagcaagatagtggcttaacatcccatcttttgaaaatgacagatgcctttaaggaagatataataaactctacttaaagaaacaggaaaacaaaggcaaacaggtagaaacaaataaatcccttaaagaaatgcaggaaaatacgagcaagcaggtaaaggagttgaataaaacagtcttagaactaaaaattgaaatagaaacaatagagaaaacacaaacgaggaaacccaagagatggacaatttagagaatgtacctaaagagttgaaggggtctacaaccatataggtggaacaaaaatatgaactaaccagtacccccagtgattatgtctctagctgcatatgtagcagaagatggcctagtcggtcgtcaatgggaagagaggccccttgatcatgcaaactttatatgtcccagtacaggggaacaccagggctgagaatttg

SEQ ID NO: 2575 - DNA, 1600 bp, mus musculus
atttccatcacctgtttgtatgttttttcctgtttttctgtaaggacttctacctgtttgatttgctttcctgtttttctttaaggacttgtaactctttagcagtgttctccggtatttctttaagtgagttattaaaggccttcttgatgtcctctactatcatcatgagatatgcttttaaatctgggtctaggtttttgggtgtgttgtggtgccctggactgggcgaagtgggagtgctgggttcttatgatggtgagtggtcttggtttctgttagtaagattcctacgtttacctttcgccatctggtaatctctggagttagttgttatagttgactctgtttagagattgttcttctggtgattctgttaccgtctatcagcagacctgggagacagattctctcctctgagtttcagtgctcatagcactctctgctggcaagctctcttacagggaaggtgcacagatatcttgtgtttggacctcctcctggccgaagaagaaggcccaaaacaggacctttctcagaagctgtgttgctttggcaggtcccagaagctgtcagattctgtggtgcagactctcacctgtgcagactaaattcctaagttcagcagaggcctggaaccaaggtggtgcctgctgctcctgaggctgaggccttccgagccaggcagacacctgtcctctggtccggatggtggccggctgtctgtggcccgcaaagtgtgctgcctcagtggctctgtgcctccgcctgtcccagaagctgtccgggtctgtggtgcaccctctcacctgttcagactaattttctaagttcggtggagtccaggaaccaaggtggcgaccgctgctcctgaggctgaggtcttcagagccaggcggacacctgtcctctggtcccgacggtggctggctccttattttctttttcaatgacctgtcgattggtgagagtagactgttgaagtctcccactattattgcgtgaagttcaatgtgtgttttgagctttagtaaaatttcttttatggatgtgggtgcccttgcatttggtgtatatatgctcagaattgagactttgttttttggtggatttttttcctttgatggatatgaattcttcctcacctttttttctactatttgtggctgaaatattattttttggatgttaggatgtctatgatgtaggcctgtgtactgtaagctttccctgaagatctttggcctaaacaggtctgagggttcaggagaaggggagagaatgctaccaggaacgaggaattgtctctgctgtttccactaatgcagctgtatccaccactgccgtcgcttttgttgctccaagatgctctatgctgagtaatacctggctgagctggtgggaggctgactagcctgggagaggtggcaggaagcttcttgtggtgttttgggagagcaggtcctttccctggtggtggtcttacaactcttatgacagaggctctctgataatgacagagtaattctcactcctttatttattctcaataggatttttatatacagtcttgtggtggttcacagtatgacagtaggtg

SEQ ID NO: 2576 - DNA, 1000 bp, mus musculus
gatagcaaatgtaaatgaagaaaatacgaaagaactcaaagacattttagaaccaaataaaatgagtatacatcatatctgatctcgaacaattgaaagaggttaaagaaaatgtacaagcacaaaattcctacataaaaatcaatcatttagttagttatttgattttaaaaatctggatatatctaatattaacaatttaacatcacatacaaaatctctaaacaaaacaaagaaataaaccccaagaatttatcttgggtgagaacttgacagagggtcccaatgtctccagaggactttatatgcagtaggtgccctagcacacccaggatcttgggatcactggtgattggaatgcaacttttcttccaaagaatcccggagtgtcttttgccatcaggctcagtgacaaaggaaccctgaccttccagtagctgggatttattccagtctgcaccagcctcatgccatctagggtgtgaacttgatggagtgtcccaaggaccccagaggactctccacgccacaggtgccctagcatatccaggatcttgagatcactggtgagtggaaagcaacatctgttccaaagaatcctggagggtattgtgccagcaggaacagggaaaaaggaaccctgccaattagagtctaggattccttctggtggctgcagccccacaccatcttgggcatgacctgggccgaccctagcacacctaggatcttgggatcagtgagaccggtctacttaggatagcacgtgggaggcagaagcaacagagcttcttggtaagggtccctttgagccttcatgctcagccaagaggtagagctgagacccagacccctgggcaccacccttgccagaggagagttgtcctccagagagtgctctgaccttgaaactcagggtgtgtatctgagaaccagacttctgagcaccatcccttcaagaggagagcttgcctgacaactgggcctaaggagagaggtg

SEQ ID NO: 2577 - DNA, 1600 bp, mus musculus
tatttacttcacctacatttcaaattccatcccgaaactcccctatacccttcccctgtcctgctcccctattctcctactccaaattcttggcccttgtgttcccctgtactgggacatataaagtttgcaagaccaaggggcctctcttcccattgatggctgactagtccatcttctgctacatatgcagctagagacaagagctccaggatactggttagttcatattgttgttccacccatagggttccagacaccttcagctccttaggtacattctctagctcctccattgggtttgaagctttttacactttgtattttctatacctaggattctctattctatctctcatattctgttggtaatatttgcatctgtaactcctgatatcttgtctaagttgtccatctcctgggtttccacattttgttgtttccatattgtttctatttcaaattatagttctaagactgttttattcaactcctttacctgctctctcatattttccagtatttctttaagggatttgtttgtttctacctgtttgcctttgttttcctgtttctttaaagggagtttgttatatcttccttaaaggcatctgtcatcttcaaaaatgggaagtgaggccactatattgcttttcagtcatgttagagtatccagggattgctctggtggaagaactgggttctgattgtgccaaattgcattgggcttgccacatatgatcttctgcttgactctggccatctggttcactctggtgttaattggcccgggtgtctctgattgtaactggtctccttggaggcagagagctctgtaatctgagttagggctgatctccttggagacaggcagtgttgcctctgattagagtgggcctccagtgtctctggttaggttagaccttctgtgtctctggttacttcagaaatcctgtgccccttttactcaagatgtcctgtgcccttggttactatggagctcctgggatgtttccaggctgtagtatttgtgcaggtattgggccactgctctgaccctggtgaggaaaaggtgctgaaggaaagtggagcttgggggttgaggtagaagtggggggtaagtcccctgtcagctgggctgtgtacatgttccagcctgtgtggaaatttgaggaagagagtcccctgtttctttggttactttggaccttctgggaggtaactaggctgttacatttgggcaggtattgggccactgatctagcctacttcttcttgatggatcaggtttttgatgtgttccaagattcagtttgtgagtactttattaagtattcttgcatcaatgctcataaaagaaattgtccttaaattccttttccttttagtctttgtgtggtttagaaatcagggtggctatggcttcatagaataagtttggcagtagaccctcggtttctattttgtgaaatagtttgaggagtgttagaattagctcttctttgaatgtcatatagaattgtgcactaaaaccatatggccctgggctttttggctgagagacttttgatgactgcttctaattctttaagggttatag

SEQ ID NO: 2578 - DNA, 1600 bp, mus musculus
cattgcacgggatagagtgagtgtgcttcagcagcccgagagagttgcacggctaagcactgcagtagaagggctctgcggcatatatgagcctattctagggagacatgtcatctttcaagaagggtgagtgtccaaagtgtccttctccccaggaaaaatgacacgggaccagaccaggacccctctgggtgatgagcctgggaggaggttatgtgtacgtctcctttacctgcacactggggatttgacctctatctccactctcattaatatgggtggcctattgctcttattaaaagaaaagggggatatgtaggaagctgccctcacattcgcctttgcaagatggcgctgacatcctgtgttctaagtggtaaacaaataatctgcgcatgtgccaagggtagttttccaccccatgtgctctgccttccccgtgacgacaactcggccgatgggctgcagccaatcagggagtaatacgtcctaggcggagaataattctccttaaaaagggacggggtttcgccattctctctcttgcactcttgcttttgctcttgcactctctctcttgcgctcttgcgctctggctcctaaagatgtaagcaatagagctcttgctctcttgcactcttgctcctgaagatgtaagcaataaagttttgccgcagaagattctggtttgctgcgtctttcctggccggtcgcgaatgcatgtaagagcttctcacctctggcaagctctccctgggctggactccttcacctctcctcaggcttttagcagaagtggccacaaggtgtccggagcccctctggcagccactatctctggcagtaggacactagaaagggcaggctaaaaggtgggcatcctggagcagtagtggtggtggagggggatgggactgagcccctcaggagaaacaaagtagcagtgggaacccccgtccaggggaagacaaaggggaagagttgggaggggggatctgcagtgagcagcagaaactgggcatgtccttcagagccagactgaggttctggaaagaacaaggtggagcccggaggtgggtacctggaagcagccagggaaaacagaggggactgggggcagcaggcagggaagctcaggacactaaaatggagggaggagaggcactttacagctcttcctgacttccaaacagatttgcaactatcctatgggggcagggctctagactcagcagagcacctagtatctgggaaaagaacagccagtcactgaggagagtctcttgttccccttttggggaattcctgattctattggacaccagacaacagctttgccactctctagtacttcttcacaggggccctagggaaccgcagagacagcaccacacaaccaggtgccagggcaggtttcaagcttcatccgcaggttcttggcaatagcagttaggaaccagcaaaaagcatggaggcactcactgggaaaagttaatcatttacccccatagtcaagtgtgtctcccccgttcacactgcagccttggagccctccaggacccaggaagcagaagggcaggaaagctgcataacaggacat

SEQ ID NO: 2579 - DNA, 1000 bp, mus musculus
ccctggtgttcacctgtactgggacatataaagtttgcacgatcaaggggcctctcttcccattgacgaccgactaggccatcttctgctacatatgcagctagagacataatcactgggggtactggttagttcatatttttgttccacctatatggttgtagaccccttcaactctttaggtacattctctaaattgtccatctcttgggtttcctcgtttgtgttttctctattttttctatttcaatttttagttctaagactgttttattcaactcctttacctgcttgctcgtattttcctgcatttctttaagggatttatttgtttctacctgtttgcctttgttttcctgtttctttaagtagagtttattatatcttccttaaaggcatctgtcattttcaaaagatgggatgttaagccactatcttgcttttcagtcatgttagagtatccagggattgctctggtggaagaacttggttctgattgtgccagatagcattgggttctgtcacatatgatcttctgcttgcttctggccatctggttcactctggtgttaattggcccaggtgtctctgattgtaactggtctccttggaggcagagagctctgtaatctgagttagggctgatctccttggagacatgcagtgttgtctctgattagagtgggcctccaatgtctatggttagggtagaccttctgtgtctctggttacttcagaaatcctgtaacccttttactgaagatgtcctgtgcccttggttactatggaactcctgaaagacctgcaggctgtagtatttgggcaggaattgggccactgatctggccctggtgaggaataggtaccgaaggaaattggagcttggggggttgaagtggaagtggggggtaagtaccttgtcagcttggcttggtgcatcttccagactgtgtggaaatttgggtgagagagtctcctgtgtctttggttactttggacc

SEQ ID NO: 2580 - DNA, 1600 bp, mus musculus
ccacactcttgctttagagaggtttgtggctttcagtcatatagatacagcaccccaatccttcccacatgtagatgagatatcccagacctcatagaccaagccaatagtaaacacctactgtcatactgtgaaccaccacaagactgtatataaaaatcctattgagaataaataaaggagtgagaattactctgtcattatcagagagcctctgtcataagagttgtaagaccaccaccagggaaaggacctgctctcccaaaacaccacaagaagcttcccgccacctctcccaggctagtcagcctcccaccagctcagccaggtattactcagcatagagcatcttggagcaacaaaagcgacggcagtggtggatacagctgcattagtggaaacagcagagacaattcctccttcctggtagcattctctccccttctcctgaaccctcagacctgtttaggccaaagatcttcagggaaagcttacagtacacaggcctacatcatagacatcctaacatccaaaaaataatatttcagccacaaatagtagaaaaaaaggtgaggaagaattcatatccatcaaaggaaaaaaatccaccaaaaaacaaagtctcaattctgagcatatatacaccaaatgcaagggcacccacatccataaaagaaattttactaaagctcaaaacacacattgaacttcacgcaataatagtgggagacttcaacagtctactctcaccaatcgacaggtcattgaaaaagaaaataaggagccagccaccgtcgggaccagaggacaggtgtccgcctggctctgaagacctcagcctcaggagcagcggtcgccatcttggttcctggactccaccgaacttagaaaattagtctgaacaggtgagagggtgcaccacagacccggacagcttctgggacaggcggaggcacagagccactgaggcagcaccctttgcgggccacagacagccggccaccatccggaccagaggacaggtgtctgcctggctcggaaggcctcagcctcaggagcagcaggcaccaccttggttccaggcctctgctgaacttaggaatttagtctgcacaggtgagagtctgcaccacagaatctgacagcttctgggacctgccaaagcaacacagcttctgagaaaggtcctgttttggggcttcttctttggccaggaggaggtccaaacacaagatatctgtgcaccttccctgtaagagagcttgccagcagagagtgctatgagcactgaaactcagaggagagaatctgtctcccaggtctgctgatagacggtaacagaatcaccagaagaacaatctctaaacagagtcaactataacaactaactccagagattaccagatggcgaaaggtaaacgtaggaatcttattaacagaaaccaagaccactcaccatcataagaacccagcactcccacttcgcccagtccagggcaccacaacacacccaaaaacctagacccagatttaaaagcatatctcatgatgatggtagaggacatcaagaaggcctttaataactcacttaaagaaatac

SEQ ID NO: 2581 - DNA, 1600 bp, mus musculus
ttttttctgagtgtctgtcttatgtttcctgaaatgaacatgtgctcgttgtgttggtttcttgtctgtgtttcgtcctgtgtctctgaaacatagtgcagtctgagtttagatccacctgagtttggtttctctggtgtttatagacgatggggttttctgaaatgcatatttggtatttgtagctgtcccttcgggctgtaaggaccagaggactgtggtcagcagatgtgctaggaagaatgctacctccccaggggatgccctggggagtagagagagccagagacatctggcagtctccagagattggtcagagggaccaagttttgtttatgaaatggaagcttatccttctaattcttttgcctgctcgtagaagatgagaaagggttgcatgtgtctagatctgttgtttactgttttgtgtatgtgtttagagctatgcaaaaatttagaaaagtgctagtgtaactggaaaagccctactgggagctgattgcaaatgcagctcttaaaggagcaggcagacttttgcttgtaatagaaagttagcttaaaattagtaactctgtgttagagtcattctaaactacatgtggcaggagcgaacccaggaaaacaggtctttaaagatacttcaaaataaggataatctgtgggccaggactctggcagagtgctcagactgagaaatgtttgcccttgggtagaggaggagctcagttcagagtagcctcagggaggtttgtgagacgtttcttttgttttgcaaaccgtgactggggaagttcctgggacctcacccacctctccctgccttcagggtagattccttaagattcagatgcagtatttttttaatacttaggtttttagctatactaaaaattgcggtcctgaaaatctaagaaagaaaaattgatttgcttcaaaattttattttcaaaagcttcgaggagatgctaattggttaagatctcaccttaaactcaccacaggaaaacttaagcctttgtcaggtgctattaagaaagacacaaattaactggcaaagaacaaaaggccttgcagaaaataaagaaagctttcatagttgttatcaattataatcaatggtaattacatattagctgcctattttagttattggttactgaatgtgctcacaacaatttcttggctggagaaaacattgttgtaaaatcatccttcttaacctcgaagtaaagtttcagaccctattgaggctgctgtgatgctaacaaagaattgtaagataaattcatgtattttggaataactataacaaattgtgtcttcaaaacctaagtgtctgctttttgttccaaacagcaattaatttggttattacagaatattaatatttgatctattgcatatcatcattttaaataaaattgacaatcattatcccaaagataagttaaaattgtttttatacatgtttttgtatcttctataaattcatgcatacgtgcatcccatttactgtgtttaaaatcagccctcttatgagagaaaagtatatgtgaatttgatcacacacttattattttgagcttccccctacttcaac

SEQ ID NO: 2582 - DNA, 1000 bp, mus musculus
ctgttgaccttgtagcaccaaggaagaggtgccagtagccactccagccactcctagtcccaagagcaatgaaaccctgagcacccaccatgaagggtttccttcttgttcaatagagggtactgtcccatctatctagaagctctctattgaagtagtaaataagccttgggatcaattggaccagtacacagtgaaagaccaggaaaaaattcagaccacctatcaccaagaatgtaggttagcccgattcagtgaccctattccaggaactggctgaccacaaaagttagattaaaatcttgagaacaatcttgagaagcagggagtttctccttgtgatttttagaacaccctttttattttttactggtattttcggcattttccaataacaccctccctacccccttgggttgtgtttttttttcctttaaatagccccttttccagctacctgggtccacagtcctctacccctgtgtggtgtatgactgtgggccccaagcgtgcctgaaataaaaagttctcttgctgtttgcatcaagaccatttcttgtgagtgatttggggtttctcctctcctgagtaagaatgtgggggagttctcactttgtgggtcttttggtgcattggccaggaaatgcaaccacccatctcatttgagaaccgacttggaggtaaggagatcccctcttgaatgtgtgcatgccggccgacatgtctgttctgagtatctgttttcttacttgtagtatcccacaagcctgaagcaggctgagccagaacttgaccttgctgccactaaggagattatctagggtggagccttcctcccgagatcactctattgttcagccactgttgctgtttctcatcaagatactgttacctgctgagaagcccccctgatctattccggagactttgccctatcctgcacgtcatcacctgcagctagttccaggctccaagcatgaattggcgggaatgggcctcc

SEQ ID NO: 2583 - DNA, 1000 bp, mus musculus
ctggtcgtcgattctcctctacaccactaggtgcatgagtttcgaccccagagctctggtctatgttccatgtgcttttttgctgttgttctattaaatcttgccttctacattttgagtacggtctcagtgtcttcttgggtccgtggctgtcccggggcttgagtgcttgagtgagggtctcccttcgggggtctttcagttccattatgttcatagcagccttatttataatagccagaagctggaaagaacccagatgtccctcaagagaggaatggatacaaaaatgtggtacatttacacaatggagaattgtcatttttaaggtcgcatttaggtgaccatactgttgagatttcatgagtgtagtctacttatcacttatttggagcatagatattgattttgcattttctttgattgttatgccgatgttctctattgaatcttctgcacctgagattctctcatccatctcttatatttgttgctgatgcttgcatctatggttccagatttctttcctagcttttctatctccagcgttgcctcacttggggttttctttttgtgtctacttccctttttaagtcttggatggttttattcaattccattacttgtttggtcgtgttttcctgcaattctttaagggatttttgtgcttcctctttaaggtcttctacctgtttagctgtgttctcctgtatttctttaagtgagttattaaagtccttcttgatgtcctctaccatcatcatgagagatgctattaaatcaggaactatcttttcgggtgtgttggggtgcccaggactgggtggggtgggagtgctgcgttctgatgatggtgagtggtcttggtttctgttagtaagattcttacgtttgcctttcaccatctggtaatctctggagagagttgttgtagttatctctgcttagatcttgttcctcaggtgtttatattagcctctatcagcagacctgggagact

SEQ ID NO: 2584 - DNA, 1000 bp, mus musculus
ggaactggagatgggtggtggaggagggggcagaatgatatgactgcccaaagagaggtggaaggaaaccaaagagagaggagtggcagagagaggctccctggaagaggaacagagtgaagaaagaaacagattgggaagaggtgtggaagcagggtgaggcatggtggcaccttctggctttcaggaaaactaaggaattcaggaagaaggatacacacagcagtgtaaagaggtatacagcaagggtgggcagggtgagacaatcagagaggaccctgaggacaggctcaaggacctgggaatccagaaggactgatgcatacctagtgatggagacattaaagaggtaaccctgggagaagcaattccaagaagaaaggctgtctgggtggtgagagataaggtagaatgatgggtaggtttgtggggtaggggagcctgaaggcccagggaaaaaatgtccttgtgagggcatgcaggtgcactgaagggacactaaaggccatttcaacagggactacttggacagtttcaaccacaaatcaacattgcatatatctcaggcctttctttttcagagtctgtgatagccagcagcctgaaaaagctagtaagagttcctagtttgctctgggcaaaggacaagtaatttttctgggaaatggtcccttactggatccagtaatagcagttttgtcactgtccttttcctgctggaattaaccttgctttcctagggggggaggggacgtctgctgattgtgcctcatgtctccacgatatagagagaactagcctgttcatgttctgtcacagctgcctgaagccacaggtggctccattccttgcccaggcaaagggaagctgccctttctggttagaatccctaaaaaacctatagctcctgacaccttctaggtatcttttattcaaacaagtttaccctttcttctaaaactgagagctaaccatgaaggaaatgtttgtacctctctga

SEQ ID NO: 2585 - DNA, 1400 bp, mus musculus
gcctgagagtcaatcctgtgcatggcccctaacattacacactggggatcagacctctacctctacccacggagcttgcttcattcctaaatcccttggctagcccaagttatacccaaaagactgggaccattaattcaagtctcatagatgacttgtccttgtgtccttcgtggttttagagaatcatccggtgagcaaacagacgtttaggtgatctttaaaaacgtggctacaaatttattatacaatatgccttcataataatattaaaatgggggagatgttgggagccattaaggcaacgctattgtcctgatctctgaattgggcctctccccctgagaagaaaagggggtcaaaagcgggccaccgacatatggattccgagaaccacgggaggttccagccctaggtcatcaccgatgtcctgaccacaccctgataccaccaagttcctgcttcccggtgtagctgccaaaagaaagaatttctattgcccccctcccataagtacttctccttttgcttgtattgccctacccctcccactgataagtatctgtacttccccctttgcttgtgcatttaaaccttggacctttctcaatacattggggtcttgatacaacttcagaacggtttccgtgtcgttattcgtacaagaccctcgtctctctctaccccccatttggttattaggaggatgtcccctcgagatcctcgaataactggacctgctggacaggtcaggttttgggagggggttaatctcaatggaccgggtgttaaagacttctgatgtgtatccttgggttaaatggttctagaactgtggtctgtatgtttcaggaacatcaggtttgctggagttgggtggggacatggcaggagaatggtgttctccctgagataacaggttgctctgggcagcttggtttgatcgagagggctcagagagcattgaagttgggttggggaagggaagaattcaggaatggttcaggagtctgatgaaggtagaggagaggtgttgaagagtaggaggctccctgggatagcaggctgttcaaggcagcttggcttggcccataaggctcagcaagcagagaagatgggtgggaaaagggattctatcctctattatccaagagtctgatgtaggtataggacaggtggtagtagaatagaagtccctcaggtatagtgaaagaacctagtggggaaacacccactcatatcccgagtcagacctcttacgactatcaatagcaggctgctccgggcagcttggattggctgagagggttccccaatttgatttttgataagttcatacccaataacatggctgctctggcaagcaatcatatccaaagtttttctgggtctctgtaatc

SEQ ID NO: 2586 - DNA, 1000 bp, mus musculus
tgcaggcatggacactcaaatacccacagtttaaccttgcggggctgtgggtgtagtggaagagcagggagggagagagcccgcatcccacccgagttcctgtgctctgggcaggtggccatgggaggactgccagatacttttcacacagccctgggtgggcatctggctgtgtgaagccactgaccccacatggcagggggtggacaagggcacgtccctagtaccaggttatcagtctctggcatcccatgctggatacagtaggaagaaaagctaagaacagaataggtgtgcccagggcagcaacataccctggagatatgggaagagggcagggggagagaggttcccacacaggtgagagtccttagtcctggccttgatgaacagaggcagtctatggttttagagctttagtatatagaaaggcacggaggaagagagaaggtgagagagagagagagagagagagagagagagagagagagagagagagagagactggccatggccaacaggagagaagggggaaaggaaagagagaaagagagttagagtgtaagaaaagtgaaggcttagagagagagggcttagagagagactaaagaaagtaaaagcttaaaagagtaagagagagagagtaagagggagagtaaagaaagtaaaagcttaagagagtgaggagtgggccaagcagcccctcttatagtggacttgttatcttgttgttgctaggtaactgggagaagtctagcctgaaggtcagaagcttgggacattgtgtacatgactgctagccactatcctctcttgtggggaatgtgggggtggtaacttcaacaggagccagggggccagaagacataagggaacgccttctgtcccatgtaggtgggaattgccacccatcaggttctactagaattcagacctcaactcaactggagaccagcttgtctgtgtttagcccaatgtccccacataaccaagtcttctg

SEQ ID NO: 2587 - DNA, 1600 bp, mus musculus
tcaatatggccaagtaccatgttttattagagttatttctgaattagatcattgaacaggattctatcctaaataacaaattttatctaaaacattttctagaccaaaaagcatgctttgagccctccttaaataaaaaggcccatagtgtatgaaactaatcaaccatagatcctatatttactccaccaatcctcaggacagtttatgctctttgtcctagttgggattttatttatgtgaacagacatcatgaccatggcaagtattataaaggacaatatttaattggggccggcttaaaggttcagaggttcaggccattatcattgtattagtcagtgttctctggagccccttcaagatctaacacaaaagcctatgactccagtgtcaagatccaaaccaaaggcacattatcttcatgcttcaatatcgggctcacaggtttgccctccatttctagattcaagttcattgcaaatatactcaagttggcaaccaagaatagtcatcacaatgtgtaaggagagagtaaacatccttatattcctctgtttagtgaaattgcttagagtttttctccatttaaattgatattggctatatataggcttgctgtaaactgcctttatagtgtggaggtatatccagttttacccctagtttcttcaggactgttattttgaaagaattttaaacttaggcagtttgtgcagcaaagtggtagtaaagcacatctttaatcccagcagctgggaagcagaggcagttggatctctgtgagttcaaggccatcctggtctacagaatgagatccaagactgcctggactacacagagaaaccctgtctcaaaaaccaaaaccaaatgagataaaacaaacacaatttttttttctagatctaatgaaatgatcttctgtcttgtcttttagtctgtttatgtggtagatatgtattagatttacatatgttgaaccatctctgaatcttcaagatgaggccaactttattatggttgataacttttgatgtattcttgaatatgttttggaagtattttcttgagaattgtatttatgatcataaaggatattggcctataattttatgttgagtctttttgtggttttggtaacagtaattgccacacccactccagtaaaaactgcatggcaagcccaaaagcttggacgcagacccaagccaaaaagtttcataaaaacttagtctcctggagcattggcctcccatagcacgaatgctccaaacttgtccttgcattagtctgtgaatggatctgtgtgctttctttcagttttgttttattatatgtgcctccaatgaatgatttgtcaaatacctaaattaggttgaactttgctttctggcctccaccaatgtcctaggcaattcttgagctgaccctgtgcttacaatttagtaagaatgttacttattcacacaaattgcctccaatattgaaagagagttagtggatgaaatcaggcattactatctattacatagagttagaaatttcagagcaagcttagcaaaataagtttaaaattcttattatagctatgtatggcaga

SEQ ID NO: 2588 - DNA, 1000 bp, mus musculus
tgtataccttatgtagatgtagatagatcaaaaatccctttgaatgaaaagggatgataaaaactgctttgggaagatagcaaaggactaacttgggcaaacactgaaatttccagaggggcatgatcagataccacatatcttggcgtagctgttggagcttttcgtccacctcgtgcaaatggtgagtatcctggagctctatgtggggatagcaaagggtctagagtcttgtgtagttatctaacttatcagagactcatgggaagatttcaaatttcctgacattttttgagcatgatgggtatatccttgaaacacactgggaaagatggtgaatatgctactgtgcactgtgtagaagtgaactgtgttcctgtaccttgtgaatgtcgggaaggagtagaaaccccttggacagattgagaatttcctagagaacttcacatagaacatcggttccaaccaaatgcaccgggcctgagacagcagcagggaaacagaaaacccatctgaccaggggcacaagtcccttccggtcggcgccagctccaggtcaccttgggcatgaatcaggggacagtcctatagtccccagaggactctccacacaatcttaggataactggtgagtggaacacaacatctgttccaaaccaattgtgatgggcctgtgacagcaggagaaagcacacaggagccatgcctgagcagctgctggggttccttctgatctgtactgggatacctttgtttcaaacacaccagacagccccacagtcctcagaggagacacccatccaggtgctgttacacgcccaggatcttaggatttcaggatcccaggataacaggagcttggtcacaccaggatctcaatctcagaggaagcttgactgccaagaactctgacacacccagaatctcaggatcacaggagcctggaatcacagaatcacaaagaaagctggactctgaggagtcctgaatcaactgggat

SEQ ID NO: 2589 - DNA, 1200 bp, mus musculus
acaggattaatttgacgatgaaacaatgatcaggagaaggacagattgtggcacagtggagactacccctactgttgctaaatacagacctcataaagaaatctgatgtcttctactgccaattcaaattgtaaatcaccaaggaagacaaagcatttatataccaacagctcgatactatgtgtcttgattagggtttttctgctgtgaattattcaccatgaccaaggcaactctaataaggacaagatgtaattggggctggcttacaggttcagaggtttagtccattatcatcaaggcaggagcatggcagtgttcaggcactcatggggctggaggagctgagagttttacattttcttctgcaggtggccaggtgaagactggcttccaggcagctaggaggaggctggcttccaggcagctaggacaagggtcttaaagcacatgcccaaaatgacacatttcctccaaaaaggccacacatacttcaataaggccactcttcctgatagtgccactccctgggccaagcatattcaaacaacagttcactcaatgacccctataggcttgttcaaacacaatctgggtgactcttttacattaccaagtcagctacactcaaggtacagccttggctgtctctggaatacagcttctttgtgttctcagaatagctccagctaaccagtgccaattgtcccagtagtcctttctattttttactctaacaccagagccacatggccaaagttgcagcgttctggtgcttgctggggctggactctgcacccccccaaatacacacacacacacacacacacacacacacacacacacacacacacacacattaccagctttctgtttcccaactcccgcactgccaaggcttggctgtcctggaacttgctctgtagattgaccttgatctgcctggcactgtctcttggattaaaggcatgtatcaccacacctagattaaagcaagtggcttcgataagatattatcaaacagagtggactctatgcaagacattatcagagcaggctcccctgaaagacattaacaaaaaaaaaaatggctccattgctacatgtcatcaaaggagagagggcccatctttcagaagacagcaaagttcagtgtctgggtctgctgtaagatatcatcaaacagtgcagcccctctgc

SEQ ID NO: 2590 - DNA, 1000 bp, mus musculus
aactatacataaaaaaaaaatatccaggttctgtgcaccctgaaaccacagtagtttcaggctacacaacaaagaacaaacagggccagaaacatgtatgtgtaagttttgtccagaatattgaggtatgtcttttgggtggagaagaacccctcctctggcatcaagaccccagaatattcccaccctagaaaaacaaccacctggagatggcctagttcctaggggctattcctagtctctgagtggccagagcctgttgtaaaatgtttgctcctaaagaccagtttgaccacatgcctgcagaggggctgcttatctgacagtatctggatagagactggcgcctgctctcgaccctttgaccttccagcgaacacattaggaaggcccattcaagagaaatgcagggaaccttagcaaggtatggcgatttactcagtccttcacagttttaaccagtctgtccaggactaataaccccccatcctcacccaagctcctgaaaaggcacaccatggacacatggcagactctaactgagctttctgtgaacactcaaaggaagagacctggtggatcaccttctctgtttaatttctcttctctatcaagtaacaggccgctagtataaactactaggcctagaggaaagacactctgtgttttgagaggaggtggtctcactgtggttctggttttctgaaaatcaccatgtaaacaagcctggcctgaaactcagaatccacttcattctttcccctgaacgctgggatgaatgtcgtgaaaagacaccccccaactaaacaagagatattctaaaaacacttgagtatcatctccagagcttttcttcttcagtacgagtcgtttggcaaagttgaacgtagacagtaatttatccaactgcgaggtgggtcgccacgtgtgcatccataccagcttgagtaccatgcggtccctgcaatgatatcctgctccttgcagcacaaacctgttt

SEQ ID NO: 2591 - DNA, 1000 bp, mus musculus
atttggttttttactttaatcgttttttattttctatcctaagacctctgtgttcagatccatagaccctctttcttttcttttctttttaaattgggtcacttgctatcttgattttagtggtctgtcagattttactttgtttaggtacactgtggctgtcttcagacacccccccccacacacacacaagagggcattggaccccattacagatggttgtgagccaccatgtggttgctgggaatcaatacctctgcaagagcaatctgtgctcataaccactgagccatctctgcagcatgacattttttttctttgacacctgtatatgtaggaatgaatccatgatctctcttgtcactatgtcttattgttagtgtatacaagggcaactggattttgtaacttggttttgtatcctgccactttattgattttttaaatatatgcctgtatttggcttgcaagcatttttccctttaattctcaacatcatgtaaaaagttcaggcaatgcagttgcggagacatctccaaacccagggctgatggagccgggtgtcaggtgaagattcaaagatcccgggagtcatgcgatgtcctgagacgttcagtgatcgaatttgttggatgtcttattgaagagtttgttgaaggagtgagggacctggagtggctaggaactccatagttggaccaacaggatcaagtcactcttgggagctctcagaaaatgaaccaccaaccaaagtgtatacaccggcgggacttaaacccccatatatatgtagcagatgtcctacttggaagctacctggaggagatggggcagctaacatgatataaagtgaataaataaattaatggaaaaaattaacaaaaaaagaaaaaccaaaccagagtgcagttgacaaagacacctgacataggcatctgacttccagtacacaagcatacatggacactccacaccaacacatgcatacatatcccttggg

SEQ ID NO: 2592 - DNA, 1000 bp, mus musculus
tgcatttgtgcagctgtttctggggggtgggggcacatgtacacagttgcctgcggccacagtgtacttgtgaagatcagagcaagccttgacggacttggtcccaggctaccaggaccttttaagtgctgatccacctcactagtcccgagaaataaaatgataaatcaaaccagacacaaaagaaatgttacaaaatctctcagagctggccacacagttccaaattcccagcaggaagaagacagaaacaacgggtccctgcaagttccaggctatccctgctacagttgggagaccccgcaggacacaatcagaaggaaagagatacaaaacaacaacaaaacaaaaaaaaaacccaacaaaccataaaagaaaaccttggcctaaaggagcagcagaaaacctcctggcagtgggctggttttagtctcataactaagggtgaccttgaatgacctcttcctccccctttaagtacagggtcacagacatgcctattctgataaacaagttatttttctctgtatacttagggttcctatctgcagattgggcctcagaactcaccaccatagcccatgcttggccttctgagtgctgagaccacaggcagaagccaccatacccaacactgaggcttgtctttagggacaatagtctgtaggcagggcacacaattttcagagaatactaaaaccagcagtaaagagaaaggtcgcactgatgtgtttatattaggaaagagagagaaatatgcacgatacaaagatgtatcagcacattgagtgactgtcaccacgtgtcaacccaaccacctctcgggcttctgaggcctgtcctaacagggcctcacctagatccgcagactctgacaaaggttttacttgctccaagtagatactacaagctgcacagcctttagcatagctcccactcccatcccagagccctgggacagcaaggcagggtctggcaggctggacgactgctcttagtt

SEQ ID NO: 2593 - DNA, 1200 bp, mus musculus
ctagacttgggaatctgcagaaggtgctagagtaggagtcctgatcacatacagggctggagtggtactcaggctgtgtaaaccaagccaggcctatcagcgtgaggatgctgctgaagggagagcctggatcactaagagtacttaggaaactcacttctgtcctctggtgttcacacagtctgaccttaaaaggtcctggaattattgctatggtgggtaactgtggaatccagggtaatcatctctctgggctgatgcaaagtctgcctgtgactgggagaccacacctagaccaagcaggtgcagaaaggcatggtctgagtcactactaaacttgactaagccacaatgtgcttgctccaaattcaccctaagggtttcagtttgctgcagaagagtgaagtcttctcaccaaggagagagacaggtctaaaaggacagtctcagcaggacagactgatactcaggctgtttcagcaatgcatagacctggaacaatgagggtaacctcagagtgaaggatcaggttcaggtactgggctgggtcatggtgtacaggctgtggcacacaagcaagaccacagacctctcttgtgatacgggaaggatacgatattgggttgtcatcaggttgggatggtacagtctggttgaccacagttaggccacagagtgtgaggacagagtctgaggagggcactggaaagtgagtcttgacaactcaccaggctgggttgttgctctgactgtgagcataatgatggtagaggccggttgggaatttggacactcactagggtgcactgcctacccaggatcttggggtttctggctagtgtgagctggtgcagggtggcaggggtctggctccacagtgggatgcttgaccaaacatagcctgggagtttgaggatggtgaagctcagtaggctggcctataggcctgggttcttaggagaacaacagcagggcatgctgttgagctctccctgggcttggatgtgctgtagtttatgtgaactcagctacgctggggagtgtgtctgtggctctgacagaggagattcttgaaaacttactgcgcatggatggtgttcagcctgtgtggcgccatcgaggcctgtcaagtacactagtgacaccatggactaatgtatagtttaatgtgaaagctacaaattaatcttagattgtaaa

SEQ ID NO: 2594 - DNA, 1000 bp, mus musculus
atcaatttgagtgatcaaactgtttgtcatcttagtcgctaattagacagatatgagcagtgacaaagaccagaaaggtggactcatgaaaatgcaggtagggcttttctgatcctcccatcatttcttctcttgaagatcataggtgtttcttcccaccagcctagcagagaaaatcgctgggttttcttgaagaaagtatttagaggagtgatggctctttacaaccctgaactgcccccatcccaagccctgtcctgtcagaaatggatgaagaacatcggggtcaccacagccctccacatggaatgtgcctccttgtgggggttaattacgttttaaatagaactgatgtgtggggagcaggcttgcggactcctctttcagtatgtgtggggtttgcaggctttctgctcccctgagtcagcggcttcaaggcaaggaggaacgagggtggagatgggcctgaggggttaaatccaacttcagcttgaaccacaagtgttcatgagttgctggaaggatcctgcccagatacccaggagccacttttgtcagagttcttcattagtaataaagtgcacacttgcctggtatgtgttctgggtagattttaattcagatatttgtttagaggtggcagctccaatcctcactgcccttgacatcccaactaggtaaagttcagtctcatttcctattggaatgctgctcttgtgatgattaccaaggattggaggcacctgtgtggggccttcaatccattgttttcccagtgatcctcactatctagtactgcaatgggcccctgaaagtgggcatatctgtccttgagctaggagagtgaggcaagtatttcttccctgatatctggtggtctaagaaccttttgtaggacaggaagtcattttcctgaggttctctatgtgtgatgatttgtatatgctcggcccaaggggtggcatggttagaaggtgtggtcctgggctggcgagatggc

SEQ ID NO: 2595 - DNA, 1000 bp, mus musculus
ggaaggagttacagagacaaagtttggagctgaaacaaaaggatggaccatctagagactgccatacccggggatccatcccataatcagcctccaaacgcagacactattgcatatgccagcaagattttgctgacacaatgaggctatgccagtgtctggcaaacacagaagtggatacattcatctataggatagaacacagggcccccaatggaggagctagagaaagtacccaaggagctgaaggggtctccaaccctataggtggaacaataatatgaactaaccagtactcccagagctcgtgtctctagctgcatatgtagcagaggatggcctagtcggctctcagtggaaagagaggcccattggacgtgcaaacttttatttccccagtacaggggaaatccagggccaaaatgtgggagtgagtgggtaggagagcagggcagggggagggtatgggtgactttcaggatagcatttgaaatgcaaatgaagaaaatatctaataaaaaattggaaaaaaaaaagaatgaaaagtcttacctcttagagtgccctagtaatgattcagaggtaaactctttaatccaggtataggatagttgggaatttttatactaataaacaaaagaataattctttgtctttaaaacaagccagtaattatggctatcagcaagaggctaggaccgtcctactcacttcatgtgtgcgtatgttgggtaagtgtgcacaggcatggaggtcactggctgtactgctctacgagaacagacctagtcctttgaaatagggtctatcattgagcccagagctaggctggtgtccaggaatcctcaaagattctcctgttccctacctctaccccacccctagccactggagtcatacatacacgcaacattttttacatgggtgtcctaacaactcaggtcctcatgcttgtgcctcttaccctctgagccttcctccccaccccttcaatttatgt

SEQ ID NO: 2596 - DNA, 1000 bp, mus musculus
aagtgaagaggtgcaatgattcattgttaccaaaagagtacaaagtagattttgatgatcagtcttcttccctcatatgcacagagtggttgacatctctcaaaaaactacagtatatatgttatacagtgattgtagtcatttattcatcaaacattttaatttgcattacatttatttattcagtgtgtgtgtgcaggcatgcatgtgaccacacctgtattgggtgtggatctgtgttgggaaagtggatggggggcggggggcaggagagcaagtgtgggggagaggaacctgatctggtattgggtgagggaaaaggactgaagccctagggccatcagaaagaatgtaaacaggaaacctcagaaaataagaggttgggggaccctccagaatgcaccagagacctgggaggcaagagactttcaggaatcaaagggagggaccttagatgaaatgccctacagtaggaagagtgaacttatagagcccacctctagcaagaagacaggacatcaagtgatggatggggatgccatcccacagtcacatttctgaaccataattgttattgtctaaaagaattacagggatggaaatggagaggagcctgaggaaaagaaggtccagctataggtccaaagtgggatccagctcaaggagaggtcccaaggtctgacactattactgaggctatggagcactcacaaaaagggacctaacatgactgccctttgaaagacccaaaaagcagctgaaagagtcagatgcagatatttgtacccaatcaatggacagaagcagccaaccactgttgaattagggaaggctgaaagaaggtgaggagaatggtgatcctgtaggaggaccagcagcctcaattaatctggactcctgagatctctcaacaccaaccagacagcatacaccagctgatatgaggtccccaacacacatacagtagaggacttctgggtctgtgttcattcagagatta

SEQ ID NO: 2597 - DNA, 1400 bp, mus musculus
tctacctgtttggttgttttttcctgtttttctttaaggatttgtaactctttagcagtgttctcctgtatttttttaaagtgagttattaaagtctttcttgatgtcctctaccatcatcatgagatatgcttttaaatccgggtctagcttttcgggtgtgttgggtgcccaggaatgggtgaggtgagagggttgtgttctgattatggtgagtggtcttggtctctgttagtaagattcttacctttgcctttagccatctggtaatctctggagttagttgtcatagttgtctctggttagagtttgttcctcttgtgattttgttagcatgtatcagcacacctgggagactagctctgtcctgagtttcagtggtcagagcactctctgcaggcaagctctcctcttacagggaaggtccacaggtatctggcgttcagacctgcctcctggcagaaaatgaaggcctgaaacagggcctttcctagatgctcttagcctatgtaacccacgctctcacctgcgcagactagtctggaagcgatctgggaaccaaactggctccagttgatgctgttgcaaagccctcccaggcagggcagacccctctcctctggcagggaaggtgcttagatgtctggagcccgaaaaggggtccgcctcagcagctgtcctctagggaccttgggggtgtctgctgactgtttgcccaaggtgaccgtgtgctggcgctgactggaagggatttgtgaccctggtcaggctgggttttctgcttccctaatgctgtctcatgtcctgagcgagtggattgaaacagaagttgtgttccactcaccagaggtcctaagttcgcattgagagtcctctagggacctttgtggtgtctgcagactctgtgcccaggtgacccggtgctgtcacagacagtaactgaggtataactggatcttaaggtagattgagccccatctgcctaaggaactgctacactgatttccacaatgcaccccctctttttgagttcaaaattttctagcttccacaaataacttagaacccatagactatgtctttcttttcaggttttccaaatctatccatactattgtcacttgaggcatgtatttcttccattttaaaggctgaatagtattccattttgtgtatttacattttctttttcaatttatcttttgacagacatgggctaatgacgtaattggaagtacttcagttaatttcagagtttaggtgtatctttgacatagtaatttcatttcctttcaatgtatatacgaagggggaatttttggggagtatcatgtggattgcagactcttttggtgccaagtgttatttaagttcagttctcttttctttttatctgtcta

SEQ ID NO: 2598 - DNA, 1200 bp, mus musculus
aatcttctactaccatcataagatatgattttaaatgtaagtcttgctattcaggtgtattgggatatccaggactcattgtgtgggtgtattgggttttgatgatgcccagtgttcttggtttctgttattaagattcttattttgcctttcaccatctggtaatctctggtgttaatgttctagctgtctctggctggagcttgttcctcttgtggttttgttagcctctgtcagctctcctgggagtccaaatcttccctgagttccagtggtcagagcactctctgcaggcaagctttcctcctgcagggctggtgtccagaagtctggtgctctgatccacctccttagttcaggggtcagagacctccttatagcttgactctcctctgacaaggaaggtgcccaggggtctgggtcttagctctgcctcctggctaagcacgaaggcctgaagggaccctgtccaagaagttctgttgcttctgttgcccaggtgctctccagtgatcaggaggtcctgggtgtgctaggggtcctgcagggtggagagtcctctggggccctcgatacccttgaccagttcatgtggaagatgccggggctggccccgacctgaatggatcccagcctctgatagggcagggttcttttgtccctgtttgtgttggcagaagacccttctctattctttggagctgatgttgcattccactcacctgtgatccagaaatcccaggagtgataggggtcctgtggagtggagagttatctggggcccttggtgccctaggccggtttcacagggaagatggcattgctggcccctatggaaggaataccagcttctggtagggcagcgttcctttgtccctgttcctgctggcacaacaccctccaagattctttggagctgatgtttcattccactcacccatgatcccactataatactgaggtactgcagtgtggagagtcctctggggtccttggtggcctctgccaggtttaggcggaagatgatggggctggccctgaccagaatggatcctatttatttatttattttttaaagctctctatgaagttatgttgtgtgttgaagtttttaattgctgctctagaagttcagtttattgaaggatactggaagacttcatggaggacaaaaaaagcaatctaaatccacagaaaggg

SEQ ID NO: 2599 - DNA, 1000 bp, mus musculus
gagaaagttcaaggccaaacataccttgtaaagctatttcccactttacttctgatagactgtcttgaatttcgttagaaagttcaaggccagacataccttgtaaagctatttcccactttacttctgatagactgtcttgaatttcgttagaaagttcaagaccagacttaccttgtaaagctatacttacgggtaccctgttccccagctgaagagttctgaattcacgcagttgaatccttctcaacagtctgttttatgggaacacttcattaccaccattccccagctgaagagttctgaatccaggctggatccttctcaacagtctgttttacgggaacacttcattaccatgacccgaagttctggttccggaatgagggatcttccttgcgccagtgatggtaaccgtcccaggttttctcgtccaggatttctcgtcccaggtcttctcgtcccaggtcttctcgtcccgggtctcagcaccaactcttacacgcgttctcgcgaccggccaggaagaacacaacaaactggaatcttctgcggcaaagctttattgcttacatcttcaggagccagagagcaagagagcaagagagcaagagcaagagagagcaagaaagcaagaaaaagaacaagaacaagaaagcaagaaaaagaacaagaacaagaaagcaagagcaagaaaaagaacaagaacaagaaagcaagagaaagaacaagaacaagaaagcaagagcaagagcaagaaaaagaacaagaacaagaaagcaagagcaagagcaagaaaaagaacaagaacaagaaagcaagagagagaaaaagaacaagagcaagaaaacaagaaaaagaatggcaaaaccccgtcccttttaagaagaattatcctctgcctaggacgtattactccctgattggctgcagcccatcggcccagttgtcatcacgagaaaggcagaacacatggcgggaaaactgcccctgcatgtgt

SEQ ID NO: 2600 - DNA, 1200 bp, mus musculus
attattattattaagagtttttggtacagtgatctgtaccaggtactgtctgaactctgaaggcacaactgagaaagaaccagtcttgaaattccagccacttttctttatgatgaatcaggaggatgttgaagaagaatgctctcaatgatttaaccagatccccaaaggggaagaaccacacaaaatgtttcaagtgcttagcatcctgtgtaacaaggtgctagaatatctgggcaaggacacatgctgggagactgaaagctaatgtcatgggagcactcactcacttgcaatagtgaaaggatactgctgcaagggctgtgaaattattccattgttgaccatcacaccagtgcacttcaaagcatacattctgtaggaatgggctctggggtgagggatacagagcaaccaacttgggaaacagactccagagactagcattgaatgcagagctatgttattgtgcagcagcaaacatttttatacggccatgccaggctgcctgctcaggagagggacttctgtacagataggggaagcaggcatcacccagtcccaggcacaaaatgaggctcattagcttgctaggaaccttttatcttgtatcccacaatatgccagtggacgtgggtactcatactctcacagtggtatggaggcctccttcactgcctaccaggtctaccctggggctgcagcacccacaatggatgttgttgctaaaacaagtgtgtagtgtgggaaagaaagggtgtagtctgtataaccttctctaaccaatactcttggcttggatagaggacagtgagcctgctaaggacactgagtaccagttgagaacaaatatgtgcatttatgtggtagaacaaaactgaactgcgactcagaacaaaccagcagaagacagaggagccaaagaagattcaatttgcaaaaccagtaatgatgtcctgtgttttcatccttccaatacaagtatgcagtatggctcaactttaactacgtatgacatcagttctccaaagctgaattattttcttaaaacatagttaagagcagtgagatgactcagaagtgttttgtcaccacaagcatgacatcctgtattcaacctctgaaacccaaagtggaaggagagaactgactcctgaaagttgtcctgtgtcctccacatgtatgtcatgataccatgac

SEQ ID NO: 2601 - DNA, 1200 bp, mus musculus
tgccttttgctaaaagccaaaggttttatattttaaccaatcagaaggcactgtaggctggcaaggaaggaatttctctttctttttttctttctttctttctttctttctttctttctttctttctttctttctttctttctttctttctttcacctttatctgtatttattttatgctgaatttattcccgggccatgagtttttgtttcttcagtttcttctgggatatctttttcttctgtgcaagctcctcttctggctttggaacgatctgttccttctcagtgaggatcatctcaatgtggcagggggagatcatgtatgggttaatccggccatgagctctgtaggttcctcggcgcatcttaggtgccttgttcacctggatgtgttcaatgactagagattctacttctaaacccttaagtctagcattactctctgcatttttaagcagcaaaaattcaacactcttttttggccaccgactctgtgtccagccccaccatttggcctgagcccacctactgactccaccattataccaccggaatggcacacattgcttctttaaagtgacgtccttcagatacttggtggctttggggatatgcataccctcgatggcctggacagtttcctgggtgttcttaaagtgaacacgaaggtttgaacctcttgatttgcatgattttgtggggttttctgggtcaagagagtagcgaaccatcttagcaggtgacctctggctgcttacaggaagatgccagttgtggtggcacacgctggaaggatttgctgaaggaggcagaggcaggagaatcacgagtttgaggccagcctgtgctacataatttcaaacagtatgcaaaaacatcactgaaacagtcccctgagccctgggaggggagggatttgatggagacatccatttagtcctgagtgttcaccctctccaaaatgtctgtctatgaatctctctctctctcttttttaccccatatctgctgtaggagaacacttctctgatgctggctgaataagacattgacttatatctctctttctgtgtctggaatacccagatgattttttttttcttttctaattccatccctttgggactataaattcatgatgtcattttttaacagctgaataacactccagtgtgtaaatggaccacattttctctat

SEQ ID NO: 2602 - DNA, 1000 bp, mus musculus
tgcatagcccattgctccacagggctcccctcatagtgatgccaaatagtgcaatattctgctacatatccagctggagccatggatccctccatgtgtactctttggttggtagtttagtccttatgagctctgccggatctggttggttgatattgttgttcatcctataaagtcgcaaatcccttcagctcctttagtccttgccctaacttctccattggggtccccatgctcagtccaatgtttggctgtatacatccgcatctatattaatctggctctggaagagcccctcaggggatggttatattgggctcctgtcaataagcacttcttggcatcagcaatagcgtctgggtttggtgtcagcagatgggatgaatccccaggtggggcagtctctgtatggcctctccttcagtttctgctccactctttgtccctacatttcctttttacaggaggaattctggattaatatttttgaggtagataggtggccccattcctcaactgggggccatgcctatccactggaattggtctctacaggttctatatctccttggttgggtatttcggctaaagtcctccctgttgaacctcttgggaacctcttgggtccctggcatctgggactttttagtggctaccccctgttctccctctccctctcccactactacacacctactttcaaattcttgaccctctgcacttctcccccatctcctcccctatctaaactggcccccttttctctccccctcctcgctccgctccctcccagatccctctccctctacttcccagagattattctcttcccactactgagtagtactgtagcatccacactttggtgtgatcttctttcttcttgggtttcatatggtctgtgaattgtattgtgggtattctgagcttgtttttggctaatatccacttatcagggagtacaaggatatggggaatgagcggtagacagaacaagggc

SEQ ID NO: 2603 - DNA, 1400 bp, mus musculus
atctatctaggtaaatgttttacctgtcatagctacatattcacagtgaaaatacttgtgcactctgccatttttctagaatataatgttgtttgttattaagtgcagtccaaatgcctctatggtatgtatgttttaactttttaatctccaccatcctctagttatccaatactctcatagccatcattctatgtacaaaattgtgagatgtatatacatgctgctgtatttactgcagcactaatcacaataggcacgatatagaaaattcaaatttcattttacttttctctatgagaaagatcatggctgtgtataaatgttcctttaatttcctcagattaagggatgagagccatactcaagctgtgcaaatccgctgcttgggctgagcccagcatatttccttttctgttctatctattcctaggccaaggactagaggcttttagtgtccatctatactatctagtttctcaagctgactgattcaatccagcctttctctctctgtttctacctgaattgctttgtttggcctcatacttactttggcaatatattctaatctcctgactcttcattttctggcttattctttgctcatcagtgtctagcttctctctgcaacctgtctctgtaaaactgtccctggaaaactcctgtagccccccaaccccactcctatgtagcttctctttcctgtgctgttctcatgagagttgggcatatcctatctctgactcattctgtcaaatctttctcctctcctcaattagacatcactttcaaacatggctgcttccttttacaaactcaccttaccttcactgttaggaattaaaattgtttgtattctaggcagatcatactgcaattcagagtttgtctgtcttccaattggattatataaacctaaaagatctttgtatgtgaccccttgccaatgcagcaatattgctggtttaaaaattttaaattcgctgggcgtggtagcacatgttttttaatcctagcactcgggaagcagaggcaggcagatttctgagtttgaggccaacctggtctacaaagtgagttccaggatagccagtgctatacagagaaaccctgtcttgaaaaaccaaataaataaataaattaaataaataaataaataaataaataaataaatatttaaattcctccacagctatgtccacttcttaacttactggcccctatctaatgactaaatgcttcatggtagcctcctctcagtttctcttctccctagcatagtggcatggaagttactactatctgtagtttccaatatcttcaataaatttgaaaaactgttgttttcaaataattttagattcatacaaaatcatatatagttaagaaaggtatca

SEQ ID NO: 2604 - DNA, 1600 bp, mus musculus
tctttattgtgtctacttccccttttagttctagtatggttttgttcatttccatcacctgtttggatgtgttttcctgtttttctttaatgatttctacctgtttggctgtgttttcctgcttttctttaaggccctgtaactctttagcagtgctctcctgtaattctttaagtgacttatgaaagtccttcttgatgtcctctatcatcatcatgagaaatgtttttaaatctgggtctagattttcggttgtgttggggtgcccaggactaggtggggtgggagtgctgcattctgatgatggtgagtggtcttgatttctattagtaggattcttacgtttgcctttcgccatctggtaatctctgaacctagctgttttagttgtcactgttaagagcttgttcttcaggtgactctgttagcctctataagcagacctggagggtagcactctccttggtttcagtgggcagagtattctctgcaggcaagctctcttcttgcagggcaggtacccagatatctggtgttcgaaccagactcctggcagaagttgtgttccactcactagaggtcttaggatctcgtgtggaatcctgtgtgggcccttgtgggtgtcaggcgactctgctggcaggtagtccggggctcaagtcgagcggaagggacttgtgccccagatcaggcctgggtagcctgcttccctatgtactgcagtctcaggttccgcgcgattggattggggcaggagctgtgttccactcaccagaggtcttagggtcccgtggggagtcccgtgtggacccttgcgggtgttgggcaagactctgctggcaggtagcccagggctcaagtcgagcggaagggacttgtgcccgatattttcttttttattgcaagaaatttaatacaatatatttcacagaaaatttctgttaattgattttaaaagcatttatagctttagatgaaatgacctactggttcaattactcttctcctagtcaaactcctagataaaaggtgactgagatttgatttgtgggtgttttgggtgcttgaaggctgttttgtacatgtgacttttgtcaaaatttataaaaatcttaaaattaatttttattacacaatgaatgcaattcaacgttgaaacagaagcatttggtaagaccgatatggaaaatgtctctcaggaaatcaaactaatatgatgatctttgtacagatctttgttagttccatctgcactatcaaaaattatgtactgatatttattctatataaaatattccttatagcacctggaaattttcagagactatttgtaagcaatcgtaatagatgtgtaataaattatccatacctttgattattaaattattatttcaaaatatttcttaaatttatattagctaacaggaaatatatttattgaagaatagaagtgaataagcaggtatagagagacatttggctcgtgaggtagaactagtcaatctttgttactgcagccatgctgagatgattccccctccctttttttttttcattttggacttctgcaagagattttcatgactaacaaacaaaaatg

SEQ ID NO: 2605 - DNA, 1400 bp, mus musculus
ttctttaaggaatttttgtgcttcctttataagtacatctacctgtttagcagtgttctcctgtatttctttaaatgtgttattaatgcccttcttaaaatcctctaccaccatcatgaaatatggttttaaatccgaatcttgctttttggttgtgttggggtatccaggactctctgtgttgggagtagtgggttccgatgatgctgaatggtctgggtttctgttagtaagattctttagtttgcctttcgccatctggtgatgttagattttatagctggttctggctagaacttgttcctcctgtgattctgttagcctctgtcagcactctggggagtctaactctctcctgattcccagtggtcaaagcactctctgtaggcaagctctcctcttgcaaggaagattcacagaggactgggtctcagctctgactcctggctgaagatgaagtcctgaagggcccctgtccaagaagctctgttgctactgcagcccacaggtatctcctgctctttgagagacccgggatacaagatgctgatcttgcctgagtcccagggtcagagctctccctggaggccaactttcctctgaaggggaaggttcacagagttctggatctcagctctacctcctggttgaggatgacggcccatagggcccctgtccaagaacctctgttgcttctgcagcccacgtgctctcctgagtggactggtccctgagggacctgggatacagatggggatctcacctgagtcccagagtcagagccctccttggaggcggactctcccctggtggggaaggtatgtagaggtctgagtcttagctctgcatcctggctgagggtgaaggcccgacgggcccctgtccaagaagctctgttgcttctgaggctcatatgctctcctgtggggattagtcactgagtggcaggtatacaaaatcatgatctcacctgagtccaggagtcagagccctccctggaagctgactctcctctggcagggaaggtgagcagaggtccatttttttcttttagtttgtttatactgtggattacatttatggattttcatatattaagcatttctgcatctatgtgatgaagcctacttgatcatggtaaatgatgcatttggtgttttgttcttagatttggatttcaagaattttattgagtattcttgcttcagtgttcataagcagaattgttctgacatactcttccattattgagttgttatgtggtttaggtatcagggtgactgtggcctcatgaaattagcaagtctcacaagttgattgaaataaccccttgcatcttatcagatcaccatgtgttaaggttggacttcaatatcaacagcaacatcagaaagacctca

SEQ ID NO: 2606 - DNA, 1200 bp, mus musculus
agtatctgcactgttaatgttctgtcagaatgttgtctcatatgccaatacagtcaaggttattctccatttctcttctctcaggtagagtgtgcttcattttatgttgaggtcttcaacttgcttggacttgagttttgtgcagggtgataaatatggatctatttgctcatcacttcccagatctttctgacctctgcctagctggttcaactcagtgatcttgctcaaactcctctccaagttgttttattcagtctggtttctctaagcttctcggttaatttttctgtttggcctcaaactaattctggcaatttgttttaatcttctgatttcttattctctgtgaatattttgtcccttcttctaagtgggattgaagcatccacacttgggcctttcttcttgttaagtttcatatcgtttgtgacttgtacggtgagtattatgtatttttggctactatcctcttatcagtgagtacataccatatatttcattttgggtctgggttacatcattcaggataatattttctagttccatccatttgcctgcaattttcatgaagtcactgttttttaatagctgagcacaccacatttttgggatattttatttatttacatttcaaatgttatcccatttccttgttacccttcggaaacccctagcccatcctccttctccctgcttctatgagagtgctcatccacccactctgacctcctcatcctggcattcccctacactgaggcatccagccttcccaggaccaagggcgtcttctcccattgttgtctgataaggccatcctctgcaacatatgctgctagagccatatctagatattctgatttgcttaaggtggaatctcagggtcatttgatttgcatttccctggtgacaaaggacattgaatatttctttaagcacttctaggccactcaagattcctcagttgagaattctcttacatctatgtttatcagaaagatcaacctgtaatttcctttgtctgtaaattctttatctggtattggtaatatgataatatttagcttcatcagaaacatttggaagttttcactccttcttagtttcatagatttgtttaagtaacattgctgttctttgatgttctgaatgaattctgcaatgaattgatttgaccacaggcccttttatttgggggga

SEQ ID NO: 2607 - DNA, 1000 bp, mus musculus
cttgagtaatccctagaaccatgaaattaagatgttagaagactgattgaacattttcaccaacatcagaataatatgcataaggaaaaaaaaaacagaaggaattatgaaaactcacactgtaaagatagtgaaaatcaagaccagttactggaagagttcttagtcgtcaactctccatgggaggtatgggatgagttaatttgacttgaataatgacagtactactaacaagataggaaagtaacaaagcaaaaaaaaaaagcatgtgtaagaacatatgtaaatctgttcgcaatttctaatgaaagaaatgtacatttaaaaatccataaaagccagagcacctgggggagccatcttggttcccggatcccacagagactagtctgtgcaggtgagagtgtggaggcagaagccacagagcttctgaggcagaccccattttgggctccagacatccaggcaccttccctgccagaggagaggtgtctaacctgccctggagagctttgcctgagcacctgggggagccatcttagttcccagatccctctgagactagtatgtgcaggtgagagtgtggactatagaagctaacagtttcagggacagggcctgtttcaggccttcatcttcagccaggagggaggtctgaacaccagatatctgtgcatcttccctgcaagaggagagctatcctgcagagagtgctctaaccactgaaattcaggagaaatctagtctcccaggtctgctgatagagaataacagaatcatgacaggaacaagctctaaacagagacaactataacaactaactccagagaataccagatggcgaaaggtgaacttaagaatcatactaacagaaaccaagaccactgaccatcatcagaacccagcactcccacctcagccagtcctggataccccaacacacccgaaaagctagacctggatttaaaaccatatctcatgatgatggtagaggacatca

SEQ ID NO: 2608 - DNA, 1000 bp, mus musculus
tcaaaccttattggatataaaacaagtcaatagacataatatatgtgagaaaattattaaaactaacaaataataaataattttcattgtatagcttgactcacccatatgtaataaacttttttactatttactggcatgtctatatatcctgtctcatcctcatattctaccacaaaatattttttaatactctttcacacaaatagattgccaaacatttgatatgcactcaatgataagtggatattagcccagaaacagaatacccaagatgcaatttgcaaaactcatgaaactcaagaggaaagaagaccaaagcgtggatactttgttccttcttagaagggggagcaaaatacccacaaaaggagttacagagacaaagtccggagctgagactaaagtaaggaccatccagagactgccccacccagggatctatcccataaacagccaccaaacccagacactattgcatatactaacaagattttgttgacatacctgatatacctgtctcctgtgaggctatggaagtgcctggcaaatacagaagaggatgctcgcagttatctattggatggaacacaaggtccccaatgaaggagctagagaaaacatacaaggagctggaggggtatgcagccctatatgagaaacaacaatatgaaccaaccagtacccccagagctagtgtctctagctatatatgtagcagaggatggcctagtcggccatcaataggaggagaggctcttggtcttgtgaagatactaagcgccagtataagggaatgccagggccaggaattaggagtgggtgggttgaagagcagggggaggggagagggtataggagattttcagaaaggaaactaagaaaagggacagcatttgaaatataaatgaagaaaacatctaataaaaaaaaggaaaaaaaagacacattttcaaataccttctctttgaagcattctctaatgtttagagaacattgg

SEQ ID NO: 2609 - DNA, 1000 bp, mus musculus
ggttattttatttatttacatttcaaatgttatttgcctacctggtttcccctccacaaaccctctatcccatgcccctcctcctgcttctatgagggtgctcacccacccaccaacccatttcaacctcactgccctagtattcccctacactggggcatcaaatcgagcctccacaggaccgagagcctcccctcccattgatgccacataagtcaatcctctgctacatgtccagctgtagctatgggtccctccatgtgtactctttctttggttggtggtttagtccctgggagatctgggaagtcttattggttgatattgttgctcttctatggggtttcaaaacccttcagctccttcagtccttcccctagatcctccattggggtcccagtgctcagtttgatggttggctatgagcatccccatctgtattggtcaggctccggcagaccctctcactggacatctataccagactcctgtcagcaagtgcttcttggcatcagcaatagtggctgggtttgctgtctgtagttggaatggatccctaggtggggcagtctcttgatggcctttcctttagtcactgctattttgaccctgcatttcctttttttaaaaagtagaaataaaatatatatggcaaatattaaaaatctttgaagtttaacaatatacctctccaagaacccatgtgccaagacaaaatcttaagaggacattttaatgtattttaaggcatttttaaattagatattttcttcatttacatttcaaatgctatccccaaagccccctcccctcaccctgctcctcaacccacccactcctgcttcctggccctggcattaccctgtactggggcatatgatctttgcaataccaagggcctctcctcccattgatagccatcatctgctacatatgcaactagagacacagctctgcaattctgggttaattctgcctgtacgtatgcctgcaggctagg

SEQ ID NO: 2610 - DNA, 1000 bp, mus musculus
tgtcttgagggagtggctccttgggagttgtaagaatattgtttcagtaaagagataagtattcattcgttagccttgacgagtgaattacaagttctgagggctgttctcctaaccaagcaacagacaaataccttagaattgactgttttaaaaatgtttttcttttatttacatttcaaatgatgtcccacctccctgttcccctcacagagtatgtcaccccctctttgtctctgagagggtgttcacccacccactcccacctcacctcaccctggggtatcccccttccttggggcataaattctttacaaaaatagatgcaccctctcccactgagcccagaaaaggcagtcctctgctacataagtgccagggtccaaggaccagcccatgtatgctctttggttggtagcttaggaggtcttccaggaagtccaggctacttgacagggttggtcttcctataaagttgctattcccttcagctctttcaatccttcccataactcctccataggtatccccaacttcagtcaagtggttggctgtaagtgtctgcatcggtctacattaacttttaaggagagggacaataatatagaaagtttggggcagctcagaataccatgtctatattcagggctagagataagattcagaatccattcttttcgccatgaggaagaagttttctcttgtcttgcttagatatgtccacctattcatatggtgtcataaatactaagaaaggacagttgtgatgttttgctttctaatgttactggagaaaaaaataggtaagttccaaagctgattatgagtgggctgtccatcctcggtggcttctgcacatgccagtgcctgcctagctacttaacaggttgatttgaagttcacccagactagcactgagctcataatcatccatcttcagactcctgagtactgatggtggagtcacgtgacatcatgcccagcaactgacagcaattat

SEQ ID NO: 2611 - DNA, 1000 bp, mus musculus
ggggactctgccgaaagtagtctgcacaggtgagagtgtgcactacagaagctaacagcttctaggacaggctggagacacagggcttctgaggcagtccctttttcaggctccagacatccagccaccttcccagccagaggataggtgtccgcccagcacgggagggctttgcctcagcaccagtgggagccatcttggttctgagactccgccgaaagtagtctgcacaggtgagagtgtggactacagaaactaacagcttctgtgacaggccaaagcaacacaccttcagggacagttcctgttgtgagccttcatcttcggccatggggggaggtctgaattccagatatctgtgcaccttccctgtaagaggagagcttgcctgccgagagtgctctgacgactgaaactcagaggagagatctagtctcccaggtctgctgatagaggctaacagaatcaccagaggaacaatctctaaccagagacaactataacaactaactccagagattaccagatgacgaaaggtaaacataagaatcttactaacagaaaccaagaccactcaccatcatcagaacccagcacttccactttgcccagtacagggcaccccaacacatctgaaaagctagacccggatttaaaagcatatctcatgatgatggtagaagacatcaagaaggactttaataactcacttaaagaaatacagaagaacactgctaaacaggtagaagacattaaagaggaagcacaaaaatcccttaaagaattacaggaaaacacgaccaaacaggtgatggaattgaataaaaccatccaaaacctaaaaagggaagtagacacaataaagaatacccaaagtgaggaaaccctagagatagaaaccctagaaaagaaatctgaaccatagatgcgagcatcagcaacagaatacaagagatagaagagaaaatctcaggtgcagaagattccatagagaacatcc

SEQ ID NO: 2612 - DNA, 1000 bp, mus musculus
aatgtgtatgactttattccataggataaagcctggactgaatagaaagggaaaaatgaggagaatcaccagcattcttctctctcagctttctggtggagaatttagtgtaatcagttaccacatgatcctaccaccatgccatctctgccactgtagactcaaactgtaagacaaaataatcctgaagtagctgttgtaatacatttaatttttgcagcagagagacaaagaactaatataacatcagagaaattatttctctttccctgctaaagcatatcatcctattaacgtccttcccagctccagtcctaggtgaacttctagtatccatatcttttttacttaatgccataatctgacaattggagcagtatcattcaaccattatgaccagagccttcagaaaaaaaatatatttatcattattatcctgtgcatgaccataaaatgaagatagtttagatagatagatagatagatagatagatagatagatagatagatagagagagagatagagagatagatagagcgatagagcaatagagagatagagagatagatagagatgagtaacagattacagaatttgcacattaagtcacatgcaagttttattcaataaaactgaagaggaaaggtcaaatgagatcaatctttattaccaatttaatttcacaactcttgcctggcagtttgacaaatatttcaatatagcataatatactattgtacagagtacacaatgataaaaagtgtcaccctaggtataacaatcagcaatggaaatttccaaagcatcaaagtgcaggactacattggctcaccctgaaactcaactattttctttcttatatgctctacgtggctttcttcaccacacttgaatgcccctttgagaagctgttattttcattttgctttattttgctctgcattttttcaccctgccttcagtagtcaacatgccttcagacaatgttctggaccacaa

SEQ ID NO: 2613 - DNA, 1200 bp, mus musculus
actatcatttgattatcatgccatcagcagttaataatgttgaatttgatattatttcatttggagggaaaattaaaataaccttgagaatgctaataaatcctctatcaatagacagatgatgaaataatacaaacctgataaaggcatttgtgatttacttctataattagctgaggtactacagtttaaaatactgcaaaaaataactttgagaagtgatagcaatctagcaatgctacaatttaaatttccttctaccagaacttgctaaatcctgagaaaaagcaagatggtagtatggatgctgataaggtcatggaggctacataagtttattcagaataaattcaagtgaggtgaaaatggattcagggcttcagagaagataatatctgtagcctttggatcttcaagactgagataatggaatctcactctccaaatatgtctgatgttcctttgaatattcaagaaagtttagacctcagtaactaaggtggatgccaccataaaagttccacttaataaatacatgggagtagtattgctccaagggttagtgatgcctgatttgccttcagaagatcatccaaaaagttagggattcatttagttgcaaagaacaaaacttctttttaatatctactatacagaatgcttcatctaccttctcatttggatataactacttcatctatgcagcacaaatatttcttgatttacttgcacccttcccaagccttttctcagagtttctacacataacaggttttgagatcataatgatggattatgctctgaatagaactacaaactgggctagcagtcaaactctgctttgcgttagtatgtgacattcagcaagacatgtaagcgcattgagctttactgacatgaatgtccagaagacctagagtaatgtacatggataccaacccagaattctgtacctagaaaaactatcagccatagtttaagaagaaagaaaatcattcattgatacaaacaaggtaaaataattcatatccatcagctctgtggaaaatactagaagcaatacttcagaataaagagaataaaaatactattcatagctaatagactctagaaggaaaataaattactagaattaccaaaataaagtacaactaagaacacaaacagcaagaaaccagcaaaataactgcaatcaacata

SEQ ID NO: 2614 - DNA, 1200 bp, mus musculus
gtgtgttccaacgtggtcctcagttggtggaactgtttggcaattattaggaggtatgccctctttagaggaggtgtgtaactgggaggccaactttgagttttttttaaaacctctcgccatttccagttagatctctctgactagtaattggctgtctcaagatgtaagctctaagcgactgctctaacatcaggcctgcctgcctgccagcctgctccctgccaccatgttccctgccaagactgctgtgaacactctctgaaactaacgctccactgtaagccccatgtgaactcttgtctaaatttccttggtcatggtgccatcacagccaagagagaagtaaccaagacatttagggaaatgatttatctcatgtgaagtttttggtgctaagtgagctttgcgatctgatgaaaagccttgccacaggcattacatttgtaaggcctctctcctgtgttaatcctctggagaaactcaggtgcgaacgccacctgaagaccttattgcagtcatcacactggtacaacttttttacagtgtgcacttttttatggttcaaaagggtggaactttcagaggtgtccccaaattcatggcacctgtgggctctagtgtgtattctctggtgttcaataaggtaggagctccggctgaaggcctttccacactcattacactcatagggctttactctaacatgaattctctggtgttggaaaagggttgagttttgacggaaggtcttcccacacttgttacatgtatagggtctctccccggtgtgagtcctctgatggctggtgagctgtgtgatcatgctgaaggctttgccacactggatgcacttatatggcttctctcccttatggatcctctggtggtaaatgaggctggaggtctgggtaaaagctctcccacagtcatcacacacgcaaggcttctctcccgtgtggattcgctggtgctgaataaggtgtgagctctggacaccatttgggagttagttctctcctcccacccggtgggaagggtgtgaagcccttcccacattcatcacatttaaacagcttttctctggtttgagttctctggtggcgaatcagtcgtgaggtacagccaaaggcttttgtgcacttattgtgtaagaccccctttcggggaccccctccagtctcgggagagagagtgcac

SEQ ID NO: 2615 - DNA, 1200 bp, mus musculus
atatggtcatttcctgttggtgtttctgtatgttagtatttttaaatacatgtttgagtgtttattaatgctgacatcaaaaataggtctaatgtgttaactaagaaaacattggcattagtgtcacttcaactagtgtcccttcaacattggcattggtgtcacttcattttcacttcagtttctccaactagagttatctgcagcataaaattagaaaagtgctcggtgtaccacagctaatttaatactctaatggggaagctggttataagccactgtgtacaaaacaaatgaatgtcagctattcaggtgcttcctgattaagcactatgtttggaaaaatacctgagagcatcttagtagcattgtctacatttagaattgattagtgtgcttggtgagatggctcagtggttaagagcacttgctgttcttcctgagcacggtttcattcccagctcacttgtagtagccaataactgtatgtaactctaattccagggaacttgacaccttcttttggtctccacagacatagcattcatgtgatgtacatagatacatgcaggcaagatacttagacaaatattttaccttttcattagtaattggaaccctacttattcaaggttataaagtattttgacttgaagaaacctataaacctcatctaggccactttaatggaaacataataactccccatctctggactaacagagaagccagtgggacaagggatgagaagtgcaggagctgtcatgaatggagaatgggcaactcctttttgtttctgttcctggagagtccacgcactttacttgataattcattacaacagtacacacattttccttgtcatccttccgatgacaacagttcatgaccttctgacgtctgttgaagggagaagtttgagcctttagtggtctcagtctgtttctggctttgctaaccagtcttgctcattgtacagtaaatgaggctaaagttttgcttaactgctctaataagggctagaattttaaaggaaacatttaacataatatatacagtcaaagttatgtgctgcttgagtgaaaaaggtagagccattttgttttagtgacaagttgttagcagatttgccaagcaatccttttctaactagaatgtacaagcaaagcaacagaataactcacgttactcaaagttcac

SEQ ID NO: 2616 - DNA, 1200 bp, mus musculus; identical to SEQ ID NO: 2615

SEQ ID NO: 2617 - DNA, 1200 bp, mus musculus
gatggttttattcaattccatcacctgtttggtcgtgtttccttgcaatactttaaggtatttttgtgcttcctcattaaggtcttctacctgttcagcagtgttctcctgtatttttttaagtgagttatgaaagtccttcttgatgacctctaccatcatcatgagatatgcttttaaatccgtgtctagtatttcaggtgtgatggggtgcccaggactgggtggggtgggagtgctgtgttctgatgatggtgaatggtcttggtttctgttagtaagattcttacgtttgcctttcaccatctggtaatctctggagttagttgttgtagttgtctctggttagatcttgttcctcaggtgtttatgttagcctctatcagcagacctgggagactagctctctcctgagtttcagtgttcagagtactctgtgcaggtaggctctcctctttcagggaaggtgcccagatatctggtgtttgaacctgcctcctggcagaagttgtgatccactcacagaggtcttaagatcccatggagggtcctatgtataccttgcgggtttctacagactccacgcccaaggtactcctgtgctgacgtggactggaagggacttgtacccctgatcaagccgggttttctgcttccctaattaatgcagtcaaggtcccccgcaattggattggagcagatgctgtgttccactcaccagaggtcttaagatcctgtggcgggtcttgtgggtagttggcgggtgtcagccaactccacgccctagctatcccagtgctagccagactggaagggggtccaggttatttgacactgttggtttcctatggggttgcagaacatcttaatgtaacagaaagtgcggaaataatcagagtaatgaagtcatgtcaaatagaggggaaatattttgaagggattaacactggctaaaacgaaatatttgggcttgaaataaatgagaaaatataactctttgtataatagagggaaccatgagttcttacataagtaaattaatggataaatagaaagttcagtgattaatggaagttatagaacttcaatgttcatccctatacacacttgttaattataagtcgaaaggaggataaaatagaatagccattaagatgccaccttaattaaaggattaaagttgacatcattattgattgt

SEQ ID NO: 2618 - DNA, 1000 bp, mus musculus
ttgctattatttctatgaaatataaaacgattctttttaaggatgcatgtagattgtttattcctgcattgagaaagagggaaacacggggatccatcccataatcaacttccaaatgctgacaccattgcatatgccagcaagattttgctgaaaggaccctgatatagctgtctcttatgaggctatgccggtgcctggcaaacacagaagtggatgctcacagtcagctattggatggaacacagggcccccaatgtaggagctagagaaagtacccaaggagctgaaggtgtctgcaaccctataggtggaacaacaatatgaactaaccagtacaccccggagctcgtgtctctagctgcatatgtagcagaagatggcctagttggccatcattgggaagagagaccccttggtcttgcaaactttatatgcctcagtataggggaacaccagggccaagaagtgggagtgggtgggtaggggatggggggggtaagggggtcttttgggatagcattggaaatgtaaatgaagaaaatacctaattaaaaaaaagagaaagagggaaacaacaaaatccatagaagtccccaggcctgtccatagcaagggcatggctgtacataggactactggctcaatttcagatgctctaatatatcagcagttttgagaggctactgtactggtcagtataggttagattagggttttttgtttgtttgtttgtttgtttaaagacttcttaatagcagtagatatatacagcagaccttcatttgtcctttagctacatgctggtttcaaaggagatctcaacatgtagtgtgttccaaggcagtttatgtgaacatgaacaaattcttcaatgtttttaaatgcttccactcagatgctatacataacatttcacattacatagacaaaagaagttatatgatcttcataactacgaaagcgtattatgtttcaaaggtgaaaagaattagaatct

SEQ ID NO: 2619 - DNA, 1400 bp, mus musculus
aaagtttggttctgatgatgccaagtaaccttggtttctgttgcttctgttcttatccctgccatctgattgtctcaagtacttactgccctcaatatatctgatttgatcctgtccttcttgtaatcctggttgagtcagaactcttcagagtccagctttctctgtgatcctgtgattccatgatcctgtgaacctaagattctgggtgtgtcagagttcttggcagtcaagcttcctctgagacctgggatcctcatgtgaccagcttctaggatcctgggaacctagaatcctaagatcctggacatgttagagcacctggaattggtaactcccttggggaccttggtgctgtcagctgtgttcaaagccaaggtagaccagtgctgactagaaggaaccagagccactggtcgggcagggctcctgtgtccctgctcctgctggtcccagtcctagttgtgttagaacagatgttgtgttccattcaccagtgatcctaagatcctgggcatgctaggatgcctgggaggtggagagtcctctatggaccatggggctgttccccgagttcttgcccaaggtggcctggagctggcactgattggaaggcacctgagcctctggttgggtgggtttcctgtgtcgctgcttctgctggcccagggccttcacaattagtttggaacagatgttgcattccactcaccagtgatcctaagatcctgggtgtgctaggatgcctgggccatggagagtcctctggggaccatgggactgtccgccgagttgatgctggctcaactgatggttatcatgtagaagaatgcaaattgatccattcttatctccttgtacagagctcaagtctaagtggatcaaagaactccacaaaaaaccagagacacacttcttagcccagcactaaggtccacgctgcaggaccttgtgatcaccttggaatcacaagtgagtggaacgcaacatcccttccaaagaatcacagagggtcttgtgctggcagaaacagggacaaaggaaccctgcccgaccagaggctaggatccattcatgtgggggccagctctgcaatcttctgtgtgaacccggccaagggcatctagggcaccagaggactctctagaccgcaggacccctagcacacccaggacctcagattacctgagagcacatgggtgatagaagcaacagagcttcttggtcaaggtcccttcaggccttcattctcagccaggaggcagagctgagacccagacacctgggaacattccttgcaagaagaaagttggcctagggttctgacaccaggactcgggaggtggattagagctccagactgctggacacctgccctgcaagaggagagcttgcctgca

SEQ ID NO: 2620 - DNA, 1200 bp, mus musculus
gtatttttatgaaccaaatattgtctgccaactagttgcattctcttactattattaatggctgtttaattttaatgtgatcaagtgtttcatatattttctcttttatgtgttttgagtttcatgcttcacattatgtttagggaaagtggacatgagaggaagtgggggaggagaggggaacctgatctggtattggtactgaagccatgagggcaagtagaaagaatggaaacaggcaacctcaggaaataggaggttgggagaaccctccagaattccaccagagacctgggaggtgagagactctcaggaatcaaagggagggaccttagatgaaatgcctgatagtaggtagaggtaacatacagagcccacctccaacaggaagacaggacatcaagagagggatggggttgccatctcactgtcacatctctgacccataattgttcctgtccaaatgaatttcagggatggaaatggagaggagcctgaggaaaagaaggtccagcaacaggcacaaagtgggatctagctcaaggggaggacccaaggcctgacattattactgaggctatgggacactcacaaaaagggacctagcatgagtgcccttggaaagacccaacaagcagctgaaaaagtcagatgtagatatttgtgcccaaccaatggacagaagcagctgacccctgttgttgaattaggggaggctggaagaagctgaggagaagggcgatcctggaggagaaccagcagtctcaattaatctagaccccgagatctttcaaacactggaccaccaaacagacagcatataccagctgatatgaggcccccaacatatatatagtagaggagttccaggtctgtgttcattcagagatgatgcacctaaccctcaagagactggaggccccagggagcttagaggtcaggtggggtaggggctgagggcatccacatggagacagggagagtggggaaaaggtgtaggatgtggagcagtcacagagtggatggaggcagggaatggaatatggagtgtaaaaaataaattaatttaaaaaaagaagtgctggtggtctttttgtaacccagatgcccctcaacagaggaatggatacagaaaatgtggtacatttacacaatggagtactactcagctattaaaaaggatgaatttatgaaattcct

SEQ ID NO: 2621 - DNA, 1400 bp, mus musculus
aaatagtctcagggatttaatgagattctgaaggcagttttaataccccaacacctaccacactgaagaaatatgactccaggctttgagaaacaatgaaagatcttacaaaaataatgttattatcaaatctgaattctcaaaaggccattggtaacaacaaggaagagaagttgggttccccagtacttagaataaaatttaacacacaaaaatatgtagtttataatctcttaaatcagtttcacagaaaggcactccaaaaaataattatgggatttccaatcttgttttggcactatattctctttggaaaacatgtttttaaaatgaaaaactctgcttaaaccttttatcacagtgtggacatattatcttatagatgaatctagaagtattaaaaaatgtatatgatggtcagtgagccctgttgtgtgcctcagctctgataggttcataatctgtgtgactataaaaataggttctattgataaaaattaaatcttagatatttgtaaaactaaccctcaacatttataaaactcaaacctctattgaaatcaaaaaagccactccactacatatgcagctggagccatgagtctcccaccatgtgtactctttggttggtggtttagtccctgagagctctgggggtactggttagttcatattgttatttctcctatggggctgcagaccccttcagctacttggttactttctctagctccttcattggggaccctgtgctctgtccaatggatgactgtgagcatccacttctgtatttttcaggcactggcagagcctctcagaagtcagctatatcagtctcctgtcagcacatcttgttggcatctgcaatagtgtctgggtttggtggctcttggtccagtgaaggttctatgccctagtataggggaatgccaggcccaggaagcagaagtgggtgggttggggagcaggaggagtggggaggggatagggtattttcagaagggaaattaggaaaggggataacatttgaaatgtaaataaagaaaatatctaataaaaaagaaatcaatagaaattcaaaataaaaataaaagccactatggctatttccacaccatagcactgaaatctaaactatatacaaatccacatagcagagtgaacattctcattatcatacattcatttttgaccagatctcatttagggtttatatatgtatgcaatttgcttagtctgaaaatcctttccctattcctgcagtacttgcttacatttacacattcaacagatgaccttgattgttttttatccaatgaaatgggaacactaaaataggatcttctttaatgtttgacattcaagtgtggaacctactttctattacagaagatgcaaag

SEQ ID NO: 2622 - DNA, 1400 bp, mus musculus
gagtggtgctatctgatccatcacttttttttttttttttaccactttgacctgcgttttgtctttaagaagtttagcatgttttttgtttgtttgttttttgtttgcttgttttaataccataggcattctgtatgcttttcctatctctggaatgttgtgatccctcttttcttagttgtggctacagagctagtaaattctatcttctcggagaaatgtattctgacttctcagtattgaacaaattctgctatgacatatttacatataacaccatgtctctccctgttcatactcatcacagtgcaatactgtcattatgtatccatccctctttgtcacaagactgtacattccattaggtcaggtacccatacatttgattttatactgcttcctattctcagtcttatgccttacctatatgccataatataatgatttaataaatgaatagatggattttcagaggctcacatagccagcattcatgtttcctgagcctagtacagaactcttcatggcacaatgctgcttctatttaggcaaacagcacaagattggatcatttagcagtttcggagcagtttgggacttacaaatgaaccttctaccgtctgccagttgctatatatgcacaagacattttcatcaaagaaaatgtatgaatgcatcagtaccccagttacactattaggacaataaatacatgcgttaaagaagccacacataaagggttggcatcatcgcagtagtatgcatgtcaatttcaagaagtatattggaacattaatatgaaagagaaaataaatcatattgttgcaggcatttttaaagtcctttaggaaaaaaaaaaacgttttagtttgctgagttgaatttcaggatttcatttaaaaaatacttaatgtttctagagacctatcagaaatatttatctacagacaaaattgttacttatttttgatgaatgaaataaccataaagggccttttccttccttgaataaacttaagattagatgtgttcatttttatactttagaagctaagtgtaatactaagaaatatggaatgctttttctggaagagctacttctagaggtttttcttttaaactagtaagtggaattttaatggtgaaatctgagaattgtgcatagtatttagaaaatgcaagttataatcctgaagtgctataatcatcaaatagttgctggcatctttcaaagtctttaatccttcttcatattaactttctgacctagcttttgtcaaaataatcttaagtccctaaacatattctcatggcataaaactactatttcttgaagttgttgtgtgctagaaacgaccacacagacattgttgagttccaagtaaatcaccggaaagcat

SEQ ID NO: 2623 - DNA, 1000 bp, mus musculus
tagtcaaaaaaatgtacagaatacccaggatacaatccacagaactcaagaaggttaacaagccaaagggcccaagtgagtactcctcaatcccacttggtagggagcagaaatcaaccactggggtgctgggtagggcagagagagaaaggtacctgggtggtagaggggacagggagaaaaagggggaatatgatcaggtattggggtggggtggggaacaggactgaagccccgaggaactgtagaaagaatggaaacaggcaaccttggggggtatgaggtgggggaccctctagaatttactagagacctgggaggtcagatattctcaggactcaaaggtagggaccttagatgaaatgctgtatagtgggaagaggcaacttgaagagtccacttccagtagaaagacaggacatcaagtggagggatggggttgccatcccacagtaaaaaactctgatccacaattgttcctgtttaaaagaactgcagagacaaaaatggagaagagcctgagggaaaggaggtccagtgacaggctcaaattgggatccagctcaaggggaggctccaaggcttgacactattactgaggctatagtgtgtttatatacaggagcctagcatagatgccttcagagaggtccaacaagcagctgaaagaggcagatgtaagcatttacacccaaacaatggacaaaagctggagacccctgtggttgagttagggaaaggatggaagaagctgaggaggagggcaaccccataggaagaccagcagtctcaactaacctggaaccctgggatctctcagccaccaacaaggcagcataacccagctgataagaggtccccaactcatatacagcagaggcctgcttggtcttgcctcagtgaaagaagatgcacctctcaagagacttgaggatccaggaaatggtgaggtctggtagagtggggttgggggatacggaaatcctcttggagacagggg

SEQ ID NO: 2624 - DNA, 1000 bp, mus musculus
actcaggatgatgccctccaggtccatccatttggctaggaatttcataatagtgggctttgctctcttattattgctagataactgtggggaggagtctagccagaatgccagaagcttggggcattatctatgtgactactagccacaggcctctcttgtgggggctgtgggggcagtaactttgacaggagccaggggttcaggagacatgattgaaagccttctgtcccatgtaggtggaaattaccacccatggggttgcaccgtggttcaaaacctcaactctggagaccaggctatctgtgcatagcccatttccccacagacagtgatcacacccacatcatttgtttgctttgatgattacaagagggtttgagaaaacagctaattctcatgagtatttgtattcccctatttatctcttgttcaatatatacagtggctgtatttctcaataattagttacagtcctgaattaagttattactaataaaaattcatcaagtattattttaatgatgaattataaattgttcccatgtgccaccctcactttatttacttaatgtggtagtttgaatggccaatatagattcatgtgcttgaatgcttggtccataaggagtggaactattaagaagtgtggccttgctgtaggaagtataccactatggggcaggtctttgaggtctcatatgctcaagttatgcccagtgcacctcatagtctccttttctgatggaggatcaacatgtagcactctcagatccttctccagcacagtgtctgcctgcatactataagtttactgccatgatgataatgggcaaaacctctgaaattgtaaggccaggtacaatgaaatgttttcctgtacacgaggtgctatggccatggtatctctcagagcaatagaaatccttactaaggcacttagtcaactggtaaatgaagtatataaaggctcataggaggcaagacccacaagatatta

SEQ ID NO: 2625 - DNA, 1000 bp, mus musculus
agtgttatgaatgtgttcaaacacaaaatacccaacactggacagataagaatgactagctgcatatgtatcaaaagatggcctagtatgccatcactggaaagagaggaccattggacttgcaaactttatatgccccagtacaggggaacaccagggccaaaaagggggagtgggtgggtaggggagtggaggtgggtgggtatgggggacttttgggatagcattggaaatgtaaatgaggaaaatacctaattttaaaaaaaggaaaaaaaaagactgaaagaatgttaaaaaaaaaaaagaatgacaacaattactcagctacgtctgtagtctttgagaagtcgtcaccatacaaaactatatacatttttcagttgagaacagagtgatcattcatgggcttagtattattaggaaaataatctatgatattttgtatgagatatctatgtctttcgtagaaggctggtctcaattttcttgagttggtcttcaggactgagagggatctaaaacctgatattcagagacaatcaaaactgtcttccttgtacctagggaattcaatgacaccacaagaacacagcccgcaaaatctactgaccaagactcacatgggctcaaagagatcaggaaccctatataggtgtgacccaggtcctctgtacatacgttatggttgtgtaactcagtgttctcctggaaactctaacagtgggaggaggctgtctctgacagttttgctttccttgggaccttttttttgcctactggtttgcctgttctggcttcaatatgatggtatgtgcctggtcttattgtagcatgttatgctatagtttgcttgatgtccctagaagggctgctcttttctcagggtatgtgaaaggaggtaaaggaatgtgggggaaagggaggtagatgagagagagaatcaggggagaagaaactgcagttgggatgttaagatataatatatgagagaaaaataaaa

SEQ ID NO: 2626 - DNA, 1600 bp, mus musculus
taaaatatttttaaaaatctatactttcaaagaaaggtaattattctgagaacaatatttttctaaatttactgaaaagagtacaaaagcatatcaaaagtatctcatattatcactagaattaatatgtatctaacctaaaatcaaggaatatatagttattttgaaattaaaaattgaataataaattattcaattgaataaatttaaacacatttggtaataaaatatggaaaataatataagtgacttttctagtgaaattacattattaaattttgtaaatatctcttagcattttgctttttgaagaataggggttccttttagcaggaatttaagatggaattccacagattcttactgatctagttttgaagatattttttatctccttcttctgtgttttcatgtctttaaattcaacaacagtgacaaaatttaattaccatactaatgatcatgtaaactgaagtctatagttgtttacatgaaggtgaatttataagaaacctagatttaaatttttatgtactacattttctgtatccattcctctgttgagggacatctgcgttctttcaagcttctggctattataaataaggctgctatgtggagcatgtgtccttcttaccagttggaacatcttctggatatatgcctagtagaggaattgctgcatcttccggtagtactatgtccaattttctgaggaactgccagactgatttccagagtggttgtaccagcttgcaatcccaccaacaatggaggagtgttcctctttctccacatccttgccaacatttgctgtcacatgtatttttgatcttaaccattctctctagttgcatatgtagcagaggatcacgtagtcggccatcaatgggaggagaggaccttggtcttgtgaagatcatatgctctagtacaggggaatgcctgggccaggaagcagaagtgggtgggttggggagcagggttgggggagagtatgggggctttggagatagcatttgaaatgtaaatgaagaaaattctaataaaaaattataaaaaattatatgtttgggttttctcatacaaaccaaatttataaattttaaatggaaaatttataagcacatctatgaaatgtgatacaattcatttaaaggaaactaatcattaattttaaagatagttaacatatctaaaacatggaaaagcaagtatattgatgtcacatgaatggatttatttcaaggaagagctgtcttcaccctttctgtgtgtttatactaattttgtacagaacaaaaaaggaatgtgcagttgtcatatgatatatctgattttcatctttcaaaataaggtgtgtatttaaaaaaacacccatagctcatgtttgctttctgtctctgttataaaacaacatgaacaaaagcaacatgtggataaaaaggtttatttcatgtttatttcaggttccagttgaagcctactcaccaagagaaatcaaggcaggaatctcgaggtaggaagtgaagcagataccatggaataatgatctaactggcttgctcacagtgtgttccacatttttcagtttatgttg

SEQ ID NO: 2627 - DNA, 1000 bp, mus musculus
agagctggaacttgcatggagcctttacctttatgttttagtctctttggtgtgggaagggattcttcaggctccaaaagggaaatgtgaacatcaattcacctacaacacctactatctacaatctatcctgcctgcaggatgtgctgagacggtgatggcatggaatttatggaggtggccaaccaatgtctgtttaatttgagacatactccaggagtagttgtgcctgacacaacttggattgccaggaatgggagactggatagcacataggccttgtgtagaaacaaacacaactatctttaaaacaaaacaaaacaaaacaagtcaatgaagtaatttctaatactattctgttatactaatagatctatgcatgggtctgtgccaggtcctctgcatatgtattgtggctattagcttgttgtttttgtgggactcctaactatggaagcaactgtgtcccctatttgtttgtctgcatttgggactcttttcttcctgttgagttgcttttttttttttttttttttttttggaaaggtgtgagggatttttttcattgtcttgttgtattttgttttgtcatgtttggtggttgttgttgttgttggtttttttttttttttgtatgtttgctcttttctgaaaggagatgaaggaggagtggatgcaggagagaaaggaagtgtgtagggtgactgggaggacttttgggagggaaaactggtcaggatgtattgcatgaaagaagaatctattttcaataaaaagaaataggacccattcaactagtacgacacaaagcagtttgcaaatcactttgaaaactaacgaatggagtagaagcaaacttcttttctattatctttctacttgctcttctagtatttctctaaattcttcagaaataatgcagataaagagtaaatctcatgacccctgaattcctctggcattcctacttcaggcttattttatttgcattttagatgat

SEQ ID NO: 2628 - DNA, 1000 bp, mus musculus
ttttttaatgtgatgttcatttgaatttcttttttttgtctttttttatattccttctttttatttaatactttttatcacactccctatttttcccctccctgcccaccctccaactgtccaacatctgatacatcctccacttttcctgcctataggaggatgtttccattctccaacctctcaccccaccatactgctaagctcccttgggcttccagttccttgagggttaggtgcatcatctctgcttgaacacagacctggcagacctctgctgtatgtatgttgtgcctctcatttcatctggtgtatgctgcctggttggtgttccagtatctggaagatctcggggatccaggttaattgagactgctggtcctcctaccaggtcacctaaactgagtttctaaatggccccttaatgtggctgtgggtatctttatctagattttggaaattttctgctatgattttactattttttcatctttattttcatcttttatttatcagctgttattttttttttcgttctagttcatgagtctcatgtgtcttcatgtttgagaacttttgaaattttcattatgctaattttttcctttatttctattgaatatatttcttcaattcctcatacttttttttctggttgattttattttaaaaatattattatattcatttacattcaaaatgtccatttcccagttctatatccaagtgtattttacctcatcctcctcccctttgcctctaagaaggcactctcccacccatgtatccctgtccattcaccaccccccccttaccacccattccataccacccatcccacctcaatctggacctcatcttccttccctgtggtctctacaagcaacatcctctccccttaaagccagacaaggcagtccgccgctaaatatgtacctatttatcttgctgcctgttgattaaacttctatttccaaaatttccatttttagagattttg

SEQ ID NO: 2629 - DNA, 1600 bp, mus musculus
attggggtagtgaatagtttgggttcaatgctaagatagagttcagagtaaccaaatttcaggcctgtaattaaataataatttgagaaaaaaagtatcaatacttctaaaaccctagattaactatgtgtttgtgacaaatcctatttttaatttggtagagcagcttttgaaaataaaatgcaaatattataggatttagatgagagattgcaaggtaatccatataatttcctcttgaaattgaaaagattatctggtattttctgtaactgttatgtaatttatctttagtgctttattgagttatagttgacttccaaaaaaaaaaaaaaaaaaaaaaaaacctgccaatctaatgtatgcagtttaatgagcttgcttacacttaaatacatatgatagcattaccatgtaatcacggtaattagcaaatctgccacctctaaaaggttctttatcttcactttgttgtagaaaagaggatgtaacgtgaggtctttttgaacatttttacagttcaacaaaatatatagtttgctctgcacaatcaattttaaataggtctctagaacttagtaaccttttaaaaaagatttatttatttatttatttatttgtatatgtgggtacctgtgtgagtgcatgctatatatgtggatgaacatagaggccaggaaggtaccacatcccttggagctggatttacaggtggttgtgaaattaccagtatggacactgggacatgaattcagatccactgcaagtgcatcaagctctctaaaccactgtgccccgtctctggacccaaataactcgttagtctgaatgtgtttgcaacccatgggaagaacaacatcaaccaaccagatctctcagagctcccagggactaaaccaccaaccaaagaatacacgtggaagcacccatgacttcatctacatatgtagcagaggatggccttttaggacatcagtgagaggagaggcccttggtcctgtgaaggcttgatgccccagcataggggaatgatagggtggttgggcaggagtgggtgggtgggtgagggagcactctagtagagacagggggagggtgttggagtgggaggttttccagaggacctggaggggagatagcataaacaaaataaacaataaaaaagaaaatgaaagaatgaataataaataagtatttaataaaaaaaataaagttaaggtattcaaaaactgcttacttatttcatccacatgcaggaagataatatttgtttgtatttaactgtatattagaaacctcttatgagtaaaataattcagtatcttttttttttattttgaagaatctttcacttggtataataatttcaaaggtcaatgttgtaggcatatggcatgattttttcttcctgttcagtttttttatatgtgtatatattagacacatacatatatatacctatataaattattaatatattatgttatatataaaacttaaattgtatcaatttgtcatgattcatatatacatatgcaaatagatatatgtaatattgaatgtattctcttatttcctaggatagatgtaagtttgtcaa

SEQ ID NO: 2630 - DNA, 1000 bp, mus musculus
ccatatcacaaagcaagatagagaagaatttattttggtttatggctcctgggggataagcctccatcatgtatgggagctatggcaacaagtggtgggtatgacatcaagagcaggaagctgagagctcacatctacaaatacaagcactatataaagggagggcaaactagaaatacagtgcagctgtataatcacagactctccacagtgacttttctccaaccaggatgaaactcctaaaaaaatcccaaatggtgctactgagaacctaggggacattgcttgttcaaaccacatacaattaacatgcctatatgcaagcaacattgccagcaggttttgaaacacatatgcaggatataagatattatagttattgctagaatagagataatatttttcttaacataagtaattaatattggaagaaacttagattctttttacctgtctgtattagttgtgctttgttcggtagttcactgaaaaaatttaaccaatcaagggacagaaattcactaggatatttatatttataaaattgtacttttaggcatgactcagtaacaatgccctatagaatccttgaattttgtcattcaagtgccattacactaaatctccaaattataaaatatttataactatattaaaatattcatacaagttagtgtgtacttcaaagaactgcttttataattatcaatttatttttttatacttcaagtaactatagtgttcagaattgtacattgcattgcaaaaaaaaaatcttaaatgatatatagaatcctacaattacagacacaaatgcactaaaaaaaatcagttctttaggcatttcttggaacactggaaggaaggtggagaaatgactaatagaatttcccccacaggtgttctaatgaatgaaacaccatcccagtgtctgtctgcattgcactgcactatacctaagggaggtaataaataggaaatgatgggctgtccaattttg

SEQ ID NO: 2631 - DNA, 1000 bp, mus musculus
ggctggcctcaaacacagaaatctgccttcctctgactcagaagttctaggattaaaggtgtgtgccaccactgcccggcccaatggggcttttttaacttccctaacagcatgccattattgcactagggagtccatcatgcctggtgagtttttttgtttgttttttgtttgtttgtttttcgtatctcatagggttcacagctagagacgacttttgtttacatttcccttttggtagcctgtggagaattgcaggctggtctccaattgagctgagatctgaaccacggtggtcataattcacctacacaacaaggtaggcattcactcatgctcctggaactctgacccctgcctaaggtaccacctcccacagcccccacaagagaagcatggtcagtagtcacttagacaatatcccaagcttctgaccttcaggctaaactcctccccagttatctagcaacagtaaagaccataaaaagagctgtttagcccccacctcactctctaactcttaagctcttacctcttactcctcactctcaccctctctcttctctttcctttctctttgtcttcttctctccttcttactctcttctctgtctctgtctctgtctctgtctctgtctctgtctctctctctctctctctctctctctctctctctctcccctctctttctccctgcacttctataatatatgagagtctctgctccatcaaggtcatggagcatgctggtcagtgttgggaacctctcttcaattatccctctctcctatacactgggggctacagggtgtggccctgtggcccccaggtcaggagctgccccttttccacctccactccccacccccttgccccctccccccctgcctcatgggtcagacagaggcttgcatgcccacccagggccgagtggaaagtgtctggcagctctgcctgtgtccacctgcccagagcacaggaactctggctggaagttcgg

SEQ ID NO: 2632 - DNA, 1400 bp, mus musculus
tgcagttctgaatcctccctgtagcagggggtcttcgctcatgcctgaagatgtttcttttcccgggtttcagcaccacttgttgcgcgcactcaactggccaggaagaacgacgctgctacaggatccttctgcacatgtttattcagtcctgattcttcttgtttatatctcccttgtttatatctctcccttgtttatatctcccctgtttatatctcccttgtttttatatctcccttgtttttatatctcttgtttatatctcccccgaaccctgggcctctcactccttttatactctctctcatccacgcaccgcaggccacgccccctcgccagtcacgaggcttcagctaatcagggcagcaggggcaaatctccaccaaattggattcacctgtatcctggtacacatgcgcagcactcaagatgtttgtgtcttatatgaggaagtcaggtgcaagtcatatgacttagctgcagtctctggcacctttgggactgccgccacacccgctccccacaggaacgcaacttctgccacgaggcaggttcgaacaccagatatctgggcacctttcctgcaagaagagagcttgcctgcagagaatactctgaccactgaaactaagatgagatctagtgtcccaggtctgctgatagaggctaacagagtcacctgaggaacaagctctaaccagagacaactataacaactagcttcagagataaccagatggcgaaaggcaaacataagaatgctattaacagaaatcaagaccactcactatcatcagaacgcagcactcccaccccacctagtcctgggcacctcaacacacccgaaaagcaagacctggatttaaaagcatatctcatgatggtagaggacatcaagaaggactttaacaactcacttaataatcacccatggaaggagttacagagacaaagtttggaactgagacaaaagaatggaccatctagatactgccatatccagagatccatcccataattagcctccaaacgatgacaccattgcatacactagtaatattttgctaaaaggaccctgatatagctgtctcttgtgagactaggctggggcctagcaagcacataagtagatgctcacaatcagctattggatggagcacagggcccccaatggaagagctagagaaaatatccaaggagctaaagagatctgcaaccctgtaggtgcaacaacattaagaactaaccagtaccctggagctcttgactctatctgcatatgaagcaaaagatgacctagttggccatcactggaaagagaggcccattggaaacacaaactttatatgccccagtacaggggaatgtcagggccaaaaaatgggaatgggtgggta

SEQ ID NO: 2633 - DNA, 1400 bp, mus musculus
cttgcatttggagcatagatatttagaattgagagttcgtcttggaggatttcacctttgatgagtatgaatttccctttttaggttagtattgttttgttcatttccatcactggtttggatgtgttttcctcttttttgttaaggacttgtaactctatagcagtgttctcctgtatttctttaagtgagttattaaagtccttcttgatgtcctctaccattatcctgagacatgcttttaaatccaggtctagcttttcaggtgtgttggggtgcccaggacttggcgaggtgggagtgctgcgtcctgatgatggtgagtagtctttctttctgttagtaagattcttacatttgccttttgccatctggtaatctctggagttagttgttttagttgtctctggctagagattgttcctctcgtgattctgttagcctctatcagcagacctgggagattagctctctcctctgagtttcagtggtcagagtactatctgcaggcaagctctcctcttacagggaaggtgcacagatacctgttgttcggacctccctcctggcagaagatgaaggcccaaaacaggatctgtcccagaagctgtgttgcttaggcctgtgacagaagctgttatcttctgtaatccacactctcaccagcacagactagtctaggagggatctgggaaccaagatggctcccccaggtagtgatgcaaagccctcccgggcagggcagacacctctcctctggcagggaaggtgcctggatgtctggaacccgaaatggtgtctgtctcagaagctgtcctctagggaccttgggggtgtctaccaactctacacccaggtgaccaagtgctggcgctgactggaagggacttgtgaccctggtcatgccaggttttctgtttccctaatgctgtcttagatcccgtgagtttggattggaacagaagttgtgttccactcactggtggtcctaagatcacgtggagagtcctctaggggtccttgtgggtgtctgcctactcagtgctcaaggagacccagtgctggcgctaaacagaagggactttttttcctctagtttctttttttttttttcccccttggctaacttttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccaactaggccatcttttgatatatatgcagctagagtcaagagctccggggtactggttagctcataatgttgttccacctatag

SEQ ID NO: 2634 - DNA, 1200 bp, mus musculus
atcctcagtaaaagtcagtagtctctcatacattttattttacaatattaaaacatttcaaggtctggagagaataatcattcaagaaaatgctttctattcaaacctggggatctgagtgtgcataggcagctcttctgaagtcaggtctggtggcatatgtctacaatccatgatcctcattggaaaagataggagcatacctggggctcagctgctaaacattatgtttaagttccaggttcagtaaatgtgaggtcagggaggtgtgagtgaatggttgggtgggggagcaccctcataggagcaggagagtgaggatgagatagggggtttctgtggggggatcaggaaaggtgagaacaattgaaatgtaaataaataaaataaccaattaaaaaattgtaaaggtgtgtaggtgtttattcactctagtaagtcccaagatcttcctgacacttggcaccatgtaggcatggctggtatccatagtcatcaatttccaaatcacagttcacaagatactcttgaggacagacatacatgtatcttcctgtctcattggggaacatagcctcactcatgtggggatcagaaagaaatttatttatctactttcaagtcataatgcctgacttggtatccaagcacaccaagcaggagtagccattgattccttccaggtgcacaactcctttgtggcaaggactgaaagcatactcattgtgatctgtcttacagaacctagcagatacagataaggtgcctagagtctttatggcaggtgctccacattggcaagtgttgtcaccaaaggaattagtggcagtttcacaggtcaaccaactgtacccaggaatacattgacacaggaagcctcgttttcctggggtgtttacacaaatgacaatttcttggcagggactggagaagcaagggtattttagattctcacagtctttatccaagttactagctatatctaagcaaaaaattgctgtctcatagaaaagctttgtgcatggaattgttttggcaagaatttaagggatagctggtattttttattgcaaaaaatagatactgacacctcaattcactgcaggagtaggtacatgctttcccactgagaccagaaatgacagcctagttaagggaacaggatacaaagttagacaacagagtcagaataagatgtcg

SEQ ID NO: 2635 - DNA, 1000 bp, mus musculus
cagctaagtaataatttcttttttagatatactacattttcatcatacagtagttaatatctattaacattaattgatagatagctatcttgtttttatattctggatattatgtatatagtagtaaagaacatggatgggaagctatctctatataagaataccaagtcctttagggataagcttaagagtgacatagtttagtggtatgatagatgtgtgtctcactaagaaatctccacattgatttatgtataaaagaagaaatttagtgcaaatatctgcatctaaccctttcagctgcttgttgggtattatgaagtgcagtcatgataggtttctttttgtgagagctccatagcctcagtaagaatgtcaggctttggggcctccctttgagctggatcccactttgggcgtgtcactggaccttctttctctcaggctcctctccatttccatccctgcatttctttcagacaggaatgaatatgggacagagttctgactgtgggatggcaaacccctccctcatttgctgacctgtcttcatgctggaatctctggtgcattttggagggtcctccgacttcttacctcctgaggtggcctgtttcctttctttctgctggccctcagggctttagtccttttcccttacccagtaccagatcaggttcccctctcctcccaaaccctgtccattttccctcccaagtcaagcacctgaaagagtcagaagcagatttttttttactcaaccaatggacaaaagattctgacccctgtggttgaattagggaaagactggaagaagctgaagaggaaggtgaccctgttgaagggccagcagtttcaattaacctggactcctgagatctctcaaatgcaggaccatcaaacaggcagcatatgccagctgatatgaggcccccaacacacatacagcagaggactgccgggtctgtgttcattcagagaagattcacctaaccctcaa

SEQ ID NO: 2636 - DNA, 1200 bp, mus musculus
cctagggtttctatctccagtgttgccccactttgggttttctttattgtttctacttccctttttaggtcttggatggtgttattcaattccatcacctgtttggtcatgtttacctgcaattctttaagggaattttgttcttcctctttaacgtcttctacctgtttagaagtgttctcctgtatttctttaagtgagttattaaagtccttcttgatgtcctctaccattatcatgagatatgcttttaaatccggatctagcttttcaggtgtgttgtggtgccctggactgggcgaggtgggagtgctgggttctgatgatggtgaatggtcttggtttcttttagtaagatttttacatttaccattgccatctggttatcactggagttagttgttatagttgtccctggttagagattgttcctttcctgattcagttagcctctatcagcagacctgggagactagctctttcctctcagtttcagtggtcagagcactctttgcaggcaagctctcctcttaaagggaaggtgcacagatatctggtgtttggtcctccctcctggctgaagattaaggccaaaaacagaacctgtcccagaacctgtgttgcttctgcctgtcacagaagctgttagcttctgtagtccacactctcacctgcacagactagtctcagagagatccaggaaccaagatggctcccccaggtgctcctgcaaatccctcctgggcagggcggacacctcttctctggcagggaacgtgcttggatatctggagctctaaaagggggctgcctcagtagctctgtggctcccgcctgtcccagaagctgctagcttctgtagtccacactctaacctgtgcagattactctcggcagagtcccagaaccaagatgcctcccaccgatgctcaggcaatcaaatccttactcttaatttaccctcaactctttttctgtcatttacctctctcccctaaggttcaaggaagattgcagaacagtttaaaagactagaaggaccagatcacctgtcagattgtgccttgtagtactgtcagaagccactcccataaattctcattacagtgattgcacaaacatgatcagaacaaggacaaaaataaaagacattctactgtggttgtggaaggaattataggcaactaaggaatgctgaga

SEQ ID NO: 2637 - DNA, 1600 bp, mus musculus
ggcatgagcaaaaacaatacaagaaatgcgtacagatacagacatacacatattcacatactcaggaatcgcataaaaaactgtaataaccaaaatttataggatatatgtgtatgtaaagaacctgtaaggtggggggcaaattgccttgacttaacattttgagagaatgaacctccaaacatgctattgatttcttttgtgtgtgtgtgttgtccatatactactgggtctgtcgtctatgtttatgaatagttcattttcccagctagactcccttggagaaaactcttttgtttgcactttcctatcaattagcggtagcttctgggttagggatgggtgtatatgttcacttctttcgtttttagaaccttatttggtataaacatgtttagggcatttacatgttgccatagtctctgtgtttcaatacttttatgtttagaaggccttgatttctttgtgtccttcatctcctatggctcttacattcttttcgtctcatcttccagttttctgaaccctggggagaaagatttaagctgcagtatgtcatggtcttttactctgcacatatactgactgtggatctctgtattccctccagtctaccacaggagggaacttatctgatgatagctgagccaagccctgatctacgagtatagcacaatgaggttaggaatcattttattactattttcttttatcacaaaatttttcttttgttttgttttcagttaggtcagtggtctatctggtctcaggttcttggtcacccacgcagcattgggcagcagtttcagctcactgagtgggccttaactcagaaaagaagttggctggttaccccaatatgcttcatacaattattgcaccagcttttttaggggggtgggggtgtttgttggtttcttttttttttctttcttttgtttttttttcaggcaggtcactcctatacatatgcaagtttatagctgggttgatatttacttttcatttttggtagagtgcaaagtaacttgaataatacatgggcatttgagaattgagtaagtgttgccttaagcataagtccttcctttcaagtttatgaagaaccaccaaaaaccttggcaatagcccagaatggtaggatcaaacagggagggagtaaggaaactgaggtaagagcaaattatggtgaggtggagataaaattaagtgccatctggaatcatcatataatagtacatggttccttggttcctataacacacacacacacacacacacacacacacacacacacacacattatatacatatattcaaataatggtaatgggcaggatagaatccaagctgaaattctcatcatctaataatgaatccactacacagtacacagactgggttacatttaattgacttatatcccaaaggtgtcccattggaacccctaagcaacccagactatagtttgtgatgtttcttattgcccacctgaattaattgagcggccttgaaatatttttcattacatggaattatatagatgttggttaagctacatttctatttcatttctttttatttctcagactgtcaaaca

SEQ ID NO: 2638 - DNA, 1400 bp, mus musculus
ggctttattagaaatgtgcatggaagcagaaatgctaattctgaatagaaaatattttaaaatattttaattaattatttggcatatatatatatatatatatatatccaatttttttctaacaaagagggaagaaatgatgatatgacatgaggcaactgatagtagttatactaaagaatataaaagtcaaatactattgccataaaggaaaagttgaaaataattaatataaattatacaactaataatttcaaaacacctttttaataaaatatacaatataggaatatactagaagactagttgctttacttaatacttgaaatttaaaatttatgagttacgtgacagaaaatactatagatgccccctttctaacaacaaaaattcagttctcatcaaatagaaagcttgcatatttttgccaaattaaacattaactctcccagaaatcataaaccgtaaaattttgcaaacccataggaagaacaacaatatcaaacaaccagaccctgcccccccgccgccgccgcagagctcccagggtctaaactgccaaccaaagtgtacatatggagggtcccatggccccagccacatatgtagcagaggatagcttgtcggttatcaatgggaggaaaggcccttggtcctatcaaggctcaatgcctcagtgtaggggaatgccaggacagggtggtgtgagtgtgtgagtgggtgggagagcactatcatagaagccagtgggattatggaatagggcattttcagagaggaaccagggaagtgggataacatttggaatatatataaataaaatatccaataaaaatataccactagattatagacttcatatttctcaacttaaatatttgtgatgagtttctggatatatatatatatatatatatatatatatatatatatatatatatatgttacttgcttctctattaaaatactatgataataattttaaagaccagttgtttaatatactattattttatatgttttgtatattatataacttaattatataatgttgtttaataagcaggctcctttgtaatgttatattcatccactttgtatcatgtagtctcttggctctaactcaatctagcaaacaacaatttgaaattttggtgaaatatgatgtagaaatacttttttttttttgtttttcaagacagggtttctctgtgtagctctgactgtcctggaactcattttgtaggccaggctggccttgaagtcagaaatttgcctgcctctgccttcctagtgctggaattaaaggcatgtgccaccatacccagcttacaaatacctttttaaggcatgcaataacttatgatattcagaatactatgtaagtacttataaaaata

SEQ ID NO: 2639 - DNA, 1200 bp, mus musculus
gtagatttctttgtgtttaagaccagcctggtttatgtagaaagttctaagacagccagaaagatagaaataatgaagaaactctgtctcaaaaattacttatctttttttttccttctgtgtttttctatacacatagtgggagagaggggagaatcaaagcactaaactgatccagagtaaggaacaaattgaaaattgcttttgcctacagtgttggtgagaaccttactctcacctgttcattcccatgtctcatcacacagagcaacccgaacagctggcagtagaggggacagaattaggactcatggttacacagcagaatgttactatacagaaaagaaacactgtatagcctattctgggttaatgtcatgcttttatgactcctatgctttaatgcactgaattaaatagttgtacactcctaaaataactggtctagtttctaggagtactttttagacatcctaaacttggatagtattctacaggcatggggacatttgaagatgagttaaaggatagaattttctgacaactgcctcccaggagatcaacatgccaatcttttcatcaccttcttattagcctgactgcaacagagagattgacccttgtgtctccagctcctggaatattttttgaagtagaagagaaaaagaatattttaaatagtacttttccagtccttattcagctgcaatgtttctttaacaacaacaacaacaacaaacacacacatacacacacacacacacacgtacatacacacacagaagaccagagtctggcagaaaagtaaaattttaatgacagcatagttactgaacaaaaacaaacatatatttacactttcctcaattagcatctgaatagcacctcaacagagtctttgaaagctgagagtggtatgggaagtgtgacacaaggaagaggccatgggtaatgaaattctttagagcctagctgatttcacaacaatgctagattttggcaaattatcatttttttaattatttatttgcaccttctctgagcagctatctaaacaaataatagaaaaaaacatcaatgttatgacttcttattcaaagaaactaaattgtttaggctgcttaacagtttttttttttctgtttttatttttctaaagataggttagaaatgattctaggtctttttaaaaaattttat

SEQ ID NO: 2640 - DNA, 1400 bp, mus musculus
atacaatatattctgatcctcctcacagccccatacatccaactccatattgactttctttagaaaacaaacaggcatataaaaaataaaacaaataaaacagaataaagcaaagcaacttatctgatttaaaaaaaaactaaactaaaaatattcagatagagagacagagatataaaagagacagagagagaaacagagaaacagaaagacaatgagacagagagagactcagagaaagagaaagagagagaaagacaaaatgagagagtaaaaagtaagcaataaaatcataaatttgggaaacatattatataagcaaaagaccagtaggtcaaaaaaaaagtgcctaaaaatattatgagaccagaaaagcaaaacaaagagttccaaaaataatattgagttactttgttgtgtgccattactgctgggcatgagacctgcccttaaatctggcttgtatatccagtgaaacactactggagaaaaccactttgtgagtggttgtcatttagagagagcttctgggttaggaatgggtaataatgttcatttctcctctaagcaatggagcttcatctagaatggacctctataggctctgtgcgagctgctgttgtctctgtgagtgttcacaagttcccatttccttggtggtctctgatatcccctttggctctgacactttttccatctcctcttctgaatagttctgtaagtcctaagggaatcattccctgcacattgtctcattttgggtctctgtagcttagggtcttaaaatgatttgatatttgtattttgtccaatatggttatgattctggaaatattcctagaagaaaatgaacttgagaatatattttaacactaacttcaattgtgaattaacattccagaattcttataaaaactacatgctcttaattttagttttctcatgtattctgagatgaacatatgttggtaggacttttatctctgaattgtagagtctcaaaaacttttaataacattatgtagaaaattaaacagtttggggttacataaatgatagtgaaaatgaagaagatatgagaccttcaaggtctgactatgtatattatgatcaaaatagtaaatagtaaatttgagtgactgcaatgtggtatggattagctatattcttatttatttaaattttatgaattcataaaataattctagaatttaaaatgtgtgtcatcactcaatctgtagtaattacatcagtgttagcacaatattttatatgtcatatatagcaattatgattaaggtaatcaatatttctgcttcatccttgaaatttttctcttggatctttaaagtgtctctcttatcccctttcacaaaatacattgtaacttatgaactata

SEQ ID NO: 2641 - DNA, 1000 bp, mus musculus
acttcatatctgtccctaattttctgaaatttttgtctggcctatgtgtgtgcatgcctactgcatgataatagtatctcaactaactgtgactatgaaagacattttgtgggctttagtcttaaagtctgagatttattcaatattggatttgttcttaaacttagttaaatatacaataatctgttcttacatgcacaagtgtaggtaaatctgctttagcataagtaaataaatttgtatgttgaatgaaagcaaatatttttacagccttagctttggcttcctttagttttgccttgattacaagtaaggattttacttacccatgtctacctcataggaagaagaacaatattaactaaccaaacccctcagagatcccaaggactaaaccaccaaccaaagagtacacatggagggacccatggctccagctctatatgtagcaaagtatggcatcagtgggaggagaggccatttgtcctgtgaaggctcaagacctcagtacaggggaaggccagggtggtgaggtgggagttggtgggtggttggtggagcaccctcatagaagcaggggtgagagtatgtaatagggggtttgtggaggggaaaccaggaaaggggataacatttgaaatgtaaatgaataacacaactagaaaaaagaaacacaaaacaagctaagaagtaaatgaaggtaaattcaaagatgtagacacaaagttacacttgagatggtctttatcaaggtctaaacctttttgaccataggaagccacaattgggctttatagtggtagaactttagaaaatacagcatcatggccatacacaagatataaggggtcgtgaaaagagatgtgggaatttctgggtccctcagttcccttctgttgacaaactgaatttctctatcttacaggctattacagggttgggtggttgttccacattctatgatcttgcctggccctgctatatgtcaggaaggtactag

SEQ ID NO: 2642 - DNA, 1200 bp, mus musculus
gctgaggtctgaaccccagagtggtaataattcacctacatggcacagtgagtgttccctcatgtctcctggactcaaggctcctgtcaaagttactgccccacagcccccacaggagaaatgtggctagtagtcactagacaatgtcccaagcttctgaccttcagactaaactcctcccagttacctagcaaccctaagataacagcccatcataagaggggctgcttagccccacctcacactcttaagctctcctcactttcttactctcctcttactcttttactctctctccctcttgctctctccctcttaatctagcctttctcctctctctccttttcccccttctctcttcttggccagtctctctctctctctctctctctctctctctctctctctctctctcctcctcctcctctctctctctccttttctctttccccctgcctttctataataaagatctaaaatcatagactatctctgttcatcaaggcccactgtgcttggatgatgggataggctttcctctaatgagccatttcttttttttaataaggtatttttattagatattttcttgatttacatttcaaatgctatccccaaagccccctataccctacctctaccctgctccccaacccaaccacttctgcttcctggccctggcatttccctgtactgggtcttatgagccatttctaatctccaaatggaaggccttcctgtgctccagtcaaggcctggactaaggacgcttgcgtgagttggaacctctctccctcagccctttctccagaaaccccagggccaagggtgtcaccctgcggccccgtctggggctgccccttgtccacccctgttgagtggggtcagtggcttagattcccacccagggccgagtggaaagcaaaagtgtctggcagccctcccatgcccacctgcctagagcataggaaggactctggccagacgtgggctatcctccctctcccctttcccctacagcccctttagttcccacaaacttgggctttgaataacaaatcaatattgtttggtttgaagttcagtcaagaaatttctaattcatacatgaatttctaactaacctagaagtgatgaaaatctggaaattttactgtatttcactctacatttaggattctaattaataaatctctccat

SEQ ID NO: 2643 - DNA, 1000 bp, mus musculus
aagcaatctatagatgtattgcaatctccaacataattccaatagtcattcaaaactcagttttcagcttcatagggaaacatgcacacacacacacacacacacacacacacacacacacacacacacacatgcacaccatacacgcacaccacacacaggaatcagcaggataactaagactttcgtgaaaggtaaaagaactgctagagacctcatcatttttgatttcaagttgtactacaaaaatagattaatagaaataacatagaattgacaaaaaaaatgtggtgataaactgaatagagttaaaaacccagaataaaatctccacacctatggaaagctgattttttttttttttggtttgattttcttatttttagatattttcttcatttacatttcaaatgatatcccaaaagacccctataccctctccctgccctgatcccctactcactcactcccacttcttggccctggcattcccctgtactggggcatataaaggttgctagaccaaggggcctctcttcccaacgatggccaaataggccttcttctgctacatatgcagctagagacacgagctttgggggtactggttagttcatattgttgttccacttatagggttgcagatctctttagctccttgggtactttctctagctcctccattggaggccctgtgttccatcctatagatgactgtaagcatccacttctgtatttgccaggcaatggcaaagcctcacatgagacagctatatcagggtcttttcagcaaaatcttgctggcgtgtgcaatggtgtctgtgattggtggctgattatgggatggatccctgggtggggcagtactaccggtagattcagcaatacctctcctgggcatatacccagaagatgttctaactggtaacaagggcacatgcttcactatgttcatatcagccttatttataatagccaaaacctggaaagaacccagatg

SEQ ID NO: 2644 - DNA, 1000 bp, mus musculus
cagcacagggaaaactatactcaacaataagagaacctctgggggaatcaccatccctgacctcaagctgtactacagagcaaatgtgataaaaaaaaaaaaaactgcattattttggtacagtgtcaggcaaatagatcaatggaagagaactgcactcagtgataagtggatattagcccaaaatttcggaataccctagatataattcacagaccatatgaagcccaagaagaaggaagaccaaagtatagatgcttcagtccttcttacaaaggaggaacaaaagactcccaggaggaaatagggagacaaagtgtggagcagagactgaaggaaaggccatccagagactgcccaacctggggatccatcccatatgtagtcaccaaatctagacactattatggatgctgggaagaccttgttgacagtagcctgttatagctgtctcctgagaggctctgccagagcctgacaaatacagagttggatgcttgcagtcaaccattggactgattgcagggaccccgatggagtagttggagaagggagtgaaggagctgagaggatttgcagctctatggggggagcaacagtgtcaactggtcagactctcagtgttcccagggattggaccaccaaccaaagagaacacatgtagggacccatggctctggacgcatatgtggcaaaagatggccttgtttggcattagtggaagtagcgacccttgggcttgagggtgttagatatcccatgtaggggaatgccagggtgggaagatgggagtgagtgggtgggtgggggatcaccctcatagaggcagggcaagggttatggtatagggagtttttgaaggggagacctggaaatggtaaaacaatgaaattgtaaataaagaaaatatccaataaaatgtgataaaagcatctaacttgtcaaataattttttataagaatatatgtttaagtatgaataaaatttatggaaattttc

SEQ ID NO: 2645 - DNA, 1000 bp, mus musculus
cttttaaaaatccctttacggttcctggatctcaccaaaactagactgcacaggtgagagtgaggactacagaagctaacagcttctgggataggcaggagccacagagcttctgtggcagaccccgttttggggaccagatatccaggcaccttccctgccagaggagaggtgtcctcccagcccgggaagccaatgctggaacatctgccagagacatcttggttcccggatcctgccaagactagtctgcaaaggtgagagtgtggactacagaagctaaaagcttctgggtcaggcaggagccacagagcttctaaggcaggccctgtttcaggctccagactttcgggcacctgcactgccagatgagaagtgtctgtccaggcctggaggccattgcaggagcatctgccagagacatcttggatccctgatcctgcaaagactagtctgcacaggctccagacatccaggccccctcgggccagaggagaggtgtccaccccgcccaggaggactttgtggagcatctgctggagccattttcattcctggatcctgccaagactagtctgcacaggtgagattgtggactacataagctaacaggttctgggacaggccctgtttcaggccttcatcttctgccaggaggcaaatctgaacaacagatatatctgtgcaccttctgtgcaagaggagagcttgcctgcagagagtgctctaaccagtaaaactcaggagaaagttagtctcccaggtctgctggtagaggctaacagaatcacgaaaggaacaagctctaaccagagacaactataacaactgactccagagattaccagatggtgaaaagcagacataagaatcttactagcagaaaccaagaccactccccaacatcagaacccagtattcccaactcagccagtcctgggtacccccaacacacccaaaatgctagactcaaatttaaaggcatatctcatgatgatgc

SEQ ID NO: 2646 - DNA, 1000 bp, mus musculus
acaacaacaacaaaatgcatgttcaggaccaaatggatttaatgcagagctctacctgaccttcaaaaaagacctaatacctataacttcaacctattccaaatatggaatcagaaggaatactacccaatttgttctatgaagccataattattttgatacctaaaccacacaaagatctgtgggaattaaagtgggctggcgaagtgggggtagggaggatagcctgcaccaggccagagttcctcctatgctctgggcaggcagacatgggagggctgcaagatgctgaaccaacttgatgggggggtggtggacaagttgcaacaccctgtagcaccagagttattggagagagggctgaaggaaagaggttcacatgcaggcaagtgtaagtgcatcaggatttgatgaacagagtcagtttacagttttagagctttattatagaaaagccaggggaagaaaaaaggtagagagagagagagagagagagagagagagagagagagagagagagagagacttgtcatgccaagaggagagaagggggcaaggagagagagaagaaaggctggagagtaagagggagagagagaaagagaggagagagaggaaagagaataagaggagtaagagaaagagcaagaaagcaagagagtgaggaggggtcaaacagcccttcttatggtttgttcttatctttactgttgctaagtaactgaggaggagtctagcctgaaggtcagaagcttgggacattgtctatttgactaaaagccatgcttctcttgtgggggctgagggggtggtaacttcagcaggaaccagggttccaggagacatgaaagaactccttccatcccatgtaggtgaattggcaccaccacgtccaggggttccaccttagctcaactggagaccaatacccaacaaagacccaacaaaattggtatttcagaccaacttcccttatgaatatcaatgcaaaaatagtcaa

SEQ ID NO: 2647 - DNA, 1000 bp, mus musculus
cagaaagaatgatcaatttgaaacaggaaccaatcagctaataattctccaatttccttctttctctctagggttcatatcgttatctcgtcatcatgacacaatttgaaactttcaacaaggaagatttagggtcacagaaatgatggccggtgtcagtaacaggaactccaaggtcctggccagaatgtggacttgccgcagcttaaatacccaagcagacagggtgccttgtcttcctaggtactcgttttaattacttgatttggagttggggtggagtgctgagcactgggtgctggaatttagtaaagggagctttggcagatcaatcactgatctttgaattgttgtgcctggaatccaaccagagcattcattgactgccttctcctttgagggcaggttgagagtcaccccaaagaactttagtggctcaggatttaggcagcacatgtggctcagctgtgtccacatatctacacttgggcccagcatggtgccatggtaatctgtacctcttaactcctgaaaaacattccagcaaaaccaacatgtactgactgtgctgtgtgtaagaaggacccgttctgttcaactgtcaactaccccaccacaagccaaagatctggctcttgctcaccaactcctctactgttgttggaagcgccagtgacgtcacagaaggagttcttgtagtcaggaggttctgtagactgatcatttgttccttcttgttcgtccccttggtgtgattctgtgggttcctcctcacctgctccccttcttctgaaggtgtagggtgctccttatttgaaaggctgtcctttttttttcaattttttttattaggtattatgctcatttacatttccaatgctatacaaaagtcccccataacaccccccactcccctacccacccactcccacttcttggccctggcatccccctgtactgatgcatataaagtttgcatgaccaatgggcctctctttcc

SEQ ID NO: 2648 - DNA, 1200 bp, mus musculus
ttagaaaacaaaaagtgtcaaaaacacaagatacagtccagataactcaataaggtcaagaagctgaagaatctaagagaggatgactcagtcccatttgggagggagaagaaatcaaacaaaagtagggagggagggacctgggaagtaaagggtatggaggggtggataggggaagatgaacaggtactatagggtgaaggaaaaggactgaagccatcagggtcagcagaaagaatggaaacaggcaacctcaggaggtaggaggtttggggggccctctagaatgtaccagaagccagaaaggtgagacactcacaggactcaaagggagtccttagaataggagacctacattgggagagggactctatattgggagagggaacttgtcgagcccaccttcagggggaagacaggatatcaagtgaagggtgggcttgccataccacagtcaaaactctgacccatgtttgttcctttctgaaagaactggaaatggagaggagcctaaggaaaagaaggtccagcaacagactcaaagtaggatccagatcaaggggaggccccaagactgataagctataattagaacacaacatacaagcaaaataaaatgaaagacatgaaacaagatcccataatcagcccccaaacgctgacaccattgcacacactagcaagatgttgctaaaaggaccctgatatagctgtctcttgccaggctatgccggggcctagcaaacacataagtggaagctcacagtaagctattggatggatcacagggcccacaatggaggagctagagaaagtacccaaggagctaaaggggtctccaactctataggtatcacaacaatttgaactaaccagtacctcctggagctcgtgtctctagctgcatatatatcagcagatgacctagtcggcgatcagtggaaagagaggcccattggtcttgcaaattttatatgcctcagtacaggggaatgccagggccaagtgggagtgcgggggagggagtgaggggggagggtttgtgggacttatggggtagtattggaaatgtaaatgtaaatgaagaaaatacctaattaataaaaaaggggaaaaaagaaaaaaagaataactaagacagaaggtgataataggaactggtatatttctatggcagtctttaccatgtttcttgtcaac

SEQ ID NO: 2649 - DNA, 1000 bp, mus musculus
tcttgctgtttcagtatcagtgagtttatattggtttatatgagctttgctcagttgattctttagggatttgttctcctggtgtcctccatcacctttctgcctcttcttctgtggagttccctgaactctgtgaggaaggatttaatgaaaacctcccatttagagctatgtgtcccaagggctctcactttctctgtgatgtctagttatgggtctttgtatttgttcccatctattgcaagagtaagcctctctaaatatggtcaaataaagtagccatctttgaataaagtatatcattaggtgtcattgggttttctttagaccagtattatttgattttaccctagatccctgggcttctagtctcgggttcttggtcaaacaaggagtgtccaatctgagttctgtcatgcggagtgggtattaagtcagattagagattattcttaagggtagtttgaaggcctagcaataaatggcaacaacaacagcagcaacaacaacaaaaacaactcaccagtatttttagaaaatttttattttacaatgtcatatcagtgcttttccttttttctttcttttttctctcttcttttctcttaatttttctgtctttcttgtttggaagcttatcttctttttttacaatttttagtttttatttactttttcattttttaccctttcatagactaaaccgctaactgaagcaacaggctggaaccaggcccctgacatatgtagcaggtaagcagcttggtcttcatgtgggtctcccaacagggatgtatgtgtgtgtgtgtcagggtggggggggttatcccttaagctgttactgtttgtgaaatctgatcccctaacctggctaccttctctagtctcagtgggagaggatgagcctaaacttgcagagagtttatcagggtctgaagatacctagagtgtcctctaccctctcagaggaaaatgagaagaagggataggcagtggactg

SEQ ID NO: 2650 - DNA, 1400 bp, mus musculus
cttctacctgtttggttgtgttttcctgcttttctttcagggcctgtaactctttagcagtgctctcctgtatttctttaagtgagttatgaaagtccttcttgatgtcctctaccatcatcatgagaaatgtttttaaatctgggtctagattttcggttgtgttgggatgcccaggactaggtggggtgggagtgctgggttctgatgatggtgagtggtcttgatttctgttagtaggattcttatgtttgcctttcgccatctggtaatctctgaagctagctgttatagttgtctctggttagagcttgttcctcaggtgactctgttagcctctataagcagacctgcgaggctatctctctccttagtttcattgggcagagtattctctgcaggcaagctctcttcttgcagggaagttacccagatatctggtgttcgaacctgcctcctggcagaagttgtgttccactcactagaggtcttaggatcctgtggggaatcctgtgtgggcccttgctggtgtcagaagactccgctggcgaggcaccccggtgctcgagtggagtggaagcgacttgtgcctcaggtcaggcctgggtccactgcttccctagttaccgcagtctcaggttctgcgagattggattggggcagacgctgtgttccactcaccagaggtcttaggatcccgtggggaatcctgtgtgggcccttgcgggtgtcgggtgactccgctggcaaggcaccccgatgcttgagtggagcagaagggacttgtgccccaggtcaggcctgggtccactgcttccctagttacagcagtctcaggttccgcaagattggattggggcagacactgtgttaaactcaccagaggtcttaggatcccgtggggaatcctgtgtgggcccttgggggtgtcgtgcgactctgctggcaaggcaccccggtgctcaagtcgatttcttattattttacaatgaaaattttgattaaggaagaactacacatgcttataacttcagggctgtggcacactgagaaagaaaatctgaggaggttgctagacacacagcctatctaaaacagtgaacaccaggtttcatgagactctctcaagaataagtagatcaatagaggaagacaacagtagtcaatcatattttctttggcttttggtacatgcagacattagcaagtctgcttatgcatatagaggaaaaggaagtaaggatagaaagtttgtaatgttaaatattgtagatttttattatcaccaattcagtttaaatttagaagttatttgttgatactttcgtttctgtttttttttttttctatgcatgtattagatttttaaatgttcaaaacttgcagatctttttgcccat

SEQ ID NO: 2651 - DNA, 1000 bp, mus musculus
gaagctctctctttctactggaggtggactctacaagttccctgtccccactgttgggcctttcattgagtcctgacagtctcgcctcccaggactctcatactttctagagagtaccctacctacccgtacccagcaggttgcatttccattcattctggtgctcattggggcttctctcatgttctgccccaaaactgagtatgttccccttatcccctcaccttcccctctctcactcaggtccctccctctctctgcttcccatgattgtcatattctccctcccaagtgtgattgaagcatctttacttggggtcctcagcttgttaaccttcttgagttctgtgggttataaactaggtattcagccaggcagcatacactagctcgtccaagggcccagaaacatatataacagagaacttcctagcctggcctcagtgggtgaagatgcacctaaccctcaagatacttcagacctcagggaatggaaaggcatggctagggtggtgtactggctagtgttgtgtcaacttgacacagctggagttatcacagagaaaggagcttcagttgaggaaatgcctccatgagatgcaattgtaaggcattttctcaattagtgatcaagggggaaaggccccttgtgggtgggaccatctcagggctggtagtctgggttctataagaaagcaggctgagcaagccaggtgaggcaatccagtaaagaacatccctccatggcctctgcatcagctcctgctttctgtcctgcttgagttccagtcctgcatcctttggtgatcaacagcagtatggaaatgtaagccgaataaatcctttcctccccaacttgcttcttggtcatgatgtttgtgcaggaatagaaaccctgactaagacaggtgggtatcatcctcttggagacaggggaaggaggaatggaatgaggaactgtgggatggtgaactgggagaacagcaatgactggattcta

SEQ ID NO: 2652 - DNA, 1200 bp, mus musculus
ggggagtggagagtcttctggggactgtaagactgtccatcgagtttaagcccaaagtttccaggcactggtgctgacctgaaggaacctggtcaggtggggctactgctggctgaaggcactcccagttgtgttggaaatatatgaaatgcttcatgattttgcatgccatttttgtgctggggccacgctaatcttctctgtatagttccaattttagtatatgtgctgccgaagcgagaacgaatgattaactttaaaaaaaaaatatcggactccaccgaacttaggaacttagtctgcacatgtgagagtgtgcaccacagaagctgacaaattctgggacaggtgggagccaagagcctctgaggcagcgtcctttttggggtccagacatcgaccaccctccaggccagaggatagttatccaccctgcccgggagccctttggcaaaggagcagtgggtgccattttggttccgggactccacttaacttaggaacttagtctgcaaaggcgagagtatgcaccacagaatctgacagcttctggggcaggcgggagccacagattctctgaggcagcacccttttcgggctctagacatccagccaccctcctggccagaggacaggtgtccgcccagctcgggaggcctttgcctcaggaggggcaagagccatcttgtttcctggactccaccgaacttaggaacttagtctacacagatgagagtgtgcaccacagaagctgacagcttctgtgacctgccaaagcaacacagcttctgggaaaggtcctgttttgggccttcatcttagcccaggaggaggtccaaatgccagatatctgtgcaccttccctgtaagaggagagcttgccagcagagagtgctctgaacactgaaactcagaggagagagctagtctcccaggtttgctgatagacagtaacagaatcatctcagaacaatctctgaacagagacaactataacaactaactccagaggttaccagatggcgaaaggtaaacgtaagaatcttactaagagaaaacaagaccactcaccatcatcagaacccagcactccgaattcgcccagtccagggcaccacaacacacccaaaaaggtagacctagatttaaaggcatagttcatgatgatggtagaggacatcaagaaggactttaataact

SEQ ID NO: 2653 - DNA, 1400 bp, mus musculus
tgggtaggggattgggggggtgggtatgggggacctttgggatagcattgaaaatgtaaacgaggaaattacctaattaaaaaaaaaaaataaataatgtgtatggagatataatcctccctttttaaagatattgacttaaatttccacaatatcattttaaagatattatcttaaatttccacaatatcttgtccttgagaatcataaggaatcccaataatatgggtaatattaaattttcttataagacatctcaaatgcttgactctagtagccagttccattatttgttttaacctgatttggagcaccaagcataaaaataatgcatgcagtgactaattacatttttagttgcttctcctgttaaagcagttgcaactagaaagcctgaaaaagtatcagtattcacatgtttatattttatttgtctaaaatcagaaaagtaagtatctatttgcaatagctgattaagtagaagtcctgaaagacccacaatgtgaggactcccccacgttctgactcaggagaggcgacaccccaaatcactcatgagaaacggtcttgctgcaaactgcaaggggacttttattcgagagctctctcgggcccacagtcatacaccatgcaagggtagagaggaccgtggtgccccaagtagctgggtaagggggtatttaaaggaagaaaccacaactcaagagtgtgggaggagcgttgttggaaaataccaaaaataccagttaagagtcacaaggaagtgcaaagtcacaagagtcacaaggaatacctggtaattgtgtgggttatttctcaagacagtttctaaaagcccctaacaatagcacatttgcatagctggttacagcaatggtcagggtgggtcagggtgactttctttgaatgaacactccttgatctcaggaagcgggtaggcagaggaatgtctctatctgttttatgattagcataccttggagcactgagtcacagaggtcacattctcaagcctgggcctaaaggcctagaattttgcttttatgttatactttttcagtactctagaattaacaccattatgtggaacaagtagaaactgaggacattgataacaattatttacaatttgacatgcacattctctaaaaatacaaaattattatctcaagccattactattttgatgatgtaaagaatgggattatatggcaaattgtacttgtgtaagacctataatctgcctgagatacaaatatgctctggcattgccttaagggggtctgtccagacagtccagaataagttattaaaagtccaaagacagtcctttaaaggaacagtattttctcttaacttgagttgtatatgcataaaaagttgcaaaatttgagaattag

SEQ ID NO: 2654 - DNA, 1000 bp, mus musculus
aaagtattctatagatgaattttaatccagcaacatggctactttggcaaggggtgaaatccaaagaccatttatgtttatgttatccagcagaaatgcagccatgtcctggtttatgatctgtctaaaatgcagacatgcccttaatacatacctctaatcccaaacaatgatggtaaagttagtttgtagaaggaagtagccatgtttgaaagtgacatctaattgaggccgacaaagtgatgaatcagagaaagatttgacacgagttggagatattatattcccaactctcacaagaagagcacaagaaagaggcactttagagagagcacagagagcaggagagggatacagttaactcagagaaaagtagttcagtttagagcaattcagttattatagttcaaagtcagtcttttcaagaagtacaattcagacagaagctgagagaacccaattagaatcaatcaccttagagagtagtttgaagcaaattagctgtggtaaacaagccagctagagtgctagaaagggtgagtttactcaacgataaacctatgagataacaattacatctcacaaataatagttacattttgtcttagtcagggtttctattcctgcacaaacatcatgaccaagaagcaagttggggaggaaagggtttattcagcttacacttccacattgctgttcatcaccaaggaagtcaggactggaactcaagcaggtcaggaagcaagaactgattcagaggccatggagggatgttctttactagcttgcctcacctggcttgctcagcctgctctcttatagaaccaagacttccagcccagagatggttccacccacaaggggcctttcccccttgatcactaattgagaaaatgccttacagttggatctcatggaggcgtttcctcaactgaagctcctttctctgtgataactccagctgtgtcaagttgacacaaaactagccagtacacattta

SEQ ID NO: 2655 - DNA, 1200 bp, mus musculus
gaacatatatgttattgaaaaataattgcaaataaaaataatgaatttgattcaccactgtgagaaacttcaaatattttaatagggtttaatatattttcatttagttttttcagcatgtctgtatctaaagttggataaaatgcctgttcaacataaactaaattattcaaaaccagagaattaaaaacacataaaatatatatactgccacccctagtgtcatcttaggcgtgatctcggtggagggccccaaggtccccagaggtctctccatgctgcaggcaccctagcacaccagggatcttgagaacactggtgagtggaacaaaacatcagtttcaaaaaacccagaggaccttgtgctagcaggagcagggacaaaggacaccagcccaaccagtgcctggggttcactctgaccagcgccacaaccatgccatcttggaaacaatctcagcagagggtcccaaagtccccagaggactctccactccgcagtcacacgagcatacctggcatcttgagaatactggtgaatggaacacatcagttctgaaaacttcagagggtcttgtgctagcagcaatagggtcaaaggacaaaggcaggccctagcacagccagaatctttggatcactgagactagtatatgcaggggagcacatgggcagcagaagcaacagagcttcttggacaggatgccttcaggccttcatcctcagccaggagacagagctgagacccagtcccctggagaccttccatgccagaggagagttggcctccagaggagggctctgaccccaggaatcaggaggtggatctgagctccagacttatgtgcatcttctctgcaaggggagagcttgcctacagagagtgctttgaccactgggactcaggagagagatggtctcccaggagtgctgacagaggctaaagaatcagaggaagactccagtgaatccttgaaggaaaccttatctctctgcttctcatcctcaggtggaggagcttccccatctggttatgcttcttcaggccccaccactaaagaggtggattaagtcagttcaagaaaggggtgtagcattgttttaaaaggaacccaaaacaaataacatgggatgataaaactatttaaattggcaccaaaaaaaaaaaaaagtgaatcacaagaggaacaagctccagtc

SEQ ID NO: 2656 - DNA, 1200 bp, mus musculus
ttgaggagtaggaaagcctctaattaacaaagcagtcttccgttgtcacatgtccagcgctatcgtctcgccagcgaaaacacacatggaacacaaggatccttcttcagcaaaacgtttattgcatcttggagaggaagaccccgagccctagaaaggagctgcttatataccccctagcgtggcgtgtccacgcctgactggtcgcttacccacgatctcattgacacgccctggggtgggctaagacttggcgcgaacacactcttgcacaggcacacacatcttgttcactgacaaaggttgagctggtacagcggaatctggtgccatcttgtggcggcgaatattatcgcggctctccacatctccccctttatgttttattaaaatgaggctggtctaggcctctgcagttatgtccatcaactgtggctcctgttttaggtcgttcctctaatgtcacagccttacccgtcatagggtaaccctatcgccactgggccccgtgtcttaggttggtctgtgcatgaggaaagttgcccgtctctggataccgcagtactgtgtgacagtaactgctaaatgacctagggcgaactctacaaaagaggccagccaaaaatgaattagtgggggaatcatgatcaccctatcaagtgcaatgaggaaacctcagcgatgtgcaagggctgatcaaggatcgttgagtctctctcatcccagtgcaatggatccacaaatccgtggggtgcaagagcagagaactcagatgccgactaattcttgagcatagataaccaaatttcaggggagggcccttgctctatggcagcaagtgcttgagcaatcactaccttgtcacgtttctgctgagatctgagtttgcagaccaaccatagcatgaacactaacccacaacacagggctgcgccaaacagacccactgccacccattctttgaagtaagaaaaaactgaagaaatccaggaagagagtccctccgtcagcgacaggtccactcgtgttgagttgatagccaacactgctgccctcaaagactcgagagtcttgtcaaatccttctgaccagtttcctgcaagatacaatgacaattgcctagacaaattagctgcttgggtaaaattttcctactgcacactggtaatgcagagcgcccccagctttctttcacatcct

SEQ ID NO: 2657 - DNA, 1000 bp, mus musculus
ataaaaatagatagacagatacatacatacatacatacatacacacatacaggcaaaacatcctaaaataaaataaaaataagtaccttttctaagaaaatcagagactaatggaagccatttctcagttcagatccctgttcccatgttcactgaaggtttctgtcaggttgatacctaaagctatgacattgcataaggagaattaatcaagctctctttctgaacctccaagaactaacatcagaacacacaggcgccttcaggtctatgccagcaccagggtactttgggcatagagtctgaggactcccccaaggtctcaacaggactctccatgggatcttaggacctctggtgagtggaaaaatacttctgctacaatccaatcaaacaggacttgagacggcattaattagggaagcagaaaacctggcctgacaagggtcacaagtcccttctggtcagtgccagcacctggacaccttgggctcagagtctacagacaaccccaaggtccccagaggactctccacaggatctgaggacctctggtgagtggaacacaacttctgccgggaggcagtttcgaacacgagatacctgggcaccttccctgcaagaggagagctagcctgcagagagtactctgaccactgaaactcaggagagagctagtcttccaggtctgctgatagaggctaacataatcactgaagggacaagctctaaccaaagacaactataacaactaactccaaagattaccagatggcgaaaggcaaacataagaatcttactaacagaaaccaagaccactcaccatcatcagaatacagcactctcacaccacccagtcctggccagcccaacacacctgaaaaactagacccggatttaaaagcatatctcatgatgacggtagaggacatcaagaagaactttaataactcactcaaagaaatagaggaaaacactgctaaagagttacaagtcctta

SEQ ID NO: 2658 - DNA, 1000 bp, mus musculus
atgtggacgtgctattggcagttgagaattgcttgaagagaagtagtcattgtcgtctttagtcatgtagccaccagtgaatgttttacaaatcaaaagcaaaaacaaagcaaaaaaacatgaaagttgaatatataatagatgaaaagagaggattggtattgggaaaggagaagcaaaagtaggatgatgaatgagaccagaattcaatatattcttgttggaaattatcaaagaaaaatgtttaagtaataatgccccaaattgtcttaatcaattgttgtcttttgcagaacaatcatctgaaggtttaaatcataacacttgctattaagtgatgcataatcattctttcatgtgatcagtctggataattgttaaagggaaatttaaaatgacaaattttgtgatttttttcaggttttgtgattttatttaaacataaaatatgcacacaagccatctattcattttcttcgctgcgtagcctggcgttgggattggagactctgatagccagctgtgctgctctttctacaatggcttctcggttcttagaggacacattgtgagcaatctcagcacagtaagatttgttacacatgagcagcacttccagctccttgacatcgtggaccaggaacttgcagaagctgctgggcagcatgtgcttggttttcttgttgctcctgtaactgatgttgggcatcaggatctcgcccttgaaccttctccgaaccctgttgtagatgcctctgggtttccaccagttttgcttaattttcacatatcggtctgactggtgtctgatgaacttcttggtcctctttttgacgatcttgggcttcaccagaggccggagggcagccatgattccacaaaacagatggcagccacctcgtaggcagcgccgaggaagaagcctaattttgtgattatcaactagtatattggcttaaatttatcgacattaatttatagataaatactggaaacatag

SEQ ID NO: 2659 - DNA, 1000 bp, mus musculus
ttaagtgagttattaatgcccttcttaaaatcctttaccagcatcatgaaatatgatttttaaaacagaatcttgtttttcgggtgtgttggggtatccaagactcgctgtgttgggcgtactgggttctgatgatgttgagtggtcttggtttctattagcaagattctttgcctttcaccatgtgataatctctggtgttagatgttctagctgtctctggctggagcttgttcctcctgttattctttagcctctgtcagcactcctgggagaccatctctctcctgagtcccagtggtcagagcactctctctaggcaagctctcctcttacagggaatgtccacagaagtctggagctcagatccacctcctgagttctggtgtcagagccctcactggaggccggctctcctctggtagtgaaggtgccaaggggtctgggtctcagctctgtctcctggctgaggatgaagacccgaagggaccctgtctaagaagctctgttgattctgctgcccaggtactctcctgggtagactggtctcagtgatcccaagattcttggtgtgctaggtcctgcctttgtcctttgaccctgttgctgctagcacaagaccctctgagtttttttggaatagatgatgtgttccactcaccagtgatctcaatatcctgggtgtgcttgggtacctgtagcatggatattcctctggggaccttgggaccctctgctgcgatcatgcccaagatgactccagtgtggtgctgaccagaaagaaccccagccactggtcgggcaggtgtcctttgaccttattcctgctagcacaagaccctctgggattttttggaacagatgattaccagtgatctcaagaccctggatgtgctaggatgcctgcagtgtggagagtcctctggggaccttgggaccctccgctgcgattgtgcccaaaaaagagaaaaatgttttctcgatatcttttagatccatt

SEQ ID NO: 2660 - DNA, 1400 bp, mus musculus
aaacagagcaaaaaaatggttcaacagtagtttaggtgaaatctctccattcttcccttaatctgcattttagctgaaaaaagctttaaagtaagtaaacgaaattttggaaagttgggtttattcaataaacacaaagcatcttatgtcatgaatgccaaatcacatatgaaacattggcaataagtctggattttgacagtcttagataattttaacctaaagaatagtccaagtgaaaccaagaaggcaggtaatgtagaggaaactattaatagatacatattggagaaatacagtagaaaacaaaaataggacattgcatttacacaatttgtttaactatcaaatataagtaacatctatgaaccatagtaatctgatttatcttcaattcaatctcaaaaacagatgattagtatgctaaaacatatgaaggaaatattgcctacctaatatttccagatccctcacatataacaatttgagtcttaccccaaatctcagtgattatatgatttaatttttttaaaaaaattctaatttcctggatatttacatataactttaaatctctttgatgggccaggcagtggtggtacatacctttatacccagcacttggaaggcagaggcaggcagatttgtgagttctaggccagcctggtctacagagtgagttccaggacagccaggcctacacagagaaaccctgccttaaaaacaacaacaacagtaacaacaacaacaacaacaaagagtctttgatgtcaagtttatttagtttagtagcatttctctgagttggaatatgaaacccccatgaaaaaaatcagataggaacttgtccatattctattactgtgcatattaatcttgctcttggctttattaatctagttcttgatagatttggctgctatagtgcctgtacctagcagcctgaccttgtctccagattctgacttgctccttggttcatagtacttggcagtaatctatgacatttctttaggaagaacccttttgatctattggtctttgatagcttatacataaactgagattaaggattgttggatatgactggtgtattgatacagaggaatatcatagaaaaagagtacacaaaagaagtggctagaaaagattaatggacctaacccaccgagaaagcctcatcatcaacaaggacaaggacaaaaactgtacagtgttactacctgtcttggaaattttcctcttgactaagaaagtgttaaaaatagaaactttatagttattcctgattctaaaccattttgcaaaagggtataatttataatttaagagaaatattatacctgaagcattttaaatggaaaggtctaagtttatgttaagggctttcattctccttc

SEQ ID NO: 2661 - DNA, 1400 bp, mus musculus
ggaaatagaaaagggaatatacatatatatatatatatatatatatatatatatatatatatatttcatccacaatgagtgaagttttgtcttttacaggaaaatagatgcaactggagataattattttaaatgaattaaaataatcatagaatgacagagtcacactttatctctatgtggctcttcaagtttatgtagacagaagcacatactcattgattatgaaagtagaagcaaaattgtctagtaggacaaagagttaaacaggtgtgtgggagcaagaaaacttcacatgtgttgtatgagagggaatcatgctaagcatataattcatacacacatgaaaccctgaaaatatatttaattatattttttaattaagaaaaagtctataacacaactggtaaagctaaggctcagggattgagataatagaaagactatattgccaggcggtggtggcacacgcctttaatcccagcacttgggaggcagaggcaggcagatttctgagttcgaagccagcctggtctacaaagtgagttccaggacagccaggtctatacagggaaagccagtctcaaaaacaaacaaacaaaaaacaaaaaacaaaaacaaaaacaaaaaaaacaaaaacaaaaacaaacaaacaaacaaacaaaaagactgtatcaaccaaccagaccccccggagctcccagggactaaacctccaaccaaagagtacacctggagagaacctatggctccagctgcatatgtagcagaggatggccttactgacaaaaaggggagaaaaggttttggtcctgtgaaggcttgatgccccagtgtaggggaatgtgaggaagaggcagggaggtggtagtgggtgagggggactggggatgggataggaggtttctaaaggggaaactggaaagggggataacatttgaaatgtaaataaataaaatacccaataaaaaaataaataaagactgtaagaaccagagaagagagaagtgagattgtttctcgtaggaatgtaagaatctacacctaaagcctcatttacattactaccaagcatgagctgaataaaaatgacattagcatacatggaaacaaagaagtgagaaactcatgtggcctcaacctagataaacagctataagcaactaaagaatactgagactaggagaaatagtctttgccatggaagagatgacaaattggttatgcaataacaagtgttcatttctgaacatttatacatacaaataaaaatatgcagactgagaggatgtacttacatatttaggaatgtgtgcatgcttctgtatgtgtgtgtgtatgtgtgtgtgtgtgtgtgtgtgtgtgtgtgtgtgtgtagcaacaatgaaagaatagagagt

SEQ ID NO: 2662 - DNA, 1200 bp, mus musculus
agtgccctctagtgtccagattctgatttctgaaactattttttccactataaaggaatcatggttccttgagaaaatgagagattctatgccctgggcagaaaggtacaaggtgaatctagaaagactagtgccaaatagaaacaaaatttctgttaacagattctactagaagtttgcattaataaaattaggaaggacttccattggccaaagttattctaatttgcacatcacagaaacagcaatgcttagaattgagggaagtacagtaactccccaagacgctatgcctccatgacactacaaagagaaatagtaacacatgattctaaaataaggtgaacagaatacaatgcatttctatagagccttgcatctcactcatgagacattattgattaatcttttctctcaatggagaatagaagaactaaaatcgtacatacaggaattgaagggcatttgggaaaacaggcaaaattctgaaaatgtcactgttgttaatgttcttcccaggaggagaaataaacaacatctattgcttcttctaaggttcccaacaacaaacagaggtgcaattctgccaaagttcactctggggaacaaatgagttctctacaaatgggcttccttacagaacttgggttctggactatttacaaggatgtggatgctcctggcccacaacaagcaacacctgcaaagctgttacctaacaggcatgagggctccccacataagacatagatggagccctccccctcccaggctaccctggccttttcactttagtccctccctgaggccatgtgcaattgaggcagagatttatatgacaggtggtagtaagtagaaggacactcaggtaatgtcttgtaaccagttctccctctccacaaaccagtgtaaacagtcagtaagtccagtaggagtgattctttgttcaggctagtacagccaaactctgccaagtggtggctgcttggcttggagggtagtcattcatagtagtccccctgaaactgagatttgaaatcagataaaaaccaaataaactgcctagaattcagttctgcacaaaattaagtatctttaagatatgtgcagtttcaagaacatgaatgaatgtaaaatgtctcagcatatctcaggatcccatctgcttccaaattctttagggtaagaaaaatgttaatg

SEQ ID NO: 2663 - DNA, 1000 bp, mus musculus
cgagagagagagagagagagagagagagagagagagagagagagagagagagagagagaggcggaggcattttcctgcacagtcccatcccccacaaggttcccccagttccgggaaggtagagggaggcccgagtctaggagagactcggggctcaggatcgggataccccgctacccggccgcgcccccgccctgccccgcccccgctcagcaggcggccagcaggaaagggggaggggagggaatgctagatggttctgccgccccgctgcccccatccctgcagtgattttggtacctgtcggcgccaaaaggtcagggtttgggcccctgtgaggggccaggcacgggatgtgtccagcacacacagagcgcgcgcacacacccctttcctatttacctccttcttctcgcccttctcagtggccgtggtgccttcggtggcggcagcagccgctccctcctctttaaaggtggacggcccgggctgctcatcctctacaaccacgactgtggctctggcatccgaaactgccacggtggctgcctctgtggccgtgtccggctccatggcgttggagcgggaaagacgaggtgggacgaggaaggggagaagggaggttcctgtgcgacagcggtggctgcgctggaaagagcttgctagagcaggggtggagaatactagcttccaaccccttcgctcgccccccaccttctttaaataaccctcaaccctgccccacttccgtccacccaccctacgtcatggcctccccccatcgccctcccctccgccccccctcaccaatcgcgagactccccctccccatccagagcccaggctggtcccacaggaccaactgttgcctgactgtggggtgcactcgggggtggagaacgaaacccacagctcgtggccccttaaattttctacttctccatatgcccccaacagtgagcctgagttcccctgacagatgtgtgcagaagaaattctc

SEQ ID NO: 2664 - DNA, 1000 bp, mus musculus
tagcacctatgaaaggagttggcaccaaataactgatcaatatgtatctaagaaatgcgtaaatcttaatctgtgtcaagaatacactgatctgaaggcagcatcaaggcacaatcagagacggggaagctggagagatcacagttatatttggaagctgtcgagtgagcctatacggtccctatcacctacacagcataaatccgtgacacttactgggctctgtggcaacaggctactgctggtctcttgagtacttggaggtcgacttccactttcctccagtggcaaaataccccttcgatccaggacactgaaagaaacagaagaatgaatcaaggacttgacagtcactcttctatcagctcagtccccactaaaccttggtctgtacatcagaaagcaccaacatgccttcagcaatctgtcctgaccccagcacacatctgtcttccatttactcttccacacactggaggatgtcacattaaccagggaacaaacgaaacagccagcccatggttttacggctcaggctcatggagatgtggtgccctgtgacaactcccaggaagacctatttgatatcagaaagttccatgcagaagaatgcagcagggcaggcatggggagaggtttgaatagtgcagcttaagagtccagggtggttttgttgcttgagtacctggggggcaaggggccacaaagcacttcacagcagttcttcacaatgttgccgtggctgtacggattctgcacacgattcttccctgtccatgatcctttgatctgcaagataaaagccagggcttacactgaaaaagaaatacgtcgaagaaatacaggcagtgtgggctaatgaagaagggcgagaggcaacaattacacaataaactgaatgcactacctgtcactgacctgttcctttaaaacagttaaagaggtcacacaccctggaagcctagaacttgggagaccaaggaagggattctgggtgcta

SEQ ID NO: 2665 - DNA, 1400 bp, mus musculus
ttatcatgtaagtctgcttggttagagttactccaagatatcttatactatttgaagctactgtgaagggtgttgtttctctgatttccttttcagtccatttgtcatttgtatacagtagggctactgatttttgtgagttaatttttgtatccagatactttgctgaaagtgtttatcagctgtaggagttttctagttgaacttctagggttacttatgtagaccaccatatcatctccaaataaagatatctggatttcttcttttctactttgtattcccttgatctccttcagttgtcttattgttctaactaagacttcaattcatactgtattgagtagacacacagagagtgggtaaacttacattgttcctggtttcactggaattgctttgaacttctctgcatttaatattggttatggattttctgtacattatctttattatgtttaggcatgtaccttgtatccctgatctctccaggatttttgtcatgaggggtgttggattttgtcaatagccatgtctgaaggaaatgagatgatcctgtgttttttgtatttcagtctgtttatatgatggattacatttattgaattgcatatgttgaaacatctctgcttctgtaggatgaaacctacttgatcatggtgatggatgatcttaatgtgctcttggatttggcttataagtattttattgaatttttgcatctgtgttcataagggaaattagtctgtactttttttttttcaagacagggtttctctgtatagcccaggctgtcctagaactcactttgtagaccaagctggcttgaactcagaaatccgcctgcctctgcctcccaagtgctgggactaaaggtgtgcgccaccacgcccggcttgtacttttcttcttttgtttgtttctttttgttgggcttttatgtgtttttgggtatcagggtaactgtggcctcatagaacgaactgggcaatgttccttttgtttctattctgtggaataatttgaggagtattgggtgttaactcctctttgaaagtttcctaaaattctgtgcaaaatcatctggccctgggctttttggtagggagactttattactgcttctatttcactagaagttataggtctgtttaaattgctgatcttatcttaatttcacttttgtaaatggtaatattgggaaaattatccatttcttttggattttccaatttggtagagtccaggcttttaaagtatgtctttaggatgattatctggatttccttggtgtctattgttatgtccacctctcatttatgattttgttaatttcaatattctctttctgcctttagttaattttggataaaggtttgtcagtttctcaaagaaactat

SEQ ID NO: 2666 - DNA, 1400 bp, mus musculus
tgtatatgtgttatattttttcttaactgttcttctattgaactgctaggttagctccatttcttagatatatgaatgtgaacatatctcaatggtgggatataaagccctttggggatacagaatgtttagacttattatgaatgttactgattataaatgaggcatgaaagagagagagactgagaaggagaagagagaggacgaagaggaagaataaatgtatgtgtgcacaaaagagaacgagactgagagagaaaagaggagaaagaaaggggaagagggaggagaggagaggagaggagaggagaggagaggagaggagaggaggggaggggagaggagaggaggggaattactgatttctatgtagttagtcattttacttcttttattagatatttccattatttacacttcaaatgttatcccctttcctggtttcccctccaaaaccccttatcccctcccctctccctgctcaacaagtgaaacactcccacttcctggtcctggcattcccctacactggggcattgagccttcacaggaccaatggcctctcctcccattgatgtctgataaggctatcctctgctacatatgcagctggagccaaggttccctccatgtgtattctttggttggtgctttagtccctgggagctctgggggtactggttggttcatattgttgtttccctgatagggctgcaaaccccttcagctccttgggtcctttctctagctccttcattgtggaccctgtgctcagtccaatggatgactgtgagcatccaattctgtatttttcaggcactgaaagagcctcacaggaaacagccttaacaggctcctgtcagcaagcatatgttggcatccacaatagagtctgagtttggtgattgtatatgggatggatctccaggtggggcagactctggatggtcattccctcagtctctcttccacactttctctctgtaactccttccatgggtattttgttcccccttctaagaaggaccaaagtatccacactttggtcatccttcttgagtttcatgtggtttgtgaattgaatcttgagtatcccaagcttctgggctaatatcgacttattaagtgagtgcatatcttttttttttttcagagagttccatcccactaaacctcagattgtttttttttttaattttttttattaggtattttcctcatttacatttccaatgctatcccaaaaatcccccatacccacccccccactcccctacccacccactcctcgtttttggccgtggcgttcccctgtactggggcatataaagtttgcaagtccaatgggcctctatttccagtgatggccgactaggctgtcttttgatacatatgcagct

SEQ ID NO: 2667 - DNA, 1000 bp, mus musculus
gtctaagaggttttctaaataatacaatctattgctgttacccatagtacatcctcaaacttgaaggtaagactcagctgctgacaacactacaaacatttatgaagcaggacttgaaagaatgaggctggtactgatttgggagtttcttttctaaggactagctctcataacatcagaaggtgctatgcaacatgccaagagagaaaaggaatcaatagccaaaaccagctgttaatcctataaaccacaacaaatgaccagcctggtatgttatctccaattgcttgctagtgatatttttatcttggtggtaactaacatctatataattggacttaaggggggttccccgattccgctgagactgatctgagcaggtgagagtgtggactgcagaggctaacaggttctgggacaggcagaagccacagagcttctggggcagaccacatttcgggctccaaacatccgggcaccttccctgccacaggagaggtgtccggcctgcctgggagggctttgccacagcatctgggggagccatcttggttcctggatcctgccaagactagtatgcacaggtgagagtgtaaactacagaagctacatagattctgggacaagacctgttacgagcctcatcttctgccaggaggcaggtccaaacaccaaatatttgtccactttccctgcaaaaggagagcttgctggcagagagtgctcttaccactgaaactcaggagagacctagtcttccaggtctgctaatagaagctaacagaatcactagaggaacaagctctaacaagagacaactatataaactaactccagagattaccagatggcaaaaggcaaatgtaagaatcatactaacagaaaccaagaccactcaccatcatcagaacccagcactcccaactcacccagtcctgagcaccccaacacacccgaaaagctagaaatggatttaaaagcataactcatgatgatggta

SEQ ID NO: 2668 - DNA, 1000 bp, mus musculus
tggtggtatgtatatatcaataaatactttcatttgacctaagccaaatggccaatgtttagtggggacacattttttaaaaattatttttattctttaattgttgtgtagagtccagacttcatctccctccaagtcccccccacctcacccgaccacaccccatgccataactcccctcatctcagtctccaagaggatgttctcacctccacccccacaccaccagggctcctcactccctggaacatcaagtctcttgagggttaggtgtagcttctctcactgatgcaagaccaggctgtcctcagctgtatacttgttgggacccccatatcagatggtgtatgctgcctggttggtggctcagtgtctgagagatcttgtgtgtccaggacagttgagactgctggtcttcccatggggctgccctcctgctcagcttcttccagcttttccccaattgaaccacagggttcccaagcttctgtccattggttggatgccagtatctatatctgactcttgcagctgcttggtgggcctctcacagggtagccatgctaggctcctgtctgcaagtccaccacagcatgagtaacagtgtcagggcccgggccttcccttgagctggatcccaactgggacctgtcactggaactcctttctctcatacttttctccatttttgtccctgcagttctttcagacaggaacaattatgagtcagagcttttgactgtgggatggcaaccacatcccaggtctctggtgcattttggagggtaccccaacctcctacatcccaaggttgcctgtttccattctttctgctggccctcagggcttcagtcctgttcccttcaatacctgatcatgttccaccttcccttccctgtctcatctcccacccaggtccctccttccctctccagccctgactgcgttcatttccctccaaagtggggattaaggtatcttcacttgggtctttctgctt

SEQ ID NO: 2669 - DNA, 1000 bp, mus musculus
atattagcccagaaacttaggattcccaagatataagatgcaatttgcaaaacgcatgaaactcaagaagaacaaagaccaaagtgtggacactttgccccttcttagaattgggaacaaaacacctgtggaaggagttacagagacacagtttggagctgtgatgaaaggatagaccatctagagactgccatatccggggatccatcccataatcagcttccaaagctgactcaattgcatacactagcaaggttttgctgaaaggacccagatatagctgtctcttgtgagactatgctggggcctatcaaacacagaagtggatgctcacagtcagctattggatggatcacagggcccccagtggaggagctagagaaagtacccaaggagctaaagggacctgcagccctataggtggaacaacattatgaactaaccagtaccccagagctttttactttagatgcatatttatcaaaagatggcctagtcggccatcactggaaagagaggtccattggacttgcaaactttatatgccccagtgcagggtgatgcctgggccaaaaagtgggagtgggtgtgttggggagtggcagggagtgtatgggggacttttgggatagcattggaaatgtaaatgaggaaaatacctaataaaaaatatacaaaaaaaagttatgtacctacggtatgtctgtagttcaagccagagggatcataggtatgtactaagggcctgtctctattccagccagagaattaaagttgggtgatatccctgctttccctctggatcataactttggatgtaatccccagccagagtagctattttgcttgattaaaattaatctaccaaaattcttttaaaatgtatttagcatttttgcttttgatatgtctggttggtttgaatctcttataaaatatacaatcatgaatattcttctaatcgtgtttctgtgaacacatacacatatccctaccacat

SEQ ID NO: 2670 - DNA, 1400 bp, mus musculus
aaaaaacttcagttattaagggggaatgagaaaaggttgatcagtaaacagcaaggtacagataggaatatgaaagactggtgtgttgttgctctgtcagcaacagaaatgtattgtacttttaaaaacctgggagaaaaggttaaaagttttcattttgggtcatggagatggctcaccaagtaaaaatggttgctgctaagcctaaaaatttaagttcaatctctgggacccaaatggtagaaaaagagaaccaacctcaagatagatgtcttctacacatgctatatgatatgtaggcattttctcttctcaccaaatcaataataaggaacatttttcctggttttaacactataacacacacacacacacacacacacacacacacacacatatatatacattcaaaactaccaaagaataaaacaaaaaaaattaaaatagagttaaatcaatatgaaaaagcaacggccactgctgataaaattattttgacaggagcctagcacaactgatctctgagaggcttgcatccatcagctgatagaaactggtgcagagacccaccatcaaacatcaggcagatctcaaggagtagtcttgtggaaggagccacggaaggatggagggggtggagggatcaagtaccaccacaggaagacatacatagccaactaacctgggaccatgggggcccacagagactgaataccaaccaaaaaacatacatgggtgggccctaggaatatatagcagatgtgcagcttggtcttcatttaggtcccccaacaatcggagtaggggctctatttgacttggactctgttacctgcctgtggatccttttcacctagctgggttgctttgtcaggcttcagtgggagaggattgcttagtccttatgatacttgatgtgtcagattggggtggtaccccagagtggctcaccttctctgaggaaaaggagaggggaagaatggaagaaggcaggtgggagggtaggactgggaggagaggagggagtggggctgtgattgggatgtaaagtgaaaaaataagccacttaatgaaaagtaaatgtaaaaattattttgatggtgttaagaatacaaatttttttgaacagtgcagtacaatagaaaaaaaaatgttcttgagtttgaaggatagctcagttagtggaagttcttgtacttcaagcatgagaacctgtgttcaatcctcagaaacaacattaaaaaaatcctaggaagcgtggtgcatgactataatcttagcctctagggagggagagataggcagatccttggggctcactttggccaaccattctaacctaactgacaggttcctagccaataataagctcagtatcaaaaacagaaagaaaacaaatg

SEQ ID NO: 2671 - DNA, 1200 bp, mus musculus
aatcagttaataatatgttctcagtatgtaccatgtagcatattaattgttttctgtgtcatttcatcaacttctttgtggtgtaattatttcattatatagacaggaaaaaacagctcaggaaagtaagtaatacagctgacagagttaggagcaaatgctcagatgaggttgcaaacccaacactaactctagagactagcatagtaaccaatagcaaatgcttcaataactcaagctataggataaaaaaaaaatattactcaagttgaggctggaggactcaagaggccctagagtactctccacaacacaggaccttgggatcacctcgagatcactggtgaatggaatgcaacatcagctccaaggaatcgcggagggtcttgtgccagcaggaacagggacaaagtaaccccgccagaccagagactgggatccataccagtagagccagccccgacatcttccacctgaacccactggagatctccagaagccctaaagtgctctccaaacaacagaacatctgaatcaccttgggatcacaggtgagtggaatacaacatcagcttcaaagaatcacagagggtcttgtgccagcaggaacagggatggacgaaccccgcctgaccagaggctgggattctttcagatcggggccagacccaccatcttctgcatgaaactggccaaggggattgagggccacagaggactctccactccacaggacccctagcacacccaggacctcgtgatcacgggagagcatatgggtgacagaaacaacagagcttcttggtcagggtcccatcaggccttccttctcagccaggaggcagacatgagacccagacacctgggcaccttccttgccagaggagagatggcctacatggagggctctgaccccaggattcaggaggtagatcagagctccagacttctggacacctgccctgtaagaggagagcttgccagcagagagtgctctgaccactgggactcaagtgagggttggattcccaggagtgctgacagaggctaacagaatcacagtaggatcaagctccagccagagacagcttgaacattaacaccagagatttccagatggcgaaaggcaaacttaagaatcttactaacagaaaacaagaacctgggcaccatcagaacccagtatgcccaccacagcaa

SEQ ID NO: 2672 - DNA, 1000 bp, mus musculus
ttgtgctgttgcatctatctcctcaaatattttcctctgaagctatttctttatggtgaaaaaaaaaagttctcctctcttctgggtttttgaatgcttgtttttgttttgttttgttttgcttttgctttgtagctatgcagtacttaattgacaattggcatctgtagtcacatttctgagcaagtcttttacccctttctgagctcacagggttggcagtataaaatgcccacaggagtgactgtttctgaggtctgaaaggagtaaggcatatagacacaagctgtgttggataaaacctagggagtcaggttggattttaaaggtgggcagggtaaaaaagtttcattttgcttctgtcttcagaagttctccagaagggatgagtgaatgactgcatttaccgaaaagtactgaggaatcattaattctcccttccagatcttccacttttaaatcctcttatgtgtgactactgtggaaagttatctctcccctgtggtagcctggtcagtaatataataatgatgaccagtcagtaggcctcaatgtggcgcttttccatgttgccccaaagggctgacaggtctggcgccagcaagaattgctgcccagggaagaatcttgcctagaacttttttgagacctgccaccatccagtctgctctttgttcctctttgagcttcgccttccttggctgctctccctctggtatgcccctggctggggtgccagccaaatggttacccttcacacactctgcctgcacaccgatatgcttcctccctttgcttggctaccaggcagaaggtttctgtcaggactgctcaactgagaaattctgagttccatacaggactcttcttcccttttgcagatctttaagctttgtgataggggaccttcatgggtgaatctactttggaatgatttgcttcaggtcttaggtttcacactctgcatctcacattccttcacttgatgtgactattccag

SEQ ID NO: 2673 - DNA, 1400 bp, mus musculus
ccatgaaatagatgtaggaaatgactttctgaattggactccatctgcccaagaattaaggccagcaattgacaattgggatttcatgagagttaagagattctgcacaacagaagaaacaattcattgaagtgaatgcccataatattggaaaaaactttatatgtgacaagagggttaatattcagaatgtataaagaactcaaaaaacaaagaattgaaagaataaaaaaaagtaaaaacaaccatacaacacacacacacacacacacacacacacacacacacacacacacggagggggagtgttagaaagccctggcccatgaatctgaatttgtcttgcagcctttgtaggttcttttgtgtgattttcaagcttcaattgttccaaaaaaaatcaaagaaatgtggggcttaagcatatcttagtgatagagtttaacatgtcttaggctctggggtcagaccacagcaccagaagaaaataatacatgcttatcttactaaagtgaagcatagatacttgaaatcccagcagttgggatgtagaggcagtaggaccatgagttcaatgcctgtctcagctacataatgagttaaaggcatgtactacatgatagctggctgaaaacaactactgtcatcacaccacctctactgtctgactgccaccatccttggactgcaacacttccaacaccactaccttcatcactgcctctaccaccaccacagctaccttcatggccaccaccaccatcaccactgccaccattgtcactactactacctcccactgtaaccatcttcaccacttccagagctaatattacctccactgccaccaccacctccaaagtcactaccacctccaaagacaccaccactgccattgccatagctactgccaccaccaactctactacttccactaccacctctatagctgctgccaccactaccactaactaccaccccccttcatcatctcaacaacaaagagaatgtgaccatggaaccagacactttgcagaatctaaaatgctctgttgtctcttttacaaccaattcagctactcctgttttatattattatttattgctatcaatatatgattttatatatatatatatatatgtatatatatatatatatatatatatatatatatatatatcattaattctatatggtaatgttatacctcttaatttaatggttatatcaattgaaagaagtcttcatcttataatggtcaatacttttcattccattctggtaacctatttctgtctgttcagttttgttcaacttgaagaagatacttatttcccctaaggaaattctgttgagaaaaaaaattgttacttcaattttttgtcatttagagctgtgt

SEQ ID NO: 2674 - DNA, 1200 bp, mus musculus
ttaatcttcaaatttcatggtagaaggagagaactgactactgcaagttgttgtctgacctcctcaagcaccataataatgtataattgctcccttgcaatggacaaacagacaccttgatggtgatatttttcttagatcagtaagggtcagagcaattggcagtcctttgttcatccttgcttgatgcctgtcttagtggacaaaactgttttatgcctaggactcgtaaaaatcagatcaaagcaaagcaaatccaggcaggcagcacagggggaggaagacagagacctgtagactgtgatgctgttcatagaaattccatccagtggactgtacaggtaggccagggacacttgcttgccaacatgtcacacctggtaccatggaagtcctgaagctttggaaggctaccttttcacaaatttcaactgtgtataggtgatatagatttttgaggtgggtcaaatcagatccctggatctgggtggtagctgaactggtcatcccactggctctcccttatctgcaccaccagggtgagctctccagcactgctccaggactagctctcctgagctcatgatcctgtgggcagctttcctaactgccagaggtggtgaggctctggggtgggaaggagcttcccctctgtatccgtgccatcccataactgatgagtagtgtggtcagctctcctacactcatgccctatgattggttcacagaacatccccaccatcagaaccagctccactttgcagcttgaatgaggaaaatagcctgcttgctaaagtactgtcataggtgagaagctctcaagaagccctgccttcagtgaggagcagaggcagttgtacacagcccttggacatacaggtagtcccaagcagttgccccaaccaaggacatccccaaattctctagtggtaataggctacaggccttgacaccgacccctgccactgagtagccatggactcagacatggtcctcagtagcagcttaggctggcaccttactatggctccaggtgtcagggatgggcactgacaacagactcttcctcccaccctgggtctccagttccatatctcttgagaatgttcaaattgctccaattctctttctagcccaggatctccatgatataggtcaacaacaggataactagaagaggtcctgataaagatccaatat

SEQ ID NO: 2675 - DNA, 1200 bp, mus musculus
aatctccacggatatgtgtacttaatagagatttgcttgctatccatttaagttttattgtatcatttaaacacctgaaggtatttaattttttctgaatctgttagaatttatttttgtatttcagaacattgtctattttagagaagtttttatatgctattggtgagtagaggaattctttgctgtttggagaggatattctgcatatatctgttaatttcacttgatgaaacctgtttaatttttttatttttgtccataacatttgcctattacaaaacagtgaggctgtagcacctgggggagcaaccttggttcctggataacgctgagaatattctgtacaggtgagagtgtggactacagaagctaacagagctcctgaggcagaccctgttttgggctacagacatctgggcactttcccttccagaggagagttggctgccccgcctgggagggctttgacagagcacctgggggagccatctttgttcccggactctgccaagactagtctatggaggtgagagtgtggattacagaatctagcagcttctgggacaggccctgtttcaggccttcatcttctgccaggaggcagacccaaacccagatatctatgcaccttccctgcaagaggatagcttgcctgcagagagtgctctgaccactgaaactaaggagagatctagtctcccaggtctactgatagaggctaacagaatcacaagaggaacaagctctaaccagagacaactataacaactaactccagagattaccagatggcaaaaggcaaacgtaagaatcttactaacagaaaccaagaccattcaccatcatcagaacgcagcactcccacctcacctagtccagggcaccccaacacacctgaaaagttagacccggatttaaaagcatatcacatgatgatggtagaggatatcaagaaggactttaataactcacacaaagaaatacatgagaacacagctaaagagttacaagtccttaaagaaaaacaggaaaacacaaccaaacaggtagaagtccttaaagaaaaacaagaaaacacatccaaacaggtgatagaaattaacaaaaccatacaagacctaaaaagggaagtaaacacaataaagaaaacccaaagtgaggcaacgctggagatagaaaccctaggaaagaaatctg

SEQ ID NO: 2676 - DNA, 1000 bp, mus musculus
tgtataaatcaaaaaattttaatggctctgacagggctcaaggaaaaagttatcagatttagtttttacatcattaagatgtttaggaagtgacatttttatgaacataagttcaccaggtagatgttcattttatagacctttgagctcacaaatcgatagttccaaatgaaaaaagatagttccctgaggaaatgcacttccttggtcatttccagatttagacttgggagtttggggcttttcattcactccctcacacattcattcatctcactaagtcattcatagagttcttcagtgcctgctgctttcccagccagtctccaattatttctttgaaaggtggcccatttgggaagcaactgaaagggctagtgagtagcttgataattttcagcccaatctgagtacgtaaaatttgaaggctgtcagaaaggcctttggaaacgggttcatcatccctgccactgcctctgctgtgaatacccaggggactttctgcaaaggagggggcaggaaaaatgtcacctctgaatgtcctccttcaagttcccagtggatgtctgagatggggctcacactgcttttgcctgcttagccacatggagcctctttctgcccttttcattcaccctttttgtcacgcagttccttggcagttaacatccctgcttcccaggtgtctgcgtagggaggacttgatatttctcgagaaagagcacaaaatagagattttagagacatttccacagcaggcgttctgactgttttgatgtcggttcctttggctagaagagaagccaacactttggttaaatgaaaatccataatcgccccaacaggctatgtgccattcagtgttcatgtcgtattagtgtaccttccatctgtgtcttcatacacaattcaggttgacaaaaatgtttagaaaatagaaaaatgaacttggaagatttttaatttaaaggtgatgattgaatcattcatggtgctttgc

SEQ ID NO: 2677 - DNA, 1600 bp, mus musculus
aagacttctaacccacaaacatggactatccattccaactatttgtctgaagttgtaataatttctattttcactctttatataaatttccctgtgtttattcttagggaccttatggtttgcttctatttgattttattttacttttagtttgctgtcgtgaggaacaatgcagccatttctgcataatatgcaagctcaaagttacatcttcagccttcaacttgaactcttaaatttgcatttttacaaatagcacaatgtttcagaagttgttcaatagttctatactaattattaatatattaattttaatgtccaatagaatttcttttatctgacatggtctctttattttggtgatgattcttgaaatgtatgatttttctgtctctttcaagtgatagaattacgggtatccttcacgacactttgcatacaggtaatggtttaaaatcttttccttgaaataggaacatactttggacattggtagacacattaaatcacagtggggtgattttcagctgaaagtaattagattgcagtttacatcataaattgcttgctgttgagttctgctcagtttttttccatgttgctaggataaactattctagcaaaacaatgtaaaggaccaatggtttattatgtgtcatagtccaaatccatcatggaggggaagtcgaggaagcaagaagtggaagcagttggttatatctcactcataagcatgaagtaaagagcagtggtagtcatgctgctacttcctttctccactgtacagtccaggatctcagcagtgggaatagctggcaggtctatccccatcaattacggcagccaaaatagcctccctgtaggcttgctcagagacctgtcttctaggtgattctaaattctttcaaactaacaagtgacattaatcatcacatggaccaaatgcattttttgtgtctacttcagttcattacatttttttcactcaggatgttagtataatctataatatttactcattttctaaggtcaactcttaacatcttgagataaatttagattggtcactgtatatttatccttaaatatttctttaattttaagattttaaaaatcacaattataaatgggaatgttttatgatttctcctttcatatttttagcttgagtagtaatattataataatttcattgactggattggagaaaattctccattttggtttctagaaagttttaacatgagaactgtctgatctttatattttggcagaataagtggcagaaacattcacatacagtactttttgtgtgtggaaagaatcttaatcaatgctttaaatatattcatagttattaaaagcataagagtatatagtttgtgtacattttcataatttatatgtgactagaagtttgtctattggcttaagttttcattttgacataaaatttttcttatcatacttttatttttaaacacgttcttgcaatgttagctcaggccttgagcttttgactcttttgtcttagtctcttgtgccttagaatcccgtgattacagacaagtattgccctcctggattttattatctattt

SEQ ID NO: 2678 - DNA, 1200 bp, mus musculus
tagggtttctatctccagcgttgcctcattttgggttttctttattgtgtctacttcccgttttaggtctttgatgattttattcaaatccatcatctgttttgtcgtgttttcctgcaattctttaagagatttttgtgcttcctctttaaggtcttctacctgtttagcagtgttcttctgtatttctttgagtgagttattaaagtccttcttgatgtcctctatcatcatcatgagacatgcttttaaatctatgtctagctttttgggtgtgttggggtccccttgactgggcgaggtgggagtgctgtgttctgatgatggtgagtggtcttggtttctgttagtaagattcttacgtttacctttcgccatctggtaatctctggagttagttgatttagttgtctctggttagagattgttcctctcatgattctgttaccctctatcagcagaccttagtgactagatctctcctctgagtttcagtggtcagagcactctctgcaggcaagctctactcttacagggaaggtgcatagatatctggtgtttggatctccctcctggccaaagatgaaggcccaaaacaggacctgtcccagaagctgtgttgcttcggcctgtcacagaagctgttagcgtctgtagtccacactctcaccttcggtggagtcccggaaccaagatgcctccctctgatgctcaggcaaagccctcccgggccgggtagactcctgtcctctgacagggaaggtgcccagatgtctggagtccaaaaagggggttgcctcagaagctctgtggttcctgcctgtcctagaaggtgttagtttctgtagtccacactgtcacctgtgcagactactcttggtggagtcccggaacccaatttacttgtgtttttaaagttgtatcttgggtattctaggtttctgagctaatatccacttataagtgtgtgcatatcaagtgaatccttttgtgattgagttacctcactcaggatgatatcctccagattcatccatttgcccaagaatttcttaaattcattgtttttaatagctgagtagtactccattgtgtaaatgtatcacattttctgtatccattcctctcttgagggacatctgggttctttccaggttctggctattataaatagggctgctatgaacatagtggagcatg

SEQ ID NO: 2679 - DNA, 1200 bp, mus musculus
aaccatgacattgctttaaattattttttagagatttatttattttatgtatatgagtgcactgtagctgtcctgatggttgtgagccatcatgtgggtgctgggaatttgaattcaggacctctgctcactgcagtcgaccccgcttactatggatgactctgcttgctccagtcagcccactaaatacactgtggatgtcttcagacacaccagaagggggtgtcagatctcattacgaatggttgtgagccacgatgtggtttctgggatttgaactcaggaccttcagaagagcagtcattgctcttaactgctgagccagctatccagccctttaaattattaattttttttgcttcttatttgtatttattttcattagatattttctttatttacattttaaatgttagcccctttcctagtttcccctccaaaaccttcctatctcttcccttctcctccttctcaccagcccacccactcctgcttcctgaccctggcagtcccctatactggggcatagaaccttcacaggactaagggcctgtcctcccattggtgaccgactaggccatcctctgctacatatgtatctagagccataagtcccaccatgtgttttctttgattggtggtttagtcccagggagctctcatccctcaacagaggagtggatatagaaaatgtggtacatttacacaatggaatgctacacactattaaaaacaatgaatttatgaattccttagacaaatggatggatctggaggatataatcctaagtaaggtaacccaatcacaaaagaacgtacatgagatcttcggctccagacaaccggccaccttcctggtgagagcacaggggtccgcccggcccgagaggtttgagcctcaggccccggcgggagccttggctccgggactctgcggagggcaggctgcacgggtgacggtgtggaatacagaggccagccgtttctgggacaggcgagagccacagagcttctgaggcggtgccatcttcggctccaggcaaccggccaccttcctggtgagagcacaggggtccgccagcccaagaggcttgtgcctcaggccccggcgggagccttggctccgggactctgcggagggcaggctgcacgggtgatggtgtggaatacagaggccagccgtttctgggacaggcgaga

SEQ ID NO: 2680 - DNA, 1000 bp, mus musculus
agaatgatgagcagaatattgaaatcagttttaaaagtcctgcaatagggtgattattaagaacagaaccgactcgagccccgggcttccttgccagcggagttgcctgacacccgcaagggcccacacaggattccccacaggatcctaagacctctggtgagtggaacacagcaccggccccaatccaatcaagcggaatctgagactgcggtacatagggaagcagactacccgggcctgacctggggctcaagccccttccactccactcgagccccgggctaccttgccagcagagtcgcctgacacccgcaagggcctacacaggattccccacgggatcctaagacctctagtgagtggaacacaacttctgccaggagtccggtttgaacaccagatatctgggtaccttccctgcaagaagagagctttcctgcagagaatactctacccactgaaactaaggagagtgctaccctcccaggtctgcttatagaagctaacagagtcacctgaagaacaagctcttaacagagacaactataacagagagattaccaggtggcgaaaggcaaacgtaagaatcctactaacagaaatcaagaccactcaccatcatcagaacgcagcactcctaccccacctagtcctgggcaccccaacacaaccgaaaatctagacccagatttaaaaacatttctcatgatgatgatagaggacatcaagaaggactttcataagtcacttaaagaattacaggagagcactgctaaagagttacaggcccttaaagaaaagcaggaaaacacagccaaacaggcagaagtccttaaagaaaaacaggaaaacacatccaaacaggtaatggaaatgaacaaagccatactagaactaaaaagggaagtagacacagtaaagaaaacccaaagcgaggcaacgctggagatagaaaccctaggacagagatctggaaccatagatgcgagcatcagca

SEQ ID NO: 2681 - DNA, 1200 bp, mus musculus
aatgaaaatgaagccacaacgtacccaaacctttgggacacaatgaaagcatttctaagagggaaactcatagctctgagtacctccaaaaagaaacgggagagagcacatactagcagcttgacaacacatctaaaagctctagaaaaaaaggaagcaaattcacccaagaggagtagacggcagtgtggggagcgggtgtggcggcagtcccaaaggcgccagagactgcagctaagtcatatgacttgcacctgacttcctcatataagacacaaacatcttgagtgctgcgcaggtgtaccaggatacaggtgaatccaatttggtggagatatgcccctgctgccctgattagctgaagcttcgtgcctggtgaggtggcgtgacctgctgtgcgtggatgggaactgagagtataaaagagtgagaggcccgggttagagggaggattattattcgagagaggattgttattattgggagatataaacgagggagatataaaaacaagggagatataaacaggggagatataaacaggggagatataaacaggggagatataaacaggggagatataaacaagggagatatatggagaaagaagaaacaggactgaataaatgtgtgcagaaggatcctgtagcagcgtcgttcttcctggcctgttgggcacacgtaacagttggtgctgaaacccgggacgggacgagaagacctaggacgagaagacctgggacgagaaaacccgggacaagaaacatcttcaggcatgagtgaagaccccctactacagggaggattcagaactgcataacagggaagaaggggttaataaagtgttcccgtaaaacagactgttgagaaggatctggcgtggattcagaactcttcagctggggaacggtactgatgaagagaaagaagaaagatgaagacggaataaactgctgttagaaggactggtggtcacatcgttcttgctggtcgagagcaggcgcgacaattggtggctggtacggggaaccgactcccccaccgagttcagaactttcagcagtcagtggttgccggcagggtaagttcacggtgagtgaaacttgcgaccccaggagtttgggaaggacctcggataaaatagaggtgagcataaagttgccaggaagtaggcacaaagtaacccaggagtttgggaag

SEQ ID NO: 2682 - DNA, 1000 bp, mus musculus
tttactatgaagaccagggtggtctggaattcacagaaatctgtcttcctctgcctcccaagtgttgggaacaaaagcatgagccaccatacctgaatcatttactcataaatgcttctgctcatgacctgctactcctctaatgtaaacacgcattcaataactcaacctgtgccaaatattcctataatgtaaaacatcaggcttctgagtgagtcccgagatatcccctcctcataggaaaccattttcttgtcctttctattgtttaaatcaactaatatactcatgattaaaaaataaggtgtatataagatggcacacattagcaagtctcaccctcttgtctctttcccccttttttcctgctgttctccatgtgtttatgtacatttattttcttgttcacttgttccacaaaagttgatcacactaaccagtgtcctgtaccttcctttagaagtgttgtatttacagttacttttccacaatgggttgccttgtggtaaaatgatgcctatactctggacacagactacctttgtggacttttccctctgaacccatatatatatattggtaaaatttctatgcatttctcttcccaaatatttgtatttatactttggtgtttatttatgtatttgagataagatgtcatatatcccagggtggtcttaaactagctatatagtcaatgacgaccttgaacttctgttcttcctacctccacatcctgagtgctgggatggcagtttgtgtgatgctaagcatagaacccaggactttgtgcatacccagccagcatgctaccaactgaaacacaaccctagtcaagtttattttattttttttttatacttttacatgatatacaaaggatgggaatgggtgggaaggtgggggagcaccctcatggaggcaggaggaagggatgggatggggtggggatcgaagaggataccgggaaggggaataacatttgaaatacaaataaaaa

SEQ ID NO: 2683 - DNA, 1000 bp, mus musculus
tttcgggtgtgttggggtgccctggactgggcgaagtgggagtgctgggttctgatgatggtgagtggtcttggtttctgttagtaagattcttacattttcctttcgccatctggtaatctctggagttagttgttatagttgtttctgtttagagattgttcctctggtgattttgttaccctctatcagcagacctgggagactagatctctcttctgagtttcagtggtctgagcactctctgcaggcaagctctcctcttacagggaaggtgcacagatatctggcgttcggacctcctcctggctgaagatgaaggcccaaaacaggacccttcccagaagctgtgttgctttggcctgtcacagaagctgccagctcctacagtccacactctcacctgtgcagaatactttcagtggagtcccggaaccaagatggctccggccgatcctgaggcaaaagcctcccgggccaggcagacacctgtcctctggctgggaggttggcctggtgtctggagcctgaaaagggcgctgcctcagaagctctgtggttctggcccgtcccagaagctgctagcctctgtagtccacactctcacctgtgtagactactttcagtggagtcccagaaccaagatggctcccgccaatgctgaggcaaaggcctcctgggccgggtagacacctgtcctttggccgggaaggtggccggatgtctggagcctgaaaagggtgctgcctcagaagctctgtggctcccacctgtcccagaagctgccagcttctgtagtgcacactctcacctgtgcagactacctttggtggagtcccggaaccaagatagctcccgctgatgctgaggcaaaggcctcccgggccgggcagacacctgtcctctggctgggaaggtggccggttgtctggagcccgaaaagggcgctgcctcagaagctctgtggctcctgcccgtcccagaagctgctagcctctgt

SEQ ID NO: 2684 - DNA, 1200 bp, mus musculus
cctctgttatctaccccagtgtccttccctggtgctctgaataacggcaagtatatttcttaaagtctatgaccacttttgcaatcggtgtctcctgatttctcttgtgcacattaaccaacacatatgtgacaactccttggcaaccttgccctagactcccacccaccaacaggccttctactcattcctcttgaaggctgactaaatctgagaccttacttgaaaggaacaaagggagttgggtgaaatcgtggtccctgaacatccacccatggcaaacaactcagactgaatccattcttgcttccacatacagactgggagtagaagcaaggggcaatccctgttcagactaagagtgcttccgtgctcctggaaggagaagaaagactttcaagggacctttgtatccctgatggtgggaactggacaaagtcccttcccacattggcctactaccaagagaatttggcagaggttcagtttcacccaactcatgggtacctggggacaccctccagctcaatggccactgaggacagctgcagggcatgaactttcacacacacacacacacacacacacacacacacacacacacagccttgtgctcatagcttgctaaggaagagcctttctgaggtgtttcatgcaaagaagaccagtgacctgaggagtaccttcctggtgtatctggcctctttccacagatggcacatcccattgaaagtagtacactaccccaagtatcagcctgagtaaacatctgccaacacagttgaagaaacagcagcagcaggagcatgaaggcctggatgttgtgacccccatggtgccaccttttgaagacctgcctcactcctgggaagtggtaccagatgactacttggcagccctcaggacagccaggctcatcttgccaccccagcagctcagcaggagtccctcacacagcctctcctgagaccttggtaaccagtgggcattgttccacaaaccaaccaatgggagcgcagcatgcgctcacaatgctcctctggccaatggcaagcttcgggaggaaaaacatggatcctcctatgcattttgtctctagcacagcaagaacacataaatgtgctgtccgatgatgcctggaatgttctctgaatgctggaaagagattattagaatgattttttttgggggggggacact

SEQ ID NO: 2685 - DNA, 1600 bp, mus musculus
tagccatcttgccaaaagcaatcttcagattcaatgcaatgtccatcaaaattcaaactcaattcttcatagagatagaaagagcaattttcaaaatcattttgaataaagaacatccaggatatcgataaactattctcatcaatgaaagaactgcagggtaatcatccctgacctcaagctgtattatagagaaatagtgataaaaatgtatggtaatggtacatagacaatgacttcatgaaattcacaggcaaatggatggatctaaaatatatcatctgctgtgaggtaaaccaatcccaaaagaacaaacatggtatgcactcaatgataagtggatagatattagcctaaaagctcagaatacccacaatgtaattcagaccacatgaagctcaagaagaaggaagaggaaaatgtgggtgtttcagtccttcttagaatggggaacaaaatactcctgggcagaaatatggagacaaagtgcagagcagagactgaaggaatgaccatgtagagtctgcccaacttgtggatccatcccatatacagacaccaaacccagtcactattgtgaatgccaacaagtgcttgctgataggagcctaatatggctgtctcttgagaggctctgccagagcttggcaagaacagaggctgatgctcacagccaaccataagactgatcatggggtccctagtggaggagttagaggaaggactgaaggagctgaagggttttgcaaccttataggaagagcaacaacatgaaccaaccagaccccccagatccaccagggactaaaccaccaacaaagagggggacccatggctcctgctgcatatatagcagaggatggccttgtcagacatcagtgggaggagaggtccttggtcctgtgaaggctcgaagctccattgtaggcaaatgccagggtggggaggtgggagtgggtgggtgggggaacaccctcatagaagcacagggagggctaatggaatatggattttctggggtgaaaccaggaaagggctaatatttgaaatgtacataaagataatatcggataaaaataaataaataactaaataaaaattaaaataacaatattcacaaaatactacatataaataggaataagtcattcagatgtcatagagtatattaactaatatttcctaatatataaattatgttaatactatatagttttaaacaaattatatatccaaaaatgtaccttcaaattttcccagaatattttgtactggagatctgtgaagaaattaaagttttaaaaagtaaggattctgaagatacagtttgatggctcagcttttgtcctacaagcaggtcgatgagagttgccccacagcattacatcctccaagaaatccattcagattaaggattaatcttacggaattcttgtttggaatatacatcatatgctaaatattaatatagattacttgctatacaatcaattaaacttttctggaagtacttacactatgaaggaaataataagtttgaacatattaccgtgtatctccaactacttcttcaggatttgcattctcatcatcacgagtt

SEQ ID NO: 2686 - DNA, 1200 bp, mus musculus
atgaagactcctttaataaaacttgcaagatatgtcatagactgttgagcaagtaacttagtgaatattcaactttaccttgtgtactactttaatcatttcacctcattaattcaagattacacaaaattgggagaagggtcccaaggtccacagaggactcttcatgctgcccgtgccctagcacacccaggatcttgggatcactggtgagtggaacacaacatctgttccaaaatatctcagagggcttgtgccagcaggaacaggggcaaaggaaacccgcccaaccagtgctggggttcattctggtcatctccagccccccccccctgccatcttgggcatgaacttgacagagggtcccaaggtccccagaggactctccatgctgcaggcgccctagcacattaaggatcttaaggtcactgatgagtagaacacaaaatctgtcccaaaaaacccagaggatattgtgccagcagaaacaggaataaaggaaacccacctaactagcagctgggattcattctggtggctccagcccagcaccatcttgggcatgaaatggcaggccctggcacacccaagatcttgggagcactgagaccagtctacacaggagagcacatggagcagcagaagataaaggccttccttgtgaggagggggtgtggcagcagtcacaagaaggtgccctggactgcagttaagtcttatgacttgcacctgacttcctcatacacctgaaaataagccacgaccagcgtgagaactgcacaggtgcaccatgatgcaagatcggatcatatgacaagtgatgattctggccaatggactgctgttacatggaatgggctgatggggcatggttgagaggttatataagggattgtggttgggggtggtttggttgttgttgttttttcctggagagattgatttctggagagagattcatgcatgatgttgaaaggttcctgaataaactgctttgagaagaatgtagtgttgtcgttcctttctgctggttggaataggagactacacttccttcaggccattatcctcagtcaggaggcaggacaaaaatccaaacccctgggcaccttccttgccagagaagagtctgtctccagggacggctctggctctggactcaggaggtggatctgagctccagaattctgtgcaccctca

SEQ ID NO: 2687 - DNA, 1000 bp, mus musculus
aattcatctgaacagtattaattcatgaaagttcaactttatgttaatcttcaggaaatctgctcaacagggtggagtaatgtccaggaatccttaggtgatgtaatagtgacaggaaaggcatatcagaagcaagaagcaatcctggaataaagtatcctgggacctggcctcccagagctcacccatcttaggccatgtaaaacggtgggactttttattggtgtcctagatagtttaatgtcagcctgacaaaaggtagagtcaattgtggtgaaggactttctgttgagaaacacctcttataggcaaatcctgtaaagcattttccagattagtgattgatgtggaagggcccagcccattctgagtaaagccgtcctttggctgctggtcctggatcctataagaaagcaggctgaacaaaccatgggagccagtcagtaagcagcacacttcatggcccctacatcagctgctgcctctaggttcctgctttgatttccttcagtgatggactgtgctgtggaccttggagtgaagaaaaccctttcctctccaagttgcttcttttttttaaaaaatattttttattacatattttcctcaattacatttccaatgctatcccaaaagtcccccataccctcccacccacttccctacccacccattcccattttttttttttttggccctggcgttcccctgtaatggggcatatacagtttgcatgtccaatgggcgtctctttccagtgatagccgactaggccatttttgatacatatgcagctaggatcaagcgctccggggtactggttagttcataatgttgtttcacctatagagttgcagatccctgtagctctttgggtactttctctagctcctccattgggagccctgtgctccatccaatagctgactgtgagcatccacttctgtgtttgctaggccccggcatagtctcacaagagacagctataactgggtccttt

SEQ ID NO: 2688 - DNA, 1000 bp, mus musculus
tgcataaggtcgaggggcgctagggcctggagaccgaaccatgccctgacttaaaccaccatttccttttaacttcctccttggctttctatttctaccctcatcagggtggtatctttcttccccacagtgggctgcttcttcctctaagtcttcttcctctgaggaactaagttcttcacttgaacttgagctctcaagtcctaaaccctcaatttcttttaacgagtaaaggttcttcctcgcgggggactccttcccctacttttttctcttctcccctttatctttcctcatctttctctctccattctcctttttctctcccagggcttcctttcccttttcactttcttactcggatccagaatccttggaagtgtcttgtttcttaagtataccttttttttttctttgagctcccaatcttttaccccactttgtttctgaagtgctgtcttgaacctcctccagcactccctgtcctgctttcactatatggaaaaggataagtgctgcaaaaacaattacaaaggcttccattgccccttctaattatagagaaagaccagaaccaaacatgccactcagaaccttaaaaaaaaaaaacaacctgactgcaattctgaatcctccccgcaaaaggagggcctcctcagtgctggcgagagtaaggcagttctgggtttcggcacgaattctcacaagggctattgtctcgccagcaagaacacacacgtgagaaaacggatcctactgcagcaaatttattacaccactttcaacatgaagaggaagaccccaagcaccaaaaaggcgctgcttatatacaccttagtgtggcgtgtccacacctgattgtctgctatcccagagcctcatcaccatgccccgggatgggccgtgacttgcacgaaaacattctcgcacatgcgcacattgcttgtttaccaattaggccatgcaggcacagcacaaactgcttcccacaagttgatat

SEQ ID NO: 2689 - DNA, 1200 bp, mus musculus
attttctcttttctgtcatctacaattttggattcccagtgctcacacttttcagtgttttacctccgttgcttattgctagccttaccatctaaatagaaaactatattgagctctaataaaagaaaaattggatgacaatatatttatgttcattccataatatatacttaaattattgaagaaagccgtgtgtccatgccctgcctgtcaatcccatcagcagcaagctctgccccttttacactcaatttccttgagcacagctctgactgcattcctagaagtctgttgctgccagggccaaccaggtgagttactcaagccccaaaagccagcatgtggggactgaggcaagttcagcagccttgaaatctgctctgacccctttgagctccatcttccagtttcatgcctctaaaaccacaacctcagatatatgcagccaccagtgaacaccaggtgagacccctacccacaattccctgcctgacagctcctctggaaaatacagcaatggtgagctctgccttgcttcttctgcactccatatctggggccacaacttcatatacatccacggatacctgctgctacctaggacaaatagagcactccaaccctcaggaatcaccagtttacctgtgttcctgaaagactacctcatatgggacaatcagaaacctgaagccatcaaggcctactacatctgccagtattcctggaaacatgctataataagggacacacagttctacctgcaatattcgaggcctgctgacatcaagaaatacaagctcttcctgtagctccagtggtctaattctgccaaggactatcatgcctgtcaatactaggaacaaccaaatgactaaagccaacatatgaacataatcaacaaaagttagggcaatatggcactaccacaacacaactctcctactacagcaatagttgaatatcctaacacacctaatataagaaaatgacctagattctaatcttatgaagattatagaggcctttaaatatgatatgaatatatcccttaaagaaatacaagaaaatgcaaacatatatgttaagcatcttaaagaggaaatgaataaatgtaaagaaataaaggaaatataaccaaacaggtgaaagacatgaataaagatgctcaaggcctgaaaatagaaaaaagaaacaatgaag

SEQ ID NO: 2690 - DNA, 1000 bp, mus musculus
gatttcttggagggtgtaatgctgtggggcaactctcatcgacctgtttgtaggacaaaagctgagccatcaaactgtattttcagaatccttactttttaaaactttaatttcttcacagatctccagtacaaaatattctgggaaaatttgaaggtacatttttggatatataatttgtttaaaactatatagtattaacatactttctatattaggaaatattagttaatatactctatgacatctgaatgactaattcctatttatatgtagtattttgtgaatattgttattttaattttcatttagttatttattcatttttatccaatattatctttatttatatttcaaatattagccctttcctggtttcattccagaaactccctattccattagccctccctgtgcttctatgagggtgttcccccacccacccactccgacctccccaccctggcatttgcctacactggggcttctagccttcacaggaccaaggacctctcctcccactgatgtcttacaagaccatcctctgctatatatgcagctggagccctctttgttgttggtttagtccctgggagatctggggcttctggttggttcatgttgttgctcttcctataaggttgcaaaacccttcagctccttcagtccttcctctaactcctccactagggaccccatgatcagtcttatggttggctgcgagcatcagcctctgttcttgccaagctctggcagagcctctcaagagacagccatattaggctcctgtcagcaagcacttgttggcattcacaatagtgactgggtttggtgtctgtatatgggatggatctacaagttgggcagactctacatggtcattccttcagtctctgctctgcactttgtctccatatttcctcccaggagtattttgttccccattctaaaaaggactgaaacacccacactttcctcttccttcttcttgagcttcatg

SEQ ID NO: 2691 - DNA, 1200 bp, mus musculus
aacacctaaataattttcttgtttaaatgtaagagcctctttatattaacttccaaataaaatgtaaatgaataagtgagtggcaaatagtcctttgtaccaaacttcacacactaatgtagtgaattatttaaaatttattctttaatctttttttaaagtccagactttatccccctccttgtccgccctctgactgttccacatcccatacctcctctccccacgcccatctccaagaggatgtccccaccatcctaccccactccaccagacctccctattccctggggcctcaagtcttctgagggttagatgcaccttctctgactgagttcagacccggcagacctctgctgtatatgtggtggggggcttcatatcatcttgcatatgctgcctggttggtggctcagtgtctgagagatcctgggaggtccaggttagttgagactgctggtctttctacaggttctccctcttcctctgcttcttccagcttttccctaattcaaccacagaggttcccagattctgtccattggttgcatgtaaatttctgcatctgactctttcacctgctggttaggtctttcagagggcagtcatgataggcccatttttgtgagcacaccatagcatctgtaatagtgtcaggccttgatgcctctccttgagctggatcccaattttggcctgtcactggatctccttttcctcaggcttctctccatttttgtccctcctgttctttcagacagaaacaattatgagtcagagctattgactgtgggatggcaaccccatcttttcacttgatgtcctgtccctccgctggaggaggactctacaagttccctctccccactgcacggcatttcatctaaggttcctttctttgagtcctgagattctctcacctcccaggtctctggtacattctagagggttttttcacctcctacctaaacaaagtttcctgtttccattctttttgctggtcctcagcccttcagtcctgttccccacccccacaatacctgatcatgttcctttcttcccctacttgtcccctttcctacccaggttcctccctctcccctccctgtagtatttaaaaaaaaaaaagttgcatcagcaatttttcttgcctttatttaaacaattctcaaaacatttgagtgaattgggcctcctttg

SEQ ID NO: 2692 - DNA, 1200 bp, mus musculus
gtagcagaggcagagaaaggcagagggagcaagggggaggtagataagtagatgaatagaggtctgcgaggcagtgggcatgggggaaagagggagtgggggaaaacccgcatcccgccagagttccggtgccctgggcgggcagacatataaggactgctgcacactttccacacagcccagggtaaaccccagctcgtcggaggatggacaaggggcagtcctaggtaccaagttctcagcccctggcatcccagacaccactggacaccgcgaaagagctgagaacagaatgggggccccaggggcggctcagtcagctctgggccgaagggaggagagggcaggggggaaagggaggcgctgtgtggttcccacgtgggtgagagtccttgagagtcagtgtctggagcacagaaaggccttctggagggaggttagatgtggctcgttaggggaaagcctatccatcatcgttcaagcactgcaggccttgatgagcagagacagtttatggttttaggactttattgtggaaaggcagggggaaagagagaaggtagaaagagggagagaggctggccatggccacgtggagagagggggtgggaagggagagagagaaggagagctagagatgagagtaagaaaggtgagaacttaaaaagagcaacgaggggccaagcagccccttttatagtgggctgggctataaggtaactgtggagagaaacatgcctgactatagtcaggtaactgtgggggtggagtctagccagaatgccaggagccttcgtgactgacagtcacacacctctcctgcggggactgtgggggcagtaacttcaacaggagccaggggtccaggagacaagatcgaacactttctgtcccatgtaggaggaaatcaccacccattgagtctcccggggttcaagacctatgctcgactggagaccaggctgtctgtgcgcatcccacagccctacagaggctggccatgagcacatgaagagagggaagaagggaatggggagagagaggtagcaggaaggcaagagcaagagagagagaagggggcaagcagccccttttgtaatgagttaggtatacctggctgtggggcggagcttaaacttacattaaaatgctaacatcccccccccatttttatttaattaaaaaagaaaaaataggaag

SEQ ID NO: 2693 - DNA, 1200 bp, mus musculus
gtcttactcggggagggggaagggaggttcttgtagattcccaaggaagtgtcaaaaaagcaaaatatggccagtatccatctgcttttttggggggtttctgggtaaacagtacatcctaggcatcggagctcaggtttgctcgttggttttaatatatatactgcgaagattgagatttcagttggaagacaccctgaaatactgaaagtagcacacccaaccaaccctctctaatggctagcttgtctgcacaggcagggcgattcagctctcagtggagaccagaggccatctagatggctggaagtttgtggatgatcttggggttgcttgcctcatttactggggaaaaaaatcaggaagtggctggccttcagggacactttcacttggaaaattacaacactaggaacaagtcaaggctcacacatctaccatttgcttgttgaaagcagctcatactagcaaataaaattaaacacgtcttactttttccctcacaagaacataaaaattattaaaagggaacaggaaattttaaaaaggtaacacaatttttccttttagtagtccttgggtagtttatgacagaaagtttccacttttgtttgttgctttgaatggggatttttttggtccaaaagttttgtttgttcctagtatctgcttctgcctccccctctatcagatcggcttcctccacggccaccacctcttggtgctccgcggcttgaactgctgtaggaatcacgtggaggagggtaccccctttccatagaagggggaagccctctttcttgtctgcccacgcgatcacgaccacttgagtagagatcacttcggctgcttgagtaactgtctcgacttccaccatatccgtcacgtgagctgctgtaatcatcatagcgactgcttccaccataagatggcgggggccctcgtgtaggtggagcactacgtgagttacctgcagggtcaatggtcaggtaatatggcaacactataaattgtatatatacaacatttaaatctgaatttacagaattctttgtattaaaagttcactttctcaactgggaagttttaaactctaccattgctggccataagagggaattgctcatctgctgaggtacggaaacggattgattttaatgtttgtttgaaaagactgaagacgttgtgtatttcaagagg

SEQ ID NO: 2694 - DNA, 1200 bp, mus musculus; identical to SEQ ID NO: 2693

SEQ ID NO: 2695 - DNA, 1000 bp, mus musculus
gcagagggaatgatgttgtggatgcctgcacgcgaatgcaatttgtgtttctatccaccaccttagaattgaccaaagcctttcatgataagtttcatgttaattctagtaccttgcagaaaaggtttcatatctctagggctgaagcacgagacatagttgtctcctgtgggcattgtgctgtgttccaacatcctcctccttttggagtgaatccttggggcctattgccccttcaggtgtggcaaatggacgttactcatgttcctgagtttggaaagcttaaatatgttcatgtctcagtggatacctgctcaggtatcgtacatgccacacctatgtcaggggaaaaagcaatttatgctatcaagcattgtctcgatgcctgggctgcctgggataaacctcaacagcttaaaacagataatggacctgcttatactgcaaagacctttatgtccttttgtcaacaaatggaagtgcaagtgaagcatggcttgccctataatcctcaagggcaggggattattgaaagaacccatagaaccatcaaagagatgttatacaaacaaaaggggggaataggctatagccgcacccctaagatgagactttctttagttctttatactttaaattttgtaaatttgaataaagatagccatgcagcagcagatagacatgttcaaagagtacctggcctacaaggatatgccaggtggaaagatgtgcttacaggcacatggaaaggaccagatccggtgttgacgtgggtgagagggtctgtttgtgtgtttccacaggaccagacggaacctctttggtgagacgctgcaagaatgaggctcctgatccagttgcccctgtggatgtggtggatgatcccacaagcacaaaggatggagctgagatgagagatcctttcgatattccagaagccgataccagctagacatgacattcaaatttttccacgctttttgatccctgaatccccctt

SEQ ID NO: 2696 - DNA, 1200 bp, mus musculus
ctttcatcatcatttttctggaaagtgatagtttactcattcataccctttataaattagaactcaaaatgggctctaggcttgaagcatttcagaatagaagttacataatcaattaaagaccagtgataaggcatttctcctgatggcagattatgtacctgacttgaagccaccaaaagtagagagttcatggtaagaaaatgcatatgtctaagaaccgatgctttgcacaagcaaacgttgtctgatttcacgccagagatgaatctgtagcaccagcataagtaatgctcacactgaaaagccattatatgaaagtcacaacacaggaacctggatgaccttcaaaggcatttataatatatgtggaggaagacacacttcatattattaggatagaatgaactaagttggaagagtggagagataggtaaggcaagtgataagtataaacatttgtaggactccagttatctcacaacttaaatggaatataggctatacggtcttctttaaagatttatcatcacggtcaccagaggactcttcaccccacaggcaccctagcacgtccaagatcttagaatcactggtgagtggaacacaacatctgtttcaatagagctgagggtgcctggggacagttggagcacaaacacaggaaccccaccagagcagtggttcaggttccttccagtcagtgctggtctaccttggtttagaactcagcagacagccccatggtccccagaggaggtaccacttccaggtgctctaacacacccagaatcttaggatcccaggatcccaggagcttggtcacaccaggatctcagggtctcagaagaagcttgacttccaagaactctgacatacccagaatctcagcatcacaggatcccagaatcacaggatcacaaaggaagctggattctaagaagttctgactaacctgggaacacaggaataacaggctccattcagatatattgaaggcagggaacaggagataatcagatggcaggaggcaagcataagaacagaagcaacagaaaccaaggttgcttggcatcatcagaaccaaactctcccaccatagcaagtcctgaatacaccatcacaccagaaaagcaagatatggatctaaagtcacttctcatgaagatgatggaggactataagaaggacataaataac

SEQ ID NO: 2697 - DNA, 1400 bp, mus musculus
tgctacgttctgatgatggtgagtggtcttgatttctgttagtaggattcttacgtttgcctttcgccatctggtaatctctgaagctagctgttttagttgtcactgttaagagcttgttcttcaggtgactctgttagcctctataagcagacctggagggtagcactctccttagtttcagtgggcagagtattctctgcaggcaagctctcttcttgcagggaaggtacccagatatctggtgttcgaaccagactcctggcagaagttgtgttccactcactagaggtcttaggatcccgtgtggaatcctgtgtgggcccttgcgggtgtcaggcgacttcgctggcaaggtagcccggggctcgagtggagcggaaggggcttgtgccccagatcaggcccgggtagcctgcttccctatgtacggcagtctcaggttctgcgcgattggattggggcaggcgctgtgttccacttaccagaggtcttaggatcccgtggggagtcctgtgtgggcccttgtgggtgttgggcaagactctgctggcaaggtagcccggggctcgagtggagcgggaggggcttgtgccccagatcaggcccgggtaccctgcttccctatgtactgcagtctcaggttccgtgcgattggattggggccggtgctgtgttccactcaccagaggtcttaggatcctgtggggaatcctgtgtgggcccttgcgggtgttgggtgagactctgctggcaaggtagcccggggctcgagtggagcagaaggggcttgtgccccagatcaggcccgggtagtttgcttccctatgtactgcagtatcaggttccacgcgattggattggggcaggcgctctgttccactcactagaggtcttaggatcccgtggggaatcctgtgtgggcccttgcgggtgttgggtgagactctgctggcaaggtagcccggggcttgagtggaacggaaggggcttgtcagagtcacagttttaaagtcaaaattagagtcacatcccaagactgaaataccaagcctttccgagattgtgatcttttgcaactgtaccaatcacatgattgtgaagttggttcttttttttttttttttttttttttctatttgctagtaaaatttacaaaatacatgtgtgttagaaatatacattttctattttaaaacataattcaaagttctactcaaatattgtagctttaaggtgttatactcacatttaaagtttatttttttttccattttttattaggtatttagctcatttacatttccaatgctataccaaaagtcccccatacccacccacccccactcccctacctgcccactccccctttttggccctggcgttcccctgttctgggg

SEQ ID NO: 2698 - DNA, 1000 bp, mus musculus
cagaggatggcctgttgggcatcaatggggggagaagcccttggtcctgtggaggcttgatgtcccagtgtaggaggggtgctgaaggagtggggccggagacttgagtgggggagcaccctcgtagaagcatagggaaaggggatgggatagggggttgtggaggggaaaacaggaatggggataacatttgaaatgtaaataaaataaccaagcttttaataaagaagagacgcgtcttgagagcaaccgtgtccacagtgatgaggtaagtgcctagaacaaagaaatgcttaaatgttaataatatcaataaattaataagtactttaagatgtagccacaattttttctataagcaaggatttacatattattaaagatagctagccttttgttttcaacaaatattgaggattccatattccattccccgcccttccacatccaacctctgactgctccacatcccacagctcctccccacccaacccggtctccatgtggatgctcccactccccaccccacctgacatctaaactccctggggcctgcagtctcttgagggttagatgcttcatctctgaatgaacacagactgggcagtcctctactgtatgtatgtttggggtctcatagcacctgatgtatgctgcctgtttggtggtccagtgtttgacagatctcggggttccagattaattgagactgctggtcctcctgcaggatcccccttctcctcagcttctttcagctttccctaattcaaccacaggggtcagcagcttctgtccactggttgggtgcaaatatttgcatctgattctttcagctgcttgctggatctttcagagggtagtcatgatagcccatcccccatttcccatcccttatcctctgaggatatgtgctttccctgggtgtgcccctaccctgacaatatccaattttttgtgggtttaatttttatgattataaaaaatggcatactcataatta

SEQ ID NO: 2699 - DNA, 1000 bp, mus musculus
gaaatagattactcagctttaagtagtcaaaccaattttaggacatagacagttaatatctcccagcgacttttgaaaatcattaagagctctgaattagtctctcctggtttgtaccttctgtggttgaatttccagcagatttaccttatatcctagataattaatagaatctcctccttgtattgtttcaggagcaatttgtaaaaccaaaaagtcaaaactctctgtgcttcattaaacattctttctttctaaagtgtttccatatgaattcatcagcaaaatatcatccatacaatggtaaattatggattgaggaaattgcttacagaatttttccaatggatgttgtacaaaatattggcataaggtagaactattcaacattccttgtggcaagaccttccagtgatgtgctttgaatggcatagaatggttaaatgtgggcattgtgaaagcaaatctttatcttgttcctgtaaaggaattgttcaaaagcaatcttttaaatcaatcactatgatagcccattacttaggtaattcagaaggcaataggattccaggctataaagaaccaattggctgaataattttattaattgctctcagatctgtcaacagtctccatttgctagatttctttttcttgacaaagaattccaagggttggtggactcttctacaattgagcttccagtttttcttagactagctgttctagtatatgttctttttcctttgtcatagaccactgctcagtccaaatagcttggtcagttaaccactttagtggtaaggccattagtgttttatcagcagtggcctccctcagctaaaattgaagagtcagtctctgctgtatcttgtttatagacagcctggacagcatgtaactgtctttgatagcatgtttaaatttattttatcaagaatattatctcttttatgtcttgtttctgaagttggagggatgctaattgtgttttctgttgtaa

SEQ ID NO: 2700 - DNA, 1000 bp, mus musculus
tagacaaaatcgtcccttgacttgatttacaacacatatatagacataaagaagacagggaaatgtaattagtagtcaagaaataagcaggtggtcaattttttaaaaaaaatctgctatagtgaaaaattatgaagcatagataagtttttgataaactgagaaaatagaaaaaggaaacaagccttctgatctgtctgggccagtgccctgagcataccttgggcacaaactcagcagccagccacacaacacccagaggcagttccactcctaagagctccaacatgcccaggatcagagggtcagaggtgaggaggacacaacatctgttcccaacactgggatgattgggaatggtgagacccaggcaggcaggaactccatcagaccagtggcatgggttccttcctgtctgtctgggcctgtaccctgagcagaccttgggcacaaactcctcagccagccccacaacacccagaagcagctccactctcaggcactctaacatgctcaggatcagagaatcacaggatcccaggagcttggtcactccaagatctcaaggtctcaaaggcagcttgactcccaggagctcaaacaggatctcaggatcacatgatcccagaatcacaggatcacagacaaagcttgactcagagttctgacacaaccaggatcacaggaaggacaggctcccattagacatagccagagaggtagcactagagataaccagatggcaagagccaagcataataataagcaatggaaaccaaggttacttggtgtctccagaacccaattctcccaccttagcaaatcctggataccccaacacgccagagcaggattcagatctaaaatcacttctcatgaggatgatagaggacttggtgacagcagatgctggcgaggatgtggagaaagaggaacactcctccattgttggtgggattgcaggcttgtacaaccactctggaaatcagtctggcggttc

SEQ ID NO: 2701 - DNA, 1000 bp, mus musculus
cttccttccttccttccttccttccttccttccttccttcctttctttctttctttctttctttctttctttctttctttctttctttcttttatcattttttacagtccagacattatccttcaccaggcctgccctctggatgttccttatcccataactcttccccaatctccaagaggatgtccctacctgtctccctcatcccaccatacctctcaagtccctggagctctccagggttaggtgcttcttctctcactgaggccagaccagacagtcctctgctgtatatgtatcagggccctcatatcagtcagtgtatgttgcttgataggtgactcagtgtctgaggaatctcgcgggtacaggttagttgaaagggctagatatatcatcctatagggtctcattttctttctttttttactagatattttctttatttacatttcaaatgttatcccctttccaagtttcccctccgaaaatcctctatcccctcctcacctccccctgctccctaacccacccacacctgattcctggccatgttatttccctatactggggcatagaaccttcacaggactaagggcttctcttcccattgatgaccaactaggtcatcctctgctacatatgcagctggagccatgagtcccaccatgtgtactctttggttagtggtttagtcccagggagctctggaggtactggttagtgcatattgttgttcctcctatgaggcttcagaccccttcagctccttgggtcctttctctagctccttcactgaggaccttgtgctccatctaatggatgaatccactgtgagaatccacttctgtatttatcaggcactggcagagcctctcaggagacagctatatcaggctcctgtcaataagctcttgtttgcatccacaatagagtctggtttgggtggttgtgggacttgttgctctagacatatatgccccagtataggggaatgcca

SEQ ID NO: 2702 - DNA, 1800 bp, mus musculus
actccccctttttggccctggcgttcccctgtactggggcatataaagttggcaagtccaatgggcctctctttccagtgatggctgactaggccatcttttgatacatatgcaactagagtcaagagctctggggtactggttagttcatattgttgttccacctatagggttgcagttccctttagctccttgggtaatatctctagctcctgcattgggggctgtgtgccccatccaatagctgactgtgatcatccacttctgtatttgctaggccccggcatagtctcacaagagagagctatatctgggtcctttcagcaaaattttgctagtgtgtgcaatggtgtcagcgtttggatgggtttataattcacctggaagaataaaggatggtagtaggagcaaggaccggggaggagaaacaaaaggttgttattaactagatcttatattgtatgtgaaatgacataataacaatctgataagatgaagatatgctcaattaattgctaaagcacagatatagtaagttagcaaagggaataaaatgaaatcataaatggatatgcataaataaggtagaacattgatgaaaactataattttttaaagatttttttatttcatgtatatgagcatactgtagctgtcttcagacacaccagaagagggcatcagatcccattatagatggttgtgagccaccatgtggttgctgggaattgaactcaggacctctggaagagcagccagtgctcaacctctgagccatctctccagccccccaaactgtaatttcttaactaaactgctgcatacaaaaactgaatggttgttccctacaactcctcaaagaaggacagaatttaattgggtcttgcttacagtttcagaagtttagtccattatcataatgtcagggagcatggtggagtgcaggcaggcactgaagcagtagctgagagttacatctgcatccataagtagagagaacctgggcctgccttgggcttttcaaacctcacagcccaacctcagtgacacactttctccaacaaagctacccctactctattcttactcaaaccaccatgtaccctgagtagtgaattaatttttccctatgcatcatgaagtatgtgaaactgttgtgctttgcaactgaaaattgagcaaatgtgctgttttgtaggtttcgctttttgtttgcttaaagtaattactatttagctgttttaaagcaaatacttttttagttttttaaacttaaaaaaagattaaaaaaatttattctatatgtttgagtatactgtcactgtcttcagacacaccagaagagggtgtcagattccattacagatggttgggagccaccatgtggttgttgggaattgaactcaggacctctggaagagcagtcagtgctcttaaccactgagccgggtctccagctcaaagcaaatacatttaaataaaactatgttttccttttcatagtgaatatcttagtcatccttaatacttgaagtgtctgagcacatttttataagagggaggaagtaaaccaacatcactgtctagaggattgtgatttgacctatggtctgttatgagaatgttctataatatgtccttttctatcagtcttcatccaaccttaatagtttctgaaaatgttgaggcatggattttaaataactcataagaaatatattttgttacagtatagaaatgttataaaagcatgagagtatggacctaaagtagatatgaagacagacagaatgaaccact

SEQ ID NO: 2703 - DNA, 1000 bp, mus musculus
tcagatacatacagaagtgttgctgagaggtaagtatatagcaccagatacttaaaatagaaaggaggaaagaccttaagccaatggtgtgatcgcctcagaaaatcaaatattactgttctataaaggagcatagcaacaaaatgattcctcaaggcattttgctatatgcatagcttagtgccttgctcagctatcatcagagagcttcctccttcagtagatgggagagagtgattacagagacccacagctggataatgttcagagtgtgagagagcttgaggcaactggtcctaagtgggatgcctctgtcaacttcttcctgttggggctcagagaatcctatggaagaggaggcagaaaggctgaaagagccagaggggatggagaagaacagggaaattaggccttctaaacacagcacaatcaatgcacatatgaatttagagtctgtggcagcatgaagagggcctactcacaggttcttacctggtgggtcccagctctgagagaggaatggacagaagcctccatccctaactcagaagctatctccaactgaaaaccactagcaaattaaaatttagctttcaccaagggagtctctctggggaaacaaaggactcttaagggtaggcccaacaggagatgtcaacagaaaatgaacttaatggtatttttggaggtttttttttctatccaaccctacaggttttttgcttacatattattgtttctgatttgtgtttttaggggatttctatatgtgccaatgtatgtgtctccatgtctgtgtttcctgtgctttttcttggctctttttttctattcatttgtttgttttgtcctattcaggtttatttgcttttatttagttgtattattttcttcccacccctccctccctccctccttccttccctccctccctcccttcctttcctccttgctgatgcctgttttcaaatgagagagcaggaaagggtgtggatttgaa

SEQ ID NO: 2704 - DNA, 1000 bp, mus musculus
tgattctccagtttctgcctctgtgtgttcattctctcatttcctcccccacacctctgttccagtgtacatgttactgagaaaaccagggccttgtagatcctatgcaagtgttctaccatgaagttttatcttcaacctgaccagtatatatttttatagagtgctagtataaatctgcacacaaagtaatggattttactatgtgttttcctatctacagttttactttgttcatatttatcttctctccaattgcttccccacagccccatatttttctttcattggatattttctttacttacattttaaatgttttctccttctcaggtctcccctttggaagctccctatctcattccctctccctctgcctctatgagggtgctcctccacccacccacccactccctccttctagccctggcattcccctacactgtagcatcaagctttcacaggaccaagggccactcctcccattgatgcccaacaaggccatcctctgccacgtatgcatctgaagccatgagtccctccatgtgtactctttggttggtggtttagtccctgtgagttctgggggatctggttggttgatatttaaaatgttgcattttatcattttttaaatgccattatcaaggctagccttgaaataacaggcacaaagtgattctccagtttctgcctctgtgtgttcattctctcatttcctcccccacacctctgttccagtgtacatgttactgagaaaaccagggccttgtagatcctatgcaagtgttctaccatgaagttgttcctcctatggggctgcaaacatgttcagctccttgagtccttcctcaaactcctccattggggacccagtattaagttcaatgtttggctgcaagcatctgccaatgtatttgtcaggcactggcagagcctctcaggagacagctatatcaggctcctgtcagcaagctcttgttggcatccacaataggtt

SEQ ID NO: 2705 - DNA, 1000 bp, mus musculus
tttcattgtgtaaatgaaccacattttctgtatccattcttccattgtgggatatttgggttgtttccagcttctggctatcacaaataaggccgctatgaacatgtgcccctgtggcatggtggggcatcttttgggtatatgcccaagagtggtatagcttgatcttcaggtagacccatttccaatttcccgaggaacctccagatttatttccagagtggttgtaccagcctgcaatcccaccagcaatggaggagtgttcctttatctatacatcctcaccagcatgtactgtcacctgagtttttgatcttagccattctgagtagtgtaaagtggaatctcagggtcattttgatttgcatttccttgatgactaaggactttgaacatttctttaagtgcttctcagccattcaagattcctctgttgtgaatcctccatttagttctacaccccattttttgactggattgtttggttctttggaggttagcttcttgaattctttatatatattggatattagccctctatccgatgtggacaagttaggggcagaggaagggagggaactgggtgggaaaggaggagcacaatcaggtattgggggtggggaaacaggagttaagccctgagggccagcagaaagaatgaaaacaggcaaccttgggaggtagaagctgtggtgactctctagaatgtacaagagacctgggaagtgagacacacaggactcaaagatgaaacaccctacagtggggagagggaaactgtagagtccacttctagtagaaagatagggcatcaagtggagggatagggttgccatcccacagtcaaaaactctgatccaggattgttcctgtttaaaagatctgcacggacaaaatggagaagagattgagggtaagaagggccagtgactggcccaactggagatccatttcagggggagtctccaaggcctgacactactactgatagtgtcacaca

SEQ ID NO: 2706 - DNA, 1000 bp, mus musculus
ttaactttaagagtgaagctttaaagtccttgtaagcataagatgttcaaataaaccatggtttcttgaatatcacttcaaaaacacatgcaaagcttacaaattgcacttcaccagtctttaaaaaaatacatactacatactttaaatagcagaaaactagcccacaggctagggaaatgtgtgtcagtcatacatctgaagagggacttggatgcagacattagatatcaggaccacttacagtttggatataaataagtaaggaactgaagtgatgaaaggagaacagatttaaaactgccattttccttagaggctatgcaaatggtcaggaagaggaaaagaagcccagtgtcattatcatcaggaaattcagttcaaaaccataatgaacaagatgggttgctcatgcctgcaacctaagcacttgagattcttagaccctgagagctctgggtatgagggagggatctggttggttgatattgttgttctttcaataaggttgcaaaccccttcacctctgtcagtcctttccctaactcctccaatggggtccccaggcttagtccaatggttgactacgagcatccacatctgtattggtctggctctggcagagcctctcaggagacagctatatcaggctcctgtcagcaatcacttcttggcatccacaatagtgactgggtttggtgtctgcctcagtgtaggggaatgctagggcagtgaggcaggagtgggtggttgggtcagggagttcccccatggaagcagggggagggggagagaaggtttgtggaggggatgtggggaacagtgataacattttaaatgtaaataaataaaataaccaattaaaaaaaacagaatcttagacgtgagagctcacatgtacatggccaaattgggtcacatatcatgagcttgtcacaagtaaacacacaagcaagcaaacataagtggatataacctcatatctcccaagatcgccgaa

SEQ ID NO: 2707 - DNA, 1000 bp, mus musculus
aaactctcctttggagggttttttttttccatttttttaattaggtattttcttcatttatatttcaaatgctatcccgaaagttcactataccctccctccccccgccctgctcccctacacacccactcccacttcttggccctggtgttcccctgtactggggcatataaagtttgcaagaccaaggggcctctcttcccaatgatggctgactaggccatcttctgctacatatgcagctagagacatgagttctgggggtactggttagttcatattgttgttcctcctataaggttgcagaccccttcagctccttgggtactttctctagttcctccattgggggccctgtgttccatccaatagctgactgtgagcatccacttctgtgtttgccaggcactggcatagcctcacaagagatagctatatcagggccctttcagcaaaatcttgctggtgtatgcaacagtgtctatgtttggtggctgattatgggatggatccctgggtgggacagtctctggatggtccatccttttatctcagctccaaacttaatgaatttatgaaattcctttggaattttatgaggctattgatgatcaattaagccttcagcccatctttactgtctgaagctgctagaacaagcagaccttagatttctaattgtgctgtgaactttcttgttcctgaagctatgtagagctctctcatcattttaaaaatcccaagagttttagaggttgtattccaggaagctatttgttataccacagtaccactgtctttcttatctgttgtgatctccctagagaccataggttggcacataacaggtgcttaataaatagtcaacaattgaggaaaaaaaaacaaattgtcttgtatataagttaaagtagcatctttaattacattttcctttacttctttttccaaagagaggacagaaagataaagtaatcttgaggtctaacagtcacatcaa

SEQ ID NO: 2708 - DNA, 1000 bp, mus musculus
agaaactgccagactgatttccagagtggttgtacaagcttgcaattccaccaaaggccttcatcttctgccaggaggcaggtccgaatgccagatatctgtgcaccttccctgcaagaggagagcttgctctaaccactgaaactcaggagagagctagtttcccaggtctgcggatagaggagttgttcttgattcctgttgtaacttaaagagaagcttacacaatgtttggagcccttgaagtcctaaagatgaataaggagggtgtcctcaaatttcttggtacagaaacccacttaggtagcaccaaccttgactttcatatggaatagtaattttactaaaagaaaagtgatctatgtcttaatctgaagaggacctgggagaagctgttgcttgcatgcaggtcctgctattgtccttgataatcctgctgatgtcatttccagaaacactggccagccagtgagctgtgctgaagctttctgctgccacaggagtcactttcattgctggtctcttcatacctggaaccctcactaaccagatccaagcagccttcagggagccacagcttctagtggggactgatcccaggattaaccacctcttatgtcaacctgctcaccttgctctatgtaacacagattctctcctacgcaccatgtgagcattgccatctcgtgcagcaacaagggagctcactcagtgggtctgatgtggtggatcttggtccagaagtactctgcattagaggtactatctcccgtgaccacccatgggaggctatgcctgatctttacttttacagagacccagaggaagttgagaaggctgctgctgaaaaggctgtggtgaagggtgaatggatggaccagctcctgagttcactgctgctcagcctgacatggctgactggtttgagagtgtgcaggtaccttctgtgcctatctagcagccccacccccatggaaaactagagttccctgccaaccac

SEQ ID NO: 2709 - DNA, 1600 bp, mus musculus
atatttgtgtcttgtagattcgataaaaatcacatagtttgtgttaataacttatttaaccacaagtgatttgtaataaaaagtgagaaagaagacattgaagtatcttttgtgtaacaaaacaagataggcatacaaatttttgtcctttcagatataaggatagtacaattaacatatgcaaataacttagaaatcaaaacatgaaaacacaggcatagtaaatgatgtagtttgcattatcagtaatggtgggaaaatggtgctataccaaaccctcccccttctccctttcattgtctctgctcccagttgccctcatggactctatcagccaatgatacctgaaggcaaggagagtcaactcaactcagcactaaattcaggatacctgttcaattttcatagcctttccatttaagatacgatgatgatgattatgatgatgattatgatgatgatgattgtgatggtgtttatatgcttggcccagggagtggcactattagaaggtatggccttgttggggtatgtgtgttggggtgtgggcttaagatcttgattttttttttttttttttttttttggtttttcgagacagggtttctctgcatagctgtggctatcctggaactcactctgtagaccaggctggccttaaactcagaaatccacctgcttctgcctcccaagtgctgggattaaagtcatgcaccaccactgcctggcaagaccttcatcttaactgcctgcaagccagtattctgctagcagccttcagacgaagatgtagaactctcagctccttctgtatcatgcctgcctgaatgctgccatgttcccacatgataatggactgaacttttgaacctgtaagccagccccaattaaatgttgtccttgtaaaagttgcttcagttatggtgtctgttcacagcagtaaaactctaagactatgatgataatgacgatgaagatgacagtgacgacgatgacaatgatgatatttggctttttacagataggacctcactatgtagtagctcttgctgtcataaaactcaccatgtagataagactggcctctgatggaattaaaggcatgttccactatgctgtgatttccattccagatttaaattcaagcaataaagaatgtgttcactgtgtttcccatgtccacccctgggttaataagtatgactaatgaacctgtatcctataatatgagcgtgaacactggaacttatcaacccctacatgctgaaaacattctctgaggaattgtagactagggtgccactctaagtaagaagtgtttactatggatcagagcagttaaaagatgagtcagtcagcatttagcaaatataagcaggatgaagattaaagtttaggccagcctgaactacatgaaacactgcctcaaaaaaagccaaaaagaatgactaaaggagagagacttttcaaacagcaaacagcaagacttgaaagctccttattttttactttataacttttgtcttaaactactgaactttcttcctggcaagaattttgacagaaagcaatttttatttatctaggaatttagaaatgt

SEQ ID NO: 2710 - DNA, 1600 bp, mus musculus
cctgcagaagaggaaaaaacagagtctaatcaggaggttgctaacccagagcactatattaaacaccctctacagaacaggtgggcactctggttttttaaaaatgataaaagcaaaactaggcaagcaaaccttcgattgatctctaagtttgatactgttgaagacttttgggctctatacaaccatatccagttgtctagtaatttaatgcctggctgtgactactcacttttaaaggatggtattgagcctatgtgggaagatgagaaaaacaaacgaggaggacggtggctgatcacactgaacaagcagcagagacggagtgacctcgatcgcttctggctagacactgctgtgccttattggagaatctttcgatgactacagtgatgatgtgtgtggagctgttgttaatgttagagctaaaggtgatgagatagcaatatggactactgagtgtgaaaacagagatgcagtcacacacatagggagggtatacaaggaaaggttaggacttccttcgaagatagtggttggttatcagtcccacgcagacacagctacaaagagcggctccaccactaaaaataggtttgttgtttaagaagacaccttctgagtattctcacaggagactgcgtcatgcaatcgagattgggagctgaaccaaagcctcatcaaagcagagtggactgcactgaagttgattccatccaagtgttgccaagatataagagaagtctcattcgcctttgtcttgtacttctgtgttcattctcctcccccacccccaatttttgctagtgtgtccactatcccaatcaaagaattacagtatacgtcaccccagaacccgcagatgtgttcctggcccgctctgtaacagctggttagaattaccatgacacacacatttgcctttccacagtattcgaaaaagaacttgcatttctattaccttagcaggaaagatctggttttgctccactccatgcaggagcggactttgctggtgtgagagtatgagtacagctttctagcaaccttttgtttcctttcacagcattgtccttgctgtcctcttgctgatggctgctagatttaatttatttgcttccctccttgataacattagtgattctgatttcagtttttcatttgttttgcttttgttgttttcctcgtgtaacattggtgaaggatccaggaatatgacagaaaggtggaataaacattaaatttgtgcattctttggtaatttttttgttttttgtaactacaaagctttgctacaaatttatgcatttcattcaaatcagtgatctatgtctgtgtgatccctaaacataattgtggactataaaaatgtaacaccataattacattcctaactagaattagtatgtctgcctttgtatctctatgctgtactttaacactttgtattcttaggttattttgctttggttacaatggctcaagtagaaaagtggtcccatccatattaagacagtgtacaaaactgtaaataaaatgtgtacagtgaattgtcttttagacaaaaaaaaaaaaaaaaaaaaaaagaggacaaaacatt

SEQ ID NO: 2711 - DNA, 1000 bp, mus musculus
ttcacctatttgtttgtattttcctgtatttctttaaggagtatattcacatcctatttaaaggcctctataatcttcaaaaggtcattttcttgtattaggtgtgttaggatattcagctattgctgtagtaggagagctgtgttgtggtagtgccatattgccctaacttttgttgattatgttaaattgccctttagctatctggttgttcgtagtattgacaggcatggtagtccttggcagaagtagaccactggagctacagaaagagctggtagaccttgttgttagcaggcctctagttttgcaggtagagctgcttgtccctggttgtagcatgttttcagggattcaggcagaagtagtagaccctgatggcttcaggctgctgattgtcccatgtgaggtagtctttcaagaacacaggtaaagctggtggtccctgatggttgcaggctctatttgtccaatgtagcagaagatattcatggatgtatatggagctgtggccccagaaatggagtacagaagaggcaaggcagagctcaccattgctggatttgtccagaggagctgtcaggtagggaattgggggtatgggtctcacctggtggtccctgatggcatcagatgtctgaggttgtagttttagaggtatgtaactggaagatggagcacaaagttgtcagagaagatctcaaggctgctaagcttgcctaggtccccacaggctggcttttggggcttgggtaactcagctggttggccctggcagcagcagacttctaggaatgcagtcatagatgtgctcagggaaattgagtgtagagggggcagagcttgctgctgctgcgattgacatgcagggcatggagacaaggctttcttcaatattttgagtatatattatggaaagaaaataaatacattgttacccattttttttaaatcagagcttaatgaagcttactatttagatgataaggctaacaatatg

SEQ ID NO: 2712 - DNA, 1000 bp, mus musculus
gagtaactgggaccagcatgaccaaggcacacaggaacaccaccagaccagtagcatggatcccttctagtctgcctgggttggtgtcctgagcagaccttgggtgaaaattctgcattcagccccacaacacccagagtcagctctactcccaggcccagcatcacaggatcacaggattccaggagtttggtcacaccagaatctcagggtcccaaaggcagcttgactcccaggagctcggacaaacctaggaactcaggatcacatgatcccagaatcacaggatcacagatacagcttgattcggaagagttctgacacaaccatgatcacaggaaggacgggctcccatcagacatagccagcgcaggtagtactagagataaccagatggtgggaggcaagcataagaacataagcaatggaaaccaaggttacttggcatcatcagaacccaattctcccacgatagcaagtcctggataccacaacacacaggaaaagcaagattaagatctaagatcacttctcattatgataatagaggacattaaggacataaataattcccttaaagaaatacaggagaacacaggtaaacaggtagaagcccttaaagaggaaacacaaaaatccattaaagagttacaggaaaacacaatcatacaggtgaaggaaaggaacaaaaccatccaggatctaaaaatggaaataaaagcaataaggaaatcataaagggagacaacccaggatttagaaaacccagggaagtgatcaggagtcatagatgcaaacatcaccaagagaatacaagagatagaagagagaatctcagatacagaagatactgtagaaaacattgacaaaacagtgaaagaaaacacacacacacacacacacacacacacacacacacacacacacacacaagctcttaacccaaaacatccaggaaagacaggacacaatcagaaggccaaacataaggataatatgc

SEQ ID NO: 2713 - DNA, 1000 bp, mus musculus
gctttaagggattcattttaggaaaaaatcctgctattaatatacttttcctgctattaagcatatataataatcactcagtaatagcacaaccatttggagtagatctctgcagatccaggaagatgtactgtcctatagtgatgctatataaatagatgacttaagtttttataatgatcctataagaattcctaaaattatatgtgattattattttttttagtggggctgctattaggtcctttactttttctcttttttttaattctttttttttaaaatttgtaattgttttatttttgctctcttggatactttttgggggggttacattcatgtcttcttttttgattttttaaaatttattaggtattttattcatttacatttccaacgctatcctaaaagtcccccatacattcccccgactcctctacccacccactcccacttcatggccctggcattcccctgtactgaggcatataaattttgcaagaccaatgggcctctctttccactaatggccgactaggccatcttctgatacttatgcagctagagacatgagctacggtgggtactggttagttcatattgttgtttcacccatagggttgcagacccttttagctctttgggtactttctctagcttctccattggggggcccagtgatccatccaatagctgactgtgagcatccacttctgtgtttgctaggccccagcatagtctcacaagagacagctatatctgggtcctttcaacaaaatcttgctagggaatgcaatggtatcaaagttgggaggcttattatgggatggatacccgggtatggagtctctagattgtccatccttacctctctgctccaaactttgtctcagtaactccttttgttcccaattctaagaaggggaaaagtgtccacactttggtcttcattctttttgagtttcatgtgttttggaaattgtatcttgtatattggtta

SEQ ID NO: 2714 - DNA, 1200 bp, mus musculus
cacagacaagaaagaggaagagaaagaggaagaggaagagaatctcctgaggagaggatagctgaagagttgccttcttcagataggcctgtgagcatgtccatggaagcatcttcttcagtaataattgatatggattgtcccagcccattgtgggtggtgccaccagtttggcaagtgcttccaggttgtacaaagagataaactgagcaagctaccaccacagagaataaggagagtaagcagggtttctctttggtctctgcttcaattcttgcctccaggttcctgtcctgcttaacttttaaaatcacatttctattatcatcgctctctatcatcaatcctttcattctcacatccttcctctcatcttctactctctgctgatgctgtgaataacttttattgtacttgaaacatgaaaattccagacagttctgtcttggctctttattatttatccctacgggagtatgttttcaaaagcacatattgtgtggctgttattcaattatatctgtagatcaatatatctaaaaatgaagaaaaagtaaagttataaccattcagggaataggatatttaagtgtaaaactagagaaaaagaaacagcttttgttgcttgggagatctgtggaatggttctgtgagtgagtgccttaaaaagtgtacatatggtgaaccttgacaaagagtcgtgtcattgaggaatgtcctagtccctggtacaaacttctgtctttgttagaatttctattactgtgaagaatcatcataaccacagaaacacttgtgaaggaaaatatctaattggctgacagtttagaggttttagtcaattatcatcatagtgggtcacatgacagtgtgaagacagacatggttctggggaaagaactcagagttttgcacatccagattggcaggcagcaggaagagaactggtttgagcatttgagatctcaaagtctgtctccacagtgacacatttcctccattgagaccacacctaactctaataaaggccacgccttctcataatgccacagcctatgagccaagcattcaaacacatgagtctatggggcatttcagttcaaacaacaacaggcagaaaatgtttgcttgagtaattgcagtttgatgactgttcaatagaagtttaagcaataaattacagtaccttaatagttaaga

SEQ ID NO: 2715 - DNA, 1200 bp, mus musculus
ggttcagaaaaattactgaataaaacaaatgtgattacaacaaaataaaaaaaaaaagacttgacagagcgaattaaactaaatctgaattctgaaacgtataaataaatttaaaagagctatagttttaataaaataatgagaaggcataaaatgacccaaattgaatgatatatacataattcccaaatcaaacgctatcaatagaatgagatacctgtatattagatattttagattttggtttggtttgtttttctatttgtttgtttgtttgtttgttttgttttgttttgtttttgaggcagggattctctgtgtagccctgactgtcctggaactcactttatagaccaggctggcctcaaactcataaatccgcctgcctctgcatccttagtgctgagattaaaggcatgcaccaacactccctgtttttagattttttttttttttaagaaagggtctctatatcgctgtggatatcctggaatacacattgcagaccaggctggccttcaactctgagaacccagctgcctgtgcctcctaagtactagtactaactaaagttttgcgccattttgcctgggtcatattaacagtcttaatagattaacaccttcaaataatcaatgatgctttttcagtcttcaggtgattagaatgtacatagacatatgtactacagcactacatgtacataaccatatgtactaaagcattcttttcaagttgcactgtgatggtaattttctggagattcacatgtgacttaatgaattgaatggagaagtttcaccatgaaaattacaaggctccaaataatcacctgaataagtttgagtagaacaaagaaataaagtaaaaggccatgttttctagaaatagtatatgctttttctccttcatttagatatataaaaaaaaatcacatatcttctcccttttggatttctgaagttagtatcattgccctcaaagctctcaagcattcatccctaatgaagagtagcattataggcttcttttgtcccaaagtccttaagcttaaagtgaggcttctacctgcatctttaaacttccagcttgcagattacttgttataggatgactttgattttataattgtcaacatcactaataacttcttttcttatcatctgtatgtctacctatctacctaaccattcattgtat

SEQ ID NO: 2716 - DNA, 1000 bp, mus musculus
tatgttcctatctctgggctggtagtcttgggttctctaaaaaaaagcaagctgagtaagccaggggaagcaatccagcaggaagaatccccccatggcctctgtatcagctcctgtctccaggttcctgccctgtgtgagttcttgtcctgatttcctttgggtttgaatagcaatgtggaagtgtaagctaattaaacccttttctccccaacttgcttcttggtcatgatgttttgtgtaggaacagaaaccctaagacacaggctatgttgagctgcctgatatggattccagaaactcaaccttgttccatgtgaaacaaatttaagtcatctggaagagcaagtacccttaagcactgagctatctccccagttccaattaaatatttaaaataatttcactaaagaaggatgttttctttcttttttactggatattttctttacttacacttcaaggatttttccctttctaggtcttccctctggaaactctctagcccattccccctccccttgcctcaatgagggtgatttccccacccacctatctacacccatctaactgccttggcattcccctacactgggacatcgaacaccttcagtcccaagtgcctttcctcccacggatgtccaacaaggccatcctctgccacttatgcagccattgccatgggtcccttcatgtgtattctttggttggtggtccagtccccaggagctccgcggggggaggggtctgcctttttatccctgctgctccctccatgaggctgcaaaactcctcagctccttcagtctcttcttcaactcctccatcatggagccctgcattcattccaatggttggctgtgagcatctgcctctgtatttgtcaggctctagcagagcctctcaggagacagcagtaacagacttccatcagcaagcacttccaggcatccacaatatcattcaagtttggtgaatgtatatgggctagatccccaga

SEQ ID NO: 2717 - DNA, 1200 bp, mus musculus
atttgctaaacacatgaaactcaagaagaacgaagaccaaagtatggacacttttccccttcttagaattgggaataaaacacccatggaaggagttacagagacaaagtttggagctgagacgaaaagatggaccatctacagactgccatatctggggatccatcccataataaggttccaaatgtggacaccattgcatacactatcaagattttgctgaaaggacccagatatagctgtctcttgtgagactatgctggggcctagcatacacagaagtggatgctcacagtcagctagaggtaaaaatgattgtactgtgattaaaaaataaaatgatacatgatatttaatatttgatattttatatcaccattacaaaagtgttaactgtgtggtacttcacagtaagcccataaaatatgtccttgtgtatttatcttttctccactgtgaagctaccctcctttagttcttcttgcctgagaatatacataaccataaacaacaacaacaactgtggggcattgggctatacacagaccatctggtctccagttgagctgagatgctgaacccaagatccagtggtgataattcacctacaagggacggaaggagttctctcatgtctcctggaccctggctgctctctaagttactgcctcctcagcccccacaagagaagcatggctagaagtcaactaggcaatgtctcaagcttctgaccttcaggctaaattcctccccccagttacctagcaacagaaaagatacagcataccataagagaggctgtttggccactcctcattctcttgctttcttccttttattcccctcactctcctctctcctctcactctcttcctctctctctccctcttcctctctagtctttcttctctctctccttttcccccttctctcctcttggccatggctggtctctctctctctctctctctctctctctctctctctctctctctctctctttctctctctctccaccttctctcttttcccttctgcctttctacaataaagctctaaaaccataggctctctctgttcatctgcattaaacttagctgggtgggatcttgaccttccatcataactccctaaatttggtagtacagccacctttgttctttagatatgtgaatctccttatccaattcatatttcatc

SEQ ID NO: 2718 - DNA, 1000 bp, mus musculus
ctaaggaaagtatttcatactcacacaaagttaaatgatattagtatttccataaacactgataacaaatgtgcagatatcagataggaaatatgtttaacatatttaacatgtttaaaatatttgtgcatatttaacacaagccagtatatggtattgaaacctgacaaaaatagctgggtatactggtgctaatatgtagcaggcatagtaatataattcaagcttttttaatagggaaattgaagagaggtggcactacctggcaatctatttcaaaacaaagggaaaagataaaaaaaaatgaatctataaatctcaaattgggtcccaagaaggctcactttcctaaacatcagacaaaagaactaaatatcctttgaccatatctttatatatactccaaacatactataatgaatgtttttgaaatttttatttaaatatacattttgcttaaactataattacatcattttcttcttcctttctcccttgaaccatttcagtgtgttttcttcttattctcacaaatgtatggtctctttttttattgttaatgttacatgtaagtacatatatatatatatatatatatatatatatatatatatatatcctgttgagtctgttttctattgcttacctgtaatgattgttttgctttgtaattgtcacagtgctataagaaccttgtgtgtatcacatatttcattattatccaagaaagcacagagacagtttatatcagaaaacaataaaatacttagtacttaacattagtaacttttagtggtggtttgaatgagaaatgtccctcataagctcacttatgtgaatacttagttgttggtgctgtatgggaagttttagttggaggggcctggtggaggaagtacgtaggtgttgagttttgaagattcataacaagaaccagtgtgaatctgtgctctctctctctctctctctctctctctctctctctctctctcttgctctc

SEQ ID NO: 2719 - DNA, 1000 bp, mus musculus
cattctgatgatcgtgagtggtcttggtttttgttagtaagattcttacatttgcttctcgctatctggtaatctctggagttagttgttatagttgtctctggttaaagcttgttcctcttgtgattttgttagcctctatcagcagacctgggagactagatctctcctgagtttcagtggtcactctgcagagtgcaggtatgatttcctcttgcaggaaaggtgcacatatatctggtgtttggtcctgcctcctagcagaagatgaaggcctgaaacaaggcctgtcccataagctgttagcttctgtagtccaaactctcacctgagcagactagtcttggagggatctgggaaccaatatggctcctccaggtgctccagcaaagcgccccacccgccccgggcagggctgacacctctcctctggcagagaaggtacccagatgtctggaacctgaaacagggtctgcctcagaagctgtgtggcttctgcctgtcccagaagctgttagcttctgcagtccacactctcacctgtgcagactagtctcagacagatctaggaaccaagatggctcccccagatgctccagcaaagccctccaggctggggccaacacctctcctctggcaaggaagttgcctggatgtctggagcctgaaatggggtctgcctcagaagctgtcttctagggaccttgggggtgtctgcttactcagtgcccagttgacttggtgctgttgccgaccagaagggacttgtgaccctggtcaggcagggttttctgtttccctaatgctgtctcatgtcctgtgcaattggaatggaacagaagttgtgtttcactcactggtggtcttagattgagtggagagtcctctagggaccttggaggtgtctgctgactctgcacccaaggtgacccagtgctggtttgggttaccattcttagcatgatcttttcttattccatacatttgcctgaaagtttca

SEQ ID NO: 2720 - DNA, 1000 bp, mus musculus
tctaactaaaaggctgagataaaatatacaaattttaaaaatcagaaatgaaaatgtggacataagttggactggttattggacctcctttccttcaatgttttctccttttttgtccctgcatttcttttagacaggaacaattctgagtcagtaattttgactgtgtgttagcaaccctgtccttccacttgagaccctgtcgatctactagaggtggattcttcgagtgtcctttcctcagtgttggtcaatttggctaaggtaacctccaatgagtcctgagagtatcacctacagactttaagaagtataacaagcagaaatgcccaagtgaggaggcctcagtcccacttagaaaatggaaaggaaataatcaagagaggcagagggaggagcacatgggtggaagacgggagggtggggaaaagggaaccaagatcaaatatgaggggaggggacaggagagaagtgcaaatggccaagaggatgaatggaaataagcaatctcgaggagtaaaaagtggggagccttctagagagtaccagagacctgagacctgagtcactcttaggactcattttagcccttcttaaagaaatgtagatttttaaattataattgcttgcttattttatttatttacatttcaaatgttgtcccccttcctgatctcccctctataaaatttccattctatcttccctctcctttgcctctaatagggtgcttcccaacctactctcccactcccacctcacccatgaactgagccctggaatctcaatggaagagttacaggaaggactgacacagctgaaggggtttgcaaccccataggaagaccaaataaatagatgaccccagaactcccagggactaaaccaccaaccaaagaaactatttttaaagtaaagaagtgagaaatttttgaaaataaactgtacaactgccttgcttgtgacaatatctattttatgttagctaacttcaagttaa

SEQ ID NO: 2721 - DNA, 1000 bp, mus musculus
tatagaagctttgcaatttttatgaggtcccatttgttgattctcaatgtaatggcacaagctattgctgttctgttcaggaatttttcccctgtgcccatatattcgagacttttccccaagttctttctcagagctcatgtctctagctgcatatgtagcctagtcagccatcaatgggagaagaggcacttggtcttatgaagattatatgcccaagtacagtggaatgccagggccagaaagcatgggtgggcagattggggagcaggatggagggagggtataggggacttttgggatagcatttgaaatgtaaatgaagaaaatatctaataataaaaaagaaaggacccagtatgtaagaactcattctttgtcatcccacttaaaaatgttgaaccaattaattatgtgtagacttgtgaaaagtgtgaggaaaaatctagtgagtcctctatagaggctaatgaagtccaaattatgatggtggtatattaatgggatgccagtttaattggaggagagaagctatcacttatattgttaagaaattgcttcaagaatctgaagatatcatactcccgagatcttcaggctctttgaataaaatgatgtaattttatttgcatttagcctatacatatcttataatatactttgttacttcaatttctttcaatatctaatacagtataagtgccatatgaataataattaatattcttttgtaaatcatagcaagagaaaatctatatgtatacaataaagccatattctcattattttcaatttcaaacatataaatactggttagcaactataaattaaagatatttatcaggtttcttctggtctgtaatagatagggggcacaaatgaattctagtttgagtgttaaacaaccaaaataaaaaaaatagcatctagaagttatcaatacatatgaaaacaatgggctttgttgaaaagatacaagtttggttagggcatactaatt

SEQ ID NO: 2722 - DNA, 1000 bp, mus musculus
tttttgggggggttgcctttccagataaatttgggaattgctctttctatgttttagaagaattgtggtggaattttgatgggaattgtgttgagacctgggaggtgagaaactctcaggactcaaaggaccttagatgaaatgccctacagcgagaagagggaacttgaagagcccacctccagcagaaagaatgggcatcaagtgagagatggagttgccatcccccagtcaaaatctctgacccataattgttcctgtctgaaagaactgcaaggacaaaaccggaaaagaacatgagagaaaggagctccagtgacaggcaggcacaaattggaatccagctcaatgggaggccccaaagcctgatactatttctcaggctatggaatgctcacagaaaggggcctatcaatactgccctctgaactacccaaaagcaggtgaaagaatcatttgcagatatttatacccaaccagtggacagaaactgctcactcctgtggttgaattagggaaaagatggaagaagttgagaaggagggcaaccttgtaggaggacaagaagattcagttaacctcaacttccaagatatttcagccactgcaccaccaaccaggcagcatacatgagctgatatgaggtccctaacacatatacagtagagcactgccaggtctgggttaagtcagagaagatgcatttaaccctcaagagactggataccccaaggtgtagggaggtctaatggggtggagagtcctggagacatcctcatggagacaagagtgatctggggaggagttacaggatatggaagagtcagagggtggaccagggtgagaataaaatatggcatgtaaaaaaaaaaaagatttaataaaatttaaagaaaaataaaacagttaggatggtaatttatgtccagaagttagagagtaggttgactgaaagaaaatgagtgggctatttttgctgaccagatctaatgagtttctt

SEQ ID NO: 2723 - DNA, 1000 bp, mus musculus
gtgggattaacactaagaaagatataaatgaagaaataaaaattacatcctcatcattaccaccaccaccatcaccaccaccaccaccaccatcttctctatgaaaatagattaattcactgtaggacagtgggccatgtcacaaaacctggtaagttgagcaggttcaaagtcctccaacccaggcacccacataagatgggaggtagctccctaccacattacttcccatataggacatgtgacctgtgttcatgtaggccagaacagagttctaaatgttaatgagatatttacatgagccctgtaggtatagccaataagctttccttctcagacattcctttatgcaaagggtatttaaattctggcccaccctgatgagttgatatgctcctgatttctacactgatcaatcaataaacagtttggaaccaaggactgtctctttcatcaagaatcaccttggggagaaaggagaaagccttcatctacagaccatcacactctaagtctcctacagaaggcccttctgtgttcctagacaacctcctctaagctaaggatttttacagatgagctaagcccaagtccccccacaccactctgggctcatcttcagcctgagggcctcatccattctctgctgttcagcgatccatgtctggatgtccaggagaatggccaccttgtcacaggccagtcgaccattaaccctcccttccatgcagtttccagtggagactggatgcccaggatcttgggaatcccagcttttacctcccacatcctaggctgtatttccctaccccctgtgccttatattgacagttcactagatcatagcatcctacagaatctcagggtagattcagtctagtatctccacattcttcctgctcaagtagctgtttccacacatgaacatcagggcagaaagcaaaaccacaatttaccaaagggcaggcaggggaaaaaggaaaatcaagatacaaaagtg

SEQ ID NO: 2724 - DNA, 1000 bp, mus musculus
ttatatctcttgtattatgtggtgatgttgtgtctgtagttcttgttctcattcctaggtttctcatctccagagctgcttctatgtgtgctttctttaatgcttctattttcatttttaggtcttgaactcttttatttattttcttcacatactttgtattgtcttgtatttctttaagggatttatttctttcccctttaagagattgtatctgttcaactatgttttcctgtatgtctttaagggaattatttatgtctactttaatggcatgtaattgtctttataagatggaatttaaggtcagaattctgctcttcaggtatgttagtgtatccatggcttgctgtagtaggagaactgggttctgatggtgtcaaattacattggcttctgttgcttatgttcttctgtttaccttcctccatctagttggctctggccagggtatcccaaattgtagcaggcctccccagagggagatggaggtctgtgtgatgagttagagaagacctcctgggaggcaggcagtcctgtggccctagttagagtaggcctccagggagacaagcagagattggggatagggaggaaaccaatgtgcctgatacaagtggaggtatggaaggggaagaagatgtggctcaacagatggatcagagtccagttctggtggtctctgtggagacccagctgttttgagtaattgaggaatgggtctcacctatattcctatttagtgaagtcttccctggaaataggcagaggtgtgagtttagggcgtagcatgtctatctgcagtgggtgcaggaggaattgctgactggaagggagccagggttccaaccataagtagaaattttatagcaagagttttacactagaacatagccctgagcatctcaaccaccactccacacccaccccaattactacattaaaagatatattgcttccaaattgtgtccttaaaagacactttgaaaaattatttttt

SEQ ID NO: 2725 - DNA, 1200 bp, mus musculus
caactgttatattttgaatagtcctataaaaagattcacatatatagtagggattagaaaccctctgccaataggttcaatatgaattgaacataaggcttttttgtttttatttgtaattaactactttatttatttactactttatttatttacatttcagatgtttctcctcctggtcccccctcttccttttcatcccatttctcctactcctcaagtctctacaagattagatgcatcctctcccactgaggccagacaagaaagtcctctgcttcagtccagcctgtatatgctctctggttggttgctgtctctaggacctcgcaggggttcaggttagttgagactgctgatcttcttatggggtcaccctctccttcagctccttaaacccttcccctatttcctccacagggtccctgacttcagttcagttgttggatcaaagtatctgcatctgtctaaatcagattctggtagggcctctcagaggtcagccatgctaggctcctatctgtaagcaaatcatagcatcaatggtagtgttaggccttggtgtatggatcccatgttgggccagtcactggacagtaaggcatccctaaaggaaatgttccagctttggtcaaaccatcaagtgagtgcattggaaaagactacttgatcttagctaatgaaaaaatggatcctaagaccacttactaaattgtccaaaaattttgctccccacagaaactgaaagagtaaatatttgttgtatgaaacaaagatggttgcttttgtggcaagttgttacacagtaatggaatattttagttaaattttttggcttagccagtttgatgtcaagaaaacatccacatgggcacatgcccatccatccaccccccacatatacacataaacacacacatacttctataaattatattttgttttgtttaattttctaaaatgtacctttggtatatgaatactacagagttcaaatatgtttagggatgttagagataagggctatgctgataactagagatgaagtgaggtacaagaataaattggtatgataggaggcttatacattggttgtgtatgaaaatcatgtgaaaaatatttgagaaactgggttataacaaatctatactcttctcataatagataaaaagccttttatggtaacttggatgtattttc

SEQ ID NO: 2726 - DNA, 1000 bp, mus musculus
tttgcttgggtcaggatatataggacttgtgctctgaaggaatcatattgccctggctcctgttgattgtgttcttatgctgacctttggccacctggtcgtccctggatgttcctagcatagcaggtatcaagatggcaggcctaacctggatattcctggtgatagaaggcctctggtagggaaccttgtgttatcaagagtaggtgttcacagcaatattttgtaatgtggaaattgattttggtgaatattcttcagtgtttcttagggtatgatctgtggtgacagaaacatatactaaaccatatcttattattgattgatacctacatcaatatagtagcccaattgataacagaaataatcttagattacatttcctttttttctacactttagtcatcagcaattatttcccctattgttttgaaaatatcctatttcagttattttaaaaattttttcatatgttatattttggtcatagttttacctcccaaaattcctccaaaatcatataaacaaaacaaaactaacaaacaaaaaatccaaaacacacaaaataaagacacaaaaacacatcaaaatgaaaattaaaacaattaaaagaacattaaaataatgccaaaacaaagcaaaatggagaaaaaggtatacaaaataccactgagtcgaattttgtcttggctagctatgccagagcatggggcctacactgaagtgtggttgacatactcagtgataccccattaaagatatttttttttcttctctttgccagaggttttcgattcaagatagcttttttgttaggcaaagatgcattcctgtgtctgtctacatgtccctctcagtgctgagaactcatgtagcttgaatctctgcaggtcttatatgtactgccaaggtctctgtgggttcatatgtgcatttgtcctgttgtgactgaaatacgttgtttagagttatcaattccctctggctctttgaatctcct

SEQ ID NO: 2727 - DNA, 1000 bp, mus musculus
agaatgggaattgatccattcctatctctttgtactaaggtcaaatctaagtggatcaaggaactccacataaaaacagacacagtgaaacttatagaggagaaagtggggaaaagcctcgaagatatgggcacaggggaaaaattctggaatagacctttagtcttttgggtagtttggataatgggttatcaatcattgatttttcagaattctgtttcattgattctttgtactggttttgtttgttttcttctttttcctctttcttttttaaaaaaaaaacattatattttatttaatcttttttttctacattatagattttatcccctttctgttccaccatctgactgttccacactccatatgtactccccgccccctccccactccctcaggcctccagtctcctgacagttaggtgcatcttctatgactgagcacaaaaacagcagtcctctgctgtatatgtgttgttggcctcacatcagctggtgtatgttgcctggtagatggtccagtatttgagagatctcggtggtccagattaattgagactgctggtcttcctaaagggttaccctccacttcagctttttatgtcttttccctaattcatccacagggatcatcagtttctgaccatagtttgggtgtaaatatatacatctgactctttcagttgcttgttgggtctttcagagggcagtcatgataggctcctatttgtgagcactacacagcctcagtgatagtgtcaagatttggggcatccccttgaggttgatcctactttggtcctgttactggacttcctgttcttcaggctcttctccatttttgttcctgcagttatttcagacaggacaaattgagagtcagagtttttgactgtaggatcacaacttgatacatcacttgattcactgtctttctgctggaggtgggctctacaagttccttctccccactatagggcatttcatctaagattctt

SEQ ID NO: 2728 - DNA, 1200 bp, mus musculus
tggcccctttgtaattgtttattattattattattattattattattattattattttcacttctattttcaaatcctggatggttttattcagttccttcacctgtttggttgtgttctcctgcaattctttaagggatttctaagaactctttaaggtcttcaatctgtttatttgtgttctcttgtatttctttaagagcataattttttgtccctcttaaattcctctatcatcctcataagatgtgattttaagtcagaatctgcttttctggtgtgttggggtaatcagggttctataacatgggggaattgagttgtaatgatgacacatattcatggtttctgttgcttattttcttgggcttgcctttcactatctggttatctctcgtgttagctggtcttagtgtctctgactttggcttgtcccccttgcaaacctctttgttgctaatcctgggagaccagttctctccgggaggaatttagatatggagagttgtggcacagggtcagctctggggtacagacagagaccagaaggattctgtccccagctgatccgtggttcccctgtcttgatggctctgtgagggtctctctttggcaagaaatttgaagagaagtagtggtcttatctgtacttacaggtgtgtaggcactcctggcagaccagatctttcctggcagtatttgtgtatgtagttctgtggcacaggatcagctctgggtacaggtggagaccaaaagactcctgtcacagtcagccccttgttttctgtgtcttgagagttcctagcaggttcctctgagcagtagtggtggtccaacctgcgttcatgggcctgtctgtactccagggagtctcaattcctccaggcactatttgtgtatggagccctatgggagaggatctgctaccacaattttaaatatgtataaataaactgattatcccctcttctttttactatcccccaaacactaaaatacaattttatttttgtgtgtgtcctttgcacttctttataatacttgacaattactttcagttgcagtccttattaacagccaatagacttgcctttaaacacagatttacaagtactgaattgattgataccttcctggtttattaaaaacaaaacaaaaaacaaaaatatatctacagggatataaactttattcttttag

SEQ ID NO: 2729 - DNA, 1400 bp, mus musculus
atttttttttcaattccctcacctgtttggttgtgttttctggtaatgatttaagggatttttgtggttcctctttaagggcttctgtgttctcccatctttctttaagggagttgtttatgtccttcttaaagtcttctattatcatcctgggaagtgattttagatctgaatcttccttttctggtttgatgggttaaccagaacttgctgtgatgggataactgggttctgaacaagtagccttcattctgttacttattttcttgtgcttgcctctcaccatcaggttatctctcattcttcctggacttgctgtctctgactggagtctatctctcttctgagtccagctgtccctgtggtcctctgattctgggatcctgggatcctgagatcctgggatcctgggtatgtcagagctcctgtgagtcaagctgcctctggggtctggaaattctggtgagaccaagattctgagaaatgttgtgtcagagctcctgggagtcaagcttttctgggtgttgcattgtttggtggggagctagagacctaagtttgctccaggcatacctggtgcaagctggaaggaacccgtgcctctggctgtgttgggtttttatttccctggttcctgtggggatcccaattatgctgggtgttggtaaagatgtgacctcagctatgatcttgagtgtgtcagggatctagtgttttttggtgggtctgatatccttggagttggacttcctctgtgatcctatgatcctgggtatttcagaacccctgggtttggacttcctctgaatattttaagtgtgtgcaaagccagcaccccaggtctgctccagatgcaggttccaactggaaggaataagtggccctggctgggcagtgtttcctgtgtccctggatcctggtgaactcagttactctgggtgttagggccaatattgtggcctctgctttgattctgagtgttttagcccctatgagtcaagctttctctgggtattatgggcctgggtgtggagccagtgcccaagggctgctcagggcacaggctcaaactggaaggcatcactgactcttgaaaaggcaacacattctttacagcatttactactctctctctctctctctcttaaaaaaattatttctctcccctagtgctcaaccataaacctatattaaaagacttgcagaataattttaaaattggttttacaatggctcattctgaaacaattctctacagcataatttaggaatctcattttcacacaagtagaggcctctgtaaaaattcctaagatgtttacaggtcaccacattgacctgaacctctaggaggtgctgctgagaataagtgagaagctgagaatcaaattcccttttcc

SEQ ID NO: 2730 - DNA, 1200 bp, mus musculus
ttattaaaaatggttgaccccctaacaatatgtacaaaaatataaaatgtaaatataaaatacagacaaattttccttttaaaatatttctgagaaagaaaaaaaaaagcagggcctgggaaggtctggttcttttcccccacatgttgccagtccatgttgtggttttattgggggtggtggagaccacatgtcatctgtgggtggtatggcccgctgtaggtgggcggagcctgcttctctactctaaggtgaccaaattctgagatgggaagtggagtgtgaataggtcacggtggtgtgtaaggtaagctattccttgtgctgtctaatcatcctcatcagtcttctgcttcttggtgtcaacattgtcatcctcatcattctcagctacctgcttgtccgtaggaatctcaccttcctcagcttcatctccatcctcttcctcaccgtcaccttcctcctcttccttctccgtctccccttcctgctcttcctccccaccttcttccactttttatctacctcattgtcagcctcctgctcgccattttcctcattttgagcattcccattggcaggcgcatcccttccattctctgcctctttgacaacttccttcttctccttcaagtccttggtggtgatctcggagctggtatctactgctgagtctgacatggtgggtcacgcaggtggtccaatgccgtgagtgaggaattagttgagttcgaggactctagcgagaaagctgccagagtccgcattggaggaggcagtgggaagcgaaggtggctgcagtgaacatcacggagtataacccgggaacaatgcagatgggttttcagagcagccaatttctttttcttcttttatcttgtattcaaaacagattttcttcacacagcatatctaatatctggttatggtttcctgtccttccattcttaccagtcccttcacacattgcccacccctacccccaaatctggagccacacctttctatctctcattatcagccaaccatcacactgaacactgggatcccaatggaggagatagggaaaggactgaaggagctaaagtggtttacagtcccataggaagaagaatatcaaacagccagacaccccagagcttccagggactaaaccaccaaccaaagagtacacactgtgggattcgtggttctagttgc

SEQ ID NO: 2731 - DNA, 1000 bp, mus musculus
ccttataaagtatggattaggtatccaaaactacctctcaggcttccaaaaggggcaaatttccctattcgtgctcccatctcttgatggtgccaagcaagacattctgctcccaaggctacccaggactgcacaaaccttgccctaccataaatccagcatccacaagagtgccgctcctagcgcttcatgtccaagcagagagagggagcctgcagagtgcaaaccactgctatggggtccgcaggtcgacgtggcttcacaacagcggactaggggaaccttagctgctcccttcccaagggccgaggtgggggtggggtgggggtgtaggagaacagtggaagatcggccgctgctgtcccccgagcgctacctcgacctggaggcgacgcggttggaggggccgctggcgtgtaccgcaatgttttgccgcatcccagtgcccagagccggcgcgcagccccctcttgggtacccggaccgagcagcagcctcctcgcaggcttggtggcgggggcggggtactgtgcacgatgtcgcgggggccttcagtccctctgcgcacacatttctccgcgcgctcccgtcccacaaggggtagctgctggagttttctttggcctccctagacccaaacgtgcagtgggtgagcaagaaggagagatgactagttcaggccgcgagggatagctactggggcttcaaagacccatttgctacagtcagagtgactccatagttcggttgcctggagctgtggcccgggctttgccccccacccccacctgcccacgccagctataagatcctattcacccagccagaaatcacttcaacatttaggaatcttgcaaagtgtcactgctagcattcccccagcttcgctgggctttcggagttacccacgggttcttcctcctatactgcctgtcttgcagagtgccagcggtctctgagcagtctgccggccaccgcctgaaaccccacattcaagtcc

SEQ ID NO: 2732 - DNA, 1400 bp, mus musculus
aagctttttcagcagaacaaaacaaacaggaagtatcaaataacatttgcagatgctatgctttcgttgtcatttacactactcaataattggtctaagctacaaaataaccaactttctaaatcccttaaatacatttggaaatttttccctcatcacacttttagacatttattgttaaatggaacagaaacatgcttcaagttaatcttcgaatgctactgtaagcaggtatttctatacttcactaagcattggcaaatgaagttttctcaatgaatctgacaatatatttgaatggtctctgttatgttgtacaatgactccctgtgtcacaatactttgtgaggcttactttgtgaaattgttactgagcaaattcctgaattcccagtaccagggataggctgaaaatttataattcctatgaaggaagtatttaccagctagtggttagttagtgagcaaaaggatactcactgtgatggtttgtatatgcttagcccaaggaatgatactattagagggcatggccctgttggataaggttcacatgatcttgttggaaaggtgtgtccctgtaggcacgagctttgttctagtgtctggaaacaagtattctgctagcagccttcagatgcaggtgctgaactctcagttcctcctgcaccatgcctgcctggatgctgccatgctcttgccttgatgataatgaactgaacgtctgaacctgcaagccaggcccaattaaatattgtccttacaagagttgccttggtcatggtgtctgttcacagcagtaaaaccctaatgatgacacttactcattagactcatagcaggaaatgaatgtgtttagtctaagtaggaaaaaaaaaacagctaggaccatgatttcatggtattaggtataaaagaattccatgactaaaaaatggctgatacagtaggactttgagtagactcaagatgaggggtattatatatcattgtgaaatgtgaactgcaggataaattgtttttatggattaaaagaagtagtattactatgtaatgtattttagcaaattttctttgctaaaacatagcaagatgttaagaagaaaactagtgctacaaatcaaaactcagatttttatttctggaagttttctcagcccattaaagaaacaagcaaaatctaaaattaacatagaatttaagagaagtctctcttggtaaaacagtcttaaggaaaacatttgaggttatatacttcatagtttccaatttcaaaacatattacaaatttatagaaaccaaaactatatagtacatttaataagaaaagaaaagaattgaccctgtgcatacacatgtatatgtttaaaggtcttctataaccttgacagattatccaa

SEQ ID NO: 2733 - DNA, 1000 bp, mus musculus
cttttttgaaaaacagttattcatttacttatttatttattcttttactttatggttctataattgtttcctctatttgtcccctctcttacagtcctaccctcctccccctctccttctcctctgagagagtaaccccccctttccatatccccctaccctgccacttaaagtccctgcaggactaggtgcttcttctattgaggccagacaagacagctaagttggggaaacagttttaaggatagtccctgctccaggtgtttgggacccacaggaagatcaagcttcacatctgctacatatgtgcagggaagcctaggttcagcccatatattcatcatggttggtggttcagattgtgggagccccaagagttcaggttgttgactctgctggttttcctggagagtttctatcaccttggaccataattatttccctgactcttccataagagtccccaagctacttgcaaactttatatgacccaatacaggggaatgccagggccaaaaagtgggaatgggtgggtaggggagtgggggggagggtatgggggacttttgggatagcattggaaatgtaattgaggaaaatacataataaaaaaatatattaaaaaaaaaaagagtccccaagctccatccaagttgtggatgtctgtatctgtctgagtcagttgctgggtggaacctcacaagaagatgctaagatcctgtctgcaagcataacagattattattagtggtgtcagcaaatgatgtttgctcatagaatgtgtatcatttggcctagttattgcttgatccttccctcagtctctgctccatcctaaatacctgcatttcttatagaaaggataaatattgggtcgaaagttttcagtttccatatgtccactgctgtgagtcgtgaccattgattcttgggagtcgcccctattccatgtctctggcatgtccttgagatgtccccaacttccccccacactgtacta

SEQ ID NO: 2734 - DNA, 1200 bp, mus musculus
tttataagtcttggtattttttcatcttagagctggtaaggactaacataggaagttatgggggaaaatgcacactgaagcattgtgaggttccagtgcaatagtccaagaaatacaatgtaaactaggattattacatgccatttaccatgcagtaaattgtttttgtcatacttatcttttattcatatttgtaaatctttgctacatccaccccagtagtgacccacgagacaggccgaaaagcctggacgctgtcctgaggcaaaaagttcacagaagcatagtcttctggaaatttggcattcccatagctgggatgtcccagatttgtccctgcattagtgttaagggtcttgcatgttttcttacagtattttactggataagagttagaaatctcagggcaagcttagcaaagtatacttagaatcttcattaccgtcaggtaaggcagactacattacttattagtagaaagtccccccacacaatcacttagaataatagccgagctactttcatatgcaaaaaattaccattatctaggaagaaggaaggttgtggtctaaggaggaactaaagtaaatacttagaactatggatagctgagttacatccatacccaggaatttacaatggcttagtgggaaggtagactatacaatagactagaattggaactatggcaagggtgtgaagcccttcccctggcttctaagattaaactgaccttaggtggggctgcttttgatcccagttgttaacattgatttttctcccagttggctcctgttagctcttagtacacattcctatgttttgtgtaaaagtcacttataagactggtgcttgctttgagacaaattacattcagatacagcacaatcccttgcatctgtatttgtttgtcatttctcaccaactcctgtccatctgtctagaaccctgatttctcccgcacattgaggggggcccaactagggccggtccatggcaaatcttcatatataagaattttcattacgtatgcactcattatttacttaattatcatctttacttagctatccagaccaccgaagcaattacaatctacccctcaaatgattgaacatagtaatacatattattgttaaaataaaattaaaaaatttgcttcccttagtcttggttgcatgaacaaaaaagtgtgtgtgg

SEQ ID NO: 2735 - DNA, 1000 bp, mus musculus
tcatctatctattttattctgttggtgatgtgttgggagctattaagacacctctattgtctctatctctgaattgggcatctcgcccccgaaaagaaaagggggtcaaatgcgttccaagaacaaccacagaatgttccatccctaagtcactgccagatgtcctgaccacaagatgtaccctgataccaccaagttcctgcttcccccgtgtagttgccaaaagaaaaatttccgctgccccatctctcctactgagaagtactttctcctttccttgtgcatttaagccttgagccttgctgaatacagtgacacctcgatgctactcagactgcttccgtgtgttcttgtacttggtgtccgtctcgccctcccccatttgattcttaggagaaggtcccctcaagaccctcaaataactggacctgctggacaggtcaagtggcacccaacgtggggcatgagggatgaacaccctctggacaatgggttcaagaggtaccgagtagacagtgagacggttcccggccactttgctcaagtgccgcagacgttgaaaggtaagcctgggcataaaattgttgtcccattcaccatggggaaggttctgtccaaagagacagtttctattcaagagatgaaagggtctcttaaggagagagggataagagttaagaaaaatttaataacatcttttatttattttatttttgttttgttttgttttgttttgttttgtggacgagagatgtacatggctggtattgaatggtcctgaaatacaccctttaacttggaataaagtaggcaaagatatcaatgctttgataaaacaaggagaaagtgttcctgagtccgtttttagttattggggaatcatcagagacctccttgagcaggcagaaaagggcggagaggtcgcttgcctcctagcccttactgaagattttttagaaaactcctaatctctgtctcacaaaagcaaaactaagccgcc

SEQ ID NO: 2736 - DNA, 1000 bp, mus musculus
ctgagttcaaggtcatccaggattaaaggtgtggtgcaacacacctttaatctgggctacaccttctgctggagacaatacaaggacattggaagaagggagtcttgctcttgctcctttgcctgctttctgtgtgagactgggtaactgctagatccttggactgagtaactgctagatccttcacagctactacagaaccattgggaattgggctgcagactgtaagtcatcaataaattcctttactatatagagactatccataagttctgtgactctagagaaccctgactaatacaggggtttattcatgtaactttttattggatatttcctttatttacagtttcatgtaacttttaaagtccttaaacatgttcataattggtattttgtagtccttgtcttatgtttcagctgtatttcatttattagtgactattagaatactggcttctggtggaaacacactgttttggatgttcatgttttgattttgtgttgaagttgaggtattagaccaatattaaacaaatcattcagtagtctgaatttgtaaaatgttaatgagaaagttcatttcaagaaaaaaaatagggtttacacaggcaatgcaccacaaagaagtaaatatattctctgtgtggatactaagaagaaaagtgagccatgaaagaatatgccttaagagagatttgaagaataaaagaccacataactcagatttaagtgagcaaaatacagcacagcagttatttctcccattgaggggatataaagtcatgctgcatgggaatcagatacccagaaagcaacagacttccatgcagctcagggagaaactttcagacagcattcaaaaggaaagttgtccttccagggaatcatagaacaatgcctctgaaacagctgcattgggctttaatttgaattcaaaagcagctgcaaagacatttgcagaactgaaaaagtcacatctccagcatttacacagatt

SEQ ID NO: 2737 - DNA, 1200 bp, mus musculus
ctaaaaaccatgagtggccttgtatcactgtataaaaataaatatataattcacatttcttcatgtttactactactgtcttattctaatatgtttatatataactggtaatttatgaaaaacaactttcaaattttaatgatatattatacatgtacctaaaacacattaatacatttaaataattattgtttttaaattttacttatgtataaacctgtttgtgtgaatgtatgccatatgtatgagggtgcctgcagaagctggaactgagttttagattcctttgactgggagttatgggcttttgctgaagaacacaatacacttttaataatgaagctatatcttcagacagaccctaagttaagcataaataatggtgttctgctataaggaataatacagtgaaattttcttatgttcagcaagaagataaaaaaaaatatctgaaattaggtggttgcctatggaagaaagagatagtttctattgaaagtagttaaagtcagaaggttgaaaggatggaccatccagagactgccccacccagggatccattgcataatcagccaccaaacacaggtactattgcatctgtcagcaagattttgctgaaaggaccagatatagctgtctctagtgaggctatgccagtgcctggcaaatatagaagtggatgctcatagtcatctattggatgaaacacagggcccccaatggaagagctagagaaagtacccaaggagttgaagggatctgcaaccctataggtggaacaacaatataaactaaccagtacccccagagctcctgtctctagctgcatatgtcacagaagatggcctagtcggccatcattgggaagagaggccccttggtcttgcaaactttatatgccccagtacaggggaatgccagggccaagaactgggagcggtgagtaggggagcagggcagggggagggtatagaggacttttgggatagcatctgaaatgaaaatgaagaaaatatctaataaaaatagaaaaagaaatttgaaattaggtggttggctatggaagaaagagatagttccttttgaaagtaattaaagtcagaaggttgaaatcttggtggtcatgtagagtagataaatgcttgttatagatcactatgagtattttctacagttttttttttttgttgttgttgttct

SEQ ID NO: 2738 - DNA, 1000 bp, mus musculus
gaagggggagggtgggaccttggtggaaaaggagacacagaggggaagaggagaacatgagcaggtattggagaggaacaggagtaaagctctgagggccagcagaaagaatggaaatgggcaacctcaggaggtaggaagtggggagaccctctagaatgtatcagagacctggcaggtaagagactctcaagacacaaaggggggtatgaaatgcccaacaatggggagatggaacttgtagagtccacctccagtagaaagacagggcatcaaggggaaggatgggactgccatcccagagtaataaaataaaataaaataaactctgacccagaatttttcctgtctggaaaagctgcagggtcagaaatggagaatagcctgaagggaaggatatccagtgacaagcacaaatttggatgtagctcaagtggaggatccaaggcctgacactattactgatactatggtgtgcttacaaacaggagcctagcatgactgccttctgaaaagctcaaaaagcagctaaaagaagcagatgcagatatttgtacctaactaatggacagaagcctgggactccagggttgaaataggaaaaagctggaagaagctgaggaggagggcaaccctataggaaaagcagtctcaactaacccagatccatgagatctctcacacactaagccactaacccagtagcatacaccagctgacttgaggcccccaacacatatatagcacaggacttccggaactggcctcagtgagcgaagatgcacctaaccctcaagagagtagaggccccaggaaatgtgaaggtcttgtgtggtggatgtatggggttggggacatcttcttggaaacagggaagcagtgaggatgtatgggatgtggcatagctagagcgagcacttggagggggaaaaagactggactgtaaaaaaaaaagaattaaagaacaaaggggaaaaagttgcttttgacatggtatttt

SEQ ID NO: 2739 - DNA, 1600 bp, mus musculus
tttcacattttactatatcttaaccaatccacatgtggtcattgctacataagaatttacacaagtcctaactgacagtagagtgccttgctttgctggggtaattttatatgaattagcttgtgctaccagcaatgtgtctgctttcttgatttttcttagaacctactgagtatgatgctctgtaaggaaatgaattttacttaaaggaaggaaaataagatatggaaagacaataatacttttaagtttcttccactctaacttaggcaatatttgctactaagggtaaaagtattgttcaaggtattttctttacatgtacttttattttaaagacataattctctcagaacaactcagttgaaaaggctttttctagactttatagttacactgacaagcacaacaaaatttagtgacaagcttgtgctgtaagtcagagagcagcagaggtcttgggtatcatcttatcttgtcagtgaagtgtttctctcataaattgcattgccttgtactaggaaacatttgataatatttgcttaagaataacgttgaaaggatcttttcaaacaatgcacccatataaaagttttgtgactaattatctctgtctaatgatccttaaaatatccaaaagtaaatcatacataattttcatggaaaattgtcttaggcactttgttattttatggagaaaaaagacaataggttgattggaaatttagcgtgtaacagatattcaaatatcagcgaagcagggcatggtggcgcacgtctttaatcccaacacttgggaggcagaggcaggccgatttctgagtttcaggccagcctggtctacaaagtgagttccaggacagccagggctacacagagaaaccctgtctcaagaaaaaaaaaatcaaatatcagcagataattacctcttggcaactaggaacagtcacctattatatcttgttaaatataagattatatctttctttatgctgtgtatgtttaagtttagatttcttaatatttactgaattccattttctgataaggtgtgcatgggtgaattggatatcaataagaacttattcctggaataaagcaatttatactttagaaaacaaagagttgacagtatgtctggaacaagaataagaataaagtctgctctacaaatcaatttttgagtttaagtattctaagacatattctacaaggatttatacaataagaaatggatcatattaatgcaaagcatgcaatactaaaaatttcatgcaatattaaatacaaacattccaataataaagcatttcatataatttccttggtgatgtttggcaaaatttttcaatcttttttaaatgtaaaaacacatgtgaactcatcttccagtaaggttgtctctaatggtttatctagtagctatttcattccataatatttatagaatgtaagaattattaataattgggaatagatacatgtttggtcttaataggcaaaattggtcagtggtagatagatttggttgaaagtgacaaaattgattatttacacaaaatggcccacagtttgagactttacctcaccaaaaaaggcc

SEQ ID NO: 2740 - DNA, 1200 bp, mus musculus
acagttcagaacagatctctcctgtgctatatctaatctagtagtaacccgtgtgacaggctgaaaagcctggacacagtcctgaggtgaaaagttcaaggaaacttagtctcctggaactgtggcatcctgtaataaggaatgctctaaaactgtccttgttttagatcagtaaacggatctgtgtgctttcccttaatattgcttcattataagtgcctctaaggattgattttgacatatagctaagttagattcctcaccaggcctaggtagtccttgagctgaccataggctttgaattcagtaagaatgttgcctattcagtgacattccgatttgcctctagtattgtaatagagatagtgaaagaaatcaggcattactatcgactacctagagttagaaatctaagagcaagcttagcaaagtatacttagaatcttcataacagtcagttatggcagactacattactcattagtagaaagtcccccccacacaatcacttagaaaaatagccaaattactcccatacgcaggaatttaccattatctaggaagaaggaaagttgtggtctaaggaggaaccagagtagatgcatagaacgatagatagctaagttacatccatacacaatacaatagactagacttggaactatggcaagagcatgaagcccttgctcctgacttctaagattaagctgaccttaggaggggctgcttttgatcccagctgttaacactaatttttatcccagttggctcctgttagttttttgtatgcactcctttgttttgtgtaaaagtcacttataagactcctgctcgctttgagacaaattacattcagattcagcacactcccttgtgtctgtgtctgtctgtcacccccttctcactaactccattgactacctgtctggaactccgagttctcctgtggattgagggggccccccccgactgaggccagtcctaggcactcctgtataattagtttgaagatagcttgagtcacatgaggctctctatacaaaaaaaaaaaaaaaaaaaaaagatcagaaaaatttaaagataagcaaaagtgttaacacaaaagagagaaaaatcattactgaccataagcaattttaaatttcaacaacagaggttaagttatgttttaaagactgagaataattctgtatttctgga

SEQ ID NO: 2741 - DNA, 1000 bp, mus musculus
cctaggataacaaaaactcttctcaaggataaaagaacctctggtcaataaccatgcctgacctaaagctttactacagagcaattgtggtaaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcatgtagaagaatgcgaatcgatccatacttatctccttgtactaaggtcaaatctaaatggatcaaagaacttcacataaaaccagagacactgaaacttatagaggagaaagtggggaaaagccttgaagatatgggcacaggggaaaaattcctgaacagaacagcagtggcttgtgctgtaagatcgagaattgacaaatgggacctcattaaagtccaaagtttctgcaaggcaaaagacacagtcaataagacaaaaagaccaccttggggagatccttcaggtgaggctttctggaacccaaagaggattgtcttcttcctgtggaaagacacaaataactcccatggatcttattaaaataggatccgggcctctccattttctggttaagacatctttccatttgatcatttctctaggtctgtttggttctgaacagtgacaatcagccgcagtgtggccttgttcatcaagattcaaaaaattagagtaaagagtgccatggagatggccactcacagtgttaagggcagagcctcgttgacctcccctttctgtgtgaataggtaagatttaagagtgcagtgggcacattccacaatgccttgtccctgagggttgtatggcaaaccagttaaatgagttacattcatctggcgacagaactgtcaaaatttttgagaggtgtagcccggtccattatctgttttaagaattttgggttg

SEQ ID NO: 2742 - DNA, 1200 bp, mus musculus
aaatctttctttatttcttttttcttttttttcctaacacaaaatttttattgatcatttggaaatttcaataatgaactcccatcacatttacttcccagtctgcccaggtccaacccccacccatgtgaccttccccaaaacaaaagaagaagaagaagaaaatggaaaaagaaaaaaaaaaaaacaagtccatgctttgatctttaaattctccttagtaatcataaggttggtttggggctcagatcattggtgttttattcttgcattttagcacagtacctttgtgatcaagcaaacatatttgaattttttattacttattaggtatttatttcatttacattcccaatgctatcccaaaagtcccccacaccctcccacacccactcccccacccacccactcccacctcttggccctggagttcccctctactgtggcatataaagtctgaatgaccaatgggcctctctttccactgatgggccgatcaggccatcttctgatatatatgcagctagagacatgagatctgggggggggggtggggtggtactggttagttcatattgttgttccacctatagggttgcagatccccacagctccctaggtacttcctccagctcctccattgggggccctgggatccatccaatagctgactgtgagcatccacttctgtgtttgctaggccccagcatagtctcacaagatacagctaaaccagggtcctttcagcaaaatcttgctagtgtatgcaatggtgtcagcgtttggaggctgattatgggatggatccccgggtatggcagcctctagatggtccatcctttcatctcagctccaagctctgtctctgtagctccttccatgggtgccttgctcccaattccaagaaggggcaaagaatccacaccttggtcttcgttctttccgagcttcatgtgtttcgcagattgtatgttatatcttgggctaatatccatttatcagtgagtacatatcatgtgagttcttttgtggttgggttacctcactcaggataatgccctccaggtccatccatttgcctaagattttcataaattcatttttttaatagctgagtagtattccattgtgtaaatgtaccacattttctgtatccattcctctgttgaggcgcatctgggttctttccagcttctagct

SEQ ID NO: 2743 - DNA, 1000 bp, mus musculus
tctcaggtatgaaatatgagttatgcatctttcacctgaacctgccagaggccgccaagggccctagagtactctccacaccgcaggaatttggaatcacctcggaatcactggtgagtggaacacaacatcagctccaaagattcgcagagggtcttgtgccagcaggaagagggacaaaggaaccctgcacgaccagaggctaggatactttctggtctgggccagcccctccatcttccacctgaacccagccaagggcaccaatagccccagaggactttccatgccacaggacccctagcatacccaggacctcaggatcacaggtgagtagaacacaacatcagctccaaagaatcaaggagggtcttgtgccagcaggaacaggcacaaaggaacctcacccagccagaggctgggattctttccggtccaggccagccccaccatcttctgcatgatccctgcctagggctttgaaggccacagaggactctcaacactgcaggacccctagcacacccaggactttgggatcactggagagcatgtgggcgacagaagcaacagagcttcttggacaaggtcccatcaggccttcatcctcagccaggaagcagagctgagacccagatccctaggcaccttccttgacaagggagagcctgcctacagagagggctctgaacccaggactcaggaggtggatcagagcttcagacttctggacacctgccctgcaagaggagagcttgcctgcagagagtgctctgaccactgggactcaggtgaaagttggactcccaggaatgctgacagaggctaacagaatcacaggacgatcaagctccagccagagacagcttgaatattaaccagagattaccagatggcgaaatgcaaacataagactcttactaacacaaaacaagaccactgggcatcatcagaaccccatacgcccaccacagcaagtcctggatactccaatacaccc

SEQ ID NO: 2744 - DNA, 1200 bp, mus musculus
gcaccccttccgggtgtccctctcacaaagaccctctgcacaacccccttcccttctcctctgagagggtgccccccaggtatccacccaacaagtgaaaaatattttaagactgaatgatcccatatacaaccaccaaacccagacactattatggatgccaacaaaaacttgttaacaggaacctgagacagttgtgttatgtgaggctctgccagtgcctgacaaatacagaagtggatgctcacagccatccaatggatattggacagagcacagggtcctcactgaaggagctagagaaagtacccaaggagctgaaggaatttgcaaccccataggaggaacaatatgaactaaccagtacccccagaactccctgggactaaaccatcaaccaaagagtatacatagagggacccatggctctagctgcatatgtagcagaggatggcctagtaggtcatcaatgggaggagaggcccttgatcctgtgaaggttctatgccacagtataaaggaatgccatggccagcaagtgggagtgggtgagttggtgaacagtgggaaggtaggagggcataggggatttttggagggaaaacaaggaaaggagatagcatatgaaatgtaaataaagaaaatatctaagaaaaataaataaataaaaccataacaaaacaaacaaacaaaaataaaaaaagactgaatgcacttattttcctagagacctacaaatcagctttttgcagtatgtgagactggccacaagggggcagaagaacaatgtaatattttttaaaggtcttcctagaaaacagcagcttaatttttaccaaatgttgccaaatattcactataattattcttaaattctaacaatccagtgtatcacttctacttattcatattatacatataaagtacacaattggtaaacaatgcaaatattaatgacagtgcataggaatattaatgctttctatatgtatacaaacatataaacttatttatgaatatattttattgggctatagagaataatagtttcaatattatcaatattcctggattattttgtgttaatttaatcatttgatagagttgaattcttcattaatatccccccaggaagatgccgtgaaagaaacaaattcaactggaatgacttataaggaagctttcaagagctcctagact

SEQ ID NO: 2745 - DNA, 1400 bp, mus musculus
ttcacattttatttgattgttgtgtccatgttttctatggaatcttgtgtaccttagattctctcttccatctcttgtatactgtcggtgatgcttgcatctatggttcctgatttccttcctaggatttctatctccagagttgtctccctttgggttttctttattgtttctacttctctttttagatgttggatggttttgttcaattccttctcctgtttggttgtgttttcctgtaattctttaagggatttttgtgtttcctctttaaggaattctacctgtttagctttgttttcctgtaattctttaaaggattcttgtgttttgtctttaatgacttctacctatttagcagtggtctcctgtatttcagtaagtgagttatttatgtccttcttaaaatcctctaccatcaccctgaggtatgattttaaatccaaatctttcttattctctggtgttagatgttctagctgtctctaggtggatcttttcctcctgtcattctgttagcttctgtcaggactcctaggagtccaactctttcttaagtgccaaggcagagcactcactgcaggcaagctctcctgtggtagggaaggtgcacagaggtttgaggatcagctctgcctcctggctgaagatgaaggccaaaagggaccctgtccaagaagctctattgcttctacagcccgcatgctctcctgtgtgggctgatctctgagagacctgtgatagaagataaagatcttgcctgagtcctggggttacagccttccctggaggccaactctcctctggtggcgaaggtacacagaggtctgaggatcagctctgcctcctggctgacaggactggctcaaagggaccctgaccaggaatctctgttgcttttgcaggcagtgtgctctcctgtgaggactggtctctgagagacctgggatagaagatcgccagaatattcttgattgattgttcagtgtgtatttgaaaaaactgaacttattttcttagttctttaaaattaacatattaaaatatcaagacaaaatagcataacacacacacaaaacaaatttattcttttgaagttctaaaaagtagatttcaaaagtaaaactctatgcagggtcatagtctttgaaggctctagttaaagttttagatactgcttatctccagcaatccagtttccttggcttggggatatatcattcccatttttgcttctgctttcacacagctttcttatttagataactatacccaagactttctccctttacttgcaaagttccataatctaagataatgccatctgaggaatcttaatcacaactgcaaagatcttattaacaaatcagaatctgggtaggtatttttttttttttttt

SEQ ID NO: 2746 - DNA, 1400 bp, mus musculus
tttaagatattatattgttgtgagggaaattagccttaatttgttcatctacgactattctgatattcctatttgttaacaaacttctcaataggggaattgaactactctaatacaataattaaaaagtaaactcaaatgtatcatataacatgcttattaacataaagttaatgttttttttaagttaaactgtatgtacttagatgtattaatacactgaaattgtattaagggaaaattgtgagagaaatgttaagtcaaagtaaaacttgaactttaaaacatgcaacacaaaaactaaaaaaataaaaaagaagtaagccatgaggtggtgtcacatgcctttaatcccagcacttgggaggcagaggtaggcagatttctgagttcaaggtcagcctggtctacaaagtgagttccaggacagccagggctatacagagaaaccctgcttctaaaaagcaaaacaaaacaaagcaaaacaaaacaaacaaaaaacaacaacaaaacatgcaacacatataagtgtcatgatacatgtctaaaaatactagtcaacaggcaaaaaaaggatgcatcagggatttcagcccacttttggttaactactgaactctatatcaccccagctaatctttgcataaataaataaataaataaataaataaataaataaataaatagaatgaaaaaatggggaaatacctcagtacttttgaaaaatgtgcattatcgatcttcagtgctgtctgggcctgcttggacaagccaagctctcctgagcagcctgctttctcagagagacctccattctcccaccacctctcctccaccttcattgtacatctgaaccatacaggctagctcccctttccccatttatcttccctgctgtctgagccctctgggtcaagcttgagcagcctactctcccaggaagacctccattctcctgccatcttctatctaacttcattggacctgaggctcctgaaacatacagacctgcactgcaggtccagagccatacagcccaagaataccaatcagaggcttgcctcacaagaaccatcgaggttcacccctcccaatacccactacaataaagacatacagggaccaaaactatccagactgctaaaggcccttgaaagaacacaagcaacaggcagggcaatatgacaactccaaagcacagatacaccactatagcaaaccctgaatatcctaaaaactgaaacagatacacaaaagataaccttaaatttgatcttataaaggtgatagaggcctttgaggagaagatgaataaatcccttaaacaaataaaggaaatgcaaaaaaaaaaaaaaaagaaaagaaaaaaaaaacagaaagagatctttaaagaggaaaca

SEQ ID NO: 2747 - DNA, 1000 bp, mus musculus
acactgactctagcagccaaaagtatagttgctttatgttgataagttcactgattatttctatcacagaaatagattatttctactttatcacagaaagtctgtgataaaaaatgaaagtcaattcatccttagttatttttctattgttgtaataaaacagtgtccaagttgaattacagggaggaaaaagagtttatttatacttacagttcagagaattagagtgcacaatggtgaagtgaaggcattttggcaggtatgataacaggagaagctgctaagggttcacatcttgaacctcaagctagaaacaaagagaaaattggaaaggaatgaggtgtgagctctgtaactaatcccacaatacccagaggaaggtagactacaaggagctctaaaacaaccaggatcataggtaaggaggatacaacacctgccccaaacctggagtaactgggatcctagggggtccagggacacaggtaccccctcctggccagtggttggattccttccagtctgagctgaggcccttaacagacattgggccagagctctccaccgaattcctcaacacccagaattagctggactccaaggagctctaacacgcccaggatcatagcactcagaggaagctctaatgtgcccaggatcatagatactttaacactcccaggatcataggatcacaggatcgcaggaacttggtcacaccaggatttcaagatcccagaggcagtttgactcccaggagctctgacacacccaggatttcaggatcacaggatcacagagacagttggaccctgaggagttctgacaaaaccaagataacaggaggggcaggctgcagtcagagacagtgagtgcaggtagcactggaaataaccagactgcagcacaataacatacgtgacagaatcaaaggttacttggcatcatcagaacccagttcttctaccatagtaaatcctggatacaccatcacacttaa

SEQ ID NO: 2748 - DNA, 1400 bp, mus musculus
attccaactcaattctacatagagttagaaagagcaattctcaaattcatctggaataacaaaaaacccgggatagcaaaaattctcctcaaggataaaagaacctctggtggaatcaccatgcctgacctcaagctgtactacagagcaatcatgataaaaattgcatggtattggtacagtgacaggcaagtagatcaatggaatagaattgaagacccagaaaggaacccacacacctatggtcacttgatctttgacatagtatttaaaaccatccagtggataaaagacagcattttcaacacgtggtgctggttcaactggcaatcaacatgtagaagaatgcaaatcgatccattcttatttccctgtagaaaactaacgtccaagtggatcaagggtcttcatataaaaccagagactctgaaactcatagaggagagtggggaaaagtcactgatacatgggcacaggggaaattttcctgaacagaataccaatggcttatgctctaaaatcaagaatcagcaaatgggacctgaccagggagtacaagtcctttctgtttggcaccaacaccgggtcacattggcctcgagctcttctgaaggccccatggtacccagatgattctccatgctatcttaggatcactggttagtggaacacaatatcagttccaatccaatcacattaggcctgagccagcagcagagaagcagaaaacctgcctgaccaggggcataagtcccttccagtctgcaccagctcctgatcaccttgggcaagaactctgctgatagccccacagtccacagatgactcttcacgtgatcttaggatcactggtaagcagaacacaacatcggtcccaatccaattgtgattggcctgtgacagcaggagcaaggacacaggagcactgcctgaccagcagctccggttacttctgatctgtgctggtatagcttgattttgaacacaccaaacagcactaaggtccccagaggggacaccacttccaggcaccgtaacacgcccaggatcttaggattccaggatcccaggataacaggagcatggtcacactaggatcaaagggtctcagaggaaacctcactgccaagacctctgacacacacagaatctcaggttcacaggagcacagaatcacaggatcacaaagaaatctggactttgaggagtcctgaatcaaccaagattataggaaggacaggctccaatcaaatatattgagggcaacaagaacttaacataatcagatggcaggaggcaaccataagaacagaaacaacagaaaacaaggatatttggcatcatcaaaaccaaactctcccaccaaagcaagtcctggatacaccatcacaccagaaaag

SEQ ID NO: 2749 - DNA, 1000 bp, mus musculus
taagagggaattcttatgtgagtgctttcaaacattatctttgctagaaaatcactcaacttacttccaaacagtacagaatttttaatttcttcttgttagagatattgatttaaaacatactaaatgagctcaggtttcttaaatttgtaaagaaaaatagtggcttaagataatatatcctgaacaatgaatgcatttgagaagagtgtatttttttctgctaggttaacagttttctatatacaaatgttaggtatatttgacatatattcttgttaaaatgcattggtgatgccctagaacttggattcataattgccagctagtttttagcaggaatgggaactgtgtctacaaaggccctatgtactgcaatattttgcctaaatctcaagttcatgtggattgattctcaagggagacatgagacaaaggtctaccaggaaaagaataacctgggattggccatgagttttgatcaagtacctgggcatatgataacttcgccattcctggcaaaaaactctgtggagaaagaatctctttgaacaccttatggtgattgctgtacatagcaacaaaccggtgactgtgtatatgggctagagtttatcttttccctctcagtgttctaaagaataagaccttgtaattgtttggattatttagctgataatcatgaagtaagagctattatcttgaacttgatgccttatgctggaattaagatccataacaagatatctctctctctctctctctctttctctctctctctcatacacacccatgatagatagatagagagagagacagacagacagacagagacagatagacaaagagaaacacaaaatatcagagaagcaatgaagcacagattaaaatatttttaaaagaaaaataattccatgattttgtctgtatttggtccttacaaaaccttagccagaatttgcaaatgcagcaccaaacagatcagatcacaaggtttcaa

SEQ ID NO: 2750 - DNA, 1200 bp, mus musculus
tggtggtttttaaacactctaacctcccatctagcccaccatccaccagctgtagtggaaaagaaaggatacaggggaagtggacttgtttagaaatgcttctttgaagcaactcccatctgtgttgtcaggaaaacagcagttcaattcacaagtcagcagtggcagcttgatccacttgcaagtacttcaagaatataccagcagtccagtttgatagcagcagcagtggcatgacctagcaggaacagccaggcttccactgaatcagcaccagtcagcaggggctattcaggccagctggaattccaggaggagttctcagctgtgcctctctagtcaaagtgaatatcagcaaagacacaagataccaacaagcattgcacagctagttctaccagcaagcaagtaagccaagctaagcctcttttatagtctattgagtcctattatactccctccaaacatcacctgtccatcagcaggtgtcctgcctcagcatgtgagtctgacttaggaaaactccacttgagtctgtctcagctgacatcactctgccaattgatggagtctgaagaagcagcaagaactacaccataccaccagacattttttggtgcgtttctctctatggagtcatgacaaatggagctcaacaatgcaatgtaaggtggaccaatacatgcttgtccttagttaaaactcttcatcacatgtcctttcatgtgcttcctttagcagaacattctttcacctgtgtctgcttcagctaaacatttgttcgtgagtctgccttagccttttgcctgtgtccacttcagtgaaatgttccttcgcatgtttactccagcaaaaccccatccgatgcaactgactttctgaagaacccttaagtttttagccctggtaagctgcccatgccccagtggaaatccccaccacaatgcacagatggccaacagtaactgatcttagtgggatataaagtttaagaaaatgaagacatgatgtaagaagcaggatttttttttttctgagttgaactgtatgaggaaaatgttagacagctagtatcaaaatacattgcttatgtgtatgaaattttcagttaataaaatattatttaaaaaatcctattcttcatagttgtattttattacaaagaaaattcttgccttaatgactaagtaagtaaaaggg

SEQ ID NO: 2751 - DNA, 1200 bp, mus musculus
ttaatcatcagggaaatgcaaatcaaaacaaccctgagagtccacatcacaccagtcagaatggctaagatcaaaaattcaggtgacagcagatgctggccaggatgtggggaaagaggaacactcctccattgttggtaggattgcaagcttgtccaacccctctggaaatcagtctggcagttcttcagaaaattgaacatagtactaccagaggatcccgcaatacatctcctaggcatatatccagaagatgctccaaccagtaagaaggacacatgctccactatgttcatagcagccttatttataatagccagatgcccctcaatagaggaatggatacagaaaatgtggtacatttacacaatggagtacttctcagctattaaaaagaatgaatttttgaaatccctaggcaaatggatggatctggagggtatcatcctgagtgaggtaacccaatcacacaatgactcatatgatatgtactccctggtaagtggatattagcccaaaaacgtagaatacccaagatacaagatacaatctgcaaaacacatgaaactcaagatgaacaaatccaaagtgtggtcactttgccccttcttagaattgggaaaaaaaacacccatggaaggatttagagagacaaaatttggagctgagatgaaaggatggacaatttagagactgaatacctggggatccatcccataatcagcccccaaatgctgacaccattgcatacatagcaagattttgctgaaagaaccctgatatagctgtctcttatgaggctatacttgggcctagcaaacacagaagtagatgctcacagtcagctattgcatggaacacagggcccccaatgaaggagctagagaaagtacccaaggagctaaatggatctgcaaccctctaggtggaacaacaatatgaactaaccagtaccctctggagctcgtgtctctagctgtgtatgtatcagaagatggcctagtcagccatcactggaaattgatcagaggcccattggtcatgcaaacttcatatgcctacgtacaggggaacaccagggccaagaagtgggagtgggtgggtaaggggtgggggtatggtggacttttgggatgacatttgaaacataaatgaagaaattacctaattaaaataagaatgaaaaaagaaaaaaaaaag

SEQ ID NO: 2752 - DNA, 1000 bp, mus musculus
acccaaagaggttaaataagaaggaaagcccaagtgaggatgtttaaatcccacttagaagggggaacaaagtagtaatgggagacagaaagaactgggtgggagagagaatgtggaggggaaatggggtatcaggatctggtgtggggagagagagaagagagtgtcagaaggccaggagaatgaatggaaatctgcaactggagagggaggggaagtagagggacatctggaggacataccagagacctgggatgcacgaggctcccaggagttaatgtgggtgaccttaactgagattcatagtagtgggaatatggaacctgaagagaccccctcctgtgggcaggcagggaccctagtaaacagataagggcaccaacccacccacaaaactttcaacctaaaacttttcctgtctacaagaaatgcagagagaaagtagagcagactgaggaaatggcaaaccaataactggaccaacttgagacccatcccatgggcaagcaccaatatctgatactattaatgatattgttatgctttcagacaggaatatgttgtcctgagaggctctacctagcaactgactcagacagaagcagacacccacaatcaaacagaatggagcttggggactcttatggaagaatatgagatcatggctggaaggagttaggaactccacaagaaaaccaacagattcaactaacctggactcatgggactctcacagtttgactcaccaaccagaacatacatggactagacttaggccccaaagcacatatgtagcagatgttcagctcagtctccatgcaggtccctcaacaactggattgtgagatgaacctaaagctgttgcctgtctatggaatccagttcccttaactagattgccttgtctggcttcagagggagaggatggacctagtcctgtagtgacttgatgtaccagggtgggggagatatccagaggtagcctctaccctgtcagagg

SEQ ID NO: 2753 - DNA, 1400 bp, mus musculus
ttttctgtatctattcctctgttgagggacacctgggttctttccagcttctggatgttataaataaggctgctatgaacatagtgaagcatgtgtccttcttaccagttggggcatcttctggatatatgcccaggagaggtattgcaggatcctccggtagtactatgtccaattttttgaggaaccgccagactgatttccagagtggttgtacaagcttgcaatcccaccaacaatagaggagtattcctctttctccacatcctcgccagcatctgctgtcacctgagtttttgatcttacccattctgactggtatgaggtggaatctcagggttgttttgatttgcatttccctgatgattaagggtgctgaacattttttcaggtgcttctcagccattcagtattcctcaggtgagaattctttgtttagctctgagccccattttttaatggggttatttgattttctggagtccaccttctcgagttctttatatatattggaagaagaacaaagaccaaagtgtggacactttgccccttcttagaattgggaacaaaacaaccatggaaggagttacagagacaaagtttggagctgagacaaaaggatggaccatctagagactgccatacccagggatccatcccataatcagcctccaaacactgacaccattgcatacattagcaatattttgctgaaaggacccagatatagctgtctcttgtgagactatgccagggcctatcaaacacagaagtggatgctcacagtcagctattggatggaacacagggcccccaatggaggagctagagaaagtaaccaaggagctaaagggatctgcaaccctataggtggaacaacaatatgaactaaccagtatccccagagctagtgtctctagctgcatatgtatcagaagatggcctagttgtccatcagaggaaacagaggcccattggtattgcaaactttatatgcctcagtacaggggaacaccagggccaagaagtgggagtgagtgggtaggggagtttgggaggatggtatgggggacttttgggatagcattggagatgtaaatgaagaaaacacctaattaaaaaaaagtaaacgatcttgcacataagtgaacagtcaaaagtgattcctgagtacaatattataaatcagttttgctgtgtagaattatttattctattactttttttattattctattaccttagtaacttttaaaactttgcatttagagaaaagttaaatctatacaaaagtgatattttcaaataagttctacatacccttatcccaaagatttcattcaagattaactagttgtctcaataatacagtatacttttccaatccagaaccaaaaatc

SEQ ID NO: 2754 - DNA, 1400 bp, mus musculus
cagatcatttttaatagcatgtaggaataagtatacattttaatatttacctttaccatgatgtgactatgctggttgtatatctatacacagttcatttgttcaaaaagtatgtaaaagggacggagctgagacaaagtttggagtcattagtcactaaactacaactaagaaatgtttaggtgtgaactggagcctggagataaaaaggagttagcatagaaaagaaccttagtcttggaaatggacaggcagagaaacacaggaaggaggaagatattaaaaacagcttgctggggaccagccccatgcatgtgcactggtgattctctttggaaggcagctgattgggcagagcattgcagggccaggagggagtgcaaaacttggttttgtaagtgttaagtatgtctagtattaataacatttattgtctttaattcttagttatactggggccaaaagcgatggctttgggcgaattatcaccttttgcttaacagcagggtatgtctagtggggggtgttaggtaaaggatttattgctggggttcccttctggtcagttagacagaagcctctcacctgctaggctggttaactcttcctgaaacagagaggatggaaaagacaagaattaagatcctttacagggaaaagaaactgtccatgcaggagagctcccaaagagaccactccacacaggagagcactgaggtggcagaagtgatatagcttctgggaccgggtccattttgggccagtatcttcgggcagagggcagagctgagacccagacctctgtgctctttccccaccagaggagaggcagcctccagggagagctctgtccatgggaccaggtatgaacaccatcttgtatcccaggtcccaaagagaccagtctgctcaggagagcacccaaagaaaccagtccacacagggagcatgtgcaggtgccagaagctatatagcttttgggacagggttcctatcaggtcttcatcttcagccaggaggcagagctgaactcaagaactctgctcacttgcctgcagagagtactctgataactgagactcaggagggtgttagactcccaggagtgctgacagaagctaacagaatcactggaggaacaaactcctgccagagacagctataacagctaaggccagagattaccagatggtgaaaggcaaacttaacaatcttactaacagaaaacaagaccccacagcatcatcagaacccagcactcccaccacaatgagtacgggacaccccaacacacctaaaaagcaagatttggatttaaaatcatatctcatgatgctagtacaggattttaaggaggacattaataactcacttaaagaaatacaggagaacactgctaa

SEQ ID NO: 2755 - DNA, 1200 bp, mus musculus
cagctctgccatgctcccaccttgaagataatggactgaaactatgatctgtgagtcagccccaattaaatgttgtttcttataagacttgccttggtcatggtgtctgttcacagcagtaaaaccctaagacatagttcattatgtttttctgatgttatcagatatcagaacatcagagaacaacctttggggtcctgtatatctaattcaggcaatcagcattgggggcaagtgcttttaccaatggaaaaaaatctctgcactggctggatttgcgtgtcaacttgacacaggatggagttatcacaaaaaaggagcttcccttgaggaaatgcctccatgtgatccaactgtaaggcattttctcaattagtgatcaagagtttcaggcccattgtgggtgggaccatctctgggctggtggtcttgagttctataagaaagcaagctgagcaagccaggggaagcaagccagtgaagaaacatccctccatggcctctgcatcagctcatgcttcttgactgacctgcttgagttccagtcctgacttcctttggtgatcaacagcaatgtggaaagtgtaagctgaataaaccttttcctctccaacttgcctcttggtcattgtgatggtttgtatatccttggaccaggaagtggcaccatctgaaggtgtggccttgttggaataggtgtgacctggttggaatgggtgtgtcactgtgggtgtgggtataagatcctcacccaagttgcctggaagtcagtcttccactagcagcctttggatgaagacatagaactctcagctctgcctgtgccatgcctgcctggatattgccatgctcccaccttgatgataatggactgaacctctgaacctgaaagccagccccaattaaatgttgttttttataagacttgacttggtcacggtgtctgttcacagcagtaaaaccctaactaagacagtcttgatgtttgtgcaggaatagaaactctaagacaatttccatcctagaatttatttcttcttaaggataaacaataaaccagtgtttatgcaagccacattctggttgtttatttatgctgatggacaaatgagattttacaaagcttttggctcatatgaatagtaatactataaacactggtgctcacatatctgttaagtccttcactttcctaaggtc

SEQ ID NO: 2756 - DNA, 1400 bp, mus musculus
ctagaatgaaataaatggcaagaaatatttgaactcagtgctgaaatcaataaagtaaaaacaaacacaaaaataagcaaacaaaataaaacaatacaaagaattaatgaagcaaagagaagagagcctcaccataatccaaccatactgataccttggactcagatttccagccttcagaacatttctcttaattatatgctatctagcatatggtattctgttatagtaaccttaattaagaacaaaataaacaaatatatcttggtttatccatatattaaaatattattaataaatagaaaaactgaattaatatatatgtaacagtgcagaaaaatcatactatacttattgatatgatgttttctatttgttaaaaaaattaaaaaatggacaggatccttctagtttccatctgcatgagaagctgatcctgtgccacagcacctgcagctcatcctatgccacagtgctccatacccagatactgttggaagagagctggtctcccaggaatgctggcacatacctgtaagcacaggtaagacagccagttctgttcaaattcctggcccaagagggacacacccagagccatcagggcacaggaatcaaggaaccatcagggacagaaccctttcggtttctgtctgcaccctggagctgaccctgtactattactctccatacccaaattcctccaggagagaactggtgtcccaggagtactgacatacagtattgtaggagggacaagtcacagtcagaggcagcaagaccagctaacaccagagagccagcacccttgcaagtgccaagggcaagaatataagcaacagaaaccaagactacttgatatcatcaaaatccacttcttccaccacaacaagtcctggataacccaacacacccaaaaagcaagactgattaaaaaccacatctcataatgatgagagaggacattaggaaggacataaataactcccttaaagaaatacaggagaacacaggtaagcaggtagaagcccttaaagtggaaactaaaaaatcccttaaatatgagctaatcagtacccctagagctccctgggactaaatcaccaataaaagaaaacacatgataggactcattgctataggtgcatatttagcagaggatggcctagttggtcatcaataggaggagaggccttggttctgtgaaggttctatactccagtatagggaaatgctagggtcaggaagtgggagtgggtggtttggggatcagggggatgagaagggtgtaggggattttcagaggggaaactaggaaaggggataacattggaaatgtaaataaagaaaatatctaataaaaaaaaagaaagaaaatgaaaaaaaaatcccttaaagaa

SEQ ID NO: 2757 - DNA, 1000 bp, mus musculus
tttcacatcatttgtacatttactgcatactttgtttttgttttttatttttgacatttgtttttcttttcttttcctttttttattagatattttcttcatttacatttcaaatgctatcccgaaagtcccctgtaccctccccacaccctgctccccaacctacccacacttgcttcctggccctggcattcccctgtactggggtatataatcttcacaagaccaagggcctctcattccattgatggctgactaggccatcctctgctacatatgcaactagagacataagctctgagaggtactggttagttcatattgttgttcctcctatagggctgcagaccccttcagctccttgggtactttctccaactctttcattggggagcttgtgttccatccaatagatgactgtgagcatccacttctgtatttgccagacacttgcataacctcacaagagagagccatatcagggtcctgccagcaaaatcttgctggcatatgcaatagtgtctgagtttggtggttgtttatgggatggatccccaggtgggtcagtctctggatggttcttccttccatctcagctctgaactttgtctctgtaactccatgggtatttttgttccccattctaagaaggaatgaagtatccacactcactgcatagttttaaaaaaatggttatttctcaaattatggcctattttatttcttaaagttttgatgttgaagttttatattgataagacttaacttactttgaataatataattcatatcaggtctgatacaaattgaaaagaaatcattcattgcatagaaattatggaaataaatatccttaatatagcctttcctattttctccctccaccacaaaattgtagtggttcctattttctctattttgtgctgactatatataagtcacataggcttggcacagaaaaatttatgaagcaagaaaggttaacagtgtctgtgctctg

SEQ ID NO: 2758 - DNA, 1000 bp, mus musculus
tagttattttatagaaagttacattgaaatataattaataatgtctagtttatcatttgttaatgaaaaactccctatcaaaatgtgtggtaagtgctttatttttattactcaatatcattttttcttaattgaatttcttttttaaattctttttttattagaaaatttctttatttacatttcaaatattatcccctttcctagtttctccttcaaaaactccctatcccttccccagctccgcctcctccccaacccacccacactggcttcctggccctggcattccctttcactgggacatataacattcacatttagggcctctcctcccattgatgaccaataggccattctctgctacgtatgcagctagagccatgagtcccaccacgtattttctttgatttgtggtttagtctcagggagctctagatattctggttagtacacattgttgttcctcctatggggctgctaaccccttagctctttgggtacattctctagttccttcattggggatcctgtgatctgttcaatggatgactgcgaatatccacttctgtatttgtcaggcactggaaaagcctctcaggagacagctctatcaggctcctgtcagcaagatcttgtttttatccacaatagtgtctgggtttggtggctgtttatgggatggatccccaggtggggcagtctctggatggcctttccttcagtctctgatccacacttagtctctgtaactccttccctgggtattttgttctcccttttaagaaggagcaaagtatccacactttggtctttcttcttgagtttcatgggtttttttttgttttgttttttgttttttttgttttgttttgtttttgtgaattgtatctttaactgaatttctaatacatagtaaaaaaatgtatttagaagagtaatatgtatacatcttccaaacatgaaaaaatttcaacagaactacaaaattttgtaatac

SEQ ID NO: 2759 - DNA, 1600 bp, mus musculus
attggatgtaagtcttgctccacaagacaaaacctatacctaacaccattattgatcaggaacttatggccaagccgggtgttggtggctcatgcctttaatcccagcactctggaggcagaggcaggcagatttctgagttcgaggacagtctggtctacagagtgagttccaggacagccagggctacacagagaaaccctgtctcaaaaaacaaaaacaaaaacaaaaacaacaacaacaacaacaacaaaaaaaaaccaaccaaccaacaaaacagaacttatggccagaaagacaataggacccaggaataacatgctactattatgctgataaatggaaacagtattaaatagactcccaataacacccatggacagcgcatctctcagtattttttggggggtggggtggggtggggtaaggatatgacctttattgagcttatccaccagagtggaaacaatgtctgtataatgtttgttatgtttgttactataacttctgcatcacaattaaaattcaaacagttaaaaaacaaaacaaaacaaaacagtcaactcaatcaaagcccactacatcagaatcaatagcttatttgaaatcatagtaacacttaaatatggttaagactcgaatgcagaaatttggttggttggaaggctaattaagcctccaacttgctcaaatagaattacaaaaaggcaaaattgtgtttttcacagagatacagtccactggaatcaccaacattggacagctgttaagaatttgtctgaggaaaaaaaaaaaaagaatttcgctgagagtctgcctggcttcgtctcttccttgcttgttggagtttcagcacagttcaagatggctggctgtaaggctggaaaggattccggaaagagcaagacaaaggcggttggtttcccacacacagccagcattcttgcagttcaatgtgggccactaggacaaccaaccatttttgtctgcgggtgtgactgctgctgtgtatacagcccagccatcctagagtacctcaacacagaggtacttgagttggcaggaaatgcatcaaaagacttaaaggtgatattttgacttcttcttttccaatttgtatccccttattatccttttgttgtcgaattgctctgcctaggatttcaagtacaatgttgaataggtagggagaaagtgggcagccttgtctagtccctgattttagtgggattgcttccatttactttgatgttggctactgatttgctgtagatttcttttatcatgtttcggtatgggccttgaattcctgatctttccaagacttttatcatgaatgagtgttggattttgtcaaatgcttgctccacatctaacgagatgatcatgtgtttttttttctttgagtttgtttatataatggattatgttgatggattttcatatattaaaccatccctgcatccctggaataaaacctacttggtcaggatggatgattgctttgatgtgttctttgattcagttagcgagaattttattgagtaattttgcatcgatattcataagggaaattggtctgaagttctctatctttgtt

SEQ ID NO: 2760 - DNA, 1600 bp, mus musculus
atggaccatgtagagactgccatatccagggatccaccccataatcagcatccaaacgctgaaaccattgcatatactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatctgcaaccctataggtggaacaacattatgaactaaccagtaccccggagctcttgactctagttgcatatgtatcaaaagatggcctagtcggccatcactggaaagagaggcccattggacacgcaaactttatatgccccagtacaggggaacgccagggccaaaaagggggagtgggtgggtaggggagtgggggtgggtgggtatgggggacttttggtatagcattggaaatgtaaatgagctaaatacctaataaaaaatggaaaaaaaaacttcagggacaaaaattgagaagagactgagggaaaggaggtctagtgactggcacaactttgaatccatctcaaggggagactccaaggctgacactattactgaggctatggcatgcttacagataggagcctagcacagctgtcctctgagaagtccaacaagcaaactgagacagacacagatacttatacccaatcaatggactgtcgtttgggacccccatggttgaattagggaaagggtgcaagaaggtgaggaggtggtcaactccattggaagaccagaagtctcaactaacctggacccctgagatctctcagacactgagccaccaaccaagcagcaaacactagctggtccgaggcctctgacacatcagaggactgcctggtctgacctcagagggagaagaaaatatacctaagccgggcgtggtggcacacgcctttaatcccagcactcgggaggcagaggcaggcagatttctgagttcgaggcctgcctggtctacaaagtgagttccaggacagccagggctatacagagaaaccctgtctcgaaaaacaagaaacaaaaaacaaaaaacaaaaacaaaaacaaaaaaaagatatacctaatccttgagagacttgaggttccagggagtggggaggcctggcgcgggtatggggggaatatcctcttggagacagggcagaggagaaatggaataaggaactgtgggagggaggatcaggaggcaggtaacaactggattgtaaaaaaattaaaagtaatagaaaaagaaagaaaaaaatgactatgtactttgtaaaccaaagaatcctaaccctttgcaccacattctggagatccgtttgcataatagtttttaaaagttgttttttttcttccacacccttcttcctactctctttcaccttcttttaaaatctctttatttctgaatgctgaagacaaaacatatctattgcctttagcattctatatattatatatccatcccaaaggactgaattttaatgtaaacatttaattttagcaagcatgcttcacttcccaaataagtggcttttctattt

SEQ ID NO: 2761 - DNA, 1000 bp, mus musculus
ggatagaacttgagaatttcatcctgagtgaggtaatccagtcccaaagggacatgcatggtatgtactcacttatgagtggatattagccaaataccggtgccaagtcacattccacagattgaaagaagttaaacaagaaggaaggcccaagagaggatgcttgagtttaacatagaagggggaataaaatagtcataagaggcagatggatggagaaacctgggagaaaaggggaatggggaaggaattggagagctcaggaacaggtgtgaggaagaacaggagagatggttaaatggcaatggaaataaatggaaatctgcaaccgacacacatgggtatgaggaggtagggggcatctccaggagggacatgaacttggataaatgtagcacccaagaatcaatgggtttgaccttagttctgactcacttcattgggaatatggaacctgaggaggccactgcctatttctagacaggaacaccagtagtgcaaaagagacaacaattaacatgtaaaattttcaacccaaagtttatgctgtcctcaagaaatgtacacatggaaaatggagcagagacggaaggaatggccaaaaaataaccagcccaacttgagacccattctatgggcattcaaaaatccctaacactatcaataattttctgttatgcttgcagacaggagcatgttgttctctgatagaccccaaccagaagctgagttagacagatagagaaatgcatccaatcagtgaattgagttagggaatttttatggcagaataggaggaaggactgtgggcccccaaggggacaggaactccacaggaagaccaacagagtcaactaacctggatccttgggggctctcagaaactgaactaccaaccaaagagcttgcatgggctggacctagactttccctttcatatgtagcagatatgcaacttgagttgcctataggtcctaaacaacttgaacaggggctatac

SEQ ID NO: 2762 - DNA, 1200 bp, mus musculus
gtgtcatggagatcctgtaggtttggatctctaggaccagcaccttcacatcctcccacagttcttcaatggggtagatgttagggtgggccaacttaagcatctggatctggaactgaaagttatctgcactggtcagtctaccagttctctcctcacccaccacaccaaggtgagctctctagtctgctagcttatccactgctgcacaacagcaaaagaaggagccatcactcctgctttcatgccttttggagctggctcacctgcaacccctcttcccttgcaaccagagccagctccactttgctgcccaggtaaggtgtatggcacattctcccaagtattgcagcaagtgacggtaagggctacctcttccttttatgacactgggaccagatcttctgagggccactacacagcagagaagaggcaggggcaactctcctatgctcatgctctcagagctggctgacctgtaacccccacaagcagggccagttctactgtgctacccaggtgaaacacagggcctgctttgttaagtgctgcagcatgtgacaggcagaaacagctgaaccagctcacctgctttcctgatctggggccagctctcctgcaggctgtaggtggtaaggggtgagatgaagggcatctgcccctcacccattttatggcacccagacaagtggcagagccagctctccatgctcatacccttggggcctgttaactcacagttcccacagtgagggccagttgcacacccacagttcccacaatgagggccagttctgtgcttcctgggcaaagtgcccagcatgctctcctgagtaatacaagtgacaagaggtgagataagctgttgctgaacagtctctcctgcaatcccatgatagccagataaggtctggagctacgtctgtatagccctcagatatcaacatggcaccaggcagaagcccacaacagggcttctccaccacttaattgctcctcttagtggtacccaggatcatctcagaaatggtctcaggagtgctatctatgttctgtccatgaggtgtggcaccagacaggggccatctcagttatgctctgctcacatgggcctgtgcagcactagacttgtggtcttcttaggcttgctttttgcctgaactatgtggtggcccctgaagggggctgtctccaaatata

SEQ ID NO: 2763 - DNA, 1000 bp, mus musculus
caattgctctaatcaaatacttagctcttctgtatgatcactgttttagtgtgatcacccatttatcagtgtcaattaaaatttatgctaatcaaggttttccttaatgaaagctctttcactgttcatttgttctgtgatctgtctgtacattatcattctggtagtgcaaagatcaaatcctctgcttagcaatcaaatcaaactattatatcaccaaagaatacattgataatagcatagtcttgacccaagggtaaagagaatggagagaaagataaggaaaggctgaccaatacttcattcctccttagaatagggaacaaaatacccatggaaggagttacagagacaaaggttggagctgagacgaaaggatggactatccagagactaccacacctagagattcatcccataatcagccaccaaacccagacactatggcatatgcccgcatgattttgctgaaatatagctgactcttgtgaggctaggccagtgcctggcaaatacagaagtggatgctcaagtcatctattggatggaacacagggcccccaatggaggagctagagaaagtacccaaggaactgaaggggtctgcaaccctataggtggaacaacaatataaactacccagtacccccagagctgtgtctctagctgcatatgtagcagaagatggcctagtctgccatcattgggaagagaggccccttggtcttgcaaactttatatgtttcaatacaggggaacaccagggccaagaagtgggagtgggttggtaggggaacatggtgggggaagggtataggggacttttggtatagcatttgaaatgtaaatgaagaaaatatctaataaaatttgaaaaaagaggaaattaaaaaagacaaacataagagtaagaagttctgatacactgtttgtaccgtaggttcactatagatgtcatatttgcagcataatttttaaaagtaaaagaaaggatttgtaa

SEQ ID NO: 2764 - DNA, 1000 bp, mus musculus
ccccttctcccagtctccctcacacaaagcccctcccatatcccttccttgctttctcctcagagaagtgggaggcacccctaggtaccaacccaccatgaaacatcaagtcactgcaggactaggcacatcctctctgactgagaccagacaaggcagcccagtttggggaaggggatccaatggcaggcaagagagtctgagacagtccctgctacacctgttagggaacccacataaaggccaagctgcacatctgctacaaatattggaaggggcaggtccagcacatacatgatttctggttggtggttaagtctctgtgagccctcatgggcccaggagagttaactctgtaggtcttcttgtggtgtcattgaccccctctgatttctctaccataagacttcctagaatgtacataatgtttggttgtttggtctctgcttctgtttccatcatgctagacagacctctcaggagacagttaaactaggctcctgtctgcaagcagagccattaagagtgtcaggggttggctctctcccatggaatgggtcgcaaactggaccagtgattagttggccatttcctcagtctcttttccatctttgtccctgcaatcttgccatcaggacaaatttggacttgaaggattttgtgggtgggttggtgtcaccctcctttcactggaagtcttacctgataggaggtaaccatttcattctccatatctcgagctgccaggagtctcaactagagttaccccccatagattctcagaagcaccccccttcccaggtttcttgtttgccacagagataactcccctccacccatgtcaaattcagttctctctcccaaccttgtccccacctgctatccctccacaccacttcccttacgaagttctctccctccacccacctcctatgtctcttttatttccccttctggtgagatccaagcaccctgccttgggaattccttattacttata

SEQ ID NO: 2765 - DNA, 1400 bp, mus musculus
gaaataaaggccgtggacagttccacctcctttaataccttttaactttcttttcatatttagttacttagttgattagctggttagttattcaatcacttatatatctccacaacacatatgtggagactggaagacaacatcctctccttccaccatgtggggagccaggaaacaaattcaggtcacaggatttgtggcaagtgactttcctcacagatccatttctccaggtccccttttagctcgcccttcctttccttccttcctttcttccttccttcctcccttccctccctccctcccttccttccctccctccctccttcccttccttcctttcttttttgaatcaaagcttatttctttttaagatttgtttctacaccccaatatcaacccttcctctcctcccagtagccctttcacagacgtcctctccccattccatgcccccccagggtgtcacccccactaacactcccacagctccacccctgcacctgaggtcactgcaggaataggcacatcatttcccaataaagccagacaaggcagtccatttagggacgagatccgctggcaggcaggctacaggctcagggacagcccctgctacagtttttggggatccacatatgttcaggggccctaggtccagcccaagctcgctctttgattggtgattcagtctctgggagtacccaaatgtacaggtgagttgactgttggtcttcctgtggtgtccctgtcctcttcaggtccctcaatcctcctcccaacttccatacactacccaagctctatctaattaatatttgggcatgagcctctgcatctccttccatcagctcttgagtgaagcatctcaaaggacaattatgctaggttcctgtctgcaagaataacagagtatcattaatagtgtcaggaactggttcttgcccataggattggtctcaatttgggtcagtccctgagccactccctcagtctctgctgtatctttgtccctgcacatcttgtaggcagggcatattttgggttgaaggttttgtgggtgggttgctgatcttatccctccactaggagccctgcctggctacaggaggtggccacttcaggatccatatcccccactgctaggagtctcagctagagtcacccctaaagatcccagggcttccctccaccctgcttccaatctctcttctctctcccctactctcatatgtaaatatgactccccccactcttatccccatcccctcttccactcagttccttctttccatcaatctccagtacctaatttctttcccattctgaagaggattggcagtgttctttctgtttctattttgtggaatagtttaaagagtattagctcttctttgaaa

SEQ ID NO: 2766 - DNA, 1200 bp, mus musculus
aaagggttaaaatcggcaagtgtatggaaggctacagaaaaatgtcatcaataattagcctgttctttttttttttttcagagctgaggagtgaacctaggaccttatgcttgctaagtaaacactccgccactgagaaaaatcccaaatctcgcgagatcagcagctatcacgagagctcaaagttccctgagagtttttttttccgcgcccctccctgagagttttaagtcccaggaggttctggactgctcgcaagcggtggtgcgtcactatcacctcaggttggctggttagagacctccaacatgccttcggatcgaaggccaagtcagagaaggaatagatctaagagccgtgattatcgtggtgcacggtcaaaggtaacaagagctgatacgaggaacagagacgatactcttgccctcagtatgtatcaggggcctccgagtgccgaccaggggaacaacatggcggatgcccctcggtttggcttctggacttcagtaagccagtgtctgcaatacttgtgggccaggaggcacttgggcctgcttctacttttattctggacgctggtgatcctgttccgtcctgtgaacactggtgagtgttggttctaggctagagaaggggtgacagggacttgggaagtgtgaggtagggcctgggaggggattggagtaaaaggagggtgattggggtgctagtcagcaagggtaagggggccaaaggtggcagggcgagaccgagagcgagggaggttgatggggggtagtgaggcagggatagagggggatgaggcacaggagttgggctgatgcagcgggagcctataaggcagtgctggggattcagtggcaaattctggtcctctgaaacaaaattgctcttaactaccgagcatctcactagcacctataatcgtagttattatagtaattatagaagttagcaatattatacaaatattaatatttattaataattataattctaaacatattatacattattaaaatgtgctgttcttattatttctcactagcaatatcaataatatcaatacaattatgataattatagtatttatattttatattattttatattatgccaactataattaataatgacacaatattatagaataataaaaagtaataatgttattattatgtggggatatatgtttgtgtg

SEQ ID NO: 2767 - DNA, 1000 bp, mus musculus
gtagatagatagggaatcaagtggagggatggggttgccataccacagtcaaaatttttgacccagaattgttcctgtctaaaaatagacaaaaatggagaagagactgaaggaaaggcagtcaagtgactggcccaacttgggattcatcccatgtgtggcaccaaggcctgacactattactgatgctatggtgtggtaacagacaggagcctggcatggctgtcctctgagagtccctaccagcagctcactgaggaagactcagatatttacacccaaccattggactgaagtcagggacccctatgtttgaattagcggaaggatggaagaagccaaggaggaaggtggaaggtgaccccataggaagaacaacaatctcaactaatccggacccctgggagctcccagacactgatccacctaccagacagcatatactagctggtctgaggtccctagaacttatttagcagaggactaatccttgaaagacttgaggctccaaggagtagggaggcctggtgagggggagcatcctctcagagatgggtgaggaggaatggataaagaactgtgtgagggggtggtcaggatggggagtaatggctggattgtaaataaactactactactactactactactactactactactactactactgaaatttgttttctttaaaaaccaagttctgttatgtgactatgtttgtctttgaatcgcaagtatggggtacggggtgcttcagattctccacagccactaactatgttgccttgtgctctaggagtcttaagacttttgccagctgcagacagattatgcttgggactttggagagggtacaaattcgagagacctgagagggtgatgtggcagggcactgtcctccctggctctccctgttgctgcttttcctattgttggattgctattttactggattgctggttggagatatcctgatgacttagattagacttggccctaa

SEQ ID NO: 2768 - DNA, 1000 bp, mus musculus
gtgtccaaagaatataacaattattatatctttcgtaattaggaaaattcagtagataatagagtaagcctccacaaatattatcaggcacgttatgagtataacaaacttccctgtaaagtacacatattagttttcagttcacagctaaagaaatcaggattttgttcctttcctctttcagccactggtagctgtttgcattccttgacttgacaccatctgggatcctaatacttacctaggcttctagcttgcctttttatgggcctggaacatcagtgtgactccagcctaatcttcaagattcacagctgtctttgtgcctaaccctggatcctgatggcttaccattccattctgtcgtatataacctttggaaaacagggtaatcctatccccacccaataaaagtttgttttcatcctgcatttaggcatgaggatattgtcagaatttgccaatttattagatttgcttgggtgtaagtaaggggtttcagtgtctacaagctcagataaactcttcatatgtgatatatacatacataaacatctatttaaaaatatatgtctatacatatatgtatgtacaggttgaatatcctttatataaaatatttggcaccaatagtatttccaagtttggagtttagattttagaatatttacatatattttactgattcctaatctcaaaatctcaaatataaatgttccaaaatctaatgctttttggaatgtgatggatttatattttcagattagagagattagaaatgctcaatattcatgtgtatttgtgtttacatatagacagacacatttttaacttttctttaaaatgtttcctttacatattctaatccatatgacaactaagaagttctatttattcatttaatgtattgaacacttcttccatgccaggctctttgctgagtgctagggatacagtagtgaatctgctgcaaatggtgttctcaagagacacatactgt

SEQ ID NO: 2769 - DNA, 1200 bp, mus musculus
gcaaagcatagtaagttgtacttcagagcaaatgggtcaaaacattgtcatggatgggtgatatcaaagccatgggtttgtatatattttacaactagaatgaagtaagatgatagcagagtcattctgaattttactcagaagaggaaataaaatagagatctgaggttgatggagggaaggaactggatggagaggaaatggggaggggaacaggcttgaggatcatgcatagggaggcagggaggctggaaatcagaggcatgcaggcagggaacagtatttctaggatgtatccaagacttgggaaagagggaagccacattgagtctatgggggtgactctagctgacactttaagctcggaaaatcttgtggaagagttggggaaggattgagggacctcaaggagaggggatagagaccttacaggaacactaacaaattcaactaacttggacccttgaggcttctgaaacaccaactaaagggcaagcatgagttggacctaaattctccacatacatgtagtggctgtgtgtcttggtcttcatgcaggtcctcaacaaatggagtgggggctgtccctgagtttgttgcctgcctttagatcccatttccctaactggatcaccttgactgacctcagtgggagaggatgcacctagtccttcagtgacttgctgtgctagggtgagatgacaggaagggactctgccttctcagaggagaagtggagtgggcaggagctatgtgagggggaccttggaggaggactgctatccagatgtaaagtgaatacataaataaattaatatataaaaagataatcattttggcaaacagagtagaaaagaaaggaaattacattttgaagggcagtctagtataagccccactcagaggggaagtctagtaagtcccactcactctagaggctgcagcttcaggaatattgcatgtggaaatgtaagtaacaatagacttgatcacttcaacctaatacatataacaaagcagtagcctatagtacttcagcagatgatagcagaagtactaatgtactttcccttgtataaaatggcatgttttactgtgacccatagacaacttccctctgtgcagttaatatttacatgacctataatacagaatgaaatgagaataccatgcaaatagttattcttctgtactctttca

SEQ ID NO: 2770 - DNA, 1000 bp, mus musculus
tattagtacaaagagccataactcacaatgaagatgtatcacttataggtatttatgtactgaagaacatagcaaccacatttatgaagcaaaaacttcagataatgactctaatgaagagttccattccctctaccacagttcctcatcccattactccttccccttgcctccaagagggtagccccctgccattagggctccactttttctggggcctcaagtctctctaggagtaagcacatcttctctcactgaagcctgaccaggtagacctctgctataattgtgccagggacctcagatgagcccatgtaagctcttggttgatggctcagtctcttagtgctctctggggtctgggttagttgagactgttggtcttcctatggggtcaacctccccttcagcttcttcaatgcttcccttaactcaaccataggggtctcccacttcagtcctacgtttgagtgtaagtatctgcttctgtctcagtcagctactggtagggcctctcagaggacaatcatgctaggctcctgtctgtaaacacatcatagcatctgtaatagtgtcaggcctttgtggtgcctgaccccaccacacacatgcacacacacacatgcacacaggagatagaactcaagttgggccgatcactggacctcctttctttcagtctcttctccatttttgtccctgcaattcttttttttttaattttattttaattaggtattttcttcatttacatttccaatgctatcccaaaagtcccccataccccccccacacacacacactcccctacccttccacacccacttcttggccctgcaattcttttagacaggaacaggtatgggtcagaaattttgactgtaggttagtaactctttccctcaactagaggccctgtctatctactggagctggatgcttcaagtttactttccccaacgttgggcattttggctaaggtcacacccaataagtcctc

SEQ ID NO: 2771 - DNA, 1000 bp, mus musculus
gatatatctaatattaaaggaaacatttcttaaaaagaatgactagctagccaggaaaaacaatcaatttctcatggttcaaattttctttttttaattaattattttatttatttatatctcaaatgttgtgccatcctggtcccccctcacagagttcttcccgcctccctctccccttcacctctgagaggatgtccaccccagagtataccccctccttgagcctttaagtctctataggattaggtacatcctctcccactgaggccagacaaggatgtcctctgctacatatgtgtctgggacctcagaccagcctatgtatggtttttggttggtggctcagtctctaggagctccaaggggtccaagttagttgaccctgtttgtcttcctatgggattgccatcccctcagtttcttcaattcttcccctaattcttccatatggtcccctatgtcactacaatggttgactgtatgtatctgcatctgtctgagtcagctgttggtagagcctctcagaaaacagccatgctaggcttctgtctgcaagcacaacataacatcaggaatacggtcagggtttggtgcctgtgcatgggatggatcccaaggtggggctggttactggtcagccattccttcagtctctgttccatttttgtcccttcatttcctttagtcaagaacaattctgggttggtgtccccatccctccactgggggtcctgtctgactactggaggtggtctcttcaggttacatatccccactgttggtcatttctgttaaggtcacccacattgactcctgggagtgtcccccatgccaggtctcctggacttcttagagattcctcccatacccacacccatcccagctgcatatttccattcatgctcctgccctctggacctctctcctgtccccccatacctgatcttgtcccccttttccatttccctgtcctctcccacccaggcccctccctccc

SEQ ID NO: 2772 - DNA, 1000 bp, mus musculus
cctctgcaaagcccctgtcccatccccaccttacgcccacccacctcccgaatcccacctcaccgccctatcattcctctacactggggcatcaagccttcacaggaccaagggcctcccctcccattggtgccaaataaggcccctacagctccttcagtccttcccctaactcctctattttggtccctgtgttcagtccaatggttggctgtgagtatccacatctatttcaaagtttcggtctatctttttgatattctctactagatacttcagacatccttagccaattcccataatctcacgtgacacatgaattcaaatttagtaaaggtggctgaattgcttctgttccaagaaggattaaaatgaagaaaacaaaacaagttatttcttcaaagtgcttgatgtggtagacacgatgcagagcatagagattcacaatggcctgtataaaggaagaattaatgtacatgacatctaccattcatgtctcaaaaacaatcctgaatcattcttccctcattctaatgataccaaacaattttcataagagcacacagaggaggagagattgcaatttccgctcagggaccgtctaaggtggagccagccgggagcacacaggccacaggagcagtggaacagctggaacagggtcctttctgcctccatctgcacccaggagctggggctgtaccacagtcctttgtgtacggtcctgccaggaaaaagctggtatccagaaagttctctgactccctgactcagaggtgagaccactattttctcttaggtgactgtctaaggcaggagtgactgtctaaggcaggaccagtcaggagaacacaggctgcaggagtggtggagcagctggggcagggtctttcctgctcccatctgcactgaggagctggggatgttccacagccctctgtgcacaggttctgccaggggagagctgatctcccaggagtgtttacataggcttacagac

SEQ ID NO: 2773 - DNA, 1200 bp, mus musculus
tacggatgttctttatagaatcttctgcacctgagattctctcttccatctcttgtattctgttgctgatgctcgtatctatggttccagatttctttcctaggctttctatctccagtgttgcctcactttgggttttctttattgtgtctacttccctttttatgttggatcgttttattcaattccatcacctgtttggtcgtgttttcctgcaattctttaaggaatttttgtgtttcctctttaaggtcttctacctgtttagctgtgttcgcctgtatttctctaaatgagttattaaagtccttcttgatgttctctaccatcatcatgagatatgcttttaagtccgggtctagcttttcgggtgtgttggggtgcccaggactaggtggggtgggagtgctgcattctgatgatgatgaatggttttgatttctgttagtaggattcttactttgcctttcgccatctggtagtctctgaagctagttgttatagttgtctctggttagagcttgctcctcaggtgactctgttagcctctatcagcagacctgggagactagctctctcctcagcttcagtggtcagagtattctctgcaggcaagctctcttcttgcatggaaggtgcccatatatctggtgttcgaacctgcctcctggcagaggttgtattcgactcaccagaggtcttacgatcccgttgagggacctgtgagtaccttgggggtgtacggaatctccgtgcgcaaggaaccccagtgctggagtggactggaagggacttgtgcccctgatcaggtcaggttatctgtttccctagttaattcagtctcaggtcccgcatgattggattggagcagacactgtgttccactcaccagaggtcttaggatcccatgggtgatcctgtgtgggtccttgcgggtgtccggagactccacaggcaaggcaccctggtgcttgagtggaccggaagggacaaccagaaatatttcttttggagttgttggccaatgatgttccatagatcctcaaacattacaaaattactgtcaaagttattgggtattctccataacttgattattaagactctattgctaaagatatcacatacttaaaccataaaacatgtagaaatcaaggtgatactaacctgaaacctttataacctactggatagctcaac

SEQ ID NO: 2774 - DNA, 1000 bp, mus musculus
ccaggatccaacaggaggagagagaacctgtagagaccatatccagaggttaaacacagaccccagttgaggcatggggccactaaccaatataaaaaatattaacccagaattgctcgtgtctaaaggaaatgcagggacaaagagtggagcagagactgaaagaaaggccatccagagactgccccaccgggggatctgtcccacctgcagacacaaaacccagacactattgctgatgtcaagacatgcttgctgatattgaactggggttggaagaggcgagtccggtctcaaaatggagggccatgatccaaaggaaccagagcagctgaggaagctgtttattggtggtctgagctttgaaaccacagatgatagcttaagagaacattttgagaaatgggcacacttacagactgtgtggtaatgagagatccccaaacaaaacgttccagaggttttggttttgtgacgtactcttgtgttgacgaggtggatgctgcactgtgtgctcggccacacaaggttgatgggcgtgtgtggaaccaacgagagctgtttctagagaggattctgtaaagcctggtgcccatttaacggtgaagaaaatttttgttggtggtattaaagaggatacggaagaatataacctgagagactactttgaaaagtatggcaagattgaaaccatagaggttatggaagacaggcagagtgggaaaaagagaggatttgctttcgtaactttagatgatcatgacacagttgataaaattgttgttcagaaataccacactattaatgggcataattgtgaagtgaaaaaggccctttctaaacaagagatgcagtctgctggatcccagagaggtcgtggaggtggatctggcaactttatgggtcgtggaggaaactttggaggtggtggaggaaactttggtggaagaggtggctatggtggtggaggtggtggcagcagaggtagttatagaggtgg

SEQ ID NO: 2775 - DNA, 1000 bp, mus musculus
caaactgctgcattatttcacagtaaagtaagattggggggcggggggaggcacagtgcacaacagagaccagtcaagcaggtctcctgcctcctgcctgctgggttcagtgactgacctcattctgcatatcaagtactgctagctagcacgccttgacccaatccgccaagctcctccacatagggctagagaagtgacaggcagagtttaatattctgaagctttaaagggtggccaacaggagcatgttgctaggtcattctttaatagcactgattccatcagcctagaacataaacacctcctcctcctcctcctcctctatcccttttacctggtgttttcacaacctccacttgcttcctaagctgcactggctagggtaaagttcaaattgttccttctcctttttacttgccaggatggaagtccaagtggtagcatggctttactaaccctccctcagctagacagtgcactcactcttagactcagctgtgggccccagctggcacgccggggactgagtggcttctcagagactgcaggaattgccctctgcccatgttctgtgctcagcatgttgcaaacttgaagtgtggtgaagctaggtaaaaagtatcctcatggatatatggattccttctgctagtgcttagtgacacgtctttattgcgtactcctgggaataggggggtgggagtaggaaacaaagtcattcataaaacctatagcctgcaagagagtttgtctctaaatgcagacagtttcctctacaggtaagcaaagcaggcttcagtatggtgagggcgatcagcagacctatcatagctattacacatgagagtaaaagagaatgtcagaactaaaccataagtcacccagcaccttgctgcctggtagatgtcatagaatgtccctgtccagggccaaattccatttttatcagtgatttactgccagatctagaacaaggtcctgagcctcgctgagcctt

SEQ ID NO: 2776 - DNA, 1000 bp, mus musculus
ctattttgtgaccgagtagttagtccattttgtagaaggtaccatgaggtgttgagaagaaggtatattcttttgttttaggttaaaatgttctatagatattgtgggttaaaaatggtgtcccacatcctgcccaccacaaggctagggccactcatggaggcagacacgggaagggaggtttgactgctcaccccacacagccgcagggcaggcgtcaggctgtgagaagccacaggaccctgctcggggtggaggggcacagtctgaggtccctgcaatccttccagagtctagcttggactcttgggcaccacagatgcctctgggtgctacggaaaagctagctctggggtccctgggatgcatggatgctggggagagcagatcctagcttttggacacctcagaggccactgaatgttgcagaagacctgagaacagagtgcggaccagtgggtaggctctggcctggggccaaagggaaaagggcaggggaagtgagagctctagctgggtcctgtggggacaagaggaagacttcttccagtgctccaacaagggtgatactgataagaagagacagtccatggttttaaggtgtttattgtagaaaggcagagagagggagagagtagagaagtagaggccaaccatggccatgtggagaaggaaagagggaatggggagagaggggaagcaagaaagtaagaggcaagagtaagagagtaaaagcaagagagtaagagatgtgcctggcaaatacaaaagtggatgctcacagtcatctataggatggaatacatggcccccaatggaggagctggagaaagtacccaaggagctgaaggggtctgcaaccctataggtggaacaacagtatgaactaatcagtacccccagagctcgtgtctctagctgcatatgtagcaaaagatggcctagtcggccatcattgggaaaagaggccccttggtcttgcaaactttatatgccccag

SEQ ID NO: 2777 - DNA, 1000 bp, mus musculus
gtcaacagcatctgcaagagagagagagtaagggcgtaggggcaagaaacatgaagaatggagacaacacaggctatctgctcaagtctcatttattgaaaggcaactcgctggggagtgcagctggagacatcattaggtagtccgggggggggggcatgcagatggaggaggtctctgaaatggaggccattcaggatcatgatatttggcaacctcttcttccaggtcatacctgtctgactcagagaacgtatagtgatgagcaattgccacaaagaatatttaaatgcaggttatgaaaccctgcaggcctatggccacagcttctgcactttgtcattcccaggtacgcttttctgaaaaaaagaaaaaaaaagctcacttttaaccaacaatgcaataagtactgcttgccaaaaggaaacaaaaaccatgagtttcacacagagaaacttgccaacaggttttatagggctacacttttcctttaggactttgtaaaacagcaacaggcagtacatggcaaacaattgtgacaaactgcttaatataaccaggtatgtccaagcattggagaaactagtttccctcatcacttaatttgccccatttttgttactatgactcaccggtcccgaagcggcaggttctcctggatcgacccttcttccagtaacatccctcacggggtctctcattctcgctatccctgtttggcaccaggtgacccagtccgcgggtcagtcaatggcatctgcaagagagagagtggggactgaagggcaagagatgaagaatggagacaacacaggctatctgcctgtctcaagtctcaagtctcatttattgaaaggcaactatgggtatctatgcactcgctggggaatgcagctgaagacacttaaccacaggtccaggacgtgtacgagaaaaacaagatgttattagagtgtgttcaactgtggtaggcttcttgctaaaacatcatgctaggaaa

SEQ ID NO: 2778 - DNA, 1600 bp, mus musculus
agaaggaagcctcaaggaactgctacagatgtgtggggccacaagaactcagatgggggtgtcagcaaagtgaaggcaacttcaagtccatatggggtgtggaggagcctgccacagggttgtcttgggcagaggacaccagtgcctgggaacaagcacggctaggcagggagacagtacccaggagaggaggccgcaggatccagcctgtcttcaggatcatctacacagctctaggggagccccatgagggcagcacccttgagtcctttcgtgagtgaactccccccgcccctgtgaaacctgcaagcctcaggacccaaaggacccgggaggcaagtgccaacacaaggcagtttccttcttgacaccctgacaggacactagtgcctgagaaaagccccaggctggggcacatggcaccacagggttaatgccctcagctggcctgagagcctgggagtgtgcaggacaggttttgtgtgagcaaacaggagcagcagaaagaggactctgtgtgtggggcgggggcaggcagggggcgggggggggggggagagtttgttctgctctcttttgtccagggctgctggagaattccagagagcaagcagggacagccaggtgaatacaactctgccaggcagctgccaaggctggccccaaaccctgccgacctggagggtggcctggcagctttgccgaggtgccatcctccatctgccacccataaccaaacaggtggacatcacagaaaaggccatctcaagggttctgccaactgcctggctctcccaacacaaatgccccttcctcttccctttcccctctcccccttcccctgccactgctgtccagaggcaggctgccccctgctctggaaccccgcccccttatctgttaacctcatagtgacccagctgtccagtgagtcccttcccccatcacgtgcttacccaccatcagctgctcctgtataaagctgtgagtgagggcaactggaggccctgactacctacctggtcagccacttctacaccctggcacgtgttgtgagcttctgtgccagcctaggctatgctagctgctctcttacccacctggtgttgtgaactccttgtcagctttcctagtgtacatctaggccagctgcctgctgcttgttctcttgcagatgtgtgtgtgtgcgcgtgtgttctaacctgatcagatgctccccggagttcctgagctccgtctggaagccagcaggaaccatggatgttgacaagagactggctgatgctcatcttacgattgatttcagtctgggacaggaagacctgaactgggcatgggtagggcctggggactgggctgtgctgatcccctcctgttgttccttgtgactatcattccttgggttggtggggtattccttgctttgctttgtagtttcttgttactatcctgtgccagaatagggcaaggccaccctacagtggtaatcccttgtgagagttcctaaaagagtgaggaaattttaagaggtagctcttgggcctttgggaagggaaaaatagcagagggattccatggtggtgggcagacaaggcccatc

SEQ ID NO: 2779 - DNA, 1400 bp, mus musculus
ggctgctctctgaaccaccagcacatctggatcaccctgtgtatctctgcccccccccaccccccgtgtgagagcaataggcgttgtactcttcttgcaccctctcatcagactgtcccccgcctgtctgtcttactgcagggagggaagccattgttcccatctggagaaaatgtgaaaagacacagcacagagggaatgtgtgcaagttcttgatagaaggcttttggtcccagggccaaagtgtgtgttgagacagagatttcaggattccacctcccagacttctctgtgtgcccctggggaagttagtgtgcccttttcaccagaaaggcaactctcacagaaatttcggagaaccttttgaaagtagtgcgccggaggcggcgcctggaaacagtggaggcaggtggccatactgctaacgtctaaccaagatgtaggaaggataaggacttttatgtacccaggagcagtaggcatgcacagatggaatacacactggggagagcatggccctatatgagtgcagacacatttctttatgactgagttacagatgctacacggataccctggtttgtgggcttgaacacatacttggtattcccagttatgctttctaactgaaattagaattatgtggggctgagaatgaattatgtgggactgagaatgccccacgggagggaagcagaagcatgtacaagcctgagaagggtagaaggcatcatgtactctataagtgtgcctcgggcatccgtggtttccaagggtaccctctgaggggtgggtgggctctcacgtgctccgggcatggttcctggatggtggagaggcatggttggacttgatgggggttcatttagccttgctggaaagcatgcgcaaggaaggtccagcagaaggcagcctaaaagtaactgaagcgttcatgttttcctccatttcctcaggagatatccgtgtgacaagggccaggactccaagggggttggatcagaggaaaccagccccgggagatgacacagccacctaggatgaagagccactgtcgtctgtgatccctaagttgaactccatacctccacagtacacgtgtgctattgcgtcatccagaaggtatgccctgagacattcctagactgctttatgtagaaagccactttaggcagcgtgaactcggatttgaagtcagtaagacatgggtgggaatacaacagaagggacactgcacgtttgtggagtgaattgggagctagagtgtaccagcaggtgtttgtggatacagagggagggaagggaaggaccgaggggatcacgagaatatcatctgtcctccccgcccccatatttctgtatggttggaaattcctacagataaggtctggagtgccatg

SEQ ID NO: 2780 - DNA, 1400 bp, mus musculus; identical to SEQ ID NO: 2779

SEQ ID NO: 2781 - DNA, 1400 bp, mus musculus
tccaaccatacagaaatatgggggcggggaggacagatgatattctcgtgatcccctcggtccttcccttccctccctctgtatccacaaacacctgctggtacactctagctcccaattcactccacaaacgtgcagtgtcccttctgttgtattcccacccatgtcttactgacttcaaatccgagttcacgctgcctaaagtggctttctacataaagcagtctaggaatgtctcagggcataccttctggatgacgcaatagcacacgtgtactgtggaggtatggagttcaacttagggatcacagacgacagtggctcttcatcctaggtggctgtgtcatctcccggggctggtttcctctgatccaacccccttggagtcctggcccttgtcacacggatatctcctgaggaaatggaggaaaacatgaacgcttcagttacttttaggctgccttctgctggaccttccttgcgcatgctttccagcaaggctaaatgaacccccatcaagtccaaccatgcctctccaccatccaggaaccatgcccggagcacgtgagagcccacccacccctcagagggtacccttggaaaccacggatgcccgaggcacacttatagagtacatgatgccttctacccttctcaggcttgtacatgcttctgcttccctcccgtggggcattctcagtcccacataattcattctcagccccacataattctaatttcagttagaaagcataactgggaataccaagtatgtgttcaagcccacaaaccagggtatccgtgtagcatctgtaactcagtcataaagaaatgtgtctgcactcatatagggccatgctctccccagtgtgtattccatctgtgcatgcctactgctcctgggtacataaaagtccttatccttcctacatcttggttagacgttagcagtatggccacctgcctccactgtttccaggcgccgcctccggcgcactactttcaaaaggttctccgaaatttctgtgagagttgcctttctggtgaaaagggcacactaacttccccaggggcacacagagaagtctgggaggtggaatcctgaaatctctgtctcaacacacactttggccctgggaccaaaagccttctatcaagaacttgcacacattccctctgtgctgtgtcttttcacattttctccagatgggaacaatggcttccctccctgcagtaagacagacaggcgggggacagtctgatgagagggtgcaagaagagtacaacgcctattgctctcacacggggggtgggggggggcagagatacacagggtgatccagatgtgctggtggttcagagagcagcccctgccacacaccaggtaaaacccagctgat

SEQ ID NO: 2782 - DNA, 1400 bp, mus musculus; identical to SEQ ID NO: 2781

SEQ ID NO: 2783 - DNA, 1600 bp, mus musculus
cactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccatttacctttcgccatctggtaatctctggagttagtagttatagttgactctgtttagagattgttcttctggtgattctgttaccgtctctcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacagtgtgttgctttggcagttcccaggtggtacagactctcacctaagcagactaaattcctacgttccttggagtcccgggaccaagatggcgaccgctgctgctgtggcttaggctgcctccccagccgggtgggcacctgtcctccggtccggaaggtggccggctgtccccggcccacacagggtgctgcctcagcgcctctgtgcttccgcctgttccagaagctgtcaggttctctggcgcaccctctcacctgttcagactaatttcctaagttcggcgggtctcggaccaagatggcgaccgctgctgctgtggcttaggccgcctccccagccgggcgggcacctgtcctccggtccggacggtggctggctgtccccggcccacaaagggtgctgcctcagcgcctctgtgcttccgcctgttccagaagctgtcaggttctctggcgcaccctctcgcctgttcagactaatttcctaagttcggcgggtcccggaccaagatggcgaccgctgctgctgtggcttaggtcgcctccccagccgggcgggcacctgtcctccggtccggaaggtggccggctgtccccggcccacacagggtgctgcctcagcgcctctgtgcttccgcctgttccagaagctgtcaggttctctggcgcaccctctcacctgttcagactaatttcctaagttcggcgggtcccggaccaagatggcgaccgctgctgctgtggcttaggccgcctccccagccggcccca

SEQ ID NO: 2784 - DNA, 1400 bp, mus musculus
gtttcctcaggagatatccgtgtgacaaggcccaggactccaagggtgctggatctgatgaaaccaacaccaggagatgacacagcctcctaggatgaagagccactgtctctgtgatccctaagtttaactccatacctccacagtacacgtgtgctattgcatcatccagaaggtgtgccctgagacattcctagactgctttatgtagaaagccactttaggcagtgtgaactcggatttgaagtcagtaagacatgggtgggaatacaacagaagggacactgcacgtttgtggagtgaattgggagctagagtgtaccagcaggtgtttgtggatacagagggagggaagggaaggaccgaggggatcacgagaatatcatctgtcctccccgcccccatatttctgtatggttggaaattcccacagataaggtctggagtcccgtgatgagctccgttggcccatgctcacggaagggacaagggtaacaggagttcacaagaagagcagcgtccttaggaagctgtttcaggaggccagagtccaccagtgctctgcctcactgtgcttgctggggcccaggtcatgacctggatcgcttgcttcctggcataaacagtgagcagcggtggcatgtgagcccaccctgatccttcctctgtgttgtagtccatacttatcagcaagcacagtgggcctcttttgaggatcagacaggtgaggaaattgtttcacacaggcatgcatgacatacacactgctgataggaaccagactggttcaaggcagaggcagtcagtaacacagtagccaacctgcccttcacacccccatacaaaccagacacaacacacacacacacacacacacacacacacacacacaaaacacacatcacaaatacacaaacacacaaaacacagacatatacgcaaaacacaccacaccaaaaagacacacaaacatcaaaacacaaacatcacacgtatgcaaacacacaaaacacagacatatacgaaaaacacaccacaccaaacagacacagagagagaaagagagaaatgggccaaggagaagaacgtaatgagattcccctgagatggctgtggaggaggaactctgttgagaggcagagtatggggaaacatgaacagaagagctatgttacagatgagtgtggacactactggacttagggatgggcaaggtaccatccaggccattcattttctatgtgtttaagaccgtgtggattaagattaggccacagagctcgtgtgcaagagagctctgtggtctggggtctcttgttagaacagtgcccatcacaggcagatagggatgtgcagggtctcctgcagacttgaggttgcagcatgcgggtgcacaattc

SEQ ID NO: 2785 - DNA, 1000 bp, mus musculus
ggcttggctccactgctgggtccaggctccagccccatgtgcccctcctgccacatcaaaggccccttcctcacccgaacctcctgcctcacctacagctcctgccaatcctacagctcctatgatccctgcaactcccatgtcccctgcagctccctcctcatctgacattcctgcttcacctgcagctcctgcctcatcctcacctatagctcctgcttcacccacagaccctccaccgtccacagatccttcatcccctgcagacccctcgtcactcccagactcctcatcccctgcagacccctcttcacctgcctctaaaactcctccctctcctgcagctcccacctcacctgcagctcctacccaacccatagctcctagaacacctacaatccccatgtcacctccagccccttcctcttcagacattctcacaacccctgcctcaactacatcatcttccccatccagagccccctcgtctgacagccttgcttcatctataactcctgcctcatatataacttctgcctcgtctataagtccttcttcatcttctgctccctcctcatccgacaagcttgcctcagctgcagctcctccctccactgctcttcctgcctcacctgttcccccctccccctctgctccttcctcatctgacagtcttgcttgagctgctgcagctccggcctcctgtaggaaggacacaggagctgcagctcctcctctggccttacctgctccttcctcgccaggcattcttgcctcatctgtggctcctttctcagctggtcctcctgcctcgcccacaacccctgtctcatctatgtctccttcctcaactgcagcccctgacctgcccgagacccctgccccacctgaaaccccttccaaagcttgcccatgggcctgtgcagggaaattgaatgtatcctgtgactcgacttcagggaccggaggcaggaagatcacactccaggaccccctatta

SEQ ID NO: 2786 - DNA, 1200 bp, mus musculus
tttcggctcactcttgtaccagtgccacacatttcaattactgaagttttaaagtatgctttaatatctactgagtcttctttttttttttttactttctttttaaaaattaattaattaattatttttacactccatatttcattccccccatcccccctccaactcttccacttcccatacctcctccccactcccctgtctccatgtggatgcccccaccctccaccccacctgacctctaaactccctggagcctccagtttcttgagggttaggtgcatcatctctgaatgaatacagacctggcaattctctgctgtatgtgtgttggtggcctcatatcagctggtatatactgtctatttgatggtctagggtttgagagatcttgggggtctagattaattgagactgctggtccttctacaggatcgcccttctcctcagcttctttcagccttccctaattcaaccacaggggtcagtcagctgcttctgtccattggttgggtggaaatatctgcatctgacactcagttgcttgttgggtcttccagagcgtggtcatgctaggttcctttttgtgagcactccatagcctcagtagtagtgtcaggccttgggacctccccttgagctggatctcactctgggcttgtcactggaccttcttttcctaaggttcctctccatttctgtccctgtaaatctttcagacaggaacaattatgggtcagagttgtgactgtgggagggcaaccccatccctcacttgatgtcctgtcttcctgctggaggtgggctctgtaagttcctgctccctactgtcaggcattccatctaaggtcccccctttgagtcctgagagtctctcacctcccagggctctagtgcattctggagggtcccctcaatctcctacctcctgaggttgcctgtttccattctttctgctggccctcagggcttcagtccttttccctaccccaaatggagatatacttgaagcaatcccactgaaatcagggacaagacaaggatgcccactctccctgtatctattcaatatagtactcgaagtgctagctcgaacaataaaacaacaaaaagagatcaaggggatacaaattgtcaaagaagaaataaaagtaccactattttcagatgatatgatagtatacataagggactccaaaa

SEQ ID NO: 2787 - DNA, 1200 bp, mus musculus
ctctaacagaggaggaatgagacagcttccccttctacatagctaggattctgcaccctggacacccatgccctgaaatcacccagagcctcttacccagtcctggcaccagttctgcctacacaggctccccttcacatcctcttctcaagccaatgcctggcaaagttactcaggggagtcactgtccaaggctgagttgggttaagcaggggtccctgtctccttgcctctaaatcctatacagggtgctaagacacctgggctgtaggggtggtggtgagcagaagacgtctgactgcggatgggacaggcttctgagtatacctggtcagaggctccaggcagtgaactggaagatatatggccagggaggcaaaaggaaaagagatgggtgccccacactggtcaggagccaggcatatgacacccacaagtatgcctaccatcccaaatgggtcctttaaaaagaatgagctattttatgtgtataagtatctgcctgcatatgtctgtgcaccacatccatgcctggtgcctacagaagcctgaatggggcattggctctcctgggtctgggttgtgagccaccataatatggatgctgggtatcaatcaattctgggtcttgtggaagagaagcaagtgctctcaaacactgagccatctctctagccccacttattccattctggaaaagacccagccatacaggaaatacaggagtttttggaggctaccaggaagaagcaggccaggtgcatctttgtgacctcctcagctgactgcccagccaggccacatggcctagaatctgcagtggggtggaaatgtgcaaccacaaatgatgctatgccctggctctgttggccaacaggcaccagaagcctaggtcacagaagtcaaggtcacgtggctaaatgccctccatagcctgtcctcccacccagtgagaccaagaagggaaatgggtttgttaactccagctggaagcagggcccagagactgcaagttcaggccggactcagggcagggcaaagcaggggttgaggtgtatttctttgggctactttattaggtttttatatttaccacccttccagccccccagtactagatgggagagaaagagagttagaggggaaagagggcatagacatcttcagactacttcctgctgattatgagtgtcaggctcc

SEQ ID NO: 2788 - DNA, 1600 bp, mus musculus
cattttgcatgttctttgactgttgtgtcagtgttttctatggtgtcttctgcacctgagattctctcttctatttcttttattctgttggtgatatttgcgtctatgacttctgatttctttcctaggctttctgtctccctttataatttctttattgtttgtatttccatttttagatcctggatggttttgttaaattccttcaccttttcagttgtattttcctataattctttatgggttattttgtgtttctcctttaagggattctacctgtttacttgtgttctcctgtacttctttaagggaattatttatgtccttcttgaggtcctctatcatcatcatgagatgtgattttaaatcaaagtcttgtttttccaatttgatgggggtatccaagacttgctgtggtgagagaactgtgttctgatgatgccaagtagccttggtttctgttgcttatgttcttgcacttgcttcttcccatctggttatagctggtgttagctggtcttgctgtcttgaatgtggcttgtcactcctgtaagtctgtgtgtcagcactcctgggaaaccagcattctctgggaagaatttgggtatggagaggtgtggcacaggaggggcagatggaatccaaatagatcctgtcctgggctgttccttggttcctgagtcctgaaggctctgggtggattccttttgggccaggtatttgagcagaagtggtggtcttacttgtgctctcaagtatgtcagcactcctaggagaccagctctctcctggtagatttggtatagagagctttagcacagggtcagctctgcagtgcagacggaaaccctcttctatcagatttagtgtatctggttttatgttgagatcattgatctacttggagttgagttttgtggaaggtgatagatatgggtctatttgcattcttttacatgcagacagctaatgtagaccagcaccatttgttgaagatgctttcttttttccattgtataattttggcttctttatcaaaaatcaagtgtctgtaggtatgtgggttcatttcttggtcatcgattcaattctgttgatcaaactgtctgtttttatgccaatagcatgcagtttttattactattgctctgtattacagcttgaaatcatggatggtgatacttccagaagttcttttattgtacagtattattttggctaccttgggatttttgctttcctatataaagctgagaattattctttcaaggtctgtaaagaattgggatgagcttttgaggggaactgcattgaatctgtagattgcttttgtaagatggccatttttacaatgttaatcctactgacccatgagcatgggagatctttccatcatctgatatcttcttcaatttctttcttcaatgttcttgtcattcaagcctttcacttgttagatttgcagcaagatatgttttattatttgcagctattgtggagtgtattgtttctccgatttctttcttagtccatttatcatttgtacataggagggatattgatccttagttttatatcctgccacatcactgaaggtctt

SEQ ID NO: 2789 - DNA, 1200 bp, mus musculus
gaaaccacattggtggctttggcatctttctgaactcgggcccctctcctcttgaacctggtgttggtcacctttgagtgcacttggggttcccattctgggagcccacacagggcacacagcacatgggtcttcttttttcgactagctatgcggagtgacctgcgtagcctcaggactgggggcatgcaggctgcagatgcccgctttgagtctggcttcggggtccccaagccaggatggtccttgttctctgcgagggcggtctttctttgggctccagctgcccggatctctaagccagcacaccgaactcgttgtttgagggctttgggtgagatagagatgtgcctcggtggcccagaggcagcctgctgctcggttttagatcgggtacccttcctggaggctggggcactcaaagacctgagctttctcttccctgtgcctggctttctcttccctggattaccgccagcttttcccaagggtgtcttctttgagtaacttggccacactctggtgcctcttaacacatccccttccacttcagagcgcgggaggcctgcagcagtgtgggcctgggcttcccccacaggcactgcaggcacattctgcgagcccatcatcacaggacctggatccgggcggacccgcttcccaggactcctctgggagagcccttggcctttctggttgcgcccctggaggcacaggtgcatgtgcaggtgcagacgcaggcgcaggtgtaggtgcaggcgctggcacaggctcaggggcagaagctggcgcaggcgcaggcgcaggcgctggcctaggctggagctgctggagctggcctgctcttttggaacctttggagccaaggtgctggttcttcggctacctgctcttcctccttgaaagaagctgcttccctcacccagaccatccagggccaccttgagggctctcctggatgccctggtctgccctggcgagcccctgccccgtgactcctttcctgccaaggagttgatgcttatgatttcagacttggctaggggcctcaccttggagctcctcactctcctcttctcacccacaggcagtatttggacctccaggaagggcacccctctcctcttactatgggctggggtcctgggtctggacaacacccttgcaggacacagctggctcttccagccacagagtaca

SEQ ID NO: 2790 - DNA, 1800 bp, mus musculus
attaactccataggtccttactgactctgctagctcttttacttgtttatgcgatattggctcataatatcgctgttgagcatgatcctgaaaaacaggaaaagcctgacatattttttgcaaccctttaggagtgcaaaaagagtgaacattgccaattgctttcttatctgcataaggcggagtatgtgggggagcaatgaaactcctccctattggaacagatctttctgcttcatactccgcagcagcctccttcaaatcttcctcctctcctgttgataattcggaatcctctgagctagacaattctaacgactcagagtccttgagaggagggtaaattgacttaattttctgctttttattattttttatactattttttgtaagtttacattttgggagttgacaattaaagccatgatataagatcaaggcaagaaagatagcaaccccagcaacaattatcggatctatttcgtaggagagcatgcctctcacattaatttctttctacttaccggtaccaccgttcctcagctgaagagttctgaatccactccagatccttctcagcagtctgttttgcaggaaacttcattaccaccgttccccagctgaagagttctgaatccacgccggatccttctcagcagtctgttttgtgggaaactttattaactgctccttccccgagatgcagttctgaatcctccctgtagcagggggtcttcgctcgtgcctgaagatgtttcttgtcccgggttttcggcaccacttcttgcgcgcgctcaactggccaggaagaacaacactgcaacaggatccttctgcacacgtttattgggagagcttgattgtagaggcgaaaagaccccgagcccagaactggtactgctttgataggcctacgagaggcgtgtctcacacccggattggttatgcactacgcctcatttgcatgttcctcatctgattggctactctctctgtacctcacagagcctcattatcatacctcatttgcatgtctcacatctgattggctactctctctctctgtacctcacagagcctcattatcatacctcatttgcatgtctcacatctgattggttatactctcaaagcctcattatcatgcccggcccaggcagtgtctttgcaaaaaactttactgcatatgtacacattggttgtttgtccaaacttatgcgtggtgaccagcagtagtcagtgccactctgcaacggcacatgtggcttcccacataattacaaaatgtaagccagaccaacacacatatttcattagtgaagagtccctcatcatacatcatcctttcatgtgcttgtttagcagaacatcctttcacctgtgtctgcttcagtaaaatgttctttcatttgtttgccttagacaaacaccatgcaacacaactgactgtccaaagaacccataagtttccatttcagagaggtacacacatttccttcagggttagctctcagttttagcagaaaggaaaaacttgtttgaataaaaggtacctagaaggtgtcaggagctataggttttgtagggagtttaatcagaaagggcagcttccctttgcctgggcaaggaatggagccacctgtggcttcaggcagctgtgacagaacatgaacaggcaagttctctctatatcatggagacttcaggcacaatcagcagacgccctcccacccaggaaggcaaggacaattccagcagcaaaaggacagtgacaagactgctattcctggatccactaag

SEQ ID NO: 2791 - DNA, 1000 bp, mus musculus
agcaagtaggcacactctggccagctcggccctggagctttaacttgatgaccaactgccacccatgcctggcctgggggattggcccaccctgtggtttccagccactcacttcagctgtcaaatttggtgcccctgccccaggccaagtcacatttttgggggggagactcagggcacatccctgttggtcccaggactgtgtgtgcacttgagctttcttgacaggacctttctcctccctgtccatgccttttggccgtgttctggcattgcctgtttggcagaaggggacttagcagcctctagtggaggagggggccacataccacttcacccccacaccctggaaagtagaccaagagaggatgggtgacacatgtagggtggtggaagtgtgccaccagggccctgagcagagtcttgtgagccagagagcagggagactctgtctcaagcctgtagcctgtggaggtgggaggtgtgttcctctgcaacaacctgctggctgagatgtcagggtgtgtgcgttgggggggggggtgggtgggaggagaataacttttaaaatggcaatctgattttggggctatctagccccggtggggtggacattagttggaaatgtgtggaattcctgactccttggctgagtcatgaattaggctggttggctgatttagccataagattaattggcattttctccactttggactgggagagaagtagtaaagaggttaaaaggcatttcttgtgaatttttttcctggggtcctggagagtataggactgctgggggtagggagtggtataaaagaggcatggggaaccatgacctggcatggaggtttgtctagccttgtattggagtggtgcagagaatgctgttgtgccactggggactggggtgaggaatcagatggggctgaaggcccacttggcttctggtgagttgcattataggggatttatagagggcccatatttttccaatatg

SEQ ID NO: 2792 - DNA, 1000 bp, mus musculus
ctgagagaagtgggcctatttagatggacaatggaggtacctctgaacacagacccacatgttgctgtgctgtccatgtctgcatgtctaacctgactggctctgttttgtcatcttatacgagaagtacttttttctaaatcacctagctaggctggccaagaccagttcagagacaagagggcatctctcctgtgtaccctcacacccaggtcctccaagccattcagtgttcctctcccaaaccagcctgtcttccatgcctacaacccaacactactgtgttcctgcaagtaggccagccttccctctgcccctgctcccacctgatgcccaatggaaaaaactaggggacacagcatgtgagccacccgcaccccaacacctaccccacttctcctccatgtttctctaaactacatacactaacctttggacccaccttccactctcacctcattcccaaggtaaaagctagaagaaaccaacctctggaccacccgaacctcagcacctaacaccgtcctcccctccatgttccttcaactaggcccagctcagcctcggaccccactaacacctccatccccttcccatgaccacaaggaaaagccagagaagcaagcctatgggtttctcaaactaaagctttaataagaacacaagtgggagaagcaaggggtgatgctggccagctaggcagggcccatctgtgggaaaggttgggtgggaaggactcactgatgatgtgcaatgcatagatggggctggcagatgggccagtcagcaagccagagctgggcagtggtggtggaggcagcagcagtggctgcgggggcagcaggagcagcagcagcagcagcagcagcaagtagctagtagctagagatgaggatgatgatgaaaactaagaaggccactgtgagctgggccacctgggagatggtgatgaactggaacagacttacatttgcataagctttagagttgttggtttcct

SEQ ID NO: 2793 - DNA, 1400 bp, mus musculus
tgtttcctgctaaaggttggcactcatggaacaaggaactatcattctctcttaggatgtagaagagtagtaagcagccatgcctactgagggacaaggggcacaggcttgctcattctcttccccacccccacccccattttcctaaaaattagcaattgcagaggcacattccaattaccaagtaaaacttgagttgagctcagtgtcagaactcttgttgccaacttgtcattcctgatgatcagggttttttttctttttgtctgttgtctgttttgtcctgagaatgggctccacacagcacaggctggcctcagaatcagcatgtagccaagtaccactttgaactcctgatcttgctgcatctactgatagagtacatagacccataaaccccgcccaccaccacgtggtaccaccaccctggatcaatccactatcccacatttcacaacaccaagctctgtccacactggaccatctccaccatccttctgtgctctcctattgcccgagatgtactttacccagaagtgtctccttagtgccctccagaaacaccccctaagaccaacagacatacacagacacaatgacatgccataaacctagatctgctattgactggacagaacctgacacaaatgtaggcatctttctcctggacctttctggctgtgggtccagattatccatctcgtccttacatagtagcctgcactgtcctagcacatggatcttgcttgtcttccctcgcatgtcatcaactaccctgggcccagagcacactgagagtggccatagggacaaattcccttgtacctatcctgctgaatgtcctttctgatccagttctgactgtgtgtgctctttcaagctcacttgcgcatgtacatatacctgtgcgtgtatgtgtgcgtgttatggatttatgggaaacagttcgagcaaggcaacttggtcgaagtaccatcagggtcttgaacccagaccaggcctggtttcataggcagtctgaacattgctgtcacgctaagctttctgaagccttggggttgcatgacccagaccaggcctggtttcataggcagtctgaacattgctgtcacgctaagctttctgaagccttggggttgcatgacccttgtgagtgagccagtttacggagaatgggtggtgtggggtccatttcagcaatccagctgcagatcatcagaggttcctgaggtctatgggaagtaccagtttggccagagccaattctcacttggtcctgttttcacaagctctgttggcctcacctcttgtggtgcactgtggaaaacagagtgggatttggagcaggcacctcaggctttcctagaacctgcagggggcagtggagtcggtggtgactg

SEQ ID NO: 2794 - DNA, 1000 bp, mus musculus
aaccagaccagcattcctcgatcaatggtgctgggctcctggcagaaaccacgttggtagctttggcatctttttgaactcggggccctctcctcttgaatctggtgttggtcacctttgagtgcacttggggttcccattctgggagcccacacagggcacacagcacatgggtcttctttttcctactagctatgcagagtgacctgcatagcctcaggactggaggcacgcaggctgcagatgccccctttgagtctggcttcggggtccccgggccaggatggtccttgttctctgggagggcggtcttcctttgggctccagttgcccggatctctaagccagaacactgaactcgttgtttgagagctttaggtgagatagagatgtgcctcagtggcccagaggcagcctgctgttcatttttagcccgggtagcctccctggagcctggggcactcaaagacatgagctttctcttccctgtgcctggctttctcttccctaaattaccgccagcttttcccaagggtgtcttcttcgagtaacttggccacactctggtgcctcttaacacatccccttgcatttcagagcactggaggcctacagcagtgtgggcctgggctttccccaatcgcactgaaggcacattctctgagcctatcatcacaggacctgaatcccggcggacctgcttcccaggactcctctgggagagcccttggcctttctggttgcacccctggaggcacaggtgcaggtgcaggtgcaggtggaggtgcaggtgcaggcgtaggcgcaggcgcaggcccaggcgcaggtgtaggtgcaggcgctggcacaggctcaggggcagaagctggcgcaggcgcaggcgcaggcgctggcctaggctggagctgctggagctggcctgctgttttggaccgtttggagccatggtgctggttcttcggtcacctgctcttcctccttgaaatgagctgcttccctc

SEQ ID NO: 2795 - DNA, 1200 bp, mus musculus
aaccctgaaggaaatgtgtgtacctctctgaaatggaaacttatgggttctttggacagtcagttgtgttgcatggtgtttgtctaaggcaaacaaatgaaagaacattttactgaagcagacacaggtgaaaggatgttctgctaaacaagcacatgaaaggatgatgtatgatgagggactcttcactaatgaaatatgtgtgttggtctggcttacattttgtaattatgtgggaagccacatgtgccgttgcagagtggcactgactactgctggtcaccacgcataagtttggacaaacaaccaatgtgtacatatgcagtaaagttttttgcaaagacactgcctgggccgggcatgataatgaggctttgagagtataaccaatcagatgtgagacatgcaaatgaggtatgataatgaggctctgtgaggtacagagagagagagtagccaatcagatgtgagacatgcaaatgaggtatgataatgaggctctgtgaggtacagagagagtagccaatcagatgaggaacatgcaaatgaggcgtagtgcataaccaatccgggtgtgagacacgcctctcgtaggcctatcaaagcagtaccagttctgggctcggggtcttttcgcctctacaatcaagctctcccaataaacgtgtgcagaaggatcctgttgcagtgttgttcttcctggccagttgagcgcgcgcaagaagtggtgccgaaaacccgggacaagaaacatcttcaggcacgagcgaagaccccctgctacagggaggattcagaactgcatctcggggaaggagcagttaataaagtttcccacaaaacagactgctgagaaggatccggcgtggattcagaactcttcagctggggaacggtggtaatgaagtttcctgcaaaacagactgctgagaaggatctggagtggattcagaactcttcagctgaggaacggtggtaccggtaagtagaaagaaattaatgtgagaggcatgctctcctacgaaatagatccgataattgttgctggggttgctatctttcttgccttgatcttatatcatggctttaattgtcaactcccaaaatgtaaacttacaaaaaatagtataaaaaataataaaaagcagaaaattaagtcaatttaccctcctctcaaggactctgagtcgttagaattgt

SEQ ID NO: 2796 - DNA, 1400 bp, mus musculus
agattctggagggagagcagcgccacaggcaggagagcagagccagagaggaccggcgggcagtcacaacagtgcccagaacaaccaaaggagtcaccctgtcctgatcagcacagccccagagttcagtcaccatggactcgtcagaatatgtactctgtggctggaagagccagctgtgtcctgcaagggtgttgtccagacccaggaccccagcccatagtaaaaggagaggggtgcccttcctggaggtccaaatactgcctgtgggtgagaagaggagagtgaggagctccaaggtgaggcccctagccaagtctgaaatcataagcatcaactccttggcaggaaaggagtcacggggcaggggctcgccagggcagaccagggcatccaggagagccctcaaggtggccctggatggtctgggtgagggaagcagcttctttcaaggaggaagagcaggtagccgaagaaccagcaccttggctccaaaggttccaaaagagcaggccagctccagcagctccagcctaggtcagcgcctgtgcctgcgcctgcgccagcttctgcccctgagcctgtgccagcgactgcacctacacctgcgcctgcgtctgcacctgcacatgcacctgtgcctccaggggcgcaaccagaaaggccaagggctctcccagaggagtcctgggaagcgggtccgcccggatccaggtcctgtgatgatgggctcgcagaatgtgcctgcagtgcctgtggggaaagcccaggcccacactgctgtaggcctcccgcgctctgaaatggaaggggatgtgttaagaggcaccagagtgtggccaagttactcaaagaagacacccttgggaaaagctggcggtaatccagggaagagaaagccaggcacagggaagagaaagctcaggtctttgagtgccccagcctccagaaagggtacccgatttaaaaccgagcagcaggctgcctctgggccaccgaggcacatctctatctcacccaaagccctcaaacaacgagttcggtgtgctggcttagagatccgggcagctggagcccaaagaaagaccgccctcgcagagaacaaggaccatcctggcttggggaccccgaagccagactcaaagcgggcatctgcagcctgcatgcccccagtcctgaggctacgcaggtcactccgcatagctagtcgaaaaaagaagacccatgtgctgtgtgccctgtgtgggctcccagaatgggaaccccaagtgcactcaaaggtgaccaacaccaggttcaagaggagaggggcccgagttcagaaagatgccaaagccaccaatgtggtttctgcccaggagcccagcaccattgagcaaggaacgctggtttggttcaaa

SEQ ID NO: 2797 - DNA, 1000 bp, mus musculus
ttttctctctcttgctttctttttctctctctttctttcttgttcttgttctgtttctcgctctctcgctctcttgctctcttgttcttgttctttttcttgttctttttctctctcttgcactcttgctcctgaagatgtaagcaataaagcttttgccgcagaagattccgctttgctgcgttcttcctggccggtagcgagaacgcgtgtaagacacttccataagcagtatctgagcaggatagttattctgaagtggaagggggaaaccctgggcactttgcacaaacacatgggcaacgacagggcccaagctgggaatgggtacctgattggcaggcctcacacctttgggagtacctgtaggcagcctcaggcatgtctgcacagtagtgtttccactaatcagagacctactccagaatgtggggcctctatctgaggggcgggggaaggagcctctcagaggaatgtattgaagtgtggtcacctgggtgagtgacagggaattagcagagtcagtcttgagcctctgatggtgagaaagctcagtcagcctggtgtatcgggccttttggggagcaaagtggggttttgaggcagaagagaccaggtttagctgtgatgagatgtttggaagactttgcacctggtagtgaaatagaccagtgagaccaatggatgaaaagggttccaggagggttgcaggtttaaagagtgttggctgggacagtgacgtggagaaaaataagtagtgactctcccctgtcctctgtgggtcctcagtggacacatctgggtcctgcttctttgcagccatgggacttgcctccctcaacacaaatgcctgtgtttttgtatgtttttctcagtgtcaagatttggtcaagatctagaatattggtgggccataggaggtactcctaaaatctgtgttgaatgttgaaggggatgggccaggactggtccccttcaccaaaggactgcatctccatcc

SEQ ID NO: 2798 - DNA, 1000 bp, mus musculus
tctagattgtatgtcatttatataatgcacatgtacaaatgtgtgtgagagagagagacagacagacagacagacagacagagagaagtgggcctatttagatggacaatggaggtacctctgaacacagacccacatgttgctgtgctgtccatgtctgcatgtctaacctgactggctctgttttgtcatcttatacgagaagtacttctttctgaaccacctagctaggctggccaagaccagttcagagacaagagggcatctctcctgtgtaccctcacacccaggtcctccaagccattcagtgttcctctcccaaaccagcctgtcttccaagcctacaacccaacactactgtgttcctgcaagtaggccagccttccctctgcccctgctcccacctgatgcccaatggaaaaaaactaggggacacagcatgtgagccacccgcaccccagcacctaccccacttcccctccatgtttctctaactacatccactaacctttggacccaccttccactctcacctcattcccaaggtaaaagctagaagaaaccaacctctggaccacccgaacctcagcacctaacaccgtcctcccctccatgttccttcaactaggcccagctcagcctcggaccccactaacaccaccatccccttcccatgaccacaaggaaaagccagagaagcaagcctatgggtttctcaaactaaagctttaataagaacacaagtgggagaagcaaggggtgatgctggccagctaggcagggcccatctgtgggaaaggttgggtgggaaggactcactgatgatgtgcaatgcatagatggggctggcagatgggccagtcagcaagccagagctgggcagtggtggtggaggcagcagcagcggcagcagcagcaagtagctagtagctagagatgaggatgatgatgaaaactaagaaggccactgtgagctgggccacctgggagatggtgatga

SEQ ID NO: 2799 - DNA, 1000 bp, mus musculus
atattaatttaaattaagggagtagtgaccttggggcaagatcccaacctgcaaagtttagatcaaggcatggtagtacaagcctttaatctcaggaggcaaagaaaagcagatctctgagctcaaggccagcctagaaccgagcaagttctaggtgaagaaaagcttaagtccaggcttggtggaccatacctttaaacaacccagtgtttaggagataggcatgcagatctctgagttcaacgtcagtttacagagcaagtttcagaacagccaagcttaggaagtaaaggagttggaaaactgaaagctggtgatactgtaataaaacaagagggggaggggtggcatgttccagctcctgcaagcagcagaacttggcagcttcagccatgtggctctggctttagagtcaagaatagaagggactactgggacaattgatgctggttagctggagctaagtaattagtagtgattaagaagagatcagcatcactgaggtgacatcttctaggaagtgttttctaagagcacaaagaagcaatgttccagaggtagccaaggttgtaccttatgttgcagctgtacttggtaatgtttaagagccacccaggtggtactggttttgaaggtatgaaggggtcctggagagtagcatgacccctgtgagaggccatggaaggccattggtgaaggtgcagcctcagttgtagttgacaccccaggactgaaggggcaatgcaaagaagttgaggcttggcaccatgaaagagcctatgagaggctattggtgaaacctagttgtagtggaagaccccagtgtattggagatgcaccaagaacagcagaagcagtgaagtggatcaacctgagcttcgaggacagagcttgagaagttatgccagccctttggaggagcccagaagatcatatgtggatcccagacattgtaacaagaagctgcaatattgaagttgccttggagacccaaaggtat

SEQ ID NO: 2800 - DNA, 1600 bp, mus musculus
gggtggagaggagtagcctgttgtgaatggccagacctgtcacctggggtcgtggtgaagtcccatcccaagctgctggtgagggccatgtctgagtctgtggctgtgcaatggcagtggtcagtgtctgtggctcatattactactagagaacataggggactccctggttagggcagctgctggggaccacatggatgtccaggactgtgcatagctggccatgtcccctcactggatgtagtgctctggagacctggccccatatttcatcactgtcagcactcgggagagtgggccctgcacctcacctggacagcacagcagaggtgaccctgatggttgagacttaggtgaaccagctctgagggtgaaagtgtgggagaactggctcctgctgttaggtggcatgggtgtgggggtgatgccctccccacctcatcccttataggctgctgccatcaggagaactgaccctgaggtcatgggtaagctggccctatccctcccatactgcagcacttaatggcagataagggagagtcagtatgctaatcagctggtgtgctgcccttcataggccttgcatctcatctaggcagcacactagagcatgccctagtgaagggggtacaggtgagctgaccccgaggtttagaacataggacagctggctctgtcatttatctggaatgaggtgaagttagtgaggggatggtgcccttcccctccccaccttgccaccagagagctggccctggggtcttgagagtgggagagatagccctgcccccccttattagctgtagcactcaggagaatgggccttacacctggcctgggcaacacagtggagctagccctgatggcaaaggcatgggtgagccagcctagagggtgtgagagctggcccagccctttatgggctgcagcacttgggaatagttggcccctgagccaaggctcaaggcagctggctctagaggtttgagtacagtgagccagctctgaaggcttggtactgggagagttgaccctgcctcctgcagagggtggtagtgggtggcagagcagtgctggagaactcatcctggtggtgcagataagggaaagcaggtgtcctaaccagctaagctgccacccaggctcagatccagggttctaaattggcccaccccaaaatctatattgtctgccagtggttggggtgagtaaaagagctggccagtcctactgagccagtgctgcaggatctccatgacaaagggcagcaatggtatgacccagagaagtcccgatgaagatcaatattgatggtgtcacagaaaccagaggctctcaggccagactgatgactcatttcaaagtgaagatgtgttgatagaggaatatattgtgggacacactgtgacatacactgtgacatattacagcttccacgatgagatgttttttatgcctttttgtttatttatgtatattttattttggggaggaagttgcaagggcaaaggtggatatgaagggatggggagataagtgggactagggtgcatgatgtgaaactcataaggagtcaaaaaaattcctggtaaatgaa

SEQ ID NO: 2801 - DNA, 1400 bp, mus musculus
atttaacaggaagagggtcacggacaggttttctttatgtttgaattttgtagagtttttctataaaggctaaagtgctgatagcaatgtgactcagccgttgaggacagggaggaagatccacagtattcatgtagcatagcaagtcaggcatcttgtttatacctgtaaccccagctgcacatgaggcacagatgaagattactggggcttgccggtttccagcctagctgtgaaaaatgcaaaaatgcaagtcccccctccccgggtttaaggagagaccctgtctcaaagggatcagtggaaaatgatagaggaggactcctgacgcccctcccccctcccctctctctctgtctctctctctgtttctgtctctctctgtctctgtctgtctctctgtctctctgtctctgtctctgtctctgtctctctctctctctctctctctctctctctctctctctctcacacacacacacacacacactatagcttggtttccatggtggggcctgtggctctgggtgggacacagtgggcagctttgcctcctggggcacgtgttccttaaactcggcctgttcctaggctcctctgcctacccctctgttctccctgcctctggtcctccctcttgacccttgggctgcctcaaggccttttggctgacccccagaccccttagcctgccattcatcctgcccctaggctcctcggcctggctctctgcccctcagcctacctctaggctttaggttagtttggcctgccttggttaccaattttcctgcctcttgtccccattgcctacctctttgcctctaggcctcccccttggcttacccttaggcactccttttggctcattgacctgcctctcaatccctctggctgtctctctgcctctaggcctctcggtcagccctagggctcccaccctggctctctgcccctctgcctgcctctaggcccaggcccctttccatgcctcagccagcccctcagtctgcccttaggcctgactcttggccccttggtctgctcctctgtccctaggtccctcagcccctagcctccttgccctgcttctatgcccctccacccctgggcctgcctttctgtctgtctctaggcccatcagcctgcctctctgccctttggcccctagcccagaccttcctggtctacaaagcaagttctaggacagtgagagctgcaaagaaaaaaatctgacttgaaaaaccaaagagggaaaggtagctgtccttgaatcccatcattgtgagttcaagtccagcctggttagacttgatttaatcaaagtatttgcatatttgctcataataaagtatttgctttatttgttcataatatacttacatagtgcatattcaaca

SEQ ID NO: 2802 - DNA, 1000 bp, mus musculus
tggtgtttgaatctgcctcctggaagaagttgtgttctcctcaccagaggtcctaagatcctgtggagtgtactctggggacctttgggggtgtccgcagactccatgccctaggtgccccagtgctggtgctggcgccgaccggaagggacttgtgaccctggtcaggctgggttttctgcttccctaattaatgctgtctcaggtcctgcatgattggattggagcagaaattgtgttccactcaccagaggtcctaagatcccatggagagtcctgtggggaccttgtgtgtgtccgcagactccgtgcccaaggtgtgtcagtgctggcgctgaccagaagggctgtaccccatttttaataaggttatttgactctctggagtttaacttctttaattctttgtaaatttttgttattagcactctatagtatgtaaggttggtgaagatcttttgccaacctgttggttcccgttttgtcattttaacagtgtcctttgcctttcagaagcttttcaattttataaagttccattttcaattgttgatcttagagcctgagccattagtgttctgttccggaaattttctcctgtgcagatgtgttggagatgtgtcttaatttctcttctattagattcagtgtatctggttttatgtggaggtccttgatcgacttggacttgatctgtgatcctgcatcttttgtttttagatagacaggatctgtctgtataccacaggctgccccttattttccttttgtcttttctgccctgtagtgtcagaatttgttactgtaagtcaccaaaccaggaagttggtgctttgtgttaccttttcctgctatgaaatgtgttgtgtgctgttcctggagcacaaataatatacagtatttttgacaggctacatggatacatttgagaaaaacgttttctgtaaaaaaactatttcaatttcataccaatttaattactgtagtactcaaatactca

SEQ ID NO: 2803 - DNA, 1000 bp, mus musculus
acaacccaaaaccaacaaggcatgtcataaataagtgcccagaggcaatacattcccattgtcatatctgtagcatgtccccctgtgcatatgctacatacccctcatccctcccttttagtaaatctcctgtatgagacttggcagaacctgccacctagatccttcagagagtttgtgaacaaatgtctaattatatatcagcactgcttttccttccatttcctgtgaaactgacagggatttgttactagaaacttaatagaaaatacaaatacttgcctctgtcttttctaagaagaccaaatgttaaaaactgtgtagttaagaaaagtgactcaaaaattctgatatttccatagctaccaaactgaatgggatattatgagcaaagaaccagtatcaagacataaagggccagagtatttaatgtccctttggtttatgaaatatccctcccattctggtcccgccagcaccggtgtagctaggtcactgagttagctgacaccctcaaagctacgcacaagacctgccacgggatcttaagacctctggtgagtggaacacagctgctgctccaatccaatcgcgcaggacctgagactgcattaattagggaagcagaaaacccggcatgatcaggggcacaagtcccttcctgtccacgccagcacaggggtaccttgggcatggagtctgcggacacctgtaaggtatacacaggaccatccacaggattttaagacctctgtgagtggatcacaacttctgacaagaggcaggtttgaaaaccagttatctggacactttccctgcaagaggagagcctacctgcagagagtactctgagcactgaaaatcaggagagagctagtctcccaggtctgctgatagaggttaacataaacacctgaggaacaagatctaaccagagacaactacaacaactaactccagaaattaccagatggcgaaaggcaattgtaagaatcttact

SEQ ID NO: 2804 - DNA, 1000 bp, mus musculus
aattacataaggaaaatactacagctgataaacattttcagaaaataatggggtacacaattaactaacaaaagtcagtatcccttgttgtatgccagcccgcggcctacattaactgggtacacctgggaggcaggctggggctgaaagagacttagacggtgagagaagataatggagaccaagacacatttctgttcaagccccgcaagtttactaagagaccttgcttataagggggaaggccccccccccccctccagtccactcttggtcactggagccattctgtcagcattcggtcgccaggctggttgctattcaggaatgtctcaggaagacaggttcaacctctcggcaggtagcagaagaacagagcagttgtcacttcgaaaaggagccagccaagtcagaaagctgcaccatgcaggtggccccacttcagtggcgacaaggtttgtaccagcctgcttcaggctggggggggggtacaatccctcctatattatacaaatgacaaatagtctgagaaacaaatccaggaaacaatacctttcacaatagcaaaaataatgtaaaatatcttggggggtatctctagccaagcaagttaaccaagaaagacttaataagttccagtggttatggacctgctaatggttgatatgaatgaaaaacagaccagattggagggatttgaaaaggaccaagactgagacaaatttaactcaaccagtcagaattttgtacacttatcagatatagaatacaatgccagcatacaatggcatttgcaagttttatagtgtatatgaggttagtgcctaagtctaattgtctagccagtcttttctaagccttcctaattttgaaaggacacaaagatacaaacatgtcctgaaacagataatgcctctgtttctcaggaactgaaaagcatacagtgtcccaggagccataaactctagcctgaagaacttatgacatatgcctctcaagg

SEQ ID NO: 2805 - DNA, 1200 bp, mus musculus
ataaagtccacagaactcaaaaagctcaacaagctgaagtgcccaagtgaggacacctcagtcccacttggaagagtaaagaaagcaatcaccagcagatagtgaagaagggacctgggagggaaagtggatgagttggggcagggaactgggggaggggggagaaaaacctgatctggtattgggtgagggaaaaggattgaagctccgagggccagcagacaggaagtaaagaggcaacttcaggaaataggaggttgggacaaccatccagaatgcaccatagacctgggaagtgagagactcacatgactctaatagagagtccttaggggaaaagctggacagtagggagagggaacttatagagcccacctccagaaggaagacaggacatcaagtgagggatggggtagccattacaccgtcacaattctgacgcatatttcttactgtctgaaagaattacaaggatggaaatgaagaggagcctgaggaaaagaaggtccagctacaggcccaaagtgggatccagctcaaggggaggctcaaaggcctgacactattactgaggttatggagtgctcacaaaaaaggatatatcacgactgccctccaaattactcaacaagcagctgaaagagtcaggtgcagatatttgcacccaaccaatggacagaagcagctaacccctgttgatgaattaggaaaggctgaaagaagctgaggataagggcgatcctgtaggaggaccagcagtctcaattgatctggacctccggtatctcttaaacactggaccaccaaacagacagcatacaccaggtcatatgaggccaccaacacacatacagtagaggacatccgggtctgtgttcattcagagatgattcaacaatccctgaaaagactggagtccccaaggggtttagaggtcaggtagggtaggggctgggggcatccacatggagactggagaagaggtgtgggatacggagcagactgaggctggatgggggcagggtatggcatatggagtgtaaaaataaatttaaaataaaataatattttcaaaaagaaatgatacacaattcaaacagaaataaaataaaacaaaaatcaaataaatgtataattagtagacaacaagggaagaagtttcaaattttttgagtatttgatgttaaggaagtattgttg

SEQ ID NO: 2806 - DNA, 3000 bp, mus musculus
tgcagatagaaactggaaggatactgtcccaggctattccttggttcatgtgtcccatggctttgggtggttccctcttgggaattagaggagaagtgctggtcttccctgtgttcacaggtgtgtcagcactcctgggagaccagttctttccaggtggcatttcagtatggagagctgtggcacaggatcagctccctgtgcagatggaaaccagaccaggaggatcctgtcccaggctgcttctcaattccagtgtcctgagtgctccaggaagatccctttaagcagaagtgggacaggatctttccagtttctatctgtgctcacagttgtgtctccacttctgggaggccagctctatcccaacagaatttgggtatggagctttgtgacataggatcaactcagggcacagaaggaaactggaagcatcctgtcccagttcctccttatcagcacctaaatgagcatcctcactgtatctgactggagtctatcctttctgtgatcctggttgtgtcagaacttctcagagtctctgtgatactatgatttctggatcctgttatcctgagatcctggttctgtcagagttcctcagagtcaagctgcctctgggaccctgatatcctagtgtgaacaagcccctgggatcctgttatcctgccatcctgccatcctgccatcctggccttgttagagggcctgggagtggagcttcctctgggtgttttgagactggctacagagattgcatccaaggtaaaccagcaccgaactggagccacttgttgggtgggttcctgagtccctggatcccgctggtcccagttactccccttggttttggaacagatgttgtgccctcctcacctctgatcctatgatcctgggcatattagagcacctgggaatggggcctcctttgggtgttgtggaactggctgcagagtttgtgtctctgaaaatggtttgtaaacaataaaagtggagtacatggagaagaaaggcttggatgagatgtctcctattacaaaaatttggaaaacgaaacctctacttaaaagattaaaagaaaaagcaaggaaatatgtggaaaaccttgacaggtattttgacaaaagcattgtggatattcattacaacaatgtgtaccacagtttgggaaattgcagtggtggagagctgtaattatcacatgggaaataggcctgctttaattttcatgaattcagataaagataaaggatgatgtaagtcatctatgatttctaacactacatctactctgtgccttgattacttaccctcagcagcagaaaaaaaatccagaactcataaaactaattgggaaatattttatttaatgaaaatccataagccaattgaactactgaagctaccacaaggcaggaaataataggatggccacttgtcatcattgggcatggttttgaatctggaaattttaagtatgtatctgaagaaggcctgcgataactcctggtaattttagattttcaagtctttaagttgcaaatttacttttaaatagtatagcgcactcgggaacgtgggggaagagtgaaagaaaggggaattattccacccactagaaataagaaacaggatagagttgccattgccagtgcagtgccaattttttgatgatctgggaaggagggtgtgtggaaagacggggggaaggcaatcccatccttgcgaatgatcgataagtaattgtacaagatggaaagaaagacaaagctgctagcaatgatgttcagaattcctggaagacggaatggattgaaggtagctttcttccggagtctccctgagttcaatttccaaagagcaatgatgacagagattgtggcaataatgccaagaaagcttgcgatgagtagcagatgttgggcaactcgaatatccagagggatgaagtcatcctggtaggtgtatttgtaacacatccggttaaaggtggaattgctttcctggtggtaaatgcaggttttccacatgcctactaaggtcatgccatgcttggaatccatgggatcttgaaagaaccatactcgccattgagggaggcccatagagacaatacaaaggaaccatgctatggcgcctgcagcaaaacctcctatctgccatttggcatgctttctggccattatcacggtgacagtaatctcttggaaactgcaaagaaacacaggatgaatgagaaacataagattggactctttaggcctaggagaatgtcctctatgggttcaataccacaagataaggggtatgttgaggaagtgggcctctgaccaggaaatctcttgcagggactgtgttttgatcaaacccagagaaggaccaactctgtggcatcatttacttgcatattgataatccacagatgatataagattttatttttccactctttacagaatcccaataaactttggcactggatatttagtcaccaaaatattcatcagagcatgaaatttcatactgaaaatagtaagccacttcaagcacaacaactgggtaatttatgcaatacataccatggagttatatgccaaccttcaagagaggaataccatatattaacactgtggtattttgagcatggcacatttcacttggatgctttttttaaatgttgtatggctctacactcctgactgaaccagaactatgccctcatccccatttggctttcatctagaggccatcctgctgcctctgtttcccaaatgctgctttcctggtagtaaacgaaggctctccacatgcctactaaggtcatgccaggcttgaacagcataaaattatcaacaccatgtcttcaaagtctattaatgctatagcaagcctaaagtgtttctcctcttttatattgactagttttgcaaagtgttgatgaactgtgctttctctgcttcatgatcaagttttgatatctggattaatacccacctttac

SEQ ID NO: 2807 - DNA, 1600 bp, mus musculus
agggatccatcccataatcagcttccaaatgctgacagcattgcatacactagcaagattttgctgaaaggacccagatatagctctctcttgtgagactatgccggggcctagcaaacacagaagtggatgatcacagtcagctgttggatgggtcacagggcccccaatggaggagctagagaaattactcaaggagctaaagggaactgcaaccctataggtagaacaacaatatgaactaaccagtacccgggagctcttgtctttagctgcatatgtatcaaaagatggcctagtcggccatcactgcaaagagaggcccattggacttgcaaactttatatgccccagtacaggggaatgccagggccaaaaagggggagtgggtgggtaggggattgggggggcgggtatgggggacctttgggatagcattgaaaatgtaaatgaggaaaatacctaattaaaaaaaaaaagaaaaaaaaagaaaatcagaccggcacactgtagaacatagcgtgaaatgcacattgtaaaacatagtatatgagtgagttgcaccgaaacatatagaaaatttgaaattcccagtatagaacacagtatatgagtgagtttcactgaacaacctagaaaataaggcctgcacactgtagaaaatagtgtgaaatgcccattgtaaaacacagtatgttaatgagttgcactgaaaaacagaaaatggaaaatgcagagtgtagaagccaatatatgagtgagttgcaatgaaacaccttgaaaatgagaccgccacactgtagaacatagtgtgaaatgcacattgtaaaacacagtatgttaatgagttgcactgaaaaacagaaaatgggaaatgcacagtgtagaacccaatatatgagtgagttgcactgaaacacctagaaaatcagaccggcacattgtagaacatagtgtgaaatgcacattgtaaaacacaggatgttaatgagttgcactgaaaaacatagaaaatgggaaatgcacagtgtagaacattgtatatgagtgctttgcactgaacaacctagaaaaaaaagaaatgtaaataaagaaaataaataaagcaaatatccaataaaataaagaacaaaagactcattcaaataccggaccaagaatctgaacagagagttttcaaatgaagaaaaatagtggtcacataatatctcaaaaactgttcactattcctagcaactggggaaatgcaaatcaaaacagctttgatactcacctttattacagtgaaaatgccaaagatcaacaaaactgacaaccactgctgaatgtgaggtgaatgtatggggaatatgagaaaaagaaagtcctcattcatacttgctaagattgtatatctgtgaagcaactatcaaaattaattaggagaactctcataaaactaaatctaccatgtgacccagctatacctctccttgatatgtgctcaaaggacaagataccttactccacagattccattgattctagcaaagagaaagcctacagaatgggcaaaaatatttaccaattatacatgagattgtgagttattatctagaat

SEQ ID NO: 2808 - DNA, 1000 bp, mus musculus
accattcatatctcaaactgaggaagaggggtttttgtttttgttttggttttggtttggttttaaattaatttattttttacactttatattccattccctgcgcccccccccatccacactccaactgctccatattccatacctcctccccaccccctgtctccacatggatgcccccatttaccaccccacctgacctctaaatgccctggggccttcagtctcctgagggttaggtgcatcatctctgaatgaacacaggacctcatatcagctggtgtatactgtctttttggtggtccagtatttgagagatctctggggtccagattgagactgttggtcctcctacaggatcgcccttctcctcagcatctttcatccttccctaattcaacaactggggtcagctgcttctgtccattggttgggtgcaaatatctgcatctgactcagtcagctgcttgttgggtcttttggagggcagtcatgataggtctgttttttgtgaatggtccatagcctcagtaatagtgtcagaccttggggcctccccttgagctggatcccactttgggtccgtcgctggatcttcttttcctcagactactctccatttccatccctgtaattctttcagacatgaacaattatgggtgagagatgtgactgtgtggtagaaaccccatccctcacttgatgtcctgtcatcctgctggagttggcctctgtaagttccatttccctactgtcaagcatttcatctaaggtctctccctttgattcctgagaggctcttacctcccaggtctctggtgcattctgcagggtccccacaacctcctatttcctgaggttgcctgtttccattctttctgttggccttcagggcttcagtccatttccctcacccagtaccagatcaggttccccccaccaagtcccctccccaagtccactttccctcccaggtccctccatcccttcccacttgtga

SEQ ID NO: 2809 - DNA, 1200 bp, mus musculus
gttcagaatcagaatttttccagagctgcaaatctgtcacatgcaattggtgcaatgctgctagtaaattggagtcatgatcttcacaaagatgcaggaattacaagcatcaattgttgctgtgaacaacacccatgtggagattgcaacagcaaagcaatggctggagatcatccagggaactgtgggattcttaaaaaaattgggtagggatggccttttgagcactcctactgattgttgtgtgtggagtaatgctttggtggatagcacgtatgcgaaggcggtacagggctgataaatgagccttggggcaggctatggctgccttggaatcaggaacatccccccaatgttggctcaacatgctggatcagtaatcaatgataggtaagaccctcacgcgcacataccaacctaagacaggatggcaaaagtgaattcgtcattcccatgacaggtaaggatgtggcacagatgggggcaacctaagacagatgctgatcccagagctactaataaagctaaaagggggagatgcgggaagcaggtgtggcggcaagggccaagttgtttactgccttgcccgagcatgcacagtgaggctgcatgcatgggctgcctgccaggctggactgttcctcatgatccacacctgtcagcctatctgtgaacgacctgagctcatgcctggagtgtgtgtgaattctgattggatgaggtggggtggagctagaaggaggtcagccggtgtaaagttttgttgtatctgttgggggagtagaagcaaaaaatatccctactgcccatgaaaagcacacaccagttggccaatagtactctctctgtgtctttttttttccattttttattaggtatttaactcatttacatttccaatgctataccaaaagtcccccatatccacccacccccactcccctgcccacccactccccctttttggccctggaattcccctgtactggggcatataaagtttgcgagtcctatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctga

SEQ ID NO: 2810 - DNA, 1000 bp, mus musculus
aatacatgatcacatgatacattaagaacatggaaagtgtcttagttagggttttactgctgtgaatagataccatgaccaaggcaagtcatataaaaaccagaatttaattggggctggcttacaggttcagaggttcagttcagtgtcatcaaggtgggaacacagaccattcaggcagacatggtgcaggagatgctgaactttctatatcttcatctgaaggatgctagcataatactcacttccaggcagctaggatgaggatcttaagcttacatccacagtaacacacctacccctacaagatcacacttactccaacagggctacaccctctagtagtgccacgctctgtgcaagcataaacaaaaccatcacagaattaaaagaggaaaaaagttgagggaaaatgccaatgaattaatgcataatcttatgaagttgggagatacagatatggagatgtaaacatcataaatgtttttattaaagtgcttgagagatagtaaatgaattgtaaatggaatatttatacacttatttttgattgaaattattatttttaattaggtatttatttcatttacatgtccaatgctatcccaaaaggccccatccgctcccccacccactcactcccacttcttggccctggcgttcccctgtactgagaaagataaagtttccacgaccagtgggcctctttccactgatggccaactaggccaacttctgatacgtatgcagctagagacatgagttctggggggtactgggtagttcatattgttgttccacctatagggttgcagatccctttagctccttgggtactttctctagatcctccattgggggccctgtgatccatccaatagttgactgtgagcatccacttctgtgtttgctaggcctcagcatagtctcacaagagacagttatatcagggtcctttcagcaaaaccttgctagtgtatgcaatgctgtcagcatttgg

SEQ ID NO: 2811 - DNA, 1000 bp, mus musculus
aggatcaggtcagtgagctgatgatggcctttgtaaggactagtttaccccaaactaaacaaattggagcaagttgactttaccaagaccaagctagaatgaggcaaatcatcaactgtttctgtatttaagattgcttctcacccttcctgtcagcatcagcactgggtcaccttgggcgctgagtaggtggacacccccaaggtccctagaggactctccacgtgatcttaggaccactggtgagtggaacacaacttctcttccattctaatcgtgcgggaactgagaaagcattagggaatcagaaaacccagcctgaccagggtcacaactctcttttggtttacacaagcaccaggtcaccgtgggcgtggagtaagtggacacccccaaggtcacaagaggactctccatgcgatcttaggacctctcatgagtggaacacaacttctattccaatccaatcatgcagtacctgagacagcagtggggaagcagaaaaccaagcctgaccagggtcacaagtcccttctggttggtgccagtgtctggtcaccttgtgcgcagagttgacagacacccccacggtacctagaggactcttcatgggatcttaggaccactgactagacagctccacgctcctcaaaggagacaccactcccaggcactgtaacacgcccaggatctttgacaacaggatcccaggataaaaggagcttggtcacaccagtatttcagtgtctcagaggaaattgactcccacgaactctgacacacccagaatctcaggtttacagaagcgcagaagcaaaggatcacagagaaagctggactctgaggagttcggaatcaactgggattataggaaggacaggctccaataagatatattgaggacagcaaatacttgagataataagatggcaggaggcaagcataaaaacagaagcaacagaaaacaaggttacttggcatcatcagaaccaaactctcc

SEQ ID NO: 2812 - DNA, 1000 bp, mus musculus
ctaagcactggtgctaaaatgatgtcatcatcaggcgccaaccatcatttccagtggagctgagcacaagcagagcagggctacccagagaggcctgagtcctctgctttcagctccattgcaacacttcctctcttccgagggtctcctctgggacagccgggcattggcctctgagtcagctctgcacctctgagaaggtacaggtactgctgagactgtggttgtgttcaagatgccaccatggccgaagcaccttcacaagtgcaacagaactatgacccctgctgtgaggacgccaccaacacccatatccagctgctgctccatgcttcctatgtgtatctggctatggccttctactttgaacctgaccgtggggaatttcaagagattcttcctgagcaagtcatacaactgcaaggccagtgtggagatgtttctgttcctgcagaatacatggtcgccatgttctactgactcgcattgtgagaccagaccgcaagagttggcagggggtcctcagggccatggaatgtgccttccacatggagatgaccatcaaccagagcctgtcaacctgcacgagctggccaaggggaagggtgatgctcacctctgcaacttcctggagcagcactgtctgggcaagcaggccaatgtcctcaagaagatgggcggctacctgaccaacctgcgccagatgggggcaccagagtacggcttggccgagtacctctttgacaagctcagcctgtcctgaagcttcaagtggactgaactgggatgtccccactgccatggggtcttcctctggtcattagacctggagtcagttcatgtacatttgaagcaagttcactcgttttctggctctgtttgcaataaatttgtttgtttcaaagcaaaaccaaagtttagtgactcttcttgcaaaactcattttcagaaatcaaggtccatctattctcaagtttgtgaaatggagggaagtagggct

SEQ ID NO: 2813 - DNA, 1000 bp, mus musculus
agaaaataagtaataggtgtgggtccagcccttaaaaacagcttctacagctaacaagatattgtgtaagaaggaattaggcagaatgtatggcgcagcactgtgaataccattctctggacttgataacaatcattgtaatcaggaacccacaaaactctaggtacctgacccaggcaggctctcagatcagtgttataaacaatcactgaaggaaaagggaaggaggatcatgtgtccttactccttccctctgactgattggctactgagagattctaggaaaggtgaaccactatttttagttgaacccactaaactccagcccttagctccaaatccatgatcacacagatgcccttgttaatctcagtgggtcacaaaacaaaatgaaatgatacaaacataagacagagattcacaggcaggatgtgagttaaaagtgaggaagtgggaagttagagtggtcagtatgcattgtgtacatgtacaaatttgtctaaagataaatttacataataaaaaagtaatttagaaaaacaacttatggagcacctaggagaggcatcttggttcccggatccctcagagactagtctgctcaggtaaaagtgtggtctgcagaggctgacagattctgggacaggttgaggccacacagcttctggggcagaccccgtttcaggctccagacatctggtcaccctctctgccagaggagaggtgtctgccctgccaggaagggctttgcaggagcacctggggggagccatctctggcccgggatctctcagagactagactgtgtaggtgagagtgctaactactgaagctgcgcagcttctgggaaaggcagaagcagcacatcttctgggacaggccctgtttagggccttcatcttctgccagaaggcaaatccgaacaacagatatctgtgcaccatctctgcaagaggagagcttgcctgcagagagtgctctaaccactgaaactcaggag

SEQ ID NO: 2814 - DNA, 1000 bp, mus musculus; identical to SEQ ID NO: 2813

SEQ ID NO: 2815 - DNA, 1400 bp, mus musculus
cttttgtgtcttattgagattttgtttgtttgttttttttttttgatattagatttcttttgaaatatatagagaggacagagaaaggaagaatataaaattagatgggtagggggttgaagggcctgggaggatttgcggggaaagtaaataagctaaaagatattgtatatcttatatgaaaaattataaggaagactatcaaataggctgcctggagactatctcagctctctctgttacctctggctcaatcctacaatcttttccctagtgatgcaatagaagagctctacccacacttccattttgtccacatcacttgtgtatcccacagactgtaccctcatattctctcttcctgaattccttactatgtgccagactccaacaataataggtattccatgtgaacataccagctgagcagaccagtaaaatgggcaacacacagccatcacacgcttcaaaactacaggaagaaaattaaagccagggaacaaagcatccatttacaaaataaaatgagaaataagcaaatctacctataatcatctcaaacccagatgcataaatgcaagtataagaaaacaatagcaagagacatgtgggcaccttccctgctggaggaggggtgtccgccctgcctgggaggactttgcctgagcacctgggggagccatcttggttcctggacacctcagagactagtctgcgcaggtgagagtgtgaattactaatgctaaaaacttctggaacaggcagaagtcatacagcttctggtgcagaccccgtttcgggctccagacacctggacacattccctgctggatgagaggtgtctgccaagcctgggaggactttgacggaacacctggggggaccatcttggttcccggatcgctcagagactagtctctataggtgagagtgccaactacagaagctacatagcttctaggacaggcagaagtgacatagctctgggacaggccctgtttcaggccttcatcttccaccagaaggcagaaacaccagatacctgtacaccttccctgtaagaggagagcttgcctgcaaacagtattctgaccaatgaacctcaggagagagctagtctcacaggtctgataatagaggctgacagaatcacagaaggaacaagctctaaccagagacaacaataaaaactaactccagagattacaagatggctaaaggcaaacgtaagactcttactaacaaaaaccaagaacactcaccatcatcagaacccagcactcccatctcagacagtcctggatatcccaacacaccctaaaagatagacccggatttaaaatcatatctcatgatgatgttagaggacatcaagaaggattttaaaaactcacttaaag

SEQ ID NO: 2816 - DNA, 1200 bp, mus musculus
accctttcatcactaaacattagtcttaagtggtccttggcaatttacataccagtaaatgccagaaggtgtaacctccccagcctgaaacaggctgatccagactttgaccttgctgccactagggaaattacctagtgtggagccttcctacctagatagttctattgttctaccacctgccactgctcctccaagacactgctacctgatgagaagccactgaaatattccggaggaacatcctatactgcacattgcctgcaggctgattccagacacccagaatggactggcaggggatgggccttcccccttataagcacactctcttagtaaactagcaggctttgaacagaattgtgtcttggtctccattaatttctctcagtctagtctctttcagccccagcatgcctcccaggtatacccggttcaagtaggccgtgggctggtatacaacggattggcgccatgaacagggacattgaggacggtaggaaaacactgagggaatcgctgtcttgtatggagctccaagggaaggaaagaatcagaggactgtatcgggcacaatgagcaacaggtatttatgctagcactggctttaaacttcatttaaaaaaaaaagtgttgctggaggagtgaaaggatacaggctaaattggaacagtgctaatctagcgctgggtccacttaaggtttggcagcgaaggactagaaactgaatcaggtggttgtccacagcttttaaaagttgcttcaggaaagaggaatagggtttaaaagaaatgaaacaggtggttgtccacagtcgagaactgcataaaactagagaaacagggcttaaaatgatggagtaaaatatatagaggaaaatggattttgaaactcttccagagacagagagaaatcggggacgccctgctctactctcgctggctctacagcagaagttctctgccctctttgtgttgtctaatctctggtgcaccattccgttcacgtgtcaatacatgtgtttgtgtttagttgtctgaatgactgaatgttctgtgttttatgttggaaaataaagatgactaaaactttaactgctggttcagcagggctgagagtggccacacgctttagccaaggatcagacacagcaggggagccactgctggaaaagctgctctcaaagaaagggagtctgca

SEQ ID NO: 2817 - DNA, 1200 bp, mus musculus
cagacggagaagatcctcctcccaccaagacataaacagctgtctccaattttccacccttgctgctaatgcagagtccccttggtctcctcaggctttggagacaatggggacaagaaagggtgacctccagctcctactatagcttaagagccacaaattgtggtgttataattggcataattcttagtgagtctgaggttgacaattctcctacaggagctgaacagaactcagaactgtgtatgctggttggtgataatatgaatccggtatgggcccagcatgggtgcaagctaagtgttgcaggggaaggtcccaattgaccatttctgagttccctgagagacaaaccaagtttggatggaggttggtatctagtttctgttgcaactaaagaatttttctaaggctctgcctcccctccccaaaagataccaagagccacaagtgtgggtctgtgacagcacccacgggaggaatcaagtcaatgtccccccagccatggtaatgcccgctcatctaaggatgagaagattatttgatcacctcagttaagtgtgaccttattaaatttaattcagaaaggggagatgtcagagaccatcccgtcagaaagtgagcccttcacaatctccctgacaggccaaatggcctcatgctaggagctggttatcatcccctcctccctattcccttcctggcacctgaggctgtaaaagctgaattatagtcccctcttccctatctcttcctgaactcccatgccatccaaggacatgagttacgcctgagcccagcctgacaccccaaggctgtcaaggagaatctatgttcaggagataagatgcagagtgctcgttgcctggcgcctgactttggcccccatgtcagcagatgcccgcttctttgttctttgtaaaattccccctcgaccccccctccccattccccacgatgtatgctttaaaatgaaggcacctcagcataacaaatgagaccttgacaaattttttggtctcatgctttctttcccttcctcccatttccttccagttttgcagtccccctcaaacccacgaataactgaatcctgtgggacaggatagttaaggtgaaaagccttataacttttgcaacatggcacagcttcttactacagatatgccataacttatgattttgttactaaaatattcc

SEQ ID NO: 2818 - DNA, 1400 bp, mus musculus
tagccataagggtgaatggattcatgcttttttttttggaatatggatggaactggaggacataatgtcaataaacaataaaccaaatactgaaaaagaagtgccacacattctcacgcatattgaagcatacatttaaacacaaaataatgaaaatggctaatttgtattatggattataagaaatatacaacggcattgaaaattattgattgaagcataatagtactgagattttgtaactaaaacagtgagcctatgtgttagtgatataaacagaaaagattactattttaaagtaagttcttaatttaagatttgagagataggacatctcatttgctttcaaaagtaattttgatgggggagccatcttggttcccatatccctcagagactagtatgcaaggtgagaatgtggagtacagaagctacacagcttctgggatagaccctttttcaggctccagacatctggtcaccttccctgccagaggagaggtgtctgcccggcctgggagggctttgccggagcacatgggggagacatctctggtcctggatctctcagagactagtcagcacaggtgagagtgtggactacagaagctacactacttctgggacaggcagaattgacacagcttctgggacaggtcctgttgcaggtcttcatcttctgccaggaggcaggtccaaatgtcagatatctgtgcaccttccctgcaagacaagagcttgcctgcagagagtactctgaccactgaaattcaggagagatctagtctcccagatctgctgatagaggttaacagaatcacaggaggaacaagctccaaccagagacaactataacaactagctccagagattaccagatggtaaaaagtaaacgtaagaatcttgctaacagaaaccaataccactcacctacatcagaacccagcacacccacctcaaccagtcctggataccccaacatacccgaaaagctagacccagattaaaaagcatatctcatgatgatggtagaggacataaaaaggcattttaataactcaattaaagaaatacaggagatcactgctaaagaggtagaagtccttaaaggaaaacaggaaaacacaaccaaacaggtgatggaattgaacaaaacaatacaagacctaaaaagggaagtagacacaataaagaaaacccaaagtgagacaacactggagatagaaaacctaggaaagaaatctggaatcacagatgtgagcatcagcaacagaatacaagagatggaagagagaatctcaggtgcagaagattctatagagaacatgggcaaaacaatcaaagaaaatgcaaaattcaaaaagatcctaactcaaaacatccagaaaatccaggacaca

SEQ ID NO: 2819 - DNA, 1200 bp, mus musculus
tctcctctgagtttcagtggttagagctctctctgcaggcaagctctcctcttacagggaaggtgcacagatatctggtgttaggacctccctcctggctgaagacaaaggcccaaaacaggacctgtccggtggctgagttgccttggcctgtcccaaaagctgttagcttctgtactctacactctcaactgtgcagagaactctcggaggggtcccagaaccaagatgtctggcgcagatgctcaggcaaagtgctcccgggccgggcggacacagatcctctggcctggaaagtggccagatgtctggggccccgaaaagggggctgccttagctctgtggctcccgcctatcccagaagctgttagcttctgtattctgcacactcacctgtgcagaatacttttggtggggtcctagaaccaagatgtctgctgctgatgctcaggccagtttgtggtccaaatccccaaaaatgttcagcaatagctgtgaatggaagtccaaagatctagcagttgctcagtcccacaaggcaagcatttgaagaactttcctgtattctttaagggattcattctttggctcttcaaaggcctctattatcttgctgtagcagagtagctgtcatctgaagattccatatagccctggtttttgttgattgtgttcttccaagggccttcagccatctggatggctttagtccatggatattccagttgtaataggtattggagggggcctaacctcaatgatcctagtgtaacaggcctctagtgggtattcttgcactgtaaggttccagatcagcaggtttgatgaaagtgggaggagaggtggtgggataatggaggtcttctggggatagcaggctgctccctgctcccggcagctgtgggtcctccagaggactcagaaaccaaggaagataggtgcaggaagggaatctaatctgtatggttccaggttagcaggtctcatgaaggtgggcagagaggtattggcataatgcagacctgacaggaatagcagtcataaagtagtttttaattttcaatgttcataagttttatctaaacaagtatcagctttcatctttctgtttatggttatacaaatttagttaaaatgtcaaatacagcatttatgcacactcatgaaaaaatggcatacactgtgttgtcagaaatttcc

SEQ ID NO: 2820 - DNA, 1000 bp, mus musculus
gatcacaccacaaggaaacacatacctactattcaaactctggttaagaatttgtggctgagccagatgtggtggcgcacgcctttaatcccagcactcgagaggcagaggcaggtggatttctgagttcgaggccagcctggtctccaaagtgagttccagaacagtcatggctatacttagaaaccctgtctcgaaaacaacaacaacaacaaaaccaacaacaacaaaaaaaccaacaacaacgaaaaagattttgtggctgggaagttcactgatactctactagtactctgctaaatggacccactacctgctaaatgtttattttggtattcataggttagtggtgttctatgacatgaccaaatacatttatttgtagagaaaacagtggttagttaaaaaatctacaactggtcaaaatgcagacagtcactagagttctcagacagaaatgggattgtatattacacctatctccaaagctcagggaccactatcacagacgggtggaacaagtgttaaaagctaaaggtaagggcagatcagaggaaaacagtgacagtacaggaccactgaactcataaattgaaagctgctgtggctgctagcaaagccatgcataagatcaacccaacattctaacatagattcagaaggtgttcttgaggtctcctcatccataactaataagctatgggctgctaatgggctctggagtgaagtgaactagttttcactaagagtgtgcttaaatgagaattttattatttattgaaaccatttctctgaaaacaataaaaattgatatgaaacttacaaacagcttattttctattattgaagactaattaaagttctgaaattaacaaaatacaccaagtatatcattaaatatctggaaaaagaaactcagaattttaaaattaaaatgtcttatcagtctacatcttctggtttatctacaacacaaaaataaattacttcatcaaaatgc

SEQ ID NO: 2821 - DNA, 1800 bp, mus musculus
ctcaagaaggaagataacttttgatgagtactctattgtacagcagaatatagctgtggaaaagttgaggatgattattgtatttgttgatactaatattcacacttgttttttcattttgaatatttctcaaggcccaattttatgactccacagttattatgtctatgtcttaccgataaatattatgtctactttttaccacaaagaaaattatatttaataacatatttagttatattttatatagatttactgcttgtacattctaagttcacaataagtatttaaaaataataataaagataccaatttaatcaattctaaaaaaagttttcaaaaagtgaggtctttaaaattctaccttaatctctaaacatgactcatgtaaccactaaataggttctttcttcttctttttttaaattagatattttcttcttaacattttaaatgctatccccaaagtccctataccctctcccagccctgctccctaacccacccactctctcttcctggccctggcattcccctgtactggggcatatgatctttgcaagaccaagggcctctcttcccattgatggactattaggcaatcctctcctacatatgcaactaaagacacaagcttggggggtgagggtatgcgatagtttgtatatccttggaccagggagtggcaccatctgaagttgtggccttgttggaataggtgcgacctggttggaatgggtgtgtcactgtggatgtgggtataagatcctcactctagttgcctggaagtcagtcttccactagcagcctttggatgaagacatagaactctcagttcctcctgcaccatgcctgcctggatactgccatgctcccaccttgatgataatggactgaacctctgaacctgtaagccagccccaattaaatgttgttttttataagacttgccttggttatggtgtttgttcacagcagtaaaaccctaactaagacagggtactagttagttcatattgttgctcctcctaaagggttgcagacccctttagctccttgggtactttctctagctccttcattaggggccctgtgttccatccaatagatgactgtgagcatccacttctgtatttgccaggcactggcaaagcctcatatcaggttcttacctatgcaaaatccgtaccctctgagttaccaatttaagaagtagggcaaagccaggtggtgggggcacacgcctttaatcccagcacttgggaagcagaggcaggcagatttctgagttcaaggccagcctagtctacaaagtaaattctaggacagccagggctatacagagaaaccctgtctcataatcctccccccccctcaaaaaaagaagagaggcaagtagaatttgcaattacaatagcattctgaattttaatacatttgtttccttgataagacatatgcacatatattggattaatggcccaatttcattaaccatgctgcaactttctaaatgttaagtaatttttatcatagtcaacataccctgacaggcttgtatttgctgataaagagcaaataaatctgaatggcttagctttaatgccaaaatcattcttccatacctgaaatgctcacatcataaaatgtcaaaacaagaatgaccaatgataatgtcaatgcttctgggaaataatgcaatcatcacaagtgccatagagctaaatatttaaaccttctttttcaccaagtgaatagtccattaagttatataaatgtcatttttaagcacatgtatct

SEQ ID NO: 2822 - DNA, 1600 bp, mus musculus
tacaactttgaaatattaaaaagctaagatttaaaaactaagtttattatttctgacaatttcatatatgtatgtagtatattctgattattctcttttatttttctcacacccctacaagccctgtctttctgataagtccttatccccacactgcacatcgttttgttttgttttgtaacctgctgtctttaaccagagccttcaggataaccataagttatggacttctcaatgaactgatagattcactagtgggtagacaactaaaaatgacttcttatctcactagaatctgtcaggagcctgtatttcggagggtcacagtcacatccgtgactgattgttaaagattctatacagacacagttcatgtagccacagttatcatgagttcatgatcatgatggctatgtcagtcaggcctagaagatgacaatttgcggccctttcctctctcttccagttgtaagataggaacatgtagttcctatcttataataaataaaataagggtatgaaaagatttgaggaaatatattttaagcaaagattctattaaaggaattctattatgacacaatactgatagcttattttaatactttgtagagtcacctcttgttttattatgtgtttgtttataagaatctcttcaatataatatatcaattaaagacttttttttttttttggttttttgagacagagtttctctttatagctctgactgtcctggagctcactttgtagaccaggctgacctcgaactcagaaatccacctgcctctgccttccgagtgctgggactaaaggcatgagccaccacgcccagctaattaaagacatttcaaggggctggagagatggctcagtggtcaagagcactgactgttcttccagaggacctgagttaaattaccagaaaccacatggtggctcataaccacctgtaatgggatccgatgccctcttctggtgtgcctgaagacagctacagtgtactcatgcatataataaataaatctttttttaaagacatttcaaggcataaataactcctccttttcttgtttataatgctcattttaaaagtccctgaaactatctacgagttcaaatgaaaataacttctatataaagtgtctacctacttcatggctgttttttatatcttttgaaggaacagtttaatggaaaaaaagctttctggatttatttggtttcgtgccactacaatgagaaattagcttttgcctgtcagtaggttgcatatatttatatgcataatatatttaattacctctgctgagaattcttttaggattgacattaataatttaaagacacaaataacatctttaggagctatgactttcaaataattttcagcttaggttcattagtcattgtaaatctggttgcatagtcagagttacatatcatataaaaattgtggaatttaatacaatattatttaatcttttgaagtaacccacactctttagattatttcatatgtatgtcatctatatatttttagaagttctgtttttatccctacatattcctctgcctaaataataagtaatagcccata

SEQ ID NO: 2823 - DNA, 1600 bp, mus musculus
gctccggggtactggttagttcataatgttgttgcacctactgggttgcagatctctttagctccttggttactttctctagctcctccattgggggccctgtgatccatccaatagctgactgtgagcatccacttctgtgtttgctaggccccggcctagtctcacaagagacagctatatcagggtcctttcagcaaattcttgctagtgtatgcaatggtgtcatcgtttggaggctaattatgggttggatcttatttaatttttttaacattccagattttattccgctccagtctaccctctgactgtactatacctcctccctgccccactgtctccaagaggatgtcccgatcccccacccccactccccaatacctctaaactccttgagccctccagtctcttaagggttcagtgcatcatctccgactgaacccagacccggcagtcctctgctatatgtgtgttgggggcttcatatcagctggtatatgctgcctggttggtggtacagtgtctgagagatctcgggtgtccaggttaattgagactgttggtccttctacagggtagctctctgcctcagcttctttcagcttttctctaattcaaccacacgagtcagcagcttctgtccattaattgggtgcaaatatctgcatctgactctttcagctgtttgttgggtcttccgaagtgtggtcatgctaggtccctttttgtgagcactccatagcctgagtaatagtgtcaggctttgggacctcctcttaagctggatcccacgttgggcctatccctggaccttcttttcctcaggctcctctccctttccatccctgcagttctttcagacaggaacaattttgggtcagagttttgactgtgggatggcaaccccatccctcacttgatgtcttcctgctggaggtgggctctgtaagttccctctccccactgtaggagatttcatctaaggtccctccctttgattcctgagagtctctcacctcccaggtctctggtatattctggagagtcaccccacctcctacctcccaaggttgcctgtttccattctttctgctggcccacggggcttcagtccatttcccctacccaataccaaatcatgttctcatcttccctaccccctatcacatttcccacccaggtccctccctctccccttgtgattgctttctttcctctcccaagtggaattgaggcattctcacttggactcttcaagttattgatctttttgtgttctgtggactcagctattaagaacaaggacatcctgagtttgcaggcaaatggatggaactagaaaatatcatcctgagtgaggtaactcagacccaaaaggacatgcatggtatgtactcactaataagtggatattagccaaaaaatagtacagagtacccaagatttcattgactcttaatctttatttataaccaagtctaaaataagcctccatgttatgcaattaacaccaatttaagaggattattttgcatattttcttctctattttgagttatcagccttatgaatagagttgaagaacactaatgacaat

SEQ ID NO: 2824 - DNA, 1600 bp, mus musculus
ttttttaggtctagtatggttttgttcatttccatcacctgtttggatgtgttttcctgtttttctataaggacttccacctgtttggttgtgttttcctgtttttctttaaggacttgtaactctttagcagtgttctcctgtatttctttaagtgagttattaaactccttcttgatgtcctctaccatcatcatgaaatatgcttttaaatccaggtctagcttttcggttgtgttggagtgcccaggactaggtggggtgggagtgctgcgttctgatgatggtgagcggtcttgatttctgttagtaggattcttatgtttgccttttgccatctggtattctctggagctagttgttatagttgtctctggttagagcttgttcctcaggtgattatgttagtctctatcagcagacctgggagactagctctatccttagttttaatggtcagagtactctctgcatgcaagctctcctcttgaaaggatggtgcccagatatctgttgtttgaacctgcctcctggtagaagttgtgttccactcaccagaggacttaggatcccgtggcagatcctgtgtgggtccttgtgggtgtctggagactccccaggggccagggaccatggtgctgcagtgggccggccagaagggacttgagccctgtatcaggcagggttacctgcttccttaattactgcagtgtcaggtcctgctcgattggattggagcaggcgctgtattccactcaccagaggtcttaggatcccgtggcagatcctgtgtggggccttgcgggtgtccacagactcccccaggccagggaccatggtgctgcagtgggctggccagaagggacttgagccccgtcacatgtgaaatttctagtaaaactatgttaacatttaaataactagaaaattattgccccaagtagcctttccattttatatttgacaattagtgaagaaattatccagagttgtataagtgagattaaaatgaattatttattgggtacaaatagtgtctataaaactgagccttgatataaaacagtttaaaatagtctaaagcaaatactagtgtatataaagatgttattttggtatccatttatacaaaattaaaaatacctaatcagtagtgactaagtcatttgtagaatatatttaaatccctaatggaaatgattttaaaataattattatgtaattgaaaagcatctgataaaatagaagactcaattgaagcctgctagtgcttcctttgcaatgttgtcgcttcaccaacttttattcagccaaaccaatattgtacttttttgtgtgtataaaaagagttgaaatggtcttagatttgaatttaaggtggacatatttgtgcatagtgccaaacctagcctgaattgttttagatattaaacacataaaggttataggaatatatttaaagcacaaaaatggtaaaatatctgttaaattctggaagaattggaaaattgaataatttttaaatttcaaatcgcattgttttagtttgtttgtttgtttggttgattggttcttttgttttttaagatttgatctttaa

SEQ ID NO: 2825 - DNA, 1400 bp, mus musculus
tcaaaagaactgcacttggaaaatgtcttcctggttttttttttttttttgacttatatttttcaaacacaatccagatattatttatattttagagctcatatcctattagaatagctttcatctttaataattgaaagaataaatgttttataaatacaatttgttgtcattttattttcagttttgaaaataatttcaattttgagtattttccttaaaagatagttccttaaaattaattgatccaatctttgctccctaaatagcaaacaatttaaaatattgaaaataaatctggagttacattttctactccaattttatatgctcagacaggttttttattataattctttaacagagttgccattacaactgatactgagatcaccagcttgtctgttcctctgaagattccacattctgaatgcctccctggagttcagctgcaatcagggtaataggtaagggaccctcccagaaaactgcagcagattggaacccaatgagcccagtaaacttgggacccatcactcttaagcctccccaactcacaaattccactccctctctggtctgcatcttctgccagggcagatcgttagtttggatgctcctctaaaaaccccatagtctgaaactctccaacaagttctgcttcatgcagggcaatagaccaaacagtctgaaggcttcccaaaagtttccctgcatccagaacaacagatcatatgtgtacatgccactctgaagacccagattctgaaagcctcccaggatgtctgctacagacagggtcacaggcctcccaggagacctgcagcaacacagtgacacaggagttaggcttgagacagaaacacccagaacagctaacaccagatataaccagatgtaaccagaatcatcagattccagttcttccaccatagcaagccctggatacacgaacatacctgaaaatcaggaacctgaccaaaaatcctatcttatgaagaaaatagagtcctttaaggaggatataaacagttcactaaaataaatacaggatagcactggtaaacaggtagaagcccttaaagaggaaacagatacaccccttaaaaaaatacaggaaaacataaccaaacaggtgagggaattgaacaaaatagccgaagacagaaaagtgtaagtagaaacaataaagaaagcacaaatggaggtaacccttaaaatgtaaaactgaggaaagaagtcaggaattacagatgtaagcataatcaacagaatacaggagatagaagagagaatcccaggtgtagaagataacttttgtaattgatacaactgccaaagaaatttcaaaacaacaacaacaacaaaatcctagcccaaaatatccagtaaatctagga

SEQ ID NO: 2826 - DNA, 1200 bp, mus musculus
ttttgttgttgatgctcacatctatggttccagatttctttcctagggtttctatctccagtgttgcctcactttgggttttctttattgtgcctacttccctttttatgtcttgggtggttttattcaattccatcacctgtttggtcatgttttcctgcaattctttaagtaatttttgtgtttcctctttaaggtcttctacctgtttagctgtgttctcctgtatttctttaagtgagttattaaagtctttcttgatgtcctttaccatcatcatgatatatgcttttaaattcgtgtctagcttttcaggtgtgttgggttgtccaggactaggtggggtggggagtgctgcgttctgatgatggtgagtggtcttgatttctgttagtaggattcttacatttgcctttcgccatctggttatctctggagctagttgttatatctgtctctggttagagcttgttcctcaggtgattatgttagtctctatcagcagacctgggagactagttctctccttagtttcagtggtcacagtactctgcaggcaagctcttctcttgcagggaaggtgcccagatatctcgtgttcgaacctgcctgctgcagaagttgtgttccactcaccagaggtcttaagatcccgtggagggtcctgtgaggatcttgggggtgtccggaaactcagcgcccaaagaaccccggtgctggagtggaccagaagggacttgtgcccctgatcaggccgagatatctgcttccctacttaatgcagtctcaggtcccgcatgattggattggagcagatgctgtgttccactcaccagatgtcttaagatcccgggggggatcctgtgtgggtccttgtgggtgtccggagaatcctcgggcaaggaaccccagtgctggagtggatcagaaggacaataatgtttttcatttactcttagaattggtttggtagtattttttgagtatttttgaatcaatgttcataagaaaaattgatctgaagatccctccctccctccctccctccctccctctttctttctttctttctttctttctttctttctttctttctttctttctttcttatttttttgaagttctgtttctttgttcaatcctcctctggtttaggtatcagggtgactgtgactcatagaaagagtttggcagtggaca

SEQ ID NO: 2827 - DNA, 1200 bp, mus musculus
gggtttttgtgtttcttctttaatgacttctacctgtttggcagtgttctcatgtatttctttaagtgagttattaatgtctttcttaaaatcctctaccagcatcatgagatatgatttcaaatccaaatcttgctttttgggtgtgttggggtatccaggactcactgttgtgggagtattggcttctgatgatactgagtggtcttggtttctgttagtaagattcttatgtttgcctttcaccatctggtaatctttggtggtagatgttcttgctgtctctggatggaactttttcctcctgtgagtctgttaaactctgttgacactcctgggagaccagctctctcctgagtcctgagggtcagagcattccctagatgcctactctcttctggtggtgatggtgtacagaggtctgaggatcaaccatgcttcctggctgaggatgaaggtccgaagtgaccctgtttaagaagctctgttgcttatattaccagcatgctctcctgtgcagaccagcctcagagagatcctggatagaaattggcaatcttacctgagtcctggtgtcaaagcactccctgtaggcaagctctcctcaggtgttgaaggtgcacagatttctgaggatcacctctacttcttggctgaggatgaaggccaaaaaggaccttgtccaagaacccttgttgcttctgtggctcatgctctctccttgtacactgagttctaaagctaggtagaccagcactgaccagaagaaacctcagccactggtctgtgggattctagtgtccgtgctccagctgtccccaggtacccctggttctgatggaatagatgttgtattcttctcgccagtgatcttaagatcctgggcatgctagggctcctgtggggtgtagagtcctttggagaccctgggactgcccaccgagttcgggcccaagaagcccggttctggtgccgacctacttccttttttaagcttattttctttctttctttctttctttctttctttctttctttctttctttctttctcctttctttctttctttttcctttctttctttctttctttctttttcctttctttctttctttctttctcctttctttctttctttttcctttctttctttctttctttctttctttctttttcctttctttctttctttctttcttt

SEQ ID NO: 2828 - DNA, 1200 bp, mus musculus
ttgttgtgtctacttccctttttaggtcttgtatggttttattcaattccatcacctgtttggtcatgttttcctgcaattctttaatggatttttgtgcttcctctttaaggtctctacctgtttagcagtgttcttctgtatttctttgagtgagttattaaagtctttcttgatgtcctctaccatcatcataagatatgcttttaaatgcgggtctagcttttcgggtgtgttggggtgccctggactgggcgaggtgggagggctgtgttctgatgatggtgagtggtcttggtttctgttagtaagatacttatgtttatctttcgccatatggtaatctctggagttagttgatttagttgtctctggttagagattgttcccctcatgattctgttagactctatcagcagacctgggagactagctctctcctctgagtttcagtggccagagcactctctgcaggcaagctctccttttacagggaaggtgcacagatatctggcatttggacctccctcctgggcaaagaggaaggcctaaaataggacctgtcccagaagctgtgttgctttggcctgttacagaagctgttagcctctgtagtccacactctcacctgtgcagaatactgtggcaaagtcctggatctaagatgtctgctgccgatattcaggcaaagtgctccttggccaggcagacacctatcctctggccgggaagatgtccggatgtctggagcccaaaaagcttgctgcctcagaatctctgtggctcctgcctgtcccagaagctattagtttctgtagtcaacactctcatctgtgcagagtacttttggtggagtcccagaaccaagatgtcttcagcagatgctgaggcaaagtgctcttcatttacatttcaaatgctatcctgaaagtcccctatacccacccctgccctgctccccgacgcactcactcccaattcttggccctggtgttctcctgtactgggacatataaagtttgcaaggccgaggggcatctcttcccaatgatagcctactaggccatcttctgctacatatgcagcttgatataggagcttgggggtggtactgattagtccatattgttgttccacctatagggttgcagaaccttcagctccttgggtactttctctagctcctccattgggggccct

SEQ ID NO: 2829 - DNA, 1000 bp, mus musculus
ttttattttttatttgttttttttttatttatttgcatttcaaatgttatcctgcctcactcccctaacattctgctatgccagggcatcaagccatcacaggaccaatggcctcccctcttattgatgccacataaggccattctctactacatatgcagttggatccctgggtctcaccatatgtttgttgttgttgttgtttgtttgtttgtttgtttttgtttttgtttttgtttttgttttgcttggtggttagtctctcaaagctcttggtgccatgttggttgattgttgttcttccctatggggttgcaaaccccttcagtgccttcagtccttcccctaacttctctattggggtccctatactcagttagatgattggctacaagcatctgcatctgtatcagtaatgctctgccagagcctctcaggaggcagctacatcaggctcctgtcagcaaatacttcttggcatcagcattttgtgactggttttgctggctgcatatgggatgaatccccaggtgagacagtctttgtatggcctttccttcagtctctgctctactctttgtccctgtatttcctttagacaggagcaactctggattaaaacttttaatatgggtgggtggccccatcactcaactgaggccatgtctcacctcttcatatcatctcttcaggttttctctcccttttgggggatatttcagttaatttcattcccattgagtcctgggagcctcttgctttcctgtcctctgggactttctgttggctaccctcagttccccatcctccattgtcacacacctctgttccatttcctaaccctctctatatcttcctgtcttttctcatacctcatccctgacctcaatcactactacagagcagtagtgataagaaccgtgtggtattggttcattatcttcttaagctttacaaagaagagaatggggaaggtgttattttttaacagatgagaaat

SEQ ID NO: 2830 - DNA, 1200 bp, mus musculus
atcaatgcactgattagcatgcatcaaagaatcttcttatacccattggtaattaacacagaggatcattccacaacatctccactaggatctgcatgacaagttccacagactgaggtgtttgatctccaaagggggaggcctcctgaaaccagttgtggaactcttcaccagagaaaaaatactgagctgtagttctcatggcaatctatcagttttgttttcacttattccttttcttatttacatgtttctgctagcctaggacaagatctttttttaaatatatatttattaggtattttcctcatttacatttctaatactatcccaaaagtcccccataccttccccctccacttccctacccacccactcccactttttggccctgacgttcccctgtactggggcatataaagtttgcacgaacaatgagcctctctttccactgatggccgactaggccattttctgattcatatgcagctagagacactagctctggggggttgctggttagttaataatgttgttccacctatagggttgcagatccattcagctccttgggtactttctctagctcctgcattgggggccctgtgatccatccaatagctgactgtgagcatccacttatgtgtttgctaggccccggcatagtctcacaagatcttaagtgagaataatgggtaagaaaccacccctagtcgggtgtggtggcacacacctttaatcccagcacttgggaagcagaggcaggcggatttctgagttcaaggccagcctggtctacaaagtgagttccaggagagccagggctatacagagaaaccctttctcaaaaaaccaaaaaaagaaaaagaaaaaaaaaaaagagagatggggccactaacatgaccttataaccaggaaaaccaatgctttactctctaaatcatttacaaaactattacgatagataaaaattttcccaacaataaaatttcatatggctacatgtgtgtcatcagaggtggattttggtatatggtaaagaaagccttaattaaaaataattaaagcattttaaatttatacattgaagagttataaaaaaaatcaggcagtagatgttaaataataattgaccatggagttggaaagttagctaggcagtcaggagcactgaccattaaagatttataacctgctcct

SEQ ID NO: 2831 - DNA, 1400 bp, mus musculus
tattgtatcacatataaagcacatgtttgtgcattttgaagcagaatacttttgtttccatttttatgacaaagatatatggctgtaaatagtgaagttttttcctaaaacaagtaactgaatttaattaaaaactattaagtcatgtgttactaattgtattaaagttaagattcttactatataatagatggaagatattattatcctattgttgacctcttttacacctactattcctaaaataaattctcagtaatattgaagaaccaaaaccagaagtgaaaaacacatttagtagtaaaaagagagttaacaatatttgaatattattgtcatcatttagaccagtggttcacagccttcctaactgtgactctttaatgcatttcctcatgttgtagtgacaaccaaccataaattctcttcttatttttaattaatcattccattcgtttacatatcaaatgatatcctaatttctagttacccttccacaaatccccatcccacatttgccctctctcctctcccctttgcctctaagggagtgttcccccacccacacatcctctcctgacccaccactccagtatctccctacactgggacatcagatctccacagaatccagggcctctcctcccattgatatcagacacctcggcccaccttggccagcaaggaagacacaacacagtaggattcttctcaacagcctttattgcaggaacacctcgatgctgctgctacagggatcccgggcaccaagggaggtctgcttatatgcaccccagcacagggaaaggcttcgtgtcctcctgggataggttgaaccgttgtcacctaactagcatgtacttgctcaggaggggttggcgccagactcaggcttacgcctgcacagtggtgttgtttatgacaatggcacactggaaaccggcgccatcttagagttggcttcctacatccttgtgctggagtttttcttctaattccttttgtagggctaaatttatggatagatgttgttaagatttgactttaatcatagaatatcttgttttcaccacctatggtgatggaaaattttgctggctgtagaagtttgggctagcttatgtggtctcttagaatctacagcacatatatccaagatctttagagtctctactgaaaagtaaggtgtaattttaataagtctacctttaaatgttacttgcttttttttcccttgcacctcttaaaattcttactttgttctgcatgtttagtgttttgattatgtttagcggcaaggggacattcttttctagtccagtgtatttggtattctgtatgctttttggaccttttatagatgtgtccttctttaaactaagagaatttttttctatgat

SEQ ID NO: 2832 - DNA, 1000 bp, mus musculus
aggttaacaagctgaagggcccaagtgaggatgcttcaatcccacttgggaggaagaagaaaacagtcatgtgagacaaagggaaagaggaaagaggaaggagggacataggtggtagaggacatgaggaggggaagtggtgaatatgatcaggtattgggagtgtggaacagaagagaagccatgaaagccagcagaatgaatagatatatgcaacctccggtggtgggggggtgggaggttggaggaccctctagaatgcagcagagacctgggaggttagagattttcaggactcaaagggagggaccttaaatgaaatatagaacagtgaggagaggcaaattttagcatccgtctccaatagaaagacaggacatcaagtggagggatgcagttgctaccccataaataatcaaaaactctgatccagaattgtttctgtctaaaaaaacaaaaaaaaaacaaaacaaaaaaaacaaacaaacaaacaaaaaaaaaccttcagggacaaaaatggagaagagattgacagaaaggaagtacagtgacagcccaacttatgctacatctcaaggggaggctccaggtctgacactattactgttgctatggtgtgcttacagacaggagcctagtatggttgtccttcaacaggcccaacaagcagctgactcagacagttgcagatacttacacctatctcctctggttgaattagggaaaggctagaagaatctgaggagggtgaccacataggaagaacagcagtctcaattaacccagacccctgagatttctcagacactaagtcaccaaggaggcatcataaactaaatgatatggggcccaatacatattcagcagagtactgccttgtctggtttcaatgagagaaaaagaacctaagcctgaagagatttgaggccccagggagtggggaggcctggcaggggttgggtgagggttgggcacatcctcttggagaaacagtggagga

SEQ ID NO: 2833 - DNA, 1000 bp, mus musculus
ccccatccgccatggctcttttctttcagttccaagatgcatcccaggctcaaacctagacatgagaaccgcaggctggccccaacaaattggcatcccatgcggtgcctaggaatggcagaggacatctggaaggaacactgctggtttggagctccatggaagaaaataattaaagaaaattcgtacgggaacacgagaagcaacaggcataaggttgccaggtgtggtacagtctaagctggaacagcgctgaacccacaccctggattcacttaggttcagcagtgagattatcagaatcttccagaagctgcttcctaggtgagagagacaaaagggtttggatttaataattaagcggattggccacagtcagaatctgcatcaggctggaggtaaatgtcccagaagcagagaaattttaggggcgcttggattcatactctctgggccctacagcagaagttctctgccctctttatgtttttgtctaaagtcttgtctaatgtctggtgcaccggtcagttcacgtgttcaattcatgtctgtttgtgcctagtctgaatgaatgaatgttctgtgttttcatgttggcgggggtggggggtggggtggggtggggtggggggtggggtggggtggggtggggatatccccccagtgccagggccgcgaatttactgcactgtcattggtggcagcgggtgctcctgcttagcatacaaacacctttctttgagggaggtgggggccaaaatttggctccggtggggccaaaaaagacaaggacaaatgggccccccaggtaccctgtgggtgtgggcctgagaccacagagctatgacgaggcaggtgggcacggccgaggtagcactcacctcaaagcacagtttcaaacatctattaaaactactgtggtgctaataaagtattttaagatatatttgtgtattttggaaaacttataacaaaaattgtgtcttaggaacctgacaaa

SEQ ID NO: 2834 - DNA, 1200 bp, mus musculus
cagtatagctaagataaaacaatgaacagcttctgatgtggtgaggatgtgcagcaaggggaaccctcctgtattgctggtaggagtgcatacttgtacaatcactttgaaaccaatttggcagtatttctaagaaattaactacatcatatacattcatgagtgaattcaattatatttttaagaaaaatgaacattaatgctataacatatctactcatatttaacagaatatattgagtagcattagtgtttatttttctttaaaacatttttttctaatgagtatatacacaaatgttaaaatatttgctaatttaatgaaaaatacttaaaaaactatatactgcaattgaaccaaatttattacagatatataagcatgtttaaatatatgcaaataaagcactataatgtaccccatgaatagactgctaaagaaataattaaccatctcaataaatacagaaaaggcctttgataaagttcaaaatactttcctgatgacactttttaaaaagttacttatatggagtggatccccaggtggggcagtcttttgacaaatacagaggtgggagcttgcagccagccttcggacagagtgaagggttctccaatggaggagttggaaaagggactgaaggaacttagggggtttgcagccccatggagggagacacattatcaacaggccagaacaatctggagctcctggggactggaccaccaaccaaagaatacacatggagtgatccatggtgctggccatattggacatcagtggaaggagaggcctttggacataagggtgttcaatgacccagtgtaggggaatgccagggcagaaagatggaagtgggtgggaggagcacccgcactgaggcagggagaggaaaaatgggataaggggtttccaaagggaagacttagaaaggggaaatatttgaaatgtaaataaagaaaatatccgatttaaaaaaaaagctatgaatagaaggatcatattgccaaataaagaatgatacacatcccattggtgttctgttcaggaatctttccccagtacccatatctttgaggctcttccccactttctcctttataagtttctctataagtgtctctggttttatgtggagttctttgatccacttaaacttgagcattgtacaaggagataagattggatcaattcgc

SEQ ID NO: 2835 - DNA, 1200 bp, mus musculus
tgtgttgtctatatatatttcctgaatttgtggtgttgtggatagccctggggctagttatatttgatgttaatttcgttctcctgtgagtgtttgtgaacaaggaatgaatcagcacttaggtgatttcctgtaaacctgctgcccaccttactttgtaaaataaaagagatctgatgattgggcagataaaaggtaaggtagagcagaaggtgggggagaagaaagagtaaatggaagagggagaggatgcagaggaggataaagaaggagaaaagcggagcagaagcacatggcctggagaagccgcaagttctaggggtctcataagcaatggaagatggtagtgtagtggtagatctgcccaatctaggcacacagcatgtaatcatattaactgtgttgtgttttcattgcaggggggcagcatatttgggaggagatttactgcaacatagtgggtctgtcagcactagacttaccaggggctacatttcattcatagaaaacaaacaaacaaacagacagacagacaaaaaaacaactctatcattatgagtacctatcaaattgccaatggcatgttggttagagaaaaacagtttttaatgtttattttaaaataatgtaaaaatgcaggtatgggagaaaatccagcagcagtaagggccaattctgccttatcccctccacactccattccccaggccatggctatgcttgtatcactgaagccctgttgacacacaagtaaaacaggcgagatacgcatgccccaatcctttgctcagtgggtctcctggcaatcccagtagccatgagatcttccctattacccctgtgctccatcttctacttactcgagctctgcagccatcaaggaacatcatcagctcttccagcctttctggaggactgctgcctctcagggcagcaaaaaagcccgaagccatcaggaactaacagctctgcctgaatccctggaagccttctgccaactatgacaaccagctctaccaagaattccagaggcctgctgccatcaaagcctatcaggtctgccaataccagggacaaccagaaggataaatgctatcgtaagattacaatcaacaaaagtcaggtcaatacaataccaccacaaccaaactttcccactataacaagtcaggaataccctaaaatactggacgcatgaga

SEQ ID NO: 2836 - DNA, 1400 bp, mus musculus
caggacatgaactaaatctggaatgacaagaatggaaagaaaataaaaggcaaacagaaatgaaaataaacatctaaaccaacaaacaaattctggacttaggcataagtaatattataattcatgtgaagcattgaatcagagttgatagtttcaacctgaatatccctaaaaaacaattacagtcttaagcaagtttaaacgtatcaaatggaagtactaggaaccactataatatgaaattattaagcatcatatatactcatatatatgtatgtatttctcgtgttctgcatacgctatactatttaaatagaaactttttaatggctgggccgacatttatttatttatttatttatttaattatttattcattcatttatttatttatgtttaagatagtgcctcagtgtgtagctttggctgtactggaacttattctgcagtccaggctgtcgttgaactcaagagatttgcctgcctctacctctggagtggtggacaaaaagcctgtgccacctcaccaggttttgactgactttttagtccagggtttccagaaccacctgaaggatgagagggactacttctcagagaaaaatgataaagtgttcttcactacacagtgttccactcagtcaggagaacaaaatatataggaaggttttgttttgttttgttttgttttgttttgttttgttttgtttttgtgaaactctgactcctgctctctatctctctctatctgccgcagcattgaagctaatggcactgaggctgtgaactggctttagcacgggaaagactccaagtgcagagtctatgcaacatcccctccatatagtctttattcatgaggatgctcctctgtgaaaaggagggaacaactcggggcttcagtgagtgtgtgctccagaccttattcctggctgctctgtgtgtatgctgaggacagcagcacctaccttggcactcactgtgaccaggagctggagaactcatcctccaaatcaacttaaatagaatttaatgttattatgtcctatggattttgttatgtcatcacattgtctagtgttttatttctgaaaatggaaactctgtaagtagagatgttcatgtaaacacgtttgcttttatgttatgtctggcttctctggaacatggtactctgttcattttattagatattctaactctcataactgtcctatcacattgttatttctcttctacactataatagaaacaggaatgtccaatttgattgctgtgagctctttgtgtcccatcatagatatgaaagcagacccacatattttgtagatgataatattacatctaattaaacattaagcttatcacttgcttttctgataaatttactaaatttcact

SEQ ID NO: 2837 - DNA, 1000 bp, mus musculus
aattcagcgtaggtgaagacaagactttcttagaaataggtaagacaggctttttaaatggctcagcagataagagcactacctgcccttccagaggacctgtgttcaattcccagaaaccacatggcagctcactcctgtctgtaattttaatttcaacagatccaatatccccccccccccacacacacacacaaaatgcaggaaaaacataaatgcacatgtgtgggaactaaaaagggagcccaggggaagagggggaagggaaaggcccacaccctgccagagttttacctatcatctggtcagtcaggcatgggagggctgctaactaccttccactcttccctgggtgggcattcctctatcccactcttcagagagaggccaggagcagccctacgtgaggaccacggagcttctttgctaaagtcaaagggtcataggagagagggatgggggaaaaggttcccaacacctacctgcaagagtgcacacagccttgatgagcagataatctctatggtttaagagctttattatagaaaggcagggtgaaagagagaaagaagagggagagggagagggagagagagagagagagagagagagagagagagagagagagagaggagagagaggagagagaggagaggagaagacaaagagaggggagagaaggtaagagagtgaggggtaagagggaaaaaagtaagaaagtaagcagtaaaagagccctttatatggtcttcactgttgctaggtaactgaggaggactttagccggaaggtcagaagcttgggccattgcctacatgactactgaccatgcttctcttgtgggggctgtgggaggtgataccttaggcaggggccagagttccaggagcatgagggaacgcccaccgtgtcatgaaggtgagttatgaccattagggttcagacctcagcttgactggagaccagcctgcaattccccacacacatgaagtaaaaataa

SEQ ID NO: 2838 - DNA, 1200 bp, mus musculus
tttttatagtaaatttctttttttcaattttttattagatattttcttcctttacatttcaaatgctatcccgaaagttccctataccctcccccaaccctgcttccctatccaccctctcccacttcttggccctgtgttcccctgtactggggcatataatcttcacaagaccaagggcctctcctcccattgatggcctactaggccatcttcttctatacatgcagacacgagctctgggggtactggttagttcatgttgttgttccacctatagggttgcagaccccttcatctccttgggtaatttctctagcgcctccattggggaccctgtgttccatccattagatgactgtgagcatccacttctgtatttgccaggcactggcatagcctcacaagagacagctatttcagggtcctttcagcaaaatcttgctggcatatgcaatagtgtctgcatttggtggctgactatgggatggatccccagatgggatagtctctggatggtccatcatttcgtctcagctctaaactttgtctctgtaactcattccacgagtattttgttccccattctaataaagagacttttttaaatgacgtttttatatagtcccattttctctactagccaaaaaaaataattgggctccttttggaaagggattgaaacaaacaaaaataactgaaatagagaaaggatcatctatttggactcatttgttcagccagaataatcactcttgaagtaggctatacatgtgtgatgttagctcggttgtaaactgagtgcactatagaattatgtgggaaatgggcctatgggcatgccgtgggatatctcgattatgttaacagtggtggaaagacctgctctctgtgggtggtaccattccctaggctaggatcttgggctatacagacaaagcaagctacattaagcgttcctcactctctgcttcctgattgtgcgtgtgatgtgactgtctgtttcaagctcttgctgccttagcttccttgctgtgatgggctataccctagaactctgagccaaaggaaataatttcttttttattattattttatttatttatttttattacatattttcctcaattacatttccaatgctatcccaaaagtcccccataccctccccccacttccctactcactcattcccatttt

SEQ ID NO: 2839 - DNA, 1000 bp, mus musculus
tccccaacaagggatccatcccataaacaagcaccatacccagacactattgcagatgccaagaagagcttgctgacaggagactgatattgctgtctcctgagaggctctgcacatacagaagtggaggctcacagtcatctattggatggagcccaggtttcccaatgaagtagctagagaaatccccaaggaacagaaggggtttgcagccccctaggaggaacaaaagtatgaactaaccagtaacccccaagctccctgggactaaaccaccaaccaaagaaaacacatggtggaactcatggctctagttgcatatgtagctgaggatggcctagtaggtcatcaatgggaagagaggcccttggtcctgtgaaagttctatgccccattataggcgaattctagggccaggaagcaggagtgggtaagttggggtgtaggggcagggaggagaggataggagattttcagaggggaacctaaaaaggggataacatttgaaatataaataagggaaatatctaataaaaattaattaattaattaattaattaattaattaaaaataaattagaatggatccagatcaaggaaagtttttcttttcttgcatgcttttagtttgtttttttttaattttttattaggtatttagctcatttacatttccaatgctataacaaaagtcccccatacccacccacccccactcccctacccacccactacccctttttggccctggcgttcccctgtactggggcatataaagtttgcgtgtccaatgggcctctctttccagtgatggccaactaggccatcttttgatacatatgcagctagagtcaagagctccggggtactggttagttcataatgttgttccacctatagggttgcagatccctttagctccttgggtactttctctagctcctccattgggagtcctgtgatccatccattagctgactgtgagcatccacttctgtgt

SEQ ID NO: 2840 - DNA, 1000 bp, mus musculus
tatcaaaacaaataccaaaaagtcagaagatggcctagtcagccatcagtggaaagcgaggcccattagtcgtgcaaacttatgcctcagtacaggggaatgccagggccaagaagtgagagtgggagggtgggggagtgggtggggaagcgtgtgggggacttttgggatagcattggaaagtaaatgaaataaatacctaatttaaaaaaaagaaaatgaaaagcgatatattttatgaccttcctttaggtaacagtgtgttctctcgttttttttttaattcattttatatcctgaatgctgcacatgttcccagtcatcacctcccacaattcctacccacagctcccttcccctggtatttcccctatcctggcacatcgtctcttcagagctagccacatcctctccctctgaagccagacaaggcagcctagctagaagaacatatcacacagataggcagccactttgggatagctcgtgctccagttgtttggggaccatataaaggtcaagctgcacttctggcacatgtgttcaagggaggtccagcacctctttagttggttgttcagtatttgagagtcccaagtgtccaggcgtgttgactttttggtcttcctgtggagattcgataggcttctaggctcccattccttcctgcaactcttccatcagagtccgcaagctccatccactgtttagttgtggatatctgtatttctctgagtcagctgatggatgtaacctctcagggaacagacatgctagactcctgtctgcaagcataacaaagtatctttaataatgtcagggactgatgatctcccatgggatgggtttctagttggggcagttattgcttggttattcctttagtctctgccccatcccctgttgctgcattttttgtagacaggataagttttgggtcaaaggttttgtggatgagttgttgtccctgtcaatcaactatgatttcagcctgtttaca

SEQ ID NO: 2841 - DNA, 1000 bp, mus musculus
caaaatgatcatgggagctagagtgagggaggagcctgggagagagagaggaggacgagggaaaaagttgggcaggatcaggtgtgggaggaaacagctggggaaaagtacagagggtcaggaaattgaatggaggtatgtagcagtgggagatggggaactgggggtagccactagaaagtcccagatgccaggaaagtaagaggctccgaggacccaactgtgatgacattagccaaaatacccaacaaaggggagatagaatctgtagagaccatatctagtagataggcatggcctctggttgagggatgggggaacatacccatctcaaatattttaaccagagctgttcttgtctaaaggaaatgcagggacaaagagtggaacagaggctgaaggaaaaaccatccagagacctcctgacccggagatccatcccatccacagacaccaaacccagacactactgctgaaaccaataagagcttgttgacaggagcctggtgtagctgtcccctgagaggctctaccaatgcttgaccaatacatatgtggatgctcacagccaaccgtcaatatgagcatgggcaccctaatggaggagttaggggaaggaatgtaggaactaaaggggattgcaatcccataggaaaaacaatatcaactaaccggaccccacagagctcccagggactaaaccaccaactaaagagttcacatggagggactcatggctccagctgcatatgtatcaaaggactgccttatctggcatcaatggcagatgagacccttagtcctttggaggcttgatactccaaggtaaggggatgctagcaggagtgggagagtgagtaggatggggggggtgggtggagggaaaccaggaagggggataacatttgaaatgtaaataaataaaataaccaatttttaaaaagatatatacagagacaaaggtacctgtacttggaattgtaaaaatgacaataggaaa

SEQ ID NO: 2842 - DNA, 1400 bp, mus musculus
gaaaagaaaaaaataagtaagccccatcaaagtaataataaaagaacatttatccagggaagttaactatctagaaagggaaaacatttgaaagaattaaagacaacatgagcaaatggaaagaacaatactttacacctgttgatcaatgcatttactattattaaaatgtccatactgttcaaagtgttctgtagatttaacaaaattactccagtatatgaattaatgacttttttgttgtaagggtaaagatgcaaaatgcacatggaaccttctcatacccaaatcatccaaagatccttaaagaaaaatagagaaggaaaaaaaaggaaattggaaatgtcacactgtttccagatagtatgacaaatatctagtctaacaatcagaactatagttccttcgggtagggaacaggaatacaggtcaatggaacttaggagagatccaatagagaatgttatgcctatagggcaactcctttctgaaaagagcacaaataatacagagtaaaaaatgtctctccagttgacccagtcccttgccagatgcagcactctgaagattaggacttgaacagtagagttgtccctgctggtgtgggtgttggtgagccagccctgaggggctgaaagcaggagagctggctctgccacttctggctgcattactgggtaagctagactggagcagtgttggagaacttcccctagtgtgagtataggagagctggtgggctggcctgcttagtgaccacacaggcccaaattcagggctttgagttggttcaccctaacatcttccccatctatgaactgctgcagatgatgaaggggtgtataaattcaaaggtgcagaatctccatgacatagcccaacaataggatatttgagaagcatcctagtaaggatccagtattgatagtgtagcaagagccaaaaaccttgaacttgaccaatgactcattgcagtgaatatttgcaagaaaagaagtatggccagaagaatatattttgggatacactgtcacacattatagcttccacaacaagattttttttcttttagggagtagattagggcagaggacaggtataaagggacagggaaattagtgtgatagaggcgcttgaaatgaaattcacaaagaagcaataaaaaataaattaaaaagaactgtctatccaataaatgatgttgtgaaaaatgcatattcacaaggaaaataattacattgaattttattcttacagacacataaaattaactaatgaattaaatatttaaatgtaagagctaaatgataaacctaatcaaagcccatgtagacaatatttgaagagtccacaaggaaccaaaccagtgatctctgaatgggaagcaagcaaatacttta

SEQ ID NO: 2843 - DNA, 1200 bp, mus musculus
gcaactttatacttgtatcttctttctacttagattatttcatgtgaccattctcaccaattttcttctatcatgaatttctctccattattttagtgtttgcctataaaagattttttatgactttttagttcactttgcatcctgatcgctgtctccacttcagccctacccccaccaccgtccctctccaaatcatccttccccttctcctctgaaacagtggagatccccctggtattcctctcaccatggcacatcaagtttcttcagggctaggcacttctcccactgaaaccaaacaagacagtcaagttaggggaacagattccacagataggcaacagctttagggatagtccctgctccagttgttagggacccacatggattaagctgcacatctgctacatatgtacacatgaccagcacatgtatgctctttgattggtggtttagtctctgagagccccaagggttcaggttagttgactctgttgatcctatacccttcagggcactcaatccttctctgaactcttccaagagaccacaaggaccatccaatgtttagctgtgggtctcttcatctgtctgagtcagctgcagtgtagagcctctcagaggacagagtagctattctagattcctgtctgcaaccataacagagtctcattaatagtgtcaggaattggtgtttgtccatgggatgggtctcaagttgggccagttattgcttggcctttccctcagtctctgctccatctctcctccctgcatttctggtaggcaggataaattttgggttgaaagtcttgtgggtgggttggtgtctctatagctccacttggatttctgcctggctacaggaggtggccacttcaagttccatatccccaatgctgtgagtttcagctaaggttgcccccattaattcttggtagcttcccctactccaggtctctgacacatacttgaggtgcctccaataccccaccccatgccaacttcagattccattcattctcatggccatttggggattctcccctgtctcttcccacaccggatcctaaaacccctccatttctctccccatctcctccccacccagttccctccctccatctgcctcctatgactatttcattccatattctacatgaaattcaagcatcctcatttgtgtctttcttcttg

SEQ ID NO: 2844 - DNA, 1200 bp, mus musculus
acctactagataatttgctcttaatttgagcttatttcagtatgtagtcaaggcaggtatttttttttattattattatcttgtcttcacattctaagtgttaggataataggaatgcttccgtagacccattacatagatattttgtttctatttcatgtagaggagtacaaaatgttcatgttaatgaacccctaaagatttcaatggattgtaaaaattattttatgtatttacatcccaaatgttgccctctccttgtcccccctcccagctttattcactcttttccccctaccctttgcctctgagaaggtgctccttctcccagggcatccccctatcctgtggtatcaagtctctccaggattaggcacatcctttccccactgaggccagacaaggcagtcctctgctacatgtgtactagagccatatgtactctgcaacatacatactcagaccagaccagtatgccttttggttggagacttagtctctgggagctcccagggctccagattagttgacaatgttggtctccctgtggagttgccatcaccttcagatccttcaatccttcctctagctcttccataggcatcccagacctcagttcaatgcttgtctgtaagcatctgcatttgtctcagtcagctgctggcagagcctctcagaggagagacatattaagttcgtgtctgcaaacaaaacatagcatcagtaatagtgttagagtttggtgcccacccatgggatggatcccaagttgggatagtcacagggtggccattccttcaggctctgctccatttttgtctctgcatttttaaaagacatgaagaattctgagttaaaaattttaaaggtggattgttgttcacatccctccactgagggctcagtctaactactggaggtggtttctctaggttccaaatccctactgatgggtatttggctaaggtcacccacactgagtcctgggaacttctcacatctcaggtgtctgggactttctagaggttctttccatacccatcacccacagctgcatatttccattcattcttctggccctttgggcttctctgtctcccctatacctgaccctgtcctcattttgccctccccattccctctaccacccagatacctttctcttttccccgctccctccttccctccctccctcccacc

SEQ ID NO: 2845 - DNA, 1000 bp, mus musculus
tgaaaaaaaaatcaagaaatactaaccaggcatgatggcacatatgtacatatggaagttatgagatatacatagcagaaacaggagttcaaggtcagctaatctctcaattttgtttgtttgtttgtttttgtgtgtttgtttgttttttgagacagggtttctctgtgtagccctggctgtcctggaactcactttgtagatcaggctgtcttcaaattcagaaatctgcctgcctctgcatcccaagtgctgggattaaaggcgtgcaccaccaccgcccagctcaaaatttttcattagatatttactttatttacatttcaaatattgtctcctttcttggtttcccctctgaaaacttcctatcccatcccccctccccctgctcaccaacccacccacatcctcttcttggctctgtcatttctttacactgaggcatagaaccataagaccaaaggcctctcctcccattgatggctgactaagccatcatctgctacatatgcacctagagccatgagtcccaacatgtgtactctttgtttggtggtttagtccaaaaattaaaaagaaaaaatattggaactcttttaagtcttaattttaactgaatgaatgttaaagtctatggttttgcacatttagcatatcacaaatcactgagacttgcaagagacaatataaaaattctagtagaataatttgtgtgcatgtggaagagttcacgggggcatgaatgcaagtgtggttaaatgtgcattgtgtagcacaggtcaaattttatatgagaagacttcaggtattattcttcaggtcccagccatcaataattagtggtggtgaggaagactgggtttctacttaccctggagcaatgacatatgatacacacacacacacacacacacacacacacacacacacttttgaaccattaagacagttaagctcattgtgggtaatttgtataaggtagaaataataactttatcca

SEQ ID NO: 2846 - DNA, 1000 bp, mus musculus
tctattggtcaaaatagtaaaacattcttttttatatttggaaattaatagagggtgattataaagatttttaccactgggcgtggtggcacacacctttaaatctagcattcaggaggcagaggcaggcggatttctgagttcaagaccagcctagtctacaaagtgagttccaggacagccagggctacacagaaaaaccctgtcttgaaaaacaaacaaacaaaaagtttcttaccatagaaataaatgataagtataaaatgtaatgtctatgctatgtcttgattgaataattctgctagtttcacagacttcaggataccatgtagtgtgcaataaatttatactttttaatttgcttgttatggtaaataaaactcagcatggttctatagatcaccaaatatagatttttgatgccaagcctgataacctgaattcagtccccacggcaaacaagttgataaaaagaaaagacttccatatatatatatatatatgcaggtgatttccacacacatgcaatagcactcatgtgcacatatgtacaagaacacacataaagaaataaatgtaaaaatatagtttttaaagtttttattaacaacttataaacaattagtgatatatgcatcaagattgactacctctgaatacttattttaacaagaacaataaaaaagagcatctgtagccttcttaaaagtgtttcagattgattctaacactgtttattcataccatgataaataatgtgaactggttgatttttgtacctctcaaatttatctctccataattttatcccattatatttttgcatacttcttgaaaaaaatctaggttagtcaatataagaaaaatgctacagagtttagaacattccctaaataactatttttagggaatatttttagggaaaaactattttttaacaagttctgtagatgtttaactctggatgcattataaaacatgtgtttaagagtaccacttt

SEQ ID NO: 2847 - DNA, 1000 bp, mus musculus
tcctggccctggcattcccctgtactggggcatgggatcttcgcaatagcaagggcctctcctcccattgatggcctactaggccatcctctgctacatatgcaactagagacacagctctgggggtactggttagtttatattgttgttcctcctatagggttgcagacccctttagctcattgggtactttctctagctccttcattgggggccttgtgttccatccaatagatgactgtgagcatccacttctgtattttccagacacttacatagcctcataagagatatttcacattgtttctagaactaaaaactgacctgctttgtcattgcagtaagatggtacttcttagttaaaatgagaaataggagcccactgtgtatatttgattggtgaatagaagccagtaaaattaggacacactgagatagaattcatcaaaagactctcactacaggaagtaaatgagtactagcctaatctatgttctcaccttttagacatctgtaaaatttgtgctacctgaatataactaaggaggtctagactattatctttttttctttagttttcccaagcctatgttcatacttgttaagcttcacatatttgagagaaaatgttcaatataagaagatttggatttggtcatagtggaactcacatgtaaccttagctttcaggaggcaagagcaggagactaaattgaaaatcagcctgatttacacagcaattctccatcccaacacacacacacacacacacacacacacacacacacacacacatacactcacacacatgcacacacacaccgtcataatcgtcatcatcattttcctcaccatcattagcactaccaccaccaccatcaccaccacatttatcaatatcacaacgatagatcaaacaattgttgatatttctttataaaaataacaatgaatttttattgaaagtttcctgtcatactggttttcagctagattttaa

SEQ ID NO: 2848 - DNA, 1000 bp, mus musculus
atgaaggtattcaatgttttaaaatatataactcttgttttgttcatttctctctttttttattcactttacaacctgatcacagcttccctcaagcctatcttaccagtcccacctttacaaatctctctttccagtaactcctctccttctcctcattaaagatgatccccctttgatattactacaccctggggcatattagtcacagcatgactaggcacaccttcttccactgaagcctaagcaggtagtccagttcttgggaagggggaccaatagtagcaaacagagaccaagatagacccactccaattattaggggacccacatgaggactgaggttgacattttctacaaatgggtagggggtcttatgcccagctcctgcatgttctctggtttgtggaccaggctctgcaaacccccatgatcacaggttagttgactctcttggtcctcttgacttgcttatttctattccctacttttccacaagactccatgagctccatctgatgtttggttgtggatatctgcatctgccttcatccactgctgcatgaagcctcatgagagacaattttattaatttcctgtctgcatgcacaatagaagtatcattaatagtgtcaagggttggctctctcacataagatgggtctcaatttggggcagtcattggttggctattacctcactctctgctccaaatttatccctgcacatccaattgatttaaatcagtaggacaaggaattctgttacatttaaaacaatctatttaaatgggcaatattgcagttctataatcctaaatatttggaaggctgaggcaggactgtcataagatcaaggcctgactgggaaaaagcaagattccagccagcttgtgcaatttaatgaaacctctctcaaaataagattgtaaatggaatttgaatatacctgggtggtaaagtattgtcctagctaatatgcatgattccctagattggat

SEQ ID NO: 2849 - DNA, 1000 bp, mus musculus
tgtatgtcagaaagtatctgccaccccaaatcctttaatgtatttgtctaccaacatttattttcctgtcagatgcactcttggaaaaatttcttgatatggggactttctatgctggttcacatccattataattggtttcttgagtttacccgtggttatgttagatcatttctttctttttgctatgtgcatcttaggatacatttttggtataatgaacagggcagagtttaagtttgtgttttgaagtacatcagtacttaggacaaaattgatgttaatgtatttgaattgactatgccctctgtaatcttaaccccaagtgctcttaatagtatcccacaaacactatctaaattcctaccattatacattccccgtgagcatgcttttgtggtttgcatgttctcttcttttctattgactatcctcagttgaaggttttgccacttgcttccatttccatctagttggccgttttccttggtgatccctttaaatgttattatcacttaggacttaattgccattgtctgtatccttttatgactatcagattgtctacttggtcagtgttcagagtatactaatcatcaaatatctttagatttgtattatgatcacaatacacaatagaaaacttactgtgttaaattgtttaaatatcagcaatgtatcatagaatctaataaacaaaatctaggccagtgaccattgctgtgttagatgtctatattcagtttcagtcaaaattttctagctaacccaccattacatagatgtctgaaactgtcttttttaaactttacaatatcaaccaaccagaccccacagagctcccaggaattaaacaccaaccaaagagtgcacatgataggacccatgcctccagctgcaaataaagcagaggatgaccttgtagaacatcaatgagaggagaggcccttggtcctgggaaggtgggatgccccattgtagaggaatgaatgctagggtg

SEQ ID NO: 2850 - DNA, 1000 bp, mus musculus
tagaaactacagggttgcccccactaactattactctttttttattagatatttttgtatacatttcaaatgctatccggaaagtttcctatactctcctcccgccctgctcccctacccacccactcccgcttcttggccctggcattcccctgtactggggcatagaaagtttgcaataccaaggggcctctcttcccagtgatggtcgactaggccatcttctgctacatatgcagctagagacacgagctctagggttactggttggttcatactgtttatgtttgcctttgaattgttgcatgtgacaacagtaacttatgccagtaacttatgtagataggacattattactccaagttaaaatagccaaaatgatacatctcagggttgtgacaataccctaaaactatatacaaccaattcttttcctctattctcagccactttcagaatgtggctttctgtccagtgtcctaaagacagatattctgctcgaagatagcatggctgtgctttaaaatggaagagggagataatgggccaactaagaatgtcttcaaaattagctttgctctttgactaaggaaagcaaaagcttctggaagcctcacacagaagtctacctactccacactgtccataactgccagaaatcctaggaggattgcatatcttattagcgtctctttctaaaatcataactcaaaatgagaaaatcaatgacctactcttaaaacctagctgttctgtgtgttattctttttgtttttgttttgcttaatgaataaataatggatattgggtagccaactgccaataccttcccagattatttgaaataatggatatttcttttccttttgacttcatattaatttagctaaatgttctgattcagtctgtcatcttcattttctcattacaaaaaatacatgcaagtataagtgtaaaggtatcatactgctattaatgtgtaaggttatatattggttat

SEQ ID NO: 2851 - DNA, 1200 bp, mus musculus
tatatgtttgagaaatttaagtattagtactccagttacaataagctgagcataaccctttgcttctcctctttatatttttatccaataagtatttttatatctaattagagaatcatcacttccatgtgttgtagaattacatagtagtgaacccttgtaatagcattaggtttgtgacctagtaaatttaagctttgtaattccatgtactttttaaatataaacttcatgattctttgtttttcttttctttcttttacattagatattttatttatttacatttcaaatgttgtcccctttcttggtttcccctctgcaaaccccctattccatccccccttaccctgcttctatgagggtgctcccgcacctacctaaccactcctgcctcactaccctaacattcctcttcaatggggtatcaagccttcacaggactaagggcctgccctcctattgatgccagataaggcctcttcagttccttcattccttcccctaactccttcattggggtctttgtgctcagtctgatggttggctgtgagcatctgcatctttattggtcaggatctggcatagcctctcaggaaataattgtatcatactcctgtcagcaaacacttcttggtatctgaaatagtgtctaagtttggtgtctgcatgtgggatggatccccaggtggggcagtctctggatgtcctttccttctggatgtctctgctccactcttggtccctgtatttcctttagacagtagtaattctgagataaaattttggagataagtgggtggctccatccttcaactgtgaggccatgcctaacttctggatatggtctcaacaggttgtccctcccctttgtgggtatttcagctaatgttatccctgtagggtcctgggaggctcttgctttcctggcatctagtactttctgattgctatccccagattcccatcccccattgctacatacctctgttcaatttcttgaccctctgtacatctcctctatctcctcccataactgattttaatatgttatgtatgctagaatagatgtggtagttaaggaaatgtaaagaatttcatacccaagtaaaccaatgattcacaatgcataaggcagagagagaggggtgtgctaacaaaaggagattccagattcataaaattgttacatgtatgtta

SEQ ID NO: 2852 - DNA, 1000 bp, mus musculus
taagattccattccttggagtacttaatcaaattcggatagagaaaacagattcacagatatctagggctttgatgaaggaatataagtacagaatcatatactgtttatgttagagttgattaaaaccttgtggaaatggatgatagggatgtttcacttgatggtgtgcctaatgctactgaattgtacagtttatgatttaaatgataaatttcatgtaggatactgctatgtggatgtgctggcacatgtctgcattcacaacaatccagaggctggagcaagagaattgtgagttcaaaatcagctctgagttacatagcaggacaatgtctttaagaaaaaaaagaaagaaacttgggctcaagctcagctgacagtcccactgtccccagaggactctcctagtcacaggtgcccaaccctgcccaggatcttaggattactgaggagagtcaggctccagagagggctctgaccatgggactcaggtgagagcaccatcttgtatcccaggtctttcagagaccagtccacacaggaaagcacttggggcacagaagcaacagagatttttggacagggtcctttcgggcttttactgtcaggcaagaggttgacctgagcttcagacatctgtgcaccttccctgcaagaggagagcttgcctgcacagagtgacctgaccactgggacccaggagagagttggactcccaggagtgctgacagaggctaacagaatcacaagaagaacatgctcaagccagagcaagctagaacgtctaacaccagagattaccagatgacaaaaggcaaatgaaagactcttaataacagaaaccaagaccattcagcatcatcagaacccagtacgcccaccacagcaagttctggatgcccaaacacacccgaaaagcaagattcagatttaaaatcatatctcatgatgctagtagaggatttaagaagggcattaacaactcacttaaagaaata

SEQ ID NO: 2853 - DNA, 1000 bp, mus musculus
taagtattgatatataaagactggggacaaaagaataaactaattcattaagattatatcaataatccttctgcccagtgcttgctgttggggcagacccatagttggtctgctcctgtgaagactccatatccaatccatcctagaggacctgctgcatgcagagcagttggtaagaatcccccaccctccaccctgagtcctggagctgctgctgcgaacctggtggacttgggacccatcttcccccaaaaccccgccctcttgaataccactccccttccttccattcctcccaaccctttcacctggttcttgctgccgggacagacacaaagttggtctcctcccatgaagactccatatcccaacccatcctagagaacctgctgcactcagagagcagttgacctctacgtggtctgcttccatgaagactccatattctaatacatcctagaggatctgctgcactcagagcagttggacatactgcactcagagcagtcgagaagttgagggccctctgcactcagaacagagcagttgaggatcagctgcactcagcacaattggacaacagcttgaacactccacagaagacccaactctgaaggcctcccatgagccctactgtagccagtgcaacagatcagcagcttctctgcccctgtgaagagcccccagttagaaggacccacaggtggtctgacacagccaaggcctcaagcctaacaggagacctgaagcaacccagggacaaaagaggcagactccatacagtcacccagaccaacaaacaccacggatatccagatggcaaaaggcaagcacaagaccataagcaacagaaggccaaaatacgtgggcatcatgagaacccagttctcccaccacagcaagccctgaatagacaaaaactcctgaaaatcaggaatctgccctaaaatcctatctcatgatagataatagagtcctttaggagcataacaatacctca

SEQ ID NO: 2854 - DNA, 1200 bp, mus musculus
agccccattactaaatagcatcacattggacactgtggcttcaatgcatgcaattacacttactaaattactccctttgaaatctgtaacattatatactgctagtggacaattctgggctttgttaacaataatagtaaggcaaatgcaacaaatctgactacaattttctttctttttttttttaattcttagtggtactaatgagccagttcagatataggaggagatagaggagaagtacagagggacaggaatttaaaagtaggtgtgtagcagtggatggggaacaggggccggtagtgactagaaatcccagatgccagggacccaagaccttcccagcacccagcagggaagactttagccgaaatacccaagggaagatagaacctgtatagaccatatccagtggataggcatggcccccaattgaaggatagggccacccacccatctcaaaaatattaatccagaattcttccggtcaaaaggaaatgcagtgacaaagagtggagcagaaactgaaggaaagaccatccagagactgtcccacctagggatccatctcatctgctgacaccaaacccagacactattgctgatgccaagaattgcttactgacaagagcccagtatagctgccccttgggcagttctgccagagccggaccaatacagatgtggatgtatacagtcaaacattggactgagcatggggaccccaaaggggaagttagggcaaggactgaaggagctgaaggggtttacaatctcataggaagaacaacaatatcaatcaaccagacccccaaaactctcagggactaaaccaccatccaaagagtacacagggggtatccatgaccccaactggatatgtagtgaaggaatgccttatctgcatcactgggcagggagccccttggtcctgtggaggcttgatgacccaggataggggaatgctaggcctctgaggcaggagtgggtgggcaggttggggagcaccctcacggaggcaggggaatggagaaggggatagggagattgtggaggggaaactggaaagggaaataacattcgatatgtaaataaatacaataaccaataaaaaaaacccaaatccttgtgtacagtaagcaccaagaccaagagcatggctttctaaaaactaaatatgcccttattgttaaaatacgt

SEQ ID NO: 2855 - DNA, 1400 bp, mus musculus
ggagatacttggaagatgatatagatatagatatagatcccacttttctctcaaattttccctgaaattagcattcattagtgatacatcaatcaatcctatgatggacgaaagtgttcccagctctaacattagcctgtatgtttaccatttggattctcctgtgagtatatgtgtgtgtatttagcttttcatcatctgtgtgaatttcaggtgcttcatttctataggcctataattcatttgtgtccctcctcccatctttcccttctaatcagagagactagagccccattccctggcatccccccactctggcacatcaagtctctgcaagtctaggcagttcttctccaactgaagccaaacaagacagccagagttagtggaatggattcacagacaggcaacggcttttgagatagctccccattctagttgttcaggacctacatgaagaccaagctacacatctgctacatacatgcatgggaggcctaggtccagcccgtgtatgctctttggttggtgtttcagtctcagccccaagggtccaggctagttgactcttggctttcctagggagatcctttccccttcagagccctcagtctatcccctaactcttccataagagtacccaagctccatccactgtttggttgtgagtctttgtataagcctgagtgagctcctctgtggagcctctcacaggacagccatgctagatttatgtctgcaagcataacagagtattgttaatagtgtcagggattggtgcttgaccatgagatgggtctctagttggaccattccctcagtctctgctccatctcccctctttccatttcttgtaggctgaataaattttggatcgaaagttgtgggtaggttggtgtctctgtagctccactggggttcctgcatggctacaagaggtggcctctttaggttccatatctccacttggtctcagctaatgtcaccctcattgattcttaggagccttccatatcccaggattctttgcatgtccttgagacgcttcccaccccccaccccctccaggctgtagatttccattcattctcatggccatctggccatctcccctgtctctccccacatctgatcctgaaacctccccatcccctctcccacccacttttctccctccatctgcctcctatgactattttgttcccccttctcagtgagattcaaactattttgtcctaatggcaatgtcctttgcctggtcctcggtgttctgttcaggaatttgtctcctgtattaaagaattcaaagctattctcactttctgttctattagatttagtgtatcggattttattttgaggtctttagtccacttggacttgagttttgcgcagggtga

SEQ ID NO: 2856 - DNA, 1000 bp, mus musculus
ctactggaatgacattcattggaattgtgcatcttataatgaaccggtggctggggaccaaggcaaagagacaagttctgttgctgctctttcatattcctctgtggatgaaacacaagttcaaagtctttatgtgagctgcaaatcctctgggaagtttatttcatcagtgcatgcaagggcgagtcagcacagcagaagccagagcagaacagtgctgcaggcaaacagcaaccctgtatttgaaagtccaactttagctgcagttggtatatgcagagatgtgatcagggagacctacttggttccaccttcttgtaaaagtatttgcaaaaattacaacgacttacatattgcagggggacaggtgatggccattaactcagtaatggcaaatttcccctctgagagcagctttgaagatggtcctttgctaaagtcatctgagatttctttgtccatggaggattccacttccactcagctcactgaacttcccctcaaacctatccagcggtactcatcctactggaggataaccagcatcaaagagaaaagcagcctgcaaatgcagaagcctatttcaaatgcagtgctcaatgagtacctggagcagaaggtggtggaattgtataagcaatatattatggacactgtgtttcatgacagttctcctacccagattctggcatcagaattcatcatgacgaatgtagatcaaattagtcttcaagtgtctaaagagaagaacctggacacttcaaaagtcaaggacatagttattagccacctgttgcagttggtatcatctgagatcagcacccctagtcttcatatttctcagtatagcaatataactccatagagaaggctcctgtcaattccccttattcctatgaatcccaaggcactattgtattaatttgatcagaggatgtgatggagggaattctggaagggaattaacaactagtaaaggacactttgagaaatcacatat

SEQ ID NO: 2857 - DNA, 2000 bp, mus musculus
ctaaggtatcaaaccagtgtagaagcccatccacagatagatggataaaaatcatagttcttaaaaagaaaggagtagccagtcctaaagcaattgaaatcatgtagttttaaagaaaatgcattcttctgtaaatgattaatgaggcgacatagattcagaaactcaaatatcacacttgccaatatatctgagattatactttgtgtgtatgtgtgtgtgtgtgtgtgtgtgtgtgtgtgtgtgtgtgtgtgtgtgtgtgtgtgtgtctgtgtatgggtatggaaataggtcaggaaactgaaaaggggaacaggtgagaggaaaatgaggtcttaaatgagaggaaagaagaagctaatagaatggaacagacaggagggcttggtggtagggctaaaataggagaggaggagcaaccaaagcactctgtggaagataatggaacctattatctagagtgcttaaaaaatttttttgtggttgtttttgatttttcaattttatttagtctttttttttaacaatacagatattatccccttcccagtcctccctctgactgttccaatacttccatccaatacctcatccccacctcatcttcacgaggatgtctccaccccaccccccaccctaccaggcctctccacttcctggggcctccagtctcttgagagttaggtgcatcttctctgactaaacctatacccagaagtcctctgttgtgtatgtgttgggggcctcatatcagctggtgtatgctgtctgtttggtggtccagtgtttgagagatctagggggtccaggttaattgagactgctggtcctcctacagggtcgcccttctcctcagcttcatccagccttccctaatccaaccacaggggtcagctgcttctgtccattggttggacataaatatctgcatctgactctttcagctgcttgttgggtatttggagggcagtcatgataggtccctttttgtgagtgctccatagcctcagtaatagtgttaagccctgggacctccccttgagctggatcacacttaggaactattactggatcttcttttcctcaggctcctctccatttttgtccctgaagttctttcagacaaggacaattaagggtcagagttttgactgtggaatggtaaccccatccctcacttgatgtcctgtttctgttggaggtgggctctataaattccttctccctactgttgggcattttatctaaggtccctccctttgagacctgagagtctctcacctcccaggtctctggtatattgtggagggtccccccaacttcccacctcccgaggttgcctgtttgcattcattctgctggccctcgaggcttcagtcctatttccccacccaacaataccttatcatgtaccccctttctcctccctgtcctctctcccactcaggttcctccctccctctccacttgtgattgctttctccctcccaagtgggactgaggcatccttacttgtgcccttcagcttgttaacctttttgatttctgtggactgtatcatgggtattctgtactttttttccctttggctaatatccacttgttagtgagtacatattatgcatgtccttttggatctgagttgtctcactcaggatgatattttctagtgcgacccatttgcaaaactcaggatgtctttgttcttaacagctgagtagtactcaattgtgtaaattaactacattttctgtatccattcttctgtcccaggacatcattcttttttatttaaaaaatttaattaccttttttgatattaaagcataattgcatccaacatccagacttaatgtggcataatttaaatgttaaaattatatttagtatgtacaacataatggtttggtatacatatacatttgaaatgattagcacaatcaaaataattaatacctatcatcccactgtgtcacttgtgtgtgtatgtatatctgtgt

SEQ ID NO: 2858 - DNA, 1200 bp, mus musculus
tatgattaagtggccaaagagtgggtgcttcgatccttcttaaaagggggaacaaaatgctcacaggagcaagtatggagacaaagtgtggagcagagactgaaggaaaggccatccagagactgccttacctggggatccatcccatgtatagtcaccaaaaccagacactattgtggatgctgagaagtgcatgctgacaggagcctgatatagctatctcctgagaggctttgccagtgcctggcatatacagtggcaaatgctcacagccaatcattggactgaacatggggtccccaatggaggagtaagagaagggactgaaggagctgaaggagtttgcaaccccataggaggaacaacaatgtcaaccaaccagatcccccagagctccaagggactaaaccaccaaccaaagaatacacatagagggacccatggctccagctgcatatgaagaagaggctgtccttgttaggcaacaatgggaagagaggcccttggccctgtgaaggcttaatgccccagtgtaggggaatgccagggcagggaggtaggtgggggttggtgggtcgcagagaaccttcatagaaacaaggggagggggtatgggatagggagggttttttggggggggaccagtaaagggtataacatttgaaatgtaaataaagaaaatatccaatacaaaaagaaaatagaaaacttgatcttccttccagtccttatctccacctgcacatttggcagattggctccctatccaccgacctatcccacagccctgcctgtctcctaggaggtctcctgtaaccagagacacaggtgagattccctccccaaaccccagacatgggatctgccctgccctgttggagcccaatctcccttatgctctacacctccatctgcactctcagtggatcagcaaaccagacccctcaaccacacagccctgcctgtctcccaggaggccttctctaacccaagaaacagctctgtctacctcccaggaggcctgcactaacataggacagagatctacctgcctccagggagccatgctccaatcccagacatctaggctggccaaccccagagacaaccagatggcaaaaggcaagtgtaagagcataatcaacagaagccaatgcaatataacatcatcagcacctagctctcctactacagcaagcc

SEQ ID NO: 2859 - DNA, 1200 bp, mus musculus
agcatggtagttttaagtgaatattatccaaaagtacagaatactcatcatacaatccacagaccataagaagtttaacaagaaggaaggcccaagtgaggatgattgaataccacttagaagggggaaccaaataatcactggaggcagagggagggaggatacttggtggaagggggtagggaaaagggggcaggattaggtatgggggatacaggagaaaagtcaagagagccaagagaatgaatggaaatatgcagttacttgtggtaaggttgaggtgggagaatttctaagaagtcccagagacctgctatcattgagggttaccttagctgaaatgtccatcagtggggttatggaacctcaaatgaccacatctaatagacaggacccacagtggagggatggggatactaacccacctacaaaattttcaaccccaaattgcccctgtctaaatgaaatgtgtggacaagaatggaacagaggctgaaggaatggcccactggtgacctgttgaacttgagacccatcccatgggcaggcagcaattcctggcactattattactgatgatgactaagacagatgcagatacagccaagcttggaatagagttcggggatccctatggaagagttaggctgaggattgaaggaactgaaagagatggcaaaccccatagcaagaccaagactgtcaactaacactctggatatcccagaacctgagccaccaaacaaagagcatacgcaggcttctcagaggttcctagcacatgtgtagcagaggtctgtattatatggcctcagtggaggaggatatgtctaatcctgtagacacttgattccctagggtatttggggggtgggtacccacaaggtaggacgccctctcagaagtgaagggggaatggaaggaacaactctgcaagtgggaaaccaagaggggcaggatttaggatgtaaattaacaaaataattaattaatttggaaggaaaaagaacaaaaaagaaaagaaaggattaagattagaggatacaataggtttgcatactaaaagtatcaattagggaaaactttaaaagtttccttaactttgaaattttaagggtgtttccttaactttcagggtgtaagggtccttttgcgaatccatttaaataaatgatatttttttatagagttgggggtaaa

SEQ ID NO: 2860 - DNA, 1400 bp, mus musculus
aaaataaaaatggtaagcaaaatgaaaaagaaaaccaatggaatgggagaaaaaattataaactttataagggttaacatataaaacatccaagaataaattttttcttttccttttgtttattggatattattttctttacatttcaaatgtcatcacctttactggtttccccccaacatcgaaaaccctctatcccatcccaccttggcctgattttatgagggtgttcccctacccacccacccacttctgcatccccatcttggcattccccagaactggggcaccaagccttcgtaggaccaatgtcctctcctcccattgatctccaacaaggccatcctctgctacatatgtggctggagccatgggtccctccatgtgtactctttggttggtggtttagtccctgacggctctgggggcgtctggtaggttgatattgttgttctttctgtggggctgcaaaccccttcaactccttcagtcctttctttaactcctccattggaaacttcgtgttcagtccaatggttggctgctagtatccatctctgtatttgtcaggctctggcagaacctctcaggagacaactatatcagactcctgtcagcaagcacttcttggcatctgaaatagtgtctgggtttggtgacatatgtatatggggtggatccccaggtgggacagtctctggcttttccttcagtctctgctccaccctttgtgtccctgtttcctcccatgagtattttgttcccccttctaagaagcacagaagcatcaacattgtggtcttcattcttgagcttcctgtggtctgtgaattgtatcttaggtattccaagcttttgggctaatatccacttatcagtgaagaaatttttataaggcaatagtaaagaaaaaaaaaccaaaacaaaacaaaacatttgcttatccactcaaaaatggtcaaaatgcctaaatggacttctctccctgcagaaaatagaaagtagccaagagatacatgaaaacatagtccatgatattagtcatcaaatacaaaattaaaactttaatgagttatttcatactcattaagatggctatcatcaaatggtggcaaaagacaacacatatttgtgagtatatggaaaaatgggatctttcattttgttaatactataaattggtaaggccattatggaaacaatatggagatgaaatatacagctggcacatcgtccaaaaatttcactgctgagtgcatgttcaaaagtaataaaatgagcacttcatagaggaaaatgtaatattgttcaccatagagaatatatatatatatatatatatatatatatatatatatatacacacacacacacgtgtgtgtgtcctaaatgaatgtgga

SEQ ID NO: 2861 - DNA, 1200 bp, mus musculus
atatattactcttaaatctatacaatctatatcctaaaaccctttaagctacatattattctgaaatgctgggtatacacaaagtgatacaaaaatcttgcacatctaagagttcagcctattttatatggggttatatccactctcatcatattatggctaaatttaccttgagatcccattactgttttgtaataccattatcatagtgtgtttaattcataaggtgcaatgtcattgagatgatcaataaagagtctctctctttttttattggatattttctttacatttcaaatgttttcccctttcccagtttctctccctccaggaaacatcctatcacatcctccctcaccctgcctctatgagggtgttcctccactcacccacccactcccacctccctgccctcgattcccctatactggggcttctatggagtcttcataggaccaagaacctctccttccattgatgcatgacaaggccatcctctgctacatatggagttggagccatgggtccctcctttgttgatttagtccctgggagttctgggggtctggttggttgatattgttgttcttcctatggggatgcaaaccccttcaattccttcagtcctttctctaactcctctattggggactgtgtgctcagtccaatggttggctgtgaacatctgcctctgtatttgtaaggctctggcagagcctctcaggagacagccatatcaggctcctttcagcaagcacttcttggcatccacaatagtgtctgggtttggtgactgtatatgggatggatctccaggtggggcaatctctgtatggcctttccttcattctccactcaacactttatctccatattttctcctgtgagtattttgttctctttgtaagaaggactgaagcatccacactttggtcttccttcttgagcttcatgtggtctgtgaattgtatcctggttatttggagcttttgggctaatatccagttatcagtgggtgcataccatgtgtgttcttctgcaattgtgttacctcactcagaatgatattttctagttctatccatttgcctaagaatttcatgaattcattatatttaatagctgagttgtactccattgtgtaagtgtaccacattttctgtatccattcctctgttgaaggacatctgggttcattcc

SEQ ID NO: 2862 - DNA, 1200 bp, mus musculus
tgaaatgtagattataatactaaacttgtaacttttttgatgtttggtagtaataattttaggttgtacagcatgcagattgttgctctcatccaacagtcgttctaacattgacagttttcttatatattcttgaaataaccaaaatacactaatttttatgaacagggaagaaaatggaaaacaaagaacaactaagaataataatcactttaagaaaactgttgcttgcaggcaggagcctagcattgctctcctctgagaagctctatctaccagcagccgactgagaccgatgcagatacttatagcctagccagccaaccattggcctgaggtcagggaccccattgaaagagttaggggaaggactgaagggactgaatggggatggcaaccccataggaagaacaacaatgtcaactaacccaaacccctcagagctcccagagacttagccaccaaccaaagagcatacatgggctggtccatggccccagctaagtatgtagcagaggggctgccttgtctggcctcagtgggagaggatgtgcctaatcctgtagagacttgatgccccagggaagggggatgctggggggacagctgggggaggaggtgggtagaggaggtggggtcacaccctctcagaggcaaaggggaggggtaaataactctgggaggggggaccaggaagggggtcaacatttggaatgtaaataaataaaataatttaataataataaagaaaactccatgaaaaataatgtttctgcagcccgtcctttaccttagtggcaacaggaaaagcgtaaatggagaggatgttggacaataccaataaaccactccttttcacacatttgacaactgatagctctggctatagacccatggaaacagggacaaagtttcattttcttttgcactattaaatgtaaacctgacaaagtgaaatgcttatcaacagaattgagaaactgcaataattttcactaactcttgacacttttcaagctctatgtgttttgcaaggttaacttacattttccaagtgaccccaaaggaacacaaaataccttgaagttcactaatggatggtgtagggaggtcaattttatgaaccctagattctttttagaatgcacagatattcttggatggcttgaggcaaatgataattactgtttctataaaaca

SEQ ID NO: 2863 - DNA, 1000 bp, mus musculus
caaaggggaaagagaaccatatccagtggttaggcatggcccctggctgagagatcagtccacccacccatctcaaaaatattgctcctgactaaaggaagtacagggacaaagagtggagtaaaaactgaagaaaaggccatctagagactgcctcacctggggatccatcccatctgcaaacaccaaacccagacactattacagatgctaagaagcacttgctgacaggagcctggtatagctgtcccctgagagtctgtgccatagcctgaccaatacagatgcggatgttagtagccaaccatcaggctaagcatggggaccccacaatggaggagttagatgaaggagctaaactgaaggggttagcagtcccacaggaagaccaacaatatcaaccatccagaacccccagagctcccagggactaaatcaccagccaaagagtacatatagtgtgaccaatggctccagccacatatatagcagagtattaacttatctggcatcaatgggaggggagccccttagttctgtagaggctggatgacccagcataggggaatgctagggcactgaggtaggagtgagtgggtggataggggaccaccctcatagaagctggaggaacagggaaggaggataggggatttaactgggaaggaggatatcatttgaaatgtaaataaataaaataaccaacaaaaaagactatacatttcatgtataaaattatctaagaaggaatacaactaaaatttgtcccttattaatacagtatgcataagttaagtattaaataagaaaatactactcatttcattttcttagtttttttgagacaaggtctcaactatggagcctaggttggcctcaaacttggcagtaatcattttaccttgtcatcataggttctgagattgcagatgtgtgcctggctgccttgagtatttttgaaaaaacacatttctacaaaattcttgcaattgtaagcgta

SEQ ID NO: 2864 - DNA, 1000 bp, mus musculus
ccaagaaacatgtgtctcactttccagtcttcaaattccattgttgcttcttgttagaaggaatcccagaagaaggacattcatataaaaatctatttgagtagtaaagagagattgatttcacttccagcttgtcatagtttggtttactattgctatgatacatagcaaccatgaccaaacagaatttgaaaaggaaaggatttatttgttcaacacttccacattgatcatcgatcactgaaggaagttaagacaggaaatcaagaagagttggaacatgcagacaggagctgatgcagagggcatggcttgctccccatgacttgctcagcctgctttcttgtagaatccaaaacaatcagcccagtgatggcaccactcacaatcccgggactgccctcattgttcactaggaaaatgccttacaggcttccctacagccctattgtgtggagtcattttctcaacaggagtcccctcctctcagatgacactagcctttattaagttgacacaaattacccagcacacagatcttctactaacccatagtacataaatttgtatcactaactcatagtgcagatgctgagacaccatatgatatatccaagttatccaagttgtcctccttacaataacaaatgtgggagttgaattgcatgattttaaaaaaatcatttctagcaaaagtagtctagaaatctacccatatcttccatgaatataaatatatttgcaaagtttctttcaaatcagtgcaagcaaaatcctaactgtaatattgttttaaatcatgttttgtgatggcatttgtccttcattttgcagttataaatgtctatttgtgaggtataagaaactcatataaatgctaaaggaacacaacataatacctgtggagaaagcagctgcactgcagacctgctctgcttgctcgaggaaagctgtctcatttaacccatttcgaaaaaattgaggtgaacagaaatattca

SEQ ID NO: 2865 - DNA, 1200 bp, mus musculus
aatattttatgaaactatgttatacagttgattttattgtttttttctttttttaaattataaattttatttacatttcaaatgatatcccctttactcatttcccctccaaaacaccccctatcccttctgccctctccctgatcactaacccttcacccctgcagaagctcctgcttctctgccttggcattcccctacactggggcatagagccttcacaggaaaagggcctctcctctcattgatgtcccacaaggccatcctctgcttcatatgtggctgtagccatgggtccctccatgtgtacactttgcctgatggtttagtccctgggagctctgtaggtactggttggttcatgttgttcttcctatagggctgcaaactccttcggctccttgggtactttctctagctccttcattggggaccctgtgcactgtccaatggatggctgtgagcatccatttctgtatttgtcaggcactggcagagccttttatggggacaggtatatcaggctcttgttagcaagatcttgttggcatctacaataatgtctggttttgttagttatttatgggatggatccccaggtagggcagtctctggatggcctttccttcagttaaaaaatgttttaacttatgttacacaattgctaagttgttcaaggtaaagtcaatgattcactctaattaacacaaagaactgtttgaataagtagaaaaaagcttcttatatggtcttacatgcaaggggagagggcaggaggaagcaagcaagggagggaaagaaagagggagggagggagagatggggagagaaagagagatgaagagagagcgcgcacgcgagagagagagagagagagagagagagagagagagagagagagagagagaaggggttgacttggtatttggcaggcatcaaggttattcctgccaatgatactaacgacgctgacatgttcaatcaagagttggccatttatatcaataaagattcagtttctctattatctctcctttgacagtcatgatttttctgtcactctatattactacttgttgaagagatgagggagacctccttattctcactcttggatattttcaaacctatccctttcctagacagggtgattgcagacttcatcttctaccccagaggatgtatgatggatcctagtgt

SEQ ID NO: 2866 - DNA, 1400 bp, mus musculus
gttctacctcaagacccagttataccactcctggacatatacccaaaagatgccccagtataccacagggacacttatgcaactgtgttcatagaagctttattcataatacccagaaactggaaacaacctatatgtcccttaactgaagaatggataaggaaaatgtggtctatctacactatgaagcactattcagctattaaaatcagacatcatgaatttttcaggaaagtagatggaacttgagattatcatccggagtgaaataactcagaatgaaaatgtcatgtatggtgtgtactcattgataagtagattttaaccctaaagtgcacaatacccatgatacatcccacagacccaaataaattaaacaagaaggaaggcccacatgagggtgcttagaacagagaacaaaattgccatgggaggcaggtggagggaggggacagggtagaagaacagagggggagggaaatgggaggtattcataatcaggtgtggagaaaggcattcgagatggacagatggccatgtgaatgactgcctatcacagtctcacagtggagtgatagggacactaacctacccacaaaatgttcaacacaaaatttatcttgcctacaaaacaaaacaaatcaaaaaccaacataaaaaaacaaaacaaaacaaaagcaaacaaaaacaaaaacggaagaactgggatggagcagagactgatggaatggttaagcaataaccagcccaactcaatattcatcccattggctagcaccaatccctgactttactagtgacactccataatgctggcagacaggaggctagcatggctgttctatgagaggctccactctgtggctgactcaaagagatgcagagacccacagccaaacattggctggagcttgagaactctttttttttttgggggggggggagttcaagacagggttgctggcctcaaactcagaaatctgcctgcctctgccgcccaagtgctgggattaaggcatgcaccatcactgccaggcttagagcttgggaactcatatgaaagagttgcagtgaggattgagggccccaaagaggataggaacaccccaggaaaaccaagagctaactaacttggatccttggggctttcagagactgaatcaacaaacaaagaggatacgtgagctggacttaggcctccctgcacttatgtagcagatatgcagcttggtcttcatatgggtactgaacaattgtagcaggggctattcctaaagctgttgcctgtctgtgaaatttgttcccctaactaggctgtcttgtctggcttcattttggaagaagatatacctagacctgaagatactttatgtaccagggtggaggcatatccatggggt

SEQ ID NO: 2867 - DNA, 1000 bp, mus musculus
gttgcaaactaccaagcaatatgggataaaagcatttgcacggctatactctcacccacagagaagatgttcctcattttgaaggtcaggccatacatcactggcccaatgtcaggaaacatgcatttcctccgcctacgctgtgccaggtcagtcagaaaataaacaaaagcaaccagcacccccacaaaacagctaccccctcagctgctcttgcttcttctctaccattccatctgcaaaaaatccagtcagggaaatttaaacatgttgtttaaaagatcagagattctaatatctcacagcaacagactctctctctctctctctctctctctctctctctctctctctctctcatcaatgtaaggaaaacttgttttgaacttgaagtgctatattattgacaataattctcttttaaaatgtcaccagagacgtgcttatatctatttcagactttctagagttttttgctttgaagtagttgctaacaaaagtgtcattgtcatgagtctatcatctcagatacttttcattcctaacagaagtcatctgaacccacatgtgctagaacactgatacattacacttgtaacctgaaaagatgaaacaggctttagctactggatgatcacttttcattataaattcagtatgaacactttatcttatttccttgtggtcatatgatggttcaacaccaagtcttggcatacctagacatcttaaagataaagataacatggatttcaaatattcagttgtaaacatcaatgtagaaatgaatgaagagatgaagaattctaaagaaatgtttctaatgcctaagagattataacagaagcatttacagaatcatatggggcccacaataaagccactgagcttgggaaaatggttttgaatgagcaggtagccaaaagactaggagactaaaatcacatgacctcataaaatgaattatatctatggaactttaaaccttcaaaactcatga

SEQ ID NO: 2868 - DNA, 1000 bp, mus musculus
tgaaaggacccagatatagctgtctcttgtgagactatgctggggcctagcaaacacagaagtggatgctcacagtcagctagtggatggatcacagggctcccaatggaggagctagagaaagtacccaaggagctaaagggatctgcaaacctataggtggaacaacaatatgaactaaccagtaccccggagctcttgactctagctgcatatgcatcaaaagatggcctagtcggccatcactggaaagagaggcccattggacacacaaactttatatgccccagtacaggggaacgccagggccaaaaaaatgggaatgggtgtgtagggaagtgggggggggggttatgggggaattttgggatagcattggaaatgtaattgaggaaaatacataataaaaaaaaccaaattcataaaaataaaaaaagtgtgcatttggaactacatgttgaatgaaatatatgttgaacttaaatatcaaaaattgacaccaggcagtgtaggaagccaactctaagatggcgccagtttccagtatgctgttttcataaacaacatcagtgcaggtgtaagcctgagtctggtgccaacccctcaggagcgggtacatgctaattaggtgattaggtgacagcggttcaacctatcccaggagaacatgaagcctttccctgtgctggggtgcatataagcagacctccctgggtccccggagtccccgtagcagcaccgaggcatttctgcaataaaggctgttgagaagaatccgactgcgttgtgtcttccttgctggccaaggtgggtgcaacaaggcagcatacattagctggtgtgaggcccctgacacatgtacagcagaggactgcctggtctggcctcagggagagaagatgcacctaaccctcttgagacttgaggccccagggagtagggaattctggtggtgtgggactggggatggggacatccttttggagacagtgggaagagg

SEQ ID NO: 2869 - DNA, 1600 bp, mus musculus
atgagcgaaattttcaggtaatcaatgtgcctgaggtaataaatatctattcacaatataaatgtgactccattttatgactttacttaaagctaatattaatactttacttgatataatttaatctctccttgatgaatcatagtatagctttatatatggaaaaaatttaacacccatgatttaaaataatagctattgatttattccttaaatttggaaacgtagttaaccagtgctaagcatatattcagcatatatatatgtatatatatatatacatatatatatatatatatatatatatgatccacattctaaatatttactcttagtcaatagttgcaagcaaactttttttccctataatagacgattttagtaaaccttgcatggtatcatatctctgcattctcagttctgtggatgtttaggcaatagtattagaactcaaggttatcaatagctatatattttaagccaaccagagacacataaaacaatgtctcacaaaatcatacagcacacacacacacagacacacacacacacagagtcacgcacacactcagagtcacacacacacagtcacacatacacagagtcacacacactcagagtcacacaaacacagagtcacatacacacagagtcacacacacacacacacacatgcacacacacacagagtcacacacacacacacacagaatcacacacacacacatgcacacacacacacacacacacacactcacactcacactcacacaaacacacactaggcaactgagagagtcagatgtagatatttacacccaaccaatggacagaagctggtgatccctgtagctgaattacaggaaagctggaagaagctgggaaggagggcagtcttatcagatgaccagcagtctcaactaacctggacccctgatatctctccgacactgaatcaggcagcatataggagctagtaggaggccctggacacatttacagccgagtactgcctggtctggcctcagtgagagaagatgcacttaaccctctagagaatggaggctccagggagtggggaggcctggtggtgtgggactggggtatgaatatcctcttagagacaatggggaggagggatgggatgaggaacagtcacagggtagactgggagggggatgaagactgtactgtaaaaaaagattaaagaatgataataataattaaaaaataaaacatataaatatttaaactagtttgttaaattcctcatctgaaacatgctattcaaacctctaaagtattcctaacactccagcactcttagaagacattaaattatagaacatccatttttatataacatactaattttgaaattagagttggcaaactttgttctgtaaatatctaaatagtaagcatagtttatgtttgcacataataaggtctctataaattctgttgtagtgtgaagtgagccacaggaaatacattaactaagggtgtgtctgtgctataatacaaaataataaaagcagccattaagacaaattagatctacaggacaaatgcatgactatatagctgaacaacactc

SEQ ID NO: 2870 - DNA, 1000 bp, mus musculus
tagactcttttctctcacaatatatcctgttcataatttcccctctatctaatcctcacagttcctcccctctttccttcccctcacctctggattgtctcccttcctgtcagacacagtttactttttgttctgttttggtttggtttggtttggtttggtttggttttaattaaatgttcttactccacctatagggttacagaccccttctccttgggtactttctctagatcctccactggggccctgggttccatccaatagatgactgtgagtatccacttctgtatttgccaggcactggcctagcctcacatgaaacagctattatcagggtcctttcgcaaaatcttactggcatatgcaatacccccagagctcatgtctctagctgcagatgtaatagaagttggcctagtcagccatattgggaaaagaggccccttggtcttgcaaactttatatgccccagtacaggggaacaccagggccaagaagtgggagtgggtgggtaggggagcagggcagggagagggtatgggggactttcaggatagcatttgaaatgtaaataaagaaaatatctaaaaaagaaagaagaagaaagaaagaaacacacacacacacacacacacacacacacaaagaacttcaaatatggtaataaagtggacaaatctccaaaaaaaatgttcttactcatgagatggtgtgataaaaaatgtagatggttattaacttaagatcttccacagctccttttatatcttggattaatttgcataatatgacagtaagaaatgccagtaccttaaaggaagacatggttcttataaaattaccatatatatgcttggtggttggctaataattcacaggaataagtaatctcaagtatttcatcatcttgccatggaagagttccaaaaaaagcttttgaggtctatagagatctaatgtcaggcaggattttttgttaattttaccatattgtatt

SEQ ID NO: 2871 - DNA, 1400 bp, mus musculus
gaatgagtgcatagttggagagatgagagggtttgaagggaggaaggggaatgcagaagtggttcattaaagcataattttaaaaataaacaaaaaatttaaaaagtaaaacaaaactcccaataaagtagttttagaaggaattcacccttaaaatatttaagtcagatatagaaggccacagctaatataataatcaatataaattctctatcctaaactctagtataaggcaatgatatactaactgactccattcaacatagtactggaaattgtaaccagagcaataagctcagaaaaattagtaaatgcctaacaaaggagaaaggaaaacctatacagatcatatccagaggttaggcaaggcctctggttgggggatagggacacccacttatctccagatttttaacccataattgctcttgtcaaaaagaaatacagggacaaagtgtagatcaggactgaaggaaaggccatccagagacactattgcagatgccaagaagtgcttgctgacaggagactgatcaagctgtcccgagaggttctgccatagccttacaaatacagaggcaggtgtttgcagctaacggtgggactgagcacggggaccccaaagaaggattgaggggaaggactgaaggagctgaaggggtttgcaaccccataggaagaacaacaatatcaaccaaccagacgcccccagagctcccagggactaaaccaccaaccaaagagtacacatggaggaacccatggctccagccgcatatatagcagaggatggccttgttgggcatcaatgggagtagaggaccttggtcctgtggaggctttttgctcccgtgtaggggaatgccaggactgagaggcaggagtgggtgagtgggtgggataacactctcatcgaagcagctagaggggggatggaatagggggttgcagagggcaaactgggaaagggaatatcatttgaaatgtaaataagtaaaataaccaataaaaaaggaaattttagtaaatggtggtaaattaagaaatgaaaagcaaaaagccttgaagatatgggcacaggggaaaaattcctgaacagaacagcaatggcttgtgctgtaacatcaagaattgaaaaatgggacctcatgaaactccacagtttctgcaaggcaaaagccacccaccgtcaataagacaaaaagaccaccaacagattgggaaaggatctttacctatcctaaatcagataggggactaatatccaacatatataaagaactcaagaaggtggacttcagaaaatcaaataccccattaaaaaatggggctcagaactgaacaaagaattctcacctgaggaataccgaatggcagagaagcacctgaaaaaatgttca

SEQ ID NO: 2872 - DNA, 1400 bp, mus musculus
tattacatcaatgatgttttcaaatttctactgatacagtaactattttgaactgaattttattatcctgaatcaactgcttatttatcttaaagatatctattatggtataaattaattaggtcaaatcttagtagaaatgttagtattttatttcattttagtgacaaacttgcttccttggattatattttatggagtaattacacagttcactttagaactagatgactcattttcctgtaagaaagaaacagatttagaggcagggatccttgagctggaaagatgactcagcatttagaatcacttactgctcatgtagcggacccaaattcatttcttaatacctacattgagtggctcacaactgcctataactgcagctctaggggatctggtctccatgagtatccacatacacagtagcagtcagttttagtatcagcttccaaattttagattcaactgagtagatctcactgcattaattgatatgggacaagtcattgcgagtatgggaagcaccgtgtcatggcttgccagataaaaagagggcatagcaaaaggaaggttattaacaccccttgcttgcttggccatccctcctgttggcctagccttcacttttgctgctgaattgatttagccatttgctgctgaggattccttcactaaggtcagaagcagcatttctcagctttactatttgacacatgggttgtctccagtgtgagacatacactgtgagactactgtgactgcttaggcatccagcctcaaggagcaaggaactactagattctcaacctcctcaaagttagacaatttctgttacaactttagcatagaataacttaatatattattttattgtatatgtatattacatctccatcctattggccctattcctctagagaacagtgactaatacaaatgtgtacacacacaacaaaaacacacacacacactcttaaaaatgataaaaataaatcttaaaaaaaaaaacaatgagcctgaaccagtctagacctagaaatgagtataaatcctaacaccatttagtaatacagaatatcttaggatggaaagaggccaaagtacacatttagacctggcccatctttagattataaatattattatagcttactctgctttctccccgaccttcccttgccaaaactattttaaaactatacttgcaatactgtcttttttcattggccttgctgacttattctgtaatccattcctttggtatgagattgtagtacctactgtcatttgacattttctcatagttaagatcacctttcatctgttccctaagaattgtgaagacacaaaataatccaatcttttcattctccaagtaaatacttacgaaatttaac

SEQ ID NO: 2873 - DNA, 1200 bp, mus musculus
tcctgatgtgctctatggaatcttctgcacctgagattctctcttctatctcttgtattctgctgttgattctcacatctatggttccagatttcattactaggatttctttctctaaaattgcctcactttttgttttctttattgtgtctatatccctttttatgtcttggatggttttattcaattccatcacctgtttggtcgtgttttcctgcaattctttaagggatttttgtgcttcctctttaatgtctttcttctacctgtttagcagtgttctcctgtatttctttaagtgggttattaaagtccttcttgatgtcctctaccatcatcatgagacatgcttttaaatccgggtcttgcttttcaggtgtgttggggttcccaggacttggtgggttgggagtgctgcagtctgatgatggtgagtggtcttggtttttgttagtaagatctttacgtttgccttttgccatctggtaatctctggagttatttgttatagttgtctctggttagagctcattcctcaggtgattatgttagcctctctcagcagacctgggagactagctctctcctgagtttcagtggtcagacactctctataggcaagctctcttcttgcagcaaaggtgcccagatatctggtgttcgaatctgcctcttggcagaagttgtgatctactcaccagagttcctaagatcccgtggagagtcctctggggaccttgggtgtgtctgcagactctgtgcccaaggtggcctggtgctggtgtcgactcgaagggacttgtgaccctggtcaggcacggttttttgcttccctaattaatgctgtctcatgtcctgcgcgattggattggagtagcagttgtgttccactcacaggaggtcctaagattccatggagagtcctgtggggaatttgggggtgtccgcagactccgcgcccaagttgtgtaggtgctggcacagactggaagggctgtttccatttcttttaaatgtgtttaatggctggaagaaaaatgaaacaaatattatagaggcagggtagtgacaaaggttttgacccttttccatacttgtggatgcattagtatatttctaatagagcacactctcttttgtctcttggacaaaataaatttataagatttaatttatctaatagttaaaaatctgcccaga

SEQ ID NO: 2874 - DNA, 1000 bp, mus musculus
gtggttggtgaaaactgaactcagtagctctggaagagtagtcaatgctcttaaccactgagccatctctccagccccttagatcagatttctattgctgtgaagagaaaacatgaccatggcaacttttataaaggaaaacaatcaattggggctggcttaaaggtttagatcacagtcatctattggatggaacacagggcgcccaatggaggagctagagaaagtacccaaggggctgaaggggtctgcaaccctataggtggaacaacaatatgaactaaccagtacccccagagctcatgtcactagctgtatatgtgcagaagatggcctagtcggccatcattgggaagagaggcccctaggtcttacaaactttatatgtcccagtacaggagaatgccagggccaagaactgggagtgggtgggtaggggagcagggcaggaggagggtatagggaaccttcaggatagcatttgaattgtaaataaagacaataactaataaaagaaaaaaaaaaaggtttagagcttcagtccattattggtatggtaagaagcatggtgacatgaagccagacatggtgctggagaagaagtagctaacagttctacatctgtatctggaggcagtaggaagatacagtgccactagacctgccttgagttgtagaaacctcaaaccccaccccacagtggcacacttccaccagcaaggccacacttcctagtagtgctactcctagtagtagtatcaaggggaataacaaagcatttctttgggttccaagtatgagtgtttaagaaatattgatcagtgtgtgcaatgactactaactgtgccttcctcctcccggaagtttatagcactatactgaacacctacagcgacctcttatgaagactaccaaactctccctactgtgctccctacttcacctaaatatgatgctgaggtttcaggttatggtacaaaaaaaaatgactatttggtcc

SEQ ID NO: 2875 - DNA, 1200 bp, mus musculus
aagtataatacgagtgtattcttactactagaaatacatgagtactctctattatccaaattatgttgtgtacatttccaaagcctcttccaaattataggcttttaatttccatataatgttgaattgatgtacagcatacctttttgaaggaaacaaaattctgtttttaattagttagaggtatctgacttgtcactatgtagtttatagcacagaaaagaatgaagaatctttttattacaagacaagacttgcttgctgaagattttttccttttttaattgattattttatttatttacatgtcaaatattgtttcccttcccagtctcccctctgcaaagtcccatcttttcacccctcccatttatctttaagagggtcctcccctacccactcactctcacctcaaccctctagcaaccctcttttctggggtaataagcctccacaataccaagtgcctccccttccattgatgccagataaagcaatcctctgctacaaatgcagctgtagtaatgggtccctccatgtgtactctttggtttgtggtttagtccctaggaactctgggggctccatgtagttaatattgttgttcttcctaaggggatacaatacccttcagctccttcagtcctttccctagttcttccattggtgtcccagggctcagtcctatggttggctgtgagtatctgcatttcttagtcaggtgctggcaagccctctcagatgacagccatactatccttggcatcaaaaatagtgtctaggcttggtgtctgcagatgggatggagcccaaggtggggtggtatctatatggcctttccttcagtctctgctccatattttgcccatgcatttcctttttgacaggaacaattctaggttaaaatttttgaggtgggtaagtggccccttatctcacctgggggccatggattcaaagaaatcatttatgtcaatagtccttaatattttacactttaaaaagatactgtcaataagacaaaaggccaccagcagattgggaaaggattttttccaaacctaaatatgacaggggaataacatccaatatatacaaagatctcaagaagctggactccagaaattcaaataacccctttaaaaatggggtactgagctaaacaaagaactgtcaactgagtaaagggctgagaagcac

SEQ ID NO: 2876 - DNA, 1000 bp, mus musculus
ttacctaacaaagttaatttggagcactgcctcctctcccaaaaagattgcagcccttctgtttctcaaggccagctccctcacactgggagctcaaggtctagcttggtcgttgttaatttgcaactgaatggagaacctggacttctccaaagaagcttttatattgttgcttttcactgtcccacctttgtttttcaagcaggtcagtcaactcccttcagtctgactgcagcaggtgtacagccccatctccaacagagcaggtggcggttattaatcttcatcaaaaagaattctaagtacttattgtggctttggtctgaattgggaataaggtgtgctaatgagggccagacagtcaatgatgtgcacccagatctcgggaccgtaccaatataagacagaggtacatgccaaaaggccgtggttgttgataacacaccacagagccatgtttgtttgaaatataacacaaactagctgcacataacctccaagatggaattggatagtttgggaggatctaagatttcctaagacaggcgcagccaccagccaccataattctcaggcaggactatagagcataagtaaattttatgcctcagtccagctttttttttttttttttttttttttaaataacagggaggaaattgtaacctgcccctcagcctgaagcaggttgagccagaccttgacttcactgccactaaggagatcacctagggtggagccttcctccctagatcactctattgtttagtcactgtcactgttcctcttcaagatactgctacctgctgggaggccctggagctattcctgagactatgtcctatcctgtagctggctccaagaaccagtgggggatgggcctccccctcttctttataagcaagatccccattaaacctttgagccttgaacagactagcttgttttagtttccattatttctcgaactgcctaggttccctcttctctttcagcctcc

SEQ ID NO: 2877 - DNA, 1000 bp, mus musculus
catgaggaggaaaagggcccaaagagcaggcaaaagagtcagaacacccacaactctgacttgtaggagtcctaaaggaataccaacacaaccataacacatataaaaaggacatgagccagactcatgtattccatggctgttgcttcagtctatgggagtcagtgctcttaggccctgagtttactttttaaacaattttctgtttagtactatgctcatttaaaactgaggttattgttgggtgtgatcccggcagagggtcccaaggtccccagaggattctccatgctgcaaggccctctagcacacccagggtcttgagatcactggtgagtggcatgcaacatcttttccaaaaaacaaaaacaaacaaacaaacaaaaaaaaaacccagagggtcttgagccagaaggaacagggacaaaggactactgtctgaacagtggcctaggttcttttaagtcagcgccacccttgcatcatcttggacacaatctcagcagagggtcccaaggtccccagaagactctacactgaaggcagcatagtacacccaggtcttgagatcagtgataagtgtattccagcatctattgcaaaaaatccaaaagggtcttgtgctagcagcaacagggtcaaaagacaaaggcaggaactagcacacccagaatcttgggatcactgagaccagtccatgaaggagagcacatgggcggcagaagcaacagagattcttggacagggtgccttttggctttcattctcagccaggagacagagctgagacccagaaccctgggtaccttccctaccagaggagagtcagcttccagggagtgctctgatcccaggactcaggaggtagatccaagctccagacttctgtgcaccttccctacaaaaggagagcttgcctgcagagagtgctctcaccactgggactcaggagagagttggtctcccaggagtgctgacagaggctaaaaaatcacaggag

SEQ ID NO: 2878 - DNA, 1400 bp, mus musculus
tttgactgggtttttcttcgtatcctattgatttcaatcccaaatctgactcgttcttgctgactacatgtgttgggtatagtgcctttctttgttctagaaactggatctttctggtgtgcttcaaagttactagtatgaaatctctccaattgtttatttagtcactatatgctataaacctttctcttacaagtgcattcattgtgtcctataagtttaagtatacagtatattctttttatttgaatttaggaaaatttttcattgcttgatttatttctgtcttgaactactcttcattcaatagtttttcaatttctacgagtttgtcatctttcagttgtttctactgtttttgtcctctttaatcacaaccaccaggttgttctagtaggatgtcgggcggtatttaatttttcgtttgtttgttttgtatctgttgaaacttgtttcacatctgagtctttgataaattttggagaaagttccatgaaatgatgatagaaaggtatattctcttctgtttgagggacatgttgtataagtatctagtagatttatcttgtttatgaaataagttacctccactatgtttctgtttaatttgtgtctagatggcctgcctattggtaagagtcaggtattgaaattcatccattctcattgtgtgatttaaagtgtattcctaattcttttatgaactgtgcgcccttgtgtttagtgagtggatactcacagccaaccatcaaactgagcacggagtccccagtggaggagctagagaagtgacccaaggagctaaaggggtttgcagctccatagaaggaacaacaatatgaactaaccagtacctccggaactcccaaagagtagaccaccaaccaaagagtacacatggtggaactcagggctccagctgcatttgtagcagaggacagccttgtccgtcatcagtgggcagagagacccttggtcccatgaaggctctatgccccagtgtaggggaatgccagggccaggaaccaggagtgggtggattagtgagcagggggagggcggtgggggtgtgtataggggttcttcagaggggaaaccagaaaagaggataacatttgaaatgtaaataaagaaaatatctaataaaaaagagaaaagaagaactgaaatatcatcttggtgaatttgcctttgatatgtattcagtgtccttccccacctctttttattatttttgatttgatatctattttgtcagatattgaattagctatactggcgtatttattaggaatacctttttctagctcattatcccgaagtgatatgtatccttgatgttaaagagtcctttttagatacaacagaatgaggaatcgatcctaatttttgtatttatt

SEQ ID NO: 2879 - DNA, 1000 bp, mus musculus
gtccttcaaagtgtccctcccaccactccttcctcttctttttggagagggtgaggccaccctgtaaatccttcaaacctggcacatcaactctttgtaatgttaggcaaatgctctcccattgaggccagagaaagcaggcctgttggggaacagattccacaggcaggtaacagcttggggacaggccccactccagttgctggggtgcccatatggagactgagctgcacatctgctacatatgtgcctgaggcctcagtccagcccatgtatgctctttgtttggtggcttagtttctgagagcttccaagggtccagacatcttattttaggctaagtgacccagtgtctctcactcggcacatttttcagtagtgaatctttttgataattactatctactgcagaaataagttttgctgatgatggttgaacaatatagtgtgctatgaggcatagcaatatgtcattaggtgtcatattattattatattgctttagttgttaaccagcacaatttgttgagatgtctttatcaaactccttctctcaagactcagggatctttgtggaaatgaaggttgaaagattttaagaaattcagtaagtttttccaataaaacagaacttctgtacaaaacaggacagaaatgtacctgagctcacagagactatgagagcatgcacaacaaatacatggatccaaatcctagtgttgagagggggaagtaaacataaagtcacactccagccaagacgctctttgcaattaatgtctgctcagaaaaagaaagttagttttctccaatggagtggcattgggtgtatcaaccacgttccagagcacggactatgttaaatagcagataactaacacaaagcagattctatggtttggtatgtgtgtgtgtgtgtgtgtgtgtgtgtgtgtgtatgcatgtgcgtatgtgtgtgttgttgttgttgttattgatttcgtttaagtttgtttctctg

SEQ ID NO: 2880 - DNA, 1000 bp, mus musculus
tgcctttcagttttcaatgtttaagtctttcacttacttataagcttattctttttttcttcaattttttattagatattttcttcatttatatttccaatgctatgtcgaaagtcccctatagcctctccccaccctgctcccctacccacccactcccacctcttggccctggaattcccctgttctggggcatataaagtttgcaagacaaagggcctctccttccagtgatgaccaactagtccatcttctgctacaaatgcagctagagaaaatagctctggggttactggttagttcatattgatgttcctcctacagggctgcagaccactttaccccttgggtactttctctagctcctccattgggggctcagtgttccatccaatagatgactgtgagcatccacttctgtatttgccaggtactggcatagcctcacaagagacagctacatcagagtcctttaagaaaaatctttctggcatttgcaatagtgtctgggtttggaggctgattatgggatgtattcccaggtggggcagtctctggatggtccatcctttcgtctcagctccaaactttgtctctgtaactccttctgttggtattttgtttcccattctaaggaggaatgaattattcatgcattggtcttcttcttgagtttcatgtgttttgcaaattctatcttgggtattctaagtttctgagctaatatccacttatcagtgagtgcatatcaagtgagttcttttgtgattaggttacctcactcaggatgatatcctccatatacatacatttgcctcagaatttcacaaattcaatattttaatagctgagtagtactccattgtgtaaatgtaccacattttctgtatccattcctctgttgagtgatatctgggttctttccagcttctggctattataaataaggctgctatgaagatagtggagcatgtgtccttattaccagttggaatatctt

SEQ ID NO: 2881 - DNA, 1600 bp, mus musculus
tgttttgaaaaaattttggcagttgtgtcaatatcttctaaggtatcttctagacctaagactctctcttctgtctcttgtattctgttggtgatgcttacatttgtaattcttgaccacttctctaggttatccatttcaagggtcacctccatttgtgttttctttattgtttctacttcctctttcaggtcttggactgttttttttttcccaattctttcatctgtttgattatgttttttttctgtacttcttaagggatttgttttctctttaaaggtttcttcctgtttgtctgtggtttcctgtattctttcagtgagttatttatatcccccttaaaggactctattatattcataaaataggattttagatgagcttcctaattttcatgtgtgttggtttacccaaggcttgctgtggtgggaaaactacattctgatgatgccaaactatattggctactgctgattctggtcttacacttgcatcttgtcatctggattttgctggtgttatctattctgggtgtctgtccttggatcctgccttccatgtcacttggtttctgaaggtcacctgggatgcctgtggcccgggttatagcagaactcctttgaggccttcagactatagtgtcttcagggagtcagacaagctgcaaatctgttaccctgcatacagcagatctcctgggagattttcagagtatgcagtcttcagaggagtagacaagctgatgatgtgttttcctgtatgtagcagaacatgtgggatgccttcagactgttgggtgtttaaaggagcagtcaagatgctgccctgtttatagatgttcttctaggagactttcagagtgtggtgtctgttgccctgtgtgcaatagaactctgggtaagccttcagacttttgggttttaagctaaattataaaattttaaaacatataaatacgaaactcttctgctactagtatgatttctgcagtcaaaatctggtagtggcaatagaagagagagagagagagagagagagagagagagagagagagagagagagaaacttactactcctgatcaaagaaaaaaatggcatttaaaaagagtacactatgaacttgtattaaaatgcttttcacaatgtgtattctggaaaatttatatccatacacatattatataattttgagagatttttcaattatatattctgactgacctgtaaatgtctatgtagttcaagcttgtcacgaactcttggcaatccttttaaatgaccctcttggttcttcaattgtaggtacgtaccaccatgcttggctgctatttttgttgtttgtttaatttgtgtgattttgcttaatttttagttattgaacacctaaaacaaaccctttgtatatatatttccaatgttatagattgaagtttataatatttctttttttttaaatttttttattaggtatttagctcatttacatttccaatgctataccaaaagtcccccatacccacccacccccactcccctacccacccactccccctttttagccctggcgttcccctgtactggggcatataaagtttgc

SEQ ID NO: 2882 - DNA, 1400 bp, mus musculus
ggatttcctggatgttttgagttaggatcttttttcattttccattttctttgattgctgtgccgatgttctctatggaatcttctgcacctgagattctctcttctatctcttgtattctgttgctgatactcacatctatgcttccagatttctttcctagggtttctatctccagcattgcctcactttgggttttcttatttgtgtctacttccctttttaggtcttggatggttttattcaattccatcacctgtttggttgtgttttcctgcaattctttaagggatttttgtgctacctctttaatgtcttctacctgtttagcagtgttctcctgtatttctttaagtgagttatttaggttcttcttaatgtcctctaccatcatcattagatatgcttttaaatccgggtctagtttttcgggtctgttggggtgccctggactgggcgaagtgggagtgctgggttctgatgatggtgagtagtcttggtttctgttagtaagattcttacgtttacctttcgccatctggtaatctctggatttagttgttatagttgtctctgtttagagattgtgtctttggtgattctgttaccctctatcagcagacctgggagactagctctctcctctgagtttcagtggtgtgtgcactctctgcaggcaagctctcctcttacatggaaggtgcacagatatctggtgttcggacctcccttctggccgaagatgaaggcccaaaacagaacctttcccagaagctgtgttgctttggcctgtcccagaagctgttagcttctgtgtgcacactctcacctgtacagactacttttcggtcgagtaccggaaccaagatgggtcccgcagttcctgagtcaaaagcctcctgggctgggtggacacctgtcctctgccggggaggtggtcgaatgtctggagccggaaaagggtgctgcctaagaagctctgtggctcctgcctgtcccagaagctgtcagcttctgtgtgcacactctcacctgtgcagactactttttggcggagtccccttattactctttcttgccttgtgcatataaacaaacaaacaaacaaacacacctggcaaaaagtaagaaaaagtagggaggaagagataatttggtttatagtttggaggaatacattatattattgaacacaagtatatcaggaagaaccaggaaatgagaaagaagtaaggttgaattataaaactttatgggccacttccattgacctacatgctcaagtgctgctgcatctattaaagatttcacaatattccaatgaaggcaaccagttagagaccaagcatttaagcaaatgtgtctactaattactttcaaaataaaacccaaataagcca

SEQ ID NO: 2883 - DNA, 1000 bp, mus musculus
gttaaatagattgtcttagagtcgggaataaatttcagccataaagaaatactgtcatgaacaattcaattgatacactagttttccatctttgaagtttttttgataacaatttgaggatgaccattatttaagtctatccagatattttctttctttgtgatggtggtggttgttgttgttggaggtggcagtggtggtgatcgtgttggcggtgatggaggtggtgttgatgaagtacgtgtgtgtgtgtgtgtgtgtgtgtgtgtgtgtgtgtgtgtgtgtatgcatctgtatgaaaacttctcggttttagtgtgtatgtagttttagtagcacacaaaagtatgcttaagagtatacactctgaaccatcaaccaaggaggcatgcacaggctagatctaggctcctcacacttttctagaagatgtgcaacttgatctccatctgggtcccctaacaagtgaaacaggtgctgtctctggctctgctgtctgccattggatcttcattctgtaactagactgtctggttaggtctcagtaggaaaggatgtgcttagtccttttgggtccaatgataacagagaggggcttccctttttctgagaagaaggggaggagtaatggggaggtatttgtaaggatggaaatgggaggggtggaaggagggggatttcttttgggatataaaataaattgtgaaaaaaatataatctttgaattttaaatgatgtgtctttcaatttaacttcaggtattttctagtcctacttatcgaaaacagctgtttttaatgggaaagtgagttaaaacttttaagtactaagaatgctggacttacatagcatttaaggacagcagtgcttgcacccaagatgaggtcagggttcccagcagtctacctttaggaagtagcagatttttcaagatcagtttcagctgctttgagctacttggagccatatcaaacattgtgaaaaaaatacttaatgagca

SEQ ID NO: 2884 - DNA, 1000 bp, mus musculus
tgaatttctggcttatcaaaagtcaggtatctacaagtgtgaagatttatgcctatgtcttcaattttatttcattagtcaatgtttgttttcatgccagtaccaggtgttttataattataacttaatagtaaaacttgaaatggggcggtaagactcctgaacctcatttattgttcaggattgctatagctattctggagtgtgtgtgtgtgtgtgtgtgtgtgtgtgtgtgtgtgtgtgtgtgtgtgaagctgcgaattgtcttttaaagatctgtagaatattgtgtttaaattttgatagggattaaaactgtagactttttttcaattttattagatatcttctgcatttatctttcaaatgctatagcgaaatttccctataccctccccctgccctgcttccctacccacccactcccacttctttgccctgacatttcactatactagggcatataaagtttgcaagaccaaagggcctctcttcccaataatggccgactaggccattttctgatacatatgcagatagagacatgagctctggggatcctagttagttcatattcttgttccacctattggtttgcagaaccctttcagctccttgggtactttctctagctcctccattgagagctctgtcttctatccaatagatgactatgagcatccatttctgtatttgacaggcactggcatagcctcacaagggaaagctatatcagggtcctgtcatcaaaatctttctagcatatgcaatagtgtctgagtttggtgactgattatgggatggatccctgggtggggcagtctctggatggtccatccttttgtcttagctcctaactttgtgtagactttttgttatgatcctaccaatcccacccactcccaagtaccttgggatgtcttttcatcttcaggtatcttcttaatttttcagtctgaaaattttatcatagaaatgtttcactttcttggttagactt

SEQ ID NO: 2885 - DNA, 1000 bp, mus musculus
cagactaatttcctaagttcggcgggtcccggaccaagatggcgaccgctcttgttatattttttgagacagggtttctctgtgtagtcctggctgtcctggaactcactctgtagaccaggctgtacttgaacttagagatccgactgcctctgtgccactacacccaggaatgagccataatttatttcaatacaaatggacctgactcagaattaagaataagccactatacttggaaagtctctgagttttaaggtagaaattgaaaaaggggggggggaccaaatttggcagagggtcccaaagtacccagaggactctccactccacaggcaccctagcacacccaggatgttgagatcactggtgagtggaatgaaacatctattccaaaacaacccagaggggtttgggccagcaggaagagggacactggaaacccgcccaaccagaacctgggatgtcttctgatctgggccagccccagtgccacccttgtacatgaactcagcagacagtcccacagtccccagaggactctcccctccactggtaccctagcacacccaggatcttaggaacactggggagagttggcctccagaaaaggccttgacactgggactcaggtgagaacacaatcttttatcccaggtctctcagagaccagtcctcacaggagaacatatgggcaacagaagcaacagaacttcttgaacaggattccttcaggccttcatcttcagccaaggggtggatctgagctccagacctctgagcaccttccctgcaggatgagagcttgcctgcaaagagatctctgaccactgggttttactagagagttggactcccaggagagctgaaagaggctaacagaatcacaggaggaagaagctctagccaaacacacctagaacttctaacaccagagattaccagatggcaaaaggcaaacataagaatcttactaacagaattcagtacactcaccaca

SEQ ID NO: 2886 - DNA, 1000 bp, mus musculus
tgtgtttatatgggaagagaggggagtgagagagcccacttatggccagagttcctgtgctctgtgcaggtggatgcgggagggctgctggatgcttttgatgaggccctgggtgggcatctggctatgtgaagccactgaccccacactgcagggggtgggcaaggggcagcccctggtaccaggttctcagtctctgtcatcccattctggatatggcagaggatctgaaaacagtataggggatatgggaagaaaggttcccatgcaggcatgagtcctaaatccagtccttggctggagcacaggaaagccttctgatgggagattatgcacagctctttaggaaaaggcctatcccattgtccaagcacagtggccttgatgaacagagacagtctatggttttagagttttattgtagaaaggtagggggaaagagaaaaggtaaaaagagagaaactggccatggtcaagaggagagaaggggaaaagagagagttagagagtaagaaagataaaggcttagagagagaaaagcttagagagtaatagggagagagtgaggtgggggccaagcagcccctcttatagtgggctgtgttatcttgctgttgctaggtaactgggaggtgtctagcccgaaggtcagaagcttgggacatcgtttaagtgactaatagccacatgcttctcctgtgggacctgtgggggcagtaacttctacaggagccagctatccaggagacatgagggaacaccttctgtcccatgtaggtgaattatcaccactggatcctactcgggttccacctctcaactctacaggagaccagcctgtctgtgcatagcccattgccctacaattgagtaaaagaagtttaaggattcttttgttgtttttttgggggggttgtttgtttgtttgtttgtttttggttgtttttattttcagctgggcagtattggcacactcttttaattccagcacttgggaggc

SEQ ID NO: 2887 - DNA, 1200 bp, mus musculus
cattttagattatttccctaatatttttaggacctcagacatgcatgtattttattcactgaaaatgttccaaaatgttgaggtcaattattggattgtaaaagaagtaaattatttttattttattttagctttaatcctttttacagtccagtatttatcccgctcacagtctgttctctgactgttcttcatcccatacctccatccccccaccctattcctgtctccaagaggatgtccctatcccctacctccaacccaccagacctcaacactacctggagtatcaagtgtctcaaggtttaggcacatcttctctcactgaggccagaccagacagttctctgttgtatatgtgccagagcttcatattagctaatgtatgctgcctggttggtggctcagtgtctgagagatctcagggttccaggtcagttgagactgctggtcttcatatggggccctcttcctcctcagcttcttccaattttcccctaactcaaccacagtggtccctagcttctgcccactggttgggtataaatatctgcatctgactctttcagctgcttgttgtccctctcagagggcagtcacgctaggcctctgtttataaggacaccagaacatcaagaatagtgtcaggctttgagacctccccttgaggtagattccaatttggagctgtcactggacctactttccctcagtgacttcttcaattttgtccctgcagttatttcaaacacgaaaaattctgagtcagagtttttgattgtgcgatggcaaccccatcccttcacttgatgtcctgtttttctactggaggtagactctacaagtaccctctctctactatagaatatttcatcatcatatttagagaatttctgaactcttgggtctctggtagattctagaggttctcctcacctcctatctcctgaggttgcatgtttccattcttactgctggtcctcagggtttcagttctgtccccatcccaatacctaatcatgctcccatataccccttcctgtcccctttcacacctaggtccctccttccttggcccctccactattgtttgcaattttctccttttcaagtggaattgaagcatcctaacttgggacttttgccttgttaacctttttgagttctgtggagtgtatcctgggtaatctgtaatgtttt

SEQ ID NO: 2888 - DNA, 1000 bp, mus musculus
tatcagtagtgaaatctgaaattgttgatacacaatcaaagaaatgttgaaggttggagagatggctcagcagttaagagcactgactgttcttcgaggtgtcctgagttcaattcccagcaaccacatggtggattacaacgatctgtagtggggatctgacgccatctacaaaattgaataatgtttcatatagacttggggtaggtagggatggaggtagaggtttaggttttagggtgatcaggagattaggcagaatgctgagaaagatggctggaataagggctacttgtggggctggtgtgcaaaattagtaaagtggaaactttctggattctagagaccctaatgaggactcctattaatggaggatatggcatctcatctggtcatatcttgtagccaggcaaggctaccattggagggactgggttgcattcactttatttgttggccaagggtttccatggaaatttgcaaacaattcaggctgttgctaagacaaaagactgccctctacaagctgacagcgaggccccattaccaaagacaacaccctcacaattcactgaacatggagaagtcaaggtggtacctaaacagagactttatacctatattctagtttctttcatgcaaaaaggtacgtttcagtgaactaaaagaaaaaagggacaccaactcagccccaaaattttgttctaaactctatccttcttgtaaaatatgctagaacaaaggtgcgacagaacatacagaagtagctaagccatctttgatttgatttaagatccactgcatgaaaaagaacccacactgaacactgctttggcagccaagagccagagactagatagtccagggatctagggtaaaaacaaatactactgatataaaaaaaatcaataaaatgatttctgatgacattctgctatactcataagtcagtgccttatctagtcaacataagtcttcctccagcattgatgataacaag

SEQ ID NO: 2889 - DNA, 1200 bp, mus musculus
aaacaactcataattttaaatgagtgtggtgaaaaaccagtatattacacatgaatcagtgtttgaaacagatgaaagaagaatccagttgttaccattcaatattgcaaacaagttaatggatgcacattgtaatatttgcagttaaatagcagatctataggtaatcaacaatttttaaaaagtttttattagatattttctttatttacatttcaaatattatcccctttcctggtccccccccctgaagatcccctatctccttccccctctcaccaacctacccactcctatttcctggccctgcagttccctacactggggcatagagcctttacaggaccaagggccctatcctcccattgatgaccgactaggccatcctctgctacatatgcagcttgagtcacgagtctcaccatatatactctttagttggtggtttagtccctgatagctctggggcattggttagatcataatgttgttccttctttggggttgcaaaccccttcagctccttgggtactttctctagctacttcattggggaccctatgctcagttcaatggatgtctgtgagcatccacttctgtatttgtcaggcactggcagagcccatcaggagacagctatatcaggctcctgttagagcacttgttggcatccacagtagtgtctgggtttggtgattgtatatgggatgctattttttttaatgtgtttaccttcttatctgtatatatattactgtaccgcatacgtgtcggttgccagtagaagacagagaggccatggcaggctctggaacttaagttaccagtggctgtgagcctctgaactggtgctgagaatagaagcctgggaacaatggaagggcagtcagtgctttaaatcactgagccttctctccagccctaatcaataattccttgcatgagagatctttacaacaaacaatgttgcaataaagttagtaatacaaatgtcataactcatgtctgtaatatgtagtaactatatctgggtggatgcatagcttgaattggatatcatatataggtatctagataagattttaaattttctattttgtaaaatacttcattatgtgaaaccatacgaaatgtagtttttggtctccttagcacatacaaatgatatataattttatctaacacagacttgtttattat

SEQ ID NO: 2890 - DNA, 1000 bp, mus musculus
ctaatttttagcttaaggacctctgtcatattcataaagggtattttacagtctttgtgttgtgctttagctatgttataagtctcagtcttactgcagtaaggttgctgagatgtagtgtagacattgtctttgggcatttattgattgtgtttttgcattggcatctaagcatctgtgtttgagattatggtacatcttggtgctgacaactgcttttatctttggcatatttttccttgattattactgccctttctgtgttcttaggaaggtatagtggttgtgtatggcctggtagggaattcttctgagatttcacaagtgtggccactgggagtccctggtaaaatgtgtttctaagtattgagagttgacacttagtaattgagttgtgctgggttagggctgtgggagtcttcagaggagtggaaagcatggtgtttgccaggatctgtttagtctcctggaaatggggggcaaggagtgcagaaatgccacactaggatatagagctggggcttacactgggaagttgtatatggaggtagagcaaaaatctgaatcttgcctatctcctttgctataccacttgcttctctagcagccttggctggtggttcccaggaatacctactggaattaggagaatagaataaataatatctgagtaataaactatagatggggacagcagaagtgaccacagcaagtagactgccacagaatcgagggagagactggtaattgggtttgtaggagaaaagggagaggtaagatctccagttaacttacctgtttctctagcctgagtggccttcagttccaagggagtgcccagtggtgttcggactgtgataaggccaagaaatggtgaaggggaacatctttgttatctgctggggatgagggcaggggtggatgggaagctgaagcaggtagtctgctacagagctaggggtgagacaaagggattggattttgagtagtaacgatctgc

SEQ ID NO: 2891 - DNA, 1000 bp, mus musculus
tctttcttctatttctcgtattctgtttgtgatgcttttatctatgacacctggtctcttttctaggttttctatctccagtgttgtctccctatgttatttttttattgtttctatttctgtttttagattctgaatggttttgtttatttccttcacctgtttggttgtgtttccctgtaagtattttagggatttttgtgtttcctctttaaggtcttctacatgtttcctgtgttctcttgtatttctttaagggaattatttttgtccttctttgattcctttatcatcatcctgagatgtgattttaaatcagattcttggctttcttgtgtgttggggtaaccagagttctctgtggtgggggaactgggttcttgataccaagtagtcttggtttctattgcttatgttcttgctcttgccttttgctatctggttatctctcgtgttagctggtcttgccacttccagctttgtccctcctgcaagactgtgtgtcagttcttctgggagaccagttctctccaggaggaatttgggtatggagaactgtggtacagtgtcatctctagggtacagacagagatcagaaggattctgttcctgtttcctgatggctctgtgaaggcccctcttggtccaggaatttgaagagaaatggttgtcttacctgtggtaataggtatgtagggactcttaggagaccatctctctcctggaggtatttgtgtatttagctctgtggcaccagatcagctctgggtgcagaaggagaccagaaggctcctgtcctagagatccccttggttcctgtgttctgagggttccaggctggttcctctgagcagcaatggtgatgctacctacactcacaggcctttcagcactcctaggaggctcgatccctcccagtgccattttggtttggagccctgtggcaaaggatctgccacagccagagactgaaactggaagccagccattttcttaaagg

SEQ ID NO: 2892 - DNA, 1000 bp, mus musculus
ccctttcctggtttcccctccaaaaacccccatatcatccctccttcccctgcttctatgagcgtgctctcccatccacccatccactttcccatcctggcattcccatacattgggccatcgagccttcataggacaaagggactctcttcgcattgatatttgaaaagcccatcctctgctacatatgtggttggacccatgggtaactccccatgcatactcttcggtttgtgttttagtccctggagctctggctgtactgctggttgatattgttgttcttcctatggggctgcaaaccccttcagctccttgggtacattttctagctccttcattagggatcctatgctcagtccaatggatgactgtgagcattcagttctttatttatcaggctctgctagagcctttcaggaggcagctatagcaggctcctgtcagcgtgcacttcttggcatccacaagtgggtggatgtgtctgggtttggtaactatatattggatgaatactaacaattaataataataataatatacaattgtggaggaattatatatatgactatcagttttaaatcatatccacccctccaactcatcctgcatctccatactctcaaatatatgacttttaattttttaattattgctgttgcatatatatatatatatatatatatatatatatatataattatttttctgttatatggtaatagtgctatacttcatgttttccttgagcttttatttagtaatcatggtaaactgctttaggttcaatacattactataaatggaaaatagcattaataaaaagtcttgtagattgtcgggcatggttgcacacgcctttaatcccagcactcgggaggcagaggcaggcggatttctgagttcgaggccagcctggtctacaaagtcagttccaggagagccagggctacacagagaaaccctgtcttgaaaaacaacaaaaaaaaaaagaaaaaga

SEQ ID NO: 2893 - DNA, 1000 bp, mus musculus
tttttaattgggttatgtggttattggagtctaacttattgagtgtaggaccatgaaaggcagcctgttttctggttgagctatgtttaaaccccagagacccagcagattaatctgcaagagatggaaggcctgtttgccatgttcccagatccataattctgtggccatcagtcacatagggcaacgccccaagctcctggtattttgtctggacttcaccccagtaccagtttgccagcaccacagtacctggaaacagccaggtaggcttggcccactataaaggaggctgcttgccccctcctcccactcgtactcctgctttctacttggttctctcttaccttcttgctccccctctctctgtattcccttcccctcccctcctcctgctgtggtcatgcctgaactctctgccttcctctgcttctactaccctcttagctccccttcctgtcatgacaataaatgccttaaaaccatggactgccttttctctttgatacccactgtgctggagcaatggagcaagtcttcttcctctaaagagccatgcatctaatcttccacatgaggcctccctgtgttctcagacatgctttccaccagccaacctgcctgctgtacaagccaaagactctccccaacaggactatggggtacacacagtcaaactttgtgcatccacctccatgaacggccctagcaggccggacagggtactccattttaacccacaattgagttatttttatattttggatatgagccctctatgaaatgtagggttggtgaagattttttttttcaaaatcaaatttgctgttttgtcctattgatagtgtcatttgatttacaaaagcttgtaagtttcatggggtgccaatcatcaattgttgacattagagactgagccattggcattctcttacaggaatttccccttgtaccaaagcatttgaagctatttccatttcttttctattagattgagtat

SEQ ID NO: 2894 - DNA, 1000 bp, mus musculus
caaaagaagaatggatacagaaaatgtggaacattcacacaatggagtgctagtcagctattaaacacaatgaatttatgaaattcttaggcaaatggatggatctggaggatatcatcctgagtgaggtaacccaattacaaaggaactcacatgatatgcactcactgataagtggatattagcacagaaacttagaatatccaagatacaattggcaaaacacatgaaacacaagaggaagaaagatcaaagtgtggatacttcattcttacttagaagggggaacaaaatgcccgtagaaggagttacaaagtgtgaagcagagactgaaggaataactatccagaggctaactcacctggagatccattccatataccatcaccaaacctagacagtattttggatgccaagaaatgcttgctgacaggaacctgatatagcgttctcctgaggggctctacctctgcctgacatatccagagttggatgctctcagccaaccattggactgagcacagggtccccaatgcaggagctagagaaaggacccaaggagctgaagggattttcagcccataggaggaacaatgatatgaaccaaccagaccgcccctcccacagagctcccagggactgaaccaccaaccaaagaatatacatggagggatccatggctccaggtgtagcagaagatggcttagtcggtcatcaatgggaggaggggctcttggtcttgtgaagtctctatgtcccagtgtaggggaatgccagggccaggaaaaaggagtgggttgtttgttgagcagagggtggagggagggaggaggtgtttttcagaggggaaaccaggaaaggggataacatttgaaatgtaattttaaaaaatctagtaaaattaaaaaaaaaaaagaattttcatgtctgcattactaacaagtgttaagttgatgatcaggaacaatcactggggatatgtactgtactgaatgatctg

SEQ ID NO: 2895 - DNA, 1600 bp, mus musculus
tccatgttttgtatggaatcttctgcacctgagattctctcttccatctcttatgttctgttgctgatgctagcatctatggttcctgattttccctagggtttctatctccagagttgtctccctttgggttttctttattttttccaacttcctttttagatcctggatggttttattcaattccatcacctgtttgttagtgttttcctgtaactctctaaaagatttttgtgtttcttctttaaaggcttctagctgtttacctgtgttttcctgtatttctttcttaaagtcctccataatcatcatgagaagtgactttagatcaatgtcttgcttttctggtgagatggtgtatccaggacttgctacagtgggagaatttggttctgacgatgtcatgtaaccttgctttctgttgcttttgttcgtatgcttgcctcctgccatctgattatctcaagtgcttgctgccctcaatatatctgattggaccctgtccttcctattatcccagttgattcaggactcctcagagttcagctttctctttgatcttttgattgtggtttcctgtgaacctgagaatctgggtgtgtcagagattttggcagtcaagcttcctctgagaccctgaaatactggtgtgacccagctcctgttatcatgggatcctgctgtcctaagatcctgggtgtgttacagtgcctggaagtggtatcacctttgtggaccatggagttgtctggtatgttctaaaccaaggtaaaccagaactgatcaaaagaacccaagcctctggttaggaagggctctggtgtccttgttcctgctgtcacattcccatcacaattggattggaacagatattgtgttccactcaccagtgatcctaagatcgtgtggagaatcctctgggaactgtggtggtgtctgctgattccataccctaggtgactttatttattcaattttattattcaattatgctggtgaggactggatgggacttgtgcccctggtcaggccagttttctgcttccctactgctgtctcattacttacttttaagtattcagcttattattccaggatttttgggaactttttaggacgttgtgaaaaggtgataagtttgcatcatcagaagattatctgatctattttggactttttctaccatgaattccatgatttataaaagtacttaatgatgaatgaatgagggtatattgaacaggtcatgcctaagacactgcagtagtcactgctgaattctgaataagaattatctcaagattacaaaaccatctgtcatgtggttcttcccttctagcctaagtttaaactgctatttgctaaaacaaacaatcaaaaaaaggatcaagagattttattcttcacttttcaagccataccgttggtgattacacagttaaataaaatatatttgtttcctgttgattacgtttttcaagacaatgatttataactaagagtattttgttcctgagcaaatattttaaatgtttgaagacatttttatatatcttaaattacctgcaagatgctactagttataagatggcacagttct

SEQ ID NO: 2896 - DNA, 1000 bp, mus musculus
cagtgttgcctcactttatattttctttattgtgtctactttccttttgaggttttggatggttttattcaattccatcacctgtttgctcatgttttcctgaaattctttaagggatttttgtgcttcctctttaaggtcttctacctgtttagcagtgttctcctgtatttctttaagtaagttattaaggtccttcttgatgtcctctaccatcatcattagatatgcttttaaatccgggactatctttttgggtgtgttggggtgcccagcactgggtagggtgggagtgctgcattctgatgatggtgaatggtcttggtttctgttagtaagattcttacatttgcctttcaccatctgtaatctctggagttagttgttatatttgtctctgcttagagcttgttcctcatgtgattctgttagcctctatcagcagacctgggagactagctctctcctgaatttcagtgttcagagtactctctgcaggcaagctctcctcttgcagtgaaggtgcccagatatctggtgttcgaacctgccttctggcagaagttgtgatccagtcaccagaggtcctaagatcctatggacctttggggtgtccacagactctggacccaagctgccccggtgctggtgcggaccagaagggacttgtgaccctggtcggtctaggttttctgcttctctacttaatgcagtctcaggtccctatgattgcattggagcagaaattgttttccactcaccagaggtcttaagatcccttggagggtcctgttggtaccttgggggtgtccgcagtctccacgcacaaggtgccctggtcatgggacaccttttaaattctgaatagtgtctgcattattctatgtaaataaatatggcaacatgttttgccgattttttttcttaatgagacaaggtacagataaatcatagaggtaaacttaattggaattgcaataatacatttaaaaacctttta

SEQ ID NO: 2897 - DNA, 1200 bp, mus musculus
atatttttcatttaaatgtttgcttatttattgatatatttgtctattaaatgtttacttatttttctaatgcatataggtcttttgtttacatatatgtccatgtggcatatgaggacctgttatgcttgttgttctcagacggccaggaaatgatgttagaaattgagcccagaacctgaggaaggaagaacactattgttattttagttgtattttattactcattttattcatttccatttcaaatgatatctctcttcccagttatccctccaaaaacccactatcatatccctcatctcccccacccctttgtctctattagggtgcttccccatccacccatccactcctaccttactgtattctagcatctatctaccctgaggcatcaagcctcaacaggaccaagggccttccctcccattgatgccagataaggccatcctcttctacatatgcagctggagccatggatttctccatgtacattctttggttggtgatttattgcctgtgagctctggggtattttattactatagggttgcaatccccttcagcttctccagtccttcccctacctattccattgtggtctccagactcaataaaatggttggttctaagtatctacatctatattagtcaagtgctggcagagcctttcagggaaaagccataccaggctcatgtcagcaagcacttcttggcatcagcagtagtgtctgggtttggtgtctgtatatgggatggatcccaatatggggcagcctctagatggcctttccttcagtctgtgttgcattttttgtccctgattttcttttggacaggaacatttctgggttaacaattttgagatgggtcggtggccttatcactcatttaggggctgtgcctatctaatggaggtcttttctacaggttttctttcctcttttttgggtatttcagctaaagtcatccctgttgggtcctgaaaatctcttgcttccttgacatcttggacttcctagtggctaccccagttccctattccctactgatatatatttctattagatttcctgacacattttaggctacaaatatgtgaagagtttaggacattactgaagttatttttttctatgctcatatttccctttgcaagtcatctattcatgttaagttatttttaagatgcttttttgt

SEQ ID NO: 2898 - DNA, 1200 bp, mus musculus
attaaaacaagtataagcttcctagaatcagagccagttaatttgtagggtggaggtaatatttatggggattaatgtaaataccgaaatcatcatgaatgataaatgaggtagatttagggggaaatgtggtgggagataaatgtgttaaataatgaaagagaggagccttcatgattcaagtaagagctccagtgatattatcagtggtatttgcaaatataaatatggtttcctctggggcagtgggctacccacagacagacagcctggtctccagtcgagcataggtcttgaaccctgtaggacccaatgggtgatgatttccatttacatgggacagaaggtgttcgattatgtcttctggacccctggttcatgtcaaagttactgcccccaaagcccccacaggagaggtgtgtggctatcagtcatgtaggaacagtgtcaagcattcccacatgcaaataaggtttcccccaaaatctcagtccaagccaatgagaggcacctgctgttgaaccctgaattacccccagaactgtatataaatccatccaaggaattaaaggtatgtgagaactattcatttgtctgaatcttttgttccaagagctgtaacacttgggaagagatcttctctcctgaagagccaactaaggtctcaccgcattcctcactaaatagttggcttctccttggcccagcctgacctgactcattgcagagtgactaggagttactgagcaacctggaagacactgcagagtcttcctctccttgccttcactagcttccctttgctaacctcacaccaggcctggccagagatctccatggaaaacctctggtacccaggcccacattttccagaatgatagggcattagaatcattgactcgagatgcggtgcacttaaccaagtgtatgctctcagaccatgaaactcaggaaaagaggaatatttacaggaaacaatgggaggggggagggattttgcagctaacagaggtatgatagtggtatagcagtaaactgtgtcaaattgtagagggtgggagtcttggcaatgaaaaactagctaagagtactgtctttataatagttactgatgtataaaaagattacaaaactttgggacaaaattttagggcctttctaatattttctttgctgggataatgttcagagcaatttatt

SEQ ID NO: 2899 - DNA, 1000 bp, mus musculus
acatttcaaatgttatcccctttccaggtctcccctctggaacacccccattccatgtctctccccttgcctctatgagggtgctcccctaaccatccaccaaatcccaccttcccaccctggcatttccctactatggggcgtcaaactctctcagacccagggaatgttcctcgcactgatgtctaacaaggccatcctctgccacctatgcagccagagccatgggtccctccatgtgtactctttgcttggtgattcagtccctgggaactccagggggtctggccagttgacactgctgctcaacccatggggatgcaaacaccctcaagtccttcagtcccttctccaactccttcattgaggacctaagaagacaatatctaagagaagaagagaaaacattcattccaaagtcagaaaattataagaataaaggaaatattatttaactaaaaggtgatttatggaccaattagactgcttaggtaaattattaatcaattaaacattttaaaaaatatatacaagggtagaataactacaaggaagttaaaagaaaggacatggatctcacatggttttgtttcgatttttcaaatgtaatggaaaccactgaatatttaatgttagaatttctgtattatgggtcccaatatctcctattcaactgttcttttccatatctgataaatattcactgaggacccagtactgtcttaggtctgagtttagagttagtgaatggaataacaacacttatatctttgattttataagatgagtaggagggcaaccctgtaggaggaccagcagttccaattaacctggaacccagagatctctcagatactgaaacacaaaccaggcaatacacaccagctggtatgaggaccccaacacatatacagccaaggacttccagatctgagctcagtcacagaagatgtacttaaccctcaagagactggaggccccagagaagttagaggtttgg

SEQ ID NO: 2900 - DNA, 1600 bp, mus musculus
aagcttcctcctacagatagtgacccacaactggacaatgtgcagaaattgagagaccatagaacattgaaaaaacaccttctctcaagattcagagaaccatatggaaaagaaggtagaaaaattgcaaaacccattggggataaacgacaccaaggaaacaggttactgtgttccagatataataggactgactagaacgtgaaatcatagagatcgtgtcagaatgtacagagtctaagccagataggtttctagcactgaaaaagaaagcagacacaggctcttacttgatcagactcctatccctatccctatccaagagactataaaagtgtcaaccagtctcaaaggaaaagttcatttctgtcacagtctcattaggtatacaaaccacagttaagagcatgcccatatccattgatggccaatacaaaacaaactcaatggtatttctggatattttactttgtttctttttctttttctttttcttttcttttttttcctttttttttttttgacatcgaaagattatttaggcatttttattagatattttctttatttacatttaaaatattatcccctttcctggtttctcctctgaaagccctcttcccctattgcctatcccctccccctctgcctgctcaccaactcacccactcctgcttcctggccctggcattcccctacaatggggcatagagccttcacagaaccaagggcctctcctcccactgatgactgattagtccatcctctgctacatatacagctggagccatgagcattagtgcctattttgagcattacaaaacaaaaacaaaaacaaaaaaaacaaaaaaaaacccttaccagtcttttgcttaaatattatggattctaatttgtggattttatgtttcatttgtgtgaatgtgcatctctctctgtctctctatctctctgtctctctgtctctctgtctctgtctctctctctgtgagtgtgtgagtgagtgtgtgtgtgtgtgtgtgtgtgtgtgtgtgtgtgtgtgtgtgtgtgtttcttaggctttttcttctttttctgtttcattttattctggtccatttgtttttttactgcatatttgttttctaaaaaagaaagaaaggaggcatagaattgtatgtgtggggaggtgggatgatctgggaggagatgatggggaggaaactgtgattagaatgtgttgtataaaaacttatttttaaaaaatgaacaaacaaaccttgtttacatcctttttatgtcaaatagggtcacagcatttttaagcctaagaagaatcacaacactgtttaacatctaacagaattccctgtaagaatgaaattatcaattaataattgaagtatagaaattgccaagtccatagtccaaagatgcagaaagatatcaagtttatcaaactcaagtaatatttgtgtcacgaataaacttctgttagtatgtgggtaataaaaaacttactcaatgttttcattatcataatggtctccattcctatataattacaaatgaaaaatagacctagttcagtttttcagaatcatcgttataacatagttaa

SEQ ID NO: 2901 - DNA, 1400 bp, mus musculus
tcatatgaagtacacaattgctttttccatgtctgtgaagaattctattggcattttgattgaaattgcattgaatctgtgtattgctttttataagatggccattttctctatatagatcctactgatccatgagcatgggaaatcttttcaccttctgtggtcttctttgatttctttcttcatggatttgaagttcttgtaatacagatctttcaagagaatctttaacagtatgcagggctcatgtttcttctcaagtgagctagtaagtgaaatctatagaaagaactatactgactatttttattttttattattttattcactttacttcccaatcaatagctgtctccctctcattccccctcccacagtccttcccctgcccttcctctccttcacctctgagagagtggaggccttctttgggtatctcctcaacctggcacatcaagtctctgtggagctaagtgcttctctcccactgaggacagacaaggtagctgagctagaagaacatatcctacagacaggtaacagctttggggatagcccccacccaagttgttcaggacccacatgaagaccaagctgtacatctgctacaaatgtactggtgtaagaggcctaggtccagcctatgtatgttcctttttggtggttcagtttttgagaacacccaaggatccaggttagttcactctgctgttcttcatgtgtagttcctatcttgttcaggcccttaatacttctgcaaccctttctcaatctagggaaaccttagaggtcataacttttccactcattcacacgtgcacacatgttcaggtacacacacacacacacacacacacgcacgcacaagcacaagacaggtacccttactctcttttatggcccatcacagaaaagagtcctactgtcacacaagccatacctttctgcttaggcttcataagtcctaagagttggagagcgagctctatagtctgaagaaagcaaaggcaaataaaaagggggagtcccattcactagagcagagaagcctatcataacaatagaaattgggaagaaacagagatacaaagcaataccctgatttgattcttagaaggccaaatgtgtcactagaatgtacatgagtactctattcttattgtacaatatcaccaacctgagcatattagagcaaagtattttggtacttagttcagccaaagcagtaccatgttcttcacagaattaaaagagaaattcaacatgagttctaaggaaatctatcttcttagaagactcagtagctcactgcctgttcttgttatcatctctgagaggcaccaggtctaattttggcaaaaacagtctcagggatatgagagggatttggtgtgaagaca

SEQ ID NO: 2902 - DNA, 1400 bp, mus musculus
aagtaaagatgaatttgaaacagcactctagaacattcttctcaagctggatgaggggaaataaagactaaaaggcaatgcaagattcttcttaaagtacaagatgacattaatcagtgcaacactggtttggtcaaagaggatgaaatggaaggaattctttgcttcacttctgagaggtacttttatatcacatgaaatttaagcagaaaggagggaaatattggcaaaagaacccattatatcacactcagattatactctattcttttttattttattttttctttttttatttacatttcaaatgctatccactttcttggtttcccctccaaagacccccccatcccttccaaagaccccttcaccctgcttctatgagggtgttcccccactcactcacccactcccactttcctatcctggcatttccctacactgggccatcgagccttcaccaagggcctctcctcccactgatgtccagcaaggccatcccactcccactttcctatcctggcatttccctacactgggccatcgagccttcaccaagggcctctcctcccactgatgtccagcaaggccatcctctgctatatatgcggctggagcatgggtccttccatgtgtactctttggttggtggtttagtccctgggagctctgggagggggtctggttggtacatatcattgttcctcctatggggtgcaaaccccttcggatccttcagtcctttctctaacttctccactgggtaccctgtgtgtccaatgattggctgtgagcattcacttctgcatttgtcagactctggtagggcatctcaggagacagctataccaggctcctgtcagcaagcacttgttggcatccacaatagtgtccaggtttggtgactgtaaatgggatggatccccaggtagggtcgtctctggattgcctttccttcagtctctgctccacattttgtatctcctctcataggtatttgttctcccttctaagaaggactgaagcacccacactttggtcttccttcttgagcttcgtgtggcctgtgaaccttgggtattctgagcttctgggctaatatccactcatcagtgagtgcataccatgtgtgttcttttgtgattgtattacctcactcatgatgatattttctatttctatccatttgcctaagaattccattgtttttaatagctgagaaatactccatcgtataattgtatgtcttccggatgccaagaaccacttaattttctgtaagaattattttctcagttcagctagagctctttctattctgtttagagagaccctgactaacattttcacagatcatatctcaacacatgtgcacattatttggtgaagcattagaaaga

SEQ ID NO: 2903 - DNA, 1000 bp, mus musculus
tgctggagcttgatcctcctgtgattctgttagcctctgtcagcactcctgggagtccaactctcacctgagttccagtggtcagagcacactctgcaggcaagcaattttcttgcagggcaggtgtccagcaatctagagctctgatctacatcctgagtcctggggtcatagccttccctgtaggccacctttgctctgtcaaggaaggtgcccagggttgtgggtctcagctctgtctcctggatgaggatgagggcctgaccggaccttgaccaagaagccctgttgcttctattgcccacatgctctcaggtgattaggagttccttggtgtgctaggggtcctttggcgtggacagtcctctggtgccatagatgtcctaggttggcttcattcagaagatgtgggggttagcctgttcagaaaggatcccagcctctggttggtagggtttcttctgtccctgtaactgctggtacaagaccctccgcgattcttgatgatgcgatcccggggttctgcggcctggacagcactctggagcccctagcggcctctgctgggctcagaaggaagcaaatgaaaacttttgtagattggttttttacttccaccatgtaggtcctagagggtgtcaacctctaattgcaaggctcaggagaaagaaccttcacctgttgaattatctcactggctcaaaccttagaaatgttttaagtggggctagagaggtggctcggtggttaagagcactgactgttcttccgaaggtcctgagttcaaattccagcaaccacatggtggctcacaaccatccgtaataaggtctgatgtcctcttctggtgtgtctgaagacagctacagtgtacttacatataataataaataaatctttaaaaaaaagagaaatgttttaagtatttaaaataagggacttaaccttttaaaacttttaattctgatgactagtgtatatgttatctcagaataacatg

SEQ ID NO: 2904 - DNA, 1000 bp, mus musculus
gcaagggctgcttttccactgcaaaacagagggaaatctacaagggaacatgtagtaaagacctgttttacaggtaaagggccagtagtgtaaggactgcacactaaggaagtcttagaggaagggtgttatagtgttccaaagagctacagtggacatgataccagcttctgaatcctgttcacttttaggaagcatggatctagatgtagcaggttcctaagaaaatgaatcttaatgctaacaacttgatttgtatttttttgttctctccctttattgattgtttggattaatttaatttattaatttaaatacccacgccagctgagaaaaaacatagggcccagcttatgcaggacatacttcacccattcccactccaggaactccaaatttcttccatcccacttcctatcagcagccaagcctgtgtgcctcctagggggtccacggcaatcaaagacacaggtgagaatctcacccaaatacccatatgagctgggacaacaacagggcctccctgattcaggaccaacctcccctgctgccttttgaggtggggggggggatgcagatcagctgttagattcccaccgatgtattacagtgtacctgccttctaggaggtctgcagtaatcaaagctacatggcagagcagcagccagataaaccacccacatgccacaacctgcttgcttcctaagaggtccacagtaaacaaacacatagagccaagctgacatggggccccactcgccatactgagatccaaattcctccttgtctgtttctacactcaggccagatcagagggcccaatatcttcccaaacctcacagcctgtctgcctcccaggagacccaaccttaccagaaacagtactgcctgcctccaagaagactagctctcactgccaccaaggaggcctgctctagtcagagacaccaggccagttaacacccgtgataaccagatggccagaggcaagctaaagat

SEQ ID NO: 2905 - DNA, 1400 bp, mus musculus
tcctccagaaaaatgaaatcacatgaaaattaagcagggaaatgtgtagagggtaaacagtaaaacatttataactcatgaattgagacaagataacatcagataagatcagaaactttaaatacccctccccatatatatgagtttcaaagaacaatggttgaattactactgctttttctctttcctttgtgttaataagagaaatgcatttagtcctgaaaataagctgacttgcagaaagcattaacacttttttaacaacctaattttggacatattaaacagcatcatactgctgctctattcgtggtctctaagcaacttattcaaattttagatatgcacaaaatgtgtgttgtcaagcttccacagatgtacatactactgagaatagccacacaaacaagagattgctgtattgatattcacattttcctacttcaacataattaagagtttaattgtgccttgttccttaaaggtgagatgcaaaatcatcagcattaaataataaacaaaaggctttatttctcagatacaaatgaataactaacaattcaaatgttattttaaggaaaaaagaaggaagggaagtatgtcaacatgtctacatggaaaatatagaactttctaaacaagacaaaggttattgtttaattttcagatatttactttatttacatttcaaattttatcccttttcctagtttcctccctgaatgtcccctattccctctccctcccctgttccccaccccacccattccagcttcctggccctggcattcccctacactgggtcatagagccttcacaggaccaaagacctctcctcccattgatgaccgtttttcagtaacagtgagaacctttagaagtatctctacaatgacaaatacagtctcccacatatattctaattcaaaatttcttgaatgcagagtcactaagaaaagtagaacctcatgtgtcctgcatattttaaaatagacaaatattaagcttgctaactcattttagatatgcaaaaaaacaggattgggtatgttgagtgatttcactttggagaaggacaaaaaagattagtattcatagacatatttatctttaccattcttaactcatggagctcctcctccttaaaaaactaaaaagggataaaagaacaaacaacaactacaacaaaaacttcatgcaatcaatttcctccaagttgtaaacaaaagtgtttttccatgtaagctatctgcttcacagtcctttgagaggcaagaagcccatctgttagggcttcattataagatccttttgacatacttgaatcttttaggttaatcataggctttgctctttaatgtttccttggccagaaatgtttcccaatcctttagcaatct

SEQ ID NO: 2906 - DNA, 1800 bp, mus musculus
ccacactccaagtttgtcagtgactcgtttgtaattacaagtctccagaacagtaaaaaataatttctactgtacataagtcatcagtatacaatgttcttttacgctagtccaaatgaactaattaaggactttatatacatgaccttgaatggcagtctggttcttggtcaatcataggatggaaatcccggtgaccctgaggcattttgacacactcctggacactaggctcttgacatatggcctcagccctccatagatttttggccatcactcaggtaagggcattcctgaagcccctccacaggtcaagtagcctcaagaggtaagtaaaggcctgaagggcttagccaattaagctttccttcccagacactcctccttgtaaaaggtatttaacctcaggctcacccatgagaagtgggatatggtttttactcaactattctctgccatgacaatatatatatatatatatatatatatatatatatatatatatgtatatatatatatatgtatacacatatatatacacatatatatatacatatatatatatatatatatatatatatatatatatttgagacagagtttctacacatatatatatatacatatatatatatatatttgagacagagtttctctgtatagccctgattgtcctggaactcactctgtagaccaggctggcctcgaacttagaaatctgcctgcctctctgcctcccaagtgctaggattaaaggcatgctccaccactgcccagagacaataaatgtcttaaaaccaggaactgcctctttttatcaggatcctctgtggggagcaatggaacatgccttcatctaaagagctggccacctaatctcctgcagaaggcctctcagcactcccagccatggcattcaccaagcctagccacctgctaaacaaaccaaggattctcatccccataggacccagcaggagctcccccctttcccattttccctgggctagatccagcctgtgggccaccacccagttctcagctcttccgtggctctaagtggcacctaggtgaccaagagcctgacaaccagatggccccagcaaccctgcaagcccagggactcctgagccagcttctgcagacaccagggacctcagcctgcactcccctactcctggagtggtgtcctgcagcttcccatagcccaacagtggccaggtgctggtgtggggtaaacacagtcaaaactccctcatcttgcctccccaagtggcccaagccctgtggtagagcagatgtgagataccacagaccctacacatgtatatgtatacatttacacaagtatgaatatatgcatactttaaataaggaactgtcgtatttaatatataaattgataactacctccataattggaaaatgccattaaactggagacctaggagctctaattggacacttgtagagctaaggctgacagactcaagattcaggatcacttgattatttgattatagtttaaagggaagcagaaaaagggttaatgtctcagtaagaattaattcttaatcttgaaaagctattctttttttattaatttttttttgtttttacctattcactttacatcccactcactgccctctcccagtcatccccccacatgatcctccctcccttctcctctgagcaggtggaggccccctggatattcccctctccacactgatacttcaagtctcttgagactaggcatctagacatggaaagctgtgttcaggctgaggtcaattc

SEQ ID NO: 2907 - DNA, 1000 bp, mus musculus
atcaaaacccaaataatcaaatttaaaaatgaggtacagttatgctaggcttctgtctgaaagcataagaaagtatcattaataaagtcagggactgattcttgtccataagatggatctcaagctgaaccagtcattggttggccattcatccagtctctgttccatttctgtccctgcacttcttgtaggcaggacaaaatttgggttaaaattttgtgagtgggttgaagaccttatctctctcctaggagtcctccctggatacaggaggtggccatttcaggttccatattccccactgctaggagtctcaggtagagctacgctcaatgattctctggagcctcccccattccaggtgcctagaacagatggaatgttcactcccactgcctatttctgatttctgtttactgttatggcccctggttctccctacattagatgctccccctctgtgcttccttttggatacctgttcccacccacttccctccttccatctacctccaatgactcaccctctgagtgagatttaaacatcctcccttgggacttcattgttatttagcttctttaggtttgtggtgctgcatccagcagaagatggaaacacatgcagagacctgcagccaaacattagattgagcttgtggaagaattagaggatattgggaccctgcctgaggggagactccacaggaagacccacagagtcaactaacctggacacttggggaatttcaaagactgaatcaccaaccaacgtgtatacatgagttggaacttgcgcccccttatataatgtagaagatgtgcagcttgaatttcatgtaggtctgccaactactgggacatgggctcttactgacttggtttcctgcctctggatcctgtttctctaactgagttgctctgtctagcttcagtgggagaggatgtgcttagtcctgcagtgatttgatgtgccattgtgggttagtatccaggtgggcgg

SEQ ID NO: 2908 - DNA, 1000 bp, mus musculus
agaggatgggagggacttgggagaaaaagaggagggagtgggggaaaagaggggcagaatcaagtataagaagagatggaggagatatacagagggtcaggaaattgaacagagttgtgcagcaataggggatggagaactgggggtcgcaaccagaaagtcccagatgccaggaaagcaagagtgtcccaggaccacatggggataatatttgttgaaataccctacaaaggggagggagaacctgtcaagaccatatccagaagctaggcatggccccagggtggaaggatggggccacacacccatctctaacattttcacccagaattgcttctgtctaaaggaaatacagtgccaaagagtggaatagagattgaagaaaaggccatccagagactgccccacctgggaatttatcacacatggacacaccagaaccagacactattgcagatgccaagaattgattgctgacaggagcctgatacaactatctcctgagaggctctgccagatgtggatgctcacagccaaccatcagactgagcacaggggaccctaatggaggagttagggaaaggactgaagaagctgaaggggccttatctggcatcagtgggaagggaggcccttgttcctgtgaaggcttgatgccccagtatagaggagtgctagggcagtgaggcaggagggggtgggtgagcatccttatagaaacaggataaggggatatgagatagggagtttgcagagggaaaaccagaaaaggggataacttttgaaatataaacaaatataatatccaattaaaaatgaaaataaaaacaaaaaatgtttaatacttaaatcaataattactttttaaatattggttatcttgatagctattggtgaataaatttctatttatttatttatttattttagttagatattcatttcatttacatttccaatgctatcccaaaagtcccccacactcttccccactcactct

SEQ ID NO: 2909 - DNA, 1400 bp, mus musculus
atatgtacatacatgcatatatgcatatgttttgtgcatatgtccatatgtatatatgttggaaattcttttttcccatttttatactcaatttattatttgtactactgacaatgtccaaaatatatctcatgtaaaagaaatgggaggaaaaacaaataaaattcaattatttttacagtttcaagctgcaaatcacaagtaattataaagccctgtaagaatattgatcaacaaagaaaacaaaggataaacttcacatgaatcaaatagtacagagataataatgtcacttgacttttgttaactataaaaaatagagaatggaaatgcagaagtctcctctccggaatggttaagatttaaagttttctatatgttcaatgtaacaagataatctagaaagtcttctagatgctgtccaatggcctaatctctcaggttacaaatgcatgatagattttcattgacagcgaaaggagaaatcaatatgaacacttaggtcagttctgtgagtccaagttcaaaggagttcacagaaggccaggctacatctgtaagtgtaatttgtgtgtatacatatgtatatgtatacatatatatatagatgcatatatgtagacatgtatatgtacatacatgtatatatccatatatgttgtatgcatatgtacatatgtatatatgttggaatttcttgccactgtcttccataccctttattttcttccatcttttactgttactaagtgcattatggattaatttctacttgtatgtctcctctacaatatctaatgagcttctgaacattttattttattttattttattttattttattttattttattcttttggtttggccttaaactatcattacaaaatgactgattttaagctaagtattgtggtgcatgcctttgatccaagtatttgggaggcagaagcaggtgtttctctgtgagttcagggctacctggtctacatagtgagatcctggacaaccaggactatgtagtgagactttgtagaaaaataacagcaaaaataaacaaaatcaatgagttcagtttcaaaaatgtctgcagcaagtactgtacaggaaaactgaaaacatactattttaaataaggaacacagcgtgtttcgtccttttccacttttagtatcatgtactggggatcctgactagagattggaaggtagggaaagaaatatgactggaaaaaaaatacaccactattctccaaagaaatgcttattgaagaatccttaagtatcaaacagttaacaagatgctatgctaataaacaacaagttaattttaacagtaaatactgctactgacaatcaccaaacacctgagattaaacctaggatatgccttacatggaact

SEQ ID NO: 2910 - DNA, 1200 bp, mus musculus
gttaaaggatataaatgtacttggatgatgataaatacaataatatggaaataaaaatgcttcagataaaaatgtttaaagctggtaaatgcaagttataaatgctgaggggcttaagaaaaattttgaagatgtataaatgcaaattataaaaataaaaatgatttaagatatagaaatggctcttcttcccgccagcttcctacccaggacagatcatctgccagatacccacccataccttctgcctgcttacctcccagagggtctacaaaaattaaagacacaggtgagaatctcacccaaataccctcaccagctgggacaacagcaggacccagctgaccagggacccacctcccagatgttctgagtcctatccttcttcctatctgcttcctactcaggccaactcagttcccagataaccaccaacatgttacagcctgcttgcctcctacaaagttcaaagtaaccaaagacaaagagcccagctgacatggaacacacctgccctgcctagctccacctccttactcctccacttctacaccaggccatatcagaaggcctgataccctactacaccccacatcctatatgcctccagggagttctacaggaacaagggacattggaggtctgctctaaccagagacacaagaggcccaccctaaacagagatagcactgccccccttcaaggaaactggcttttcctaccactaaggaagcctgctctagtcaaaaacatccaggatagttaacaccagagataaccatatagccagaggcaaccacagggtcataatctacagaactcaatgaaatctggtatcaggagaaaccagttcttccaccacagcaagtcctggatacaccaacacacctgacaagaaagataattacataaaatcccatgtcataaagatgatataggcccttaaggaggatataaagaaattccttaaaaattacaggaaagcacaggcaaacaggtagaagcccttaaagaggagacaaataaatccattaacgataatacaggaaaatgtagtcaagcaggtgaaggaattgaacaaaaccgtaaaagaactaaaaatggaaatagaaacaataaagaaaatacaaaggggggctgccctgagtagtagatcaggagctacaaatgcaagcatcaccaaaagaatgcaagagatag

SEQ ID NO: 2911 - DNA, 1600 bp, mus musculus
tcaagagacttgaagtatcagggtggagaggggaatacccagggggccttcacctgctcagaggagaagggggggaggatcatgtgggggaatgactgggagagggcagtgagtgggatgtaaagtgaataggtaaaaacaaaaaaaaatattaaataataatagctttccaagattaagaattaattcttactgagacattaaccctttttctgcttccctttaaactacaatcaaataatcaagtgatcctgaatcttgagtctgtcagccttagctctagaagtgtccaattagagctcctaggtctccagtttaatggcattttccaattatggaggtacttatcaattcatatattaaatatgccagttccttatttaaagtatgcatatattcatacttgtgtaaatgtatacatatacatgtgtagggtctgtggtgtcccacatctgctctaccacagggcttgggccacttggggaggcaagatgagggagttttgactgtgtttaacccatgccagcacctggccagtgttgggctatgggaagctgcaggacaccactccaggggtagggtagtgcaggctgagtccctggtgtctgcagaagctggctcaggagtccctgggcttgcagggtggctggggccatctggttgtcaggctcttggtcaccaaggtgccacttagagccacggaagagctgagaactgggtgggggcccacaggctggatctagcccagggaaaatgggaaaggggggagctcctgctgggtcctatggggatgacaatccttggtttgtttagcaggtggcttggcttggtgaatgtcatggctgggagtgctgagaggccttctgcaggagattaggtggccagccctttagatgaaggcatgttccattgctccccacagaggatcctgataaaaagaggcagttcctggttttaaggcatttattgtctctgggcattgttggagcacgcctttaatcctagcacttgggaggcagagaggcaggcagatttctaagttcgaggccagcctggtctacagagtgagttccaggacaatcagggctgtacagagaaaccctgtctcaaatatatatatattgtcatggcagagaatagttgagtaaaatccatatcccacttcttatgggtgagcctgaggttaaataccttttgcaaggaggagtgtctgggaaggaaagcttaattgcctaagcccttcaggcctttatgtacctcttgaagctacgtgacctgtggaggggcttcaggcattgcccttacctgagtgatgcccaaaaatctatggaggtctgtggccatgtgtcaagagcctagtgtccaggagtgtgtcaaaatgcctgctgttcctcagggtcaccggggtttccatcctgtgattgaccaggaaccagactgccattcaaggtcatgtatgtaaagtccttaattagttcatttggactagtgtaaaagaacattgtagactgatgatttatgaacagtagaaattattttttactgttctggagacttgtaattacaacttgagtcactgacaaacttggagtgtggcaaa

SEQ ID NO: 2912 - DNA, 1400 bp, mus musculus
tcaatgataccttagtcaaggaagaaagaaagaaagaaattaaagactttttagagtttaatgaaaatgaagccacaacatacccaaacttatgggacacaatgaaagcatttctaagaggaaaactcatagctctgagtgcctacaaaaagaaactagagagaacacacagtagcagcttgacaacacacctaaaagctctagaagaaaaggaagcaaattcacccaagaggagtagacagcaggaaataatcaaactcaggggctaaatcaaccaagtggaaacaagaagaactattaatagaatcaaccaaacaaggagatgtttctttgagaaaatcaaaaagatagataaacccttagccagactcactaaagggcacaaggacagcatcctaatgaacaaaatcagaaatgaaaagggagacataacaacagatcctgaagaaatccaaaacaccatcagatccttctacaaaaggctatattcaacaaaactggaggactgtgcagcagatagcttacatggaaaaacacttttgtttacaacttggaggaaattaattgcatgaagtttttgttgtagttgttgtttgttttttatccctttttagttttttaaggaggaggagctccatgagttaaagaatggtaaagataaatatgtttatgaatactaatcttttttcgtccttctccaaagtgaagtcactcaacatacccaatcctgtttttttgcatatctaaaatgagttagcaagcttaatatttgtctattttaaaatatgcaggacacatgaggttctacttttcttagtgactctgcattcaagaaattttgaattagaatatatgtgggagactgtatttgtcattgtagagatacttctaaaggttctcactgatactgaaaaacggtcatcaatgggaggagaggtccttggtcctgtgaaggctctatgacccagtgtaggggaatgccagggccaggaagctggaatgggtggggtggggaacaggggagggagagggaataggggacattcagggaggaaactaggaaaagggataaaattttaaatgtaaataaagaaaatatctgaaaactaaaaaataacctttgtcttgtttagaaagttctatatcttccatgtagacatgttgacatacttcccttcctccttttttccttaaaataatatttgaattgttagttattcatttgtatctgagaaataaagcctttgttctttatttaatgctgatgattttgcatctcacctttaaggaacaaggcgcaattaaactcttaattatgttgaagtaggaaaatgtgaatatcaatacagcgaactcttgtttgtgtggctattctcagtagtatgtacatctgtggaagc

SEQ ID NO: 2913 - DNA, 1000 bp, mus musculus
catacacagacctgtgctatatcatatgccatgccataaagtgcaagcagtactcttggtaccatgcagtaggtattttcaggcatgagaacagagccatatcaaccacttattccatacatggttcctttgtttagccctggctggccttggattctctattctcctggcacagattcccattagctaaaaattgtgggcatgcaccaaagcaccaagttttgtagtaagtcttttatttttcagctatgttgaagttcaaaatcagaatcttttgcattttaagcaagcacaccactacagagctccacacttactcctagttagtcttcaaatgtattcaaagcagagtgttttctcctgtccctcattaaaatttaaattagggcaggaaatccatcagaaagttccttgcaatcttatatagacacatataacacacagaaatatcccaatttttaaaaaatgaaatatcgaagctctgaactatatttacagttaattccctagcattcctctagcatacccctagcctggctttccaatatgaagtgaggagaactatgttaagatagaaaaccccaactgaagtcatgttagcaccatgcaatcttgggggtttgcaaccccataggaggaacaacaataccaaccaaccagacctcccagagctcccaggaactaaaccaccaacaaaggagtacacatgggggactcatggctccagctgcatatgtagcagaggatggccctgttgaatatcagtgggagaagaggcacttggtcctatgaaggcttgatgcaccagtgtaggggattgccaaggtaaagacgagggagtgggtgggtaaatgagtgggtgagtggaggaacaccctcatagaagcagggggaatggggatggaaagggggggttccggaggggaaacctggaaagggtataacatttgaaatgtaaataaataaaatatctaattaaaaaaagattcagaagccaaag

SEQ ID NO: 2914 - DNA, 1200 bp, mus musculus
aaagtacaaagggactaaagttagagggggtgttatgggggaatggaatagcaggatacaggaaatatgaagtgaaacacagaataactgggagggggctccaactggggaggaaggagggaaagtcaatacaggaggagaagggacaatggggcaaaaaacaccaaggttgtttgataaagcctgtcttagttagggttttactgctgtgaacagacaccatgaccaaggcaactcttataaaggacaacatttaattggggctagcttacaggttcagaggttcagcctataatcaccaaggtcagagtatgtcagtgtccaggaaggcatgatgtaggctgagctgagagttctatatcttcatctgaaggctgctagcaggatactgacttccaggcagctaggatgagggtcttaaagcccacacctacagtgacacacctactccaacaggtccacgcctccaaatagtgcctctgcctaggctaagcatatacaaaccataacagagtatatcatgtttacatgtgtgttccagatgcggccttgtgcgtggccacagctatcctggaattgaccaagcccaagcttcagcctctgtcttggtcccagcatatttcacatttttcttttaatatacttactttctttttcttttatatgcatgaattattgtctacatgtatgtgtgtgaactatgtgaatgccctggtgccctcagaggtcatgagaggacattggatttcagaaattgcaattaaagaaggtggtaagtggccatctgggtgctaagaattgaacttggtccactgtaagagcagtaaatgatcttaaccactgagacaaccagctctccagccttactttcttgtatttaagcagccagagttcaactagagaagcagaactcagaagtgattaataggaagaggtttacttccagccacaggcttcagcactcccaagtcttcccaaggcatttggtaagcagtaggactggtctttaagaaagtcagactgagctcccgacagcgtccccaggtatatgctggatttggctagggatgccttctacagatcaaaattatttcatcagagacacctccatactgctattaaagctaccccattgattaaatcggtccctcaggtcaccaaagagagactcttccttatacagggtgaggtctccatcga

SEQ ID NO: 2915 - DNA, 1000 bp, mus musculus
acagccctcctcccaggccccactgctcagacagcccctccctttctcctctgagaaggggggggcgtaccttgggtaccaacccagcctggcatatcaagtcactgcaggactaggcacatcctcttctattgaggccagacaaggtatcccagttaggggaacaggatccacagttttgaatataaaagatttaagatttgaatctcaaagaaaaggttagattttttttaaaagaaaaatatctctaactgatgatctttttatgcattaaatgcaggcagaactggcagatataaaattttgtcaagtataagacatctttttttgctttggttttagtttaggggacttttttgtttgtaaatttttgttcttgagatggtcttgctaggtagtccaggctggccccaaacttgagatgctctggtctcagcttcctaggggttgaggttacagatgtatactaccacaccttaccctaaacaaaagacttattgacatcacagttagcaagtatactggctgttttttttttgtgtgtcaaacttgacacaaaaaagagtcatgagagaaggagcctaggttgaggaaatgccttcatgagatccagctgtaaggcattttctcaatttatgatcaggaggacagcctagccgatggtttgtggcgccattcctgggttggtggttctggattatatacgaaagcagcctgagcaaaccatggaaagcaagccaaaaagcaataaccctccaaggcctctgcatcagctcttgcctccaggtctttgccttgcctttaagttacagactacactgtcaaagtgtaagccgaagaaatcctttcctccccaacttggtttttgatcacagggtttcatcacagcactagaaaccctaaggcagcatgtaatttaagaataacaaccatttatggtgtttagtaagtactaagcacagttctaagtacttattttacatgatttgagtcattttat

SEQ ID NO: 2916 - DNA, 1200 bp, mus musculus
gaatggttttgttcaaagaaataaataaccatttgtttacttaagcaattggacttgggtggtgatttgaaatattgattgagggatgggataagaacagaagcagagataacaaaacaaaagttagacctgcaagtaaaggcaagaaggattcgtgtttgaatttgatcattagcaatgggaacacagaacaagaaaaatactcagatggcactatttttttaatttctttttttccaattttttatttaggtatttactgcatttacatttcaaatgctatcccgaaagtcccctatacaatcccaccagcctgctcccctacccacccactcccacttcttggccctggtgttcccctttactgaggcatataaagtttgcaagaccaaggggactctcttcccaatgatggccgactggggtactttctctaacccctccattggtgaccctgtgttccatccaatagctgacttctgtgtttgccaggcactggcataggctcacaagagacagctatatcagggttcaggtggcactattaaaagtcccaccagaggcaagagccacagagcttctgaggctgcgccatttttggctccagacaaccggccaccttcagggccagaggacaggtgtccgcccggcctgggaggctcctgcctcaggttccgcgggagggacagacgagagccacagagctcctgaggacacgccattttcggctccagacaaccggccaccttcctggccagaggacaggtgtccacccagcctgggaggcttttgcctcaggatccgggggagccatcttggtttcaggactccgaggaaagtagtctacacaggtgagagtgtggactactgaaacaatggcttctgtgacaggccaaagctacacagcttctcggaaagatcctgttttgggccttcatcttcggccatgaggaggtccaaacaccagataactgtgcaccttccctgaaagaggagagcatgcctgcagagactgctctgaccactgaaactcagaggagagaactagtctcacaggtctgctgatagagggtaacaaaatcaccagaggaacaatctctaaacagagacaactataacaactaacgccagagattaccagatggtgaaaggtaaatgtaagaatcttactaacagaaaccaggaccactcaccatcatc

SEQ ID NO: 2917 - DNA, 1400 bp, mus musculus
ttcctttttagtaatacaaatgcaattatggttggtaattcaattgtaatgtctctaaaatcaactgacccttcttctatacaatccaacctcattaactttggctcaagccttactgatatgcaaagcaacctgaaatctcgcctggcttcttcccaaacccaagaaactacatttttatacgattttttttctgtcattgtttccaagaaaagtaatcatttctcaaactatgtgctatttgtttgaatttccagtctgtaaattgtaaagaaggcttggggatatgaaacaagagaagataaattgcaaattggagctaaagagaaaataaagagatcttagtggattctaattgtttttcacatatcattggaacagctattatccttctttctaaatttatgttgtctgtgcatttatctatattcctatttgtctgtcatctatctgtcttccacctgcctgttagtgtctctttatttggcatggcaagttgtgctgtctttgtctgaaaagaagaaaagaagggggaaatgatgacaaatcttggtgtggcgtgaatagcaacgaggtaaggcggatgcctgatgtgcggatgaatcctggaaatgaagtggcccttgaattaaattaatttaaaatctggcaaatattacccggcatgtttgtcaatgtgctgtataattattaatttgttcattgaagcaactgtataaataaatagaaagcagaatgtcatgattaagcaagcattgaaaactccagggtcaaggagccctgcaatatagcaatctcaatagctttcctgggccctactttcatgtctccttgcaaagccacatgtcgataacagcaaattaattggcccacatttagatgccaacagggcttttgtattctcagtgcacatttttgtctccttggagtgagatgttagtaaccggggtgtttaatattacccctaggggagcaccagaaaatcttaacaatttccttcactagagtattttcattagtgctaaatgctgtgcaatttacatttgaaatcaggtgtaggggcaagcagcacgggacaaaacatgttgctgtggtgcagggggattttggttgttgttgttgttgttgttgttgttgtttcctcttcttccaatattctttatttactgccacaaggtctcaaaattaaagccaacaagtcgaaatgaaatgtttctagatttctctttgctcttccttatttaagggatggaaactctattttccttgcacatccaaagcagattttaccaagataaaggcacactttaaaaataataataacaacgtacctaaaggagagtgactactatcatgtgactgtgataaacagagattcaaggaaaaggacaaaatcctgt

SEQ ID NO: 2918 - DNA, 1200 bp, mus musculus
agagaaggatgggtcagtgttaagagccctggctgttgttccagaaaacctgggcttgatttcccagtgcccacacagcagctcacaaatgtctgtctgtaaccagggtatccaacagcctcttctggccatcctgggcactaagcatgcacaaaacatacagctattcagaggcaaaacacacatgtatataacattttttttaaaatgaaaggaatacaataaccagtgatactcatttcgacaaagtggtaaaatgctgttgaaagataaaatgatggcagcacaagctcacatcccctcctcaacttgcccagtctctccttaggtcactccaccacattcggaccctgcacaaccatgtccatcctctccttccccagcctccagagccctcatcgctgccagctacaaggaagttggtgatggtcctgggtggggaggccctcacccctgcatctgcctgcagcctcccgagtagccagactccattcactcccacccttgcctctcctaccaactctggagcagggtgtaggggggcctggctgtagctcagctgctgtggccaggaggcctgggtgaccccaggggcagctgggcagctgccctggtccaacaatgggtcagttatgtcaacatggaggcctttcttcaggaggtctggaagtggaaagaggagcagagtgacagaatttaccaccatttaaataaacttggcagctccttggtctgggattgagcctgcttcatcatagatcctaaactggcagcaactgtaatggaggcatttgttaggctccatgaagaaggggtcatctaccactgcacccacctggtcaactgatcctgcaccctcaactctgccatttctgacatttgggtggataaaaaagagctgagaggccgcaccctgctctctgtgcctggctactaggagaaggtagaatttagggtccccatgtcctttctcaggtctaaggctcagacaacaatgaggtggtggtggtggcaacaactaggattgaggctgggagatgtggctgtagctgtatgccccaaagattccagataccagcacttaaagggaaagtgtgttgtcaatccgttcttgtcccagagccttgccattgtcttcaataactttgtagacatggagtctggcataggtgctatgaagatcaacctggcccatgacaa

SEQ ID NO: 2919 - DNA, 1000 bp, mus musculus
agtgaccctccaggagaagctcaaggagcagatggtgaagcgccaggatcttctcatcagcaagctgtggtgcacgttccacaacaagagcatggtgaaaggagcctgccagaagacactgagtgacctgcagctggactacctggatctctgccttactcactggcccacaggcttctagcctgggcctgactatttcccactggatgcatcaggaaatgtgattcctagtgacaccgattttgtggacattggacggctatggaacaactagtggatgaaggtttggtaaaagcaattggtgtctccaacttcaaccttcttcagattgagaggatcttgaacaaacctggcttaaaatatatgtcggcggtgagccagatcgagtgccacccatgcctaactcaggagaagctgattgagtactgccactgcaaaggcatcgtggtgacaacatatagttcccttggttctcctgacaggccctgggccaagcctgaagtcccatctctcctggaggatcccaggatcaaagcaattgcagccaagtacaatagaactacagcccaggtgctgatccggttctccattcagaggaacttggtagtgatccccaagtctgtgacaccagtgtgcattgctgaaaactttaaggtctttgactctgagctgagcagtgaggacatgaccactctactcagctacaacaggaactggagggtgtgaacctggatgagctgtgccaaacccaaggattaccccttccacgcagaagtctgaagctgcggcagacggatccccgctcttcctcaagcggcttgcacctgttctgtctgcctcgtctgcccttgcaagtgtcctgtgccatgtgtccctctgaactgggtggcaccttgcaaaccagatggtgagaattaatttgacatagaatctggagggcagtaccagtagccgaggtttttcttcaagccttccttggtctttcttcttacccacccgg

SEQ ID NO: 2920 - DNA, 1000 bp, mus musculus
tgagatcttttatgttccaaatgaattttaagattctcttttatgtttcttttttttagtatttattgatttttttctacttttctttttctttgattaatcattcttttacatctcaaataatatcccacttcctggttacccttccacaaacctcccatcccatatccaccctctctgccctcccctttgcctctatgagggtgcttccccacttacccacccttttctgccccactgctccagcatccccttatccagctggggcatcaaacctccacaggacaaagggcctcccctcccattggtgtcaggcaaggtcatctgctctacctatgtatctggagccatggatccctccctgtacactccttagttggtgatctagtccctgggagcactgggtagttcggccagctgatgttctttttatggggttgcaatctccttctgctcctccagtccttccaccagttcccccatcagggtttcagagctcagtctgatgtttggctccaagcatccacatctgcattggtcagttgctggcagaacctcccaagaaacagccacatttggttcctgtcagcaagcgcctcttgacaatggcaacagtgttggggtttggtgtctgcagacaggatggatcgccaggccaggcagttcccagatggccttttctacagtctcattttttgttcctgttcttcctttggacacgatcatttctgggctagaacctttgagatgggtaggtggccccatccctcaaccaggggccatgcctatctactggaggtggtctctacaggttcaatctcacttgcatttcggctaaagtcatccccgttgggtcctgggagactctcttttccctggcatctggaaccctccagaggctatctccagttctagatggctcagctgttaaaggctaggctcacaatccttttatatttctatgatgaatgggtttagaattagttggggatttattgaa

SEQ ID NO: 2921 - DNA, 1000 bp, mus musculus
aatatgacccaaaaaatattgttttgtgcccttcgctctaagcagctcatcgagcgctgaaaaaattgggtgtgactgtgacgaccccatacctagtctttcacgccccacacagtcgccacagcaacaaaaatacatcgtgcaacaggtgtccctgtggcatggtggggcatcttttgggtatattcccaagagcagtaagctgggtcttcaggtagatctatttccagttttctgaggaacctccagattgatttccagagtggttgtaccagttttaattctaccagcaatggaggagtgttcctcttcctccacatcctctccaacatgtgctgtcacctgaggttttgatcttagccattctgactggtgtgaggtggaatctcagggtcattttgatgtgcatttctctgattgttagacctagtggggaaacacccactcaactcccgattcggtgtgcacccgaaaaaaatcacgaaggaccatctcttgatgtaattacatgagggcatttaatgacagagctctggaccgacatgcatcctgggaacacaggagataatggatgtcggctacgaggcttgaaagctaggagtttttatggggtaaggggcttaggggtgtggaattcagcatagcgacacactattggcttattcaaacattaacagaaagattacagggcatctggactttgttcctgtgggctgggggcttatctttgttcacatagcaaccagttgatgtatgactttacctggagccaagggacaatagacgggggggaggttccggccaaaatgtgtcgactctgacaagatagccttgcctgcgtccttgcattctttttcatctttacagccaagagccctgccctggcatccgggctcatggacaactcttttacatgaatcacaagttacaaaatctcattttccttcatgatcactaaggactttgaacatttctttacttgtttctcagccatttgaga

SEQ ID NO: 2922 - DNA, 1200 bp, mus musculus
tcggtataaattagtccaacaataaaggagtttaataatatgagtctgaaaatttgtttgaattttcacacactttatagttccactttgaaaattatgtaatagtaaagcaaagatacaagtgtgtgttttatgacattgggggtggggcatctctggaacatgtcatatatctaggacaaaccaggaacctgggacaagggagtctcctgggaggatatggttgtgaccctagcttagaattctagtagcaggggatatggagcatgaagtggccacctcgtgtagccaggcaggacttccagtggagggagagtggcaccaatccaaccacaaaacctttgacccaaaaagtgtcctgcctacaagatgtgcagggataaagatgcaacagaaattgagggaatggccaaccaatgactggtccaacttgagacccatcccataggagaaagcccacccccgacagtattaatgatactttgctatgcttacatcaggaacttagaaaaatataattcttattttaagtaagaatataaccaaagatctatcttcttacaaatcaaaagaatatagattctgaggtcactgcgtgggtaaaagtgaacacagttgggtaaaagctcttgccatgtcaccataaacagcaggatctccttcatttacacaggcaaatgacttttaattggttatgtgtaccccactttctatccatttatctatgaacatttatactactttcatgtattaacgattgtaaataatagtgaaaatggggatgcaaatatttctttcagaaaccatggtgggtttttgacttctgtccgagtatctgattgctcgatcatatggtaagtctgtttgaaacctttgaggtgcctgcctctgtgttgttttccacaggggttacaccagtttctgtttctgttaaaagtaacaagggtttccttttattcacctctgtcatactacatttgtcttcctttgtttttttgtttgtttgtttgtttgttttttaggtaatttgatattgtaactcatgtaaggtcagatctcagtgggattttacatttttctcctatgattattgatgttcagtactttcttcatacttattagtcttctaaatgttttcttcaaagaaattcctttaggtgttcttttgaaaattagattatttgtcttctttgttctgtg

SEQ ID NO: 2923 - DNA, 1000 bp, mus musculus
tggggagaaagggcatatttggcttacagctttcagtctgtcatcaaggaaagccaaggcaggagcctagaggcagaaactaaagcagagacaatgaaggaatgctgattactggcttgctcctcgtggcttttccacctccttttcttgtacaacctagacccatctgcccagggattgcattgcccacactggtttgcccattgcattgtccactgaagtttcctcttctccaataattccagctagctgtgtcatttgagaaatctcaacctcaccgtagtaaatgagttaataatcttacccagctacagaccccgcatgctacaatcctgatttatctggtaaaatgcacacttgcatggtggtatgacagttggaggggctaactaactgcattctggttagatatgaggatgccacaggagagacagtatatgctaggtaccgtaaacctggttttgaatggttctcaacatatttctgtcaatctcaaatcctcaggcatggaaatacaggtattgtttaactgtttttacaaccaataaccattatatacttctttttactgctataattattatgcatgcaaataaactgagaatacatataggttctaatccattggggacacctgccagtaagctcagacagttctgttggatacttgcaacaccagtctcacagcagaggaagagatgagttgaacagggaaggctaatactttttaggcctatttcttttgactatgtccaaaatgtacaaggtcagtcttggccccaagcacagaggggtcccattaactgatttcaaaatttcaggagcgttttgtgagatacatgctcaaaaactgagcagtatcaggataatgtaactaggcaaaagggggataatataggaaaatatgtgggtgtaatgcttgaattcttcattgcagttgctataatgacatatacagatctggaaaggcagatatggacagcatacttcaagagtggct

SEQ ID NO: 2924 - DNA, 1400 bp, mus musculus
ctactggagtaagataaaatctcattgattttcatttccttaactgctaggaaaaatgaacattatatgagacctattacatgtttttcaacttcttttgagaattctctattcaggtcccagaaccatttacagaatgcgtcgtattttgttttgttttgttttttctttctattttaagttctttatatattgtgaatattaatcctcagtctactgtataacttacaacctataatacatacacatgtatgtatgtatatatatatatatatatatatatatatatatatatatatatatatatatataatgaaagtagacagggtggggactggggagggagagggaaagaactgaagccctgagggccagcagaaggaatgtaatcaggcaacctcaggaggtagaaggttagggggaccccccagaatgcaccagagacctgggaggtgagagactcccaggactcaaagggagggatcttagatgaaatgccagacaatatgaagagggaacttataaagcccacctccagcaggaagacaggacatcaagtgagggatggggttgccatcccacagtcacatctctgacccataattatttctgtctgaaagaattacagggatggaattggagaggagcccgaggaaaagaaggtccagccacaggcccaaagtgggatccagctcaaggggaggccccaaggcctgacactattactgaggctacagaggtgaccactcacaaaaagggacctagcatgaccacgctccagaagacccaacaagcagctgaaagagtcagatgtatatatttgcaccggaccaatggacagaagcagctgacccctattgttgaattagggaaggctgaaagaagctaaggagaagattgaccctgtaggaggaccagcaccagcagttttttttttcttttgagacaagtgctgggattaaagacgtgtgccaccactgcccaggtaggagcagcagtcttaattaatctggacccctgagatctttcaaacagtggaccaccaaaaagacagctgatatgaggcccccccccaacacagatacaatagaggacctcccagtctgtgttcattcagagatgatgcacctactcctcaagagaatggagggacagggaatttagaggtcaggtgaggtggggtgtgtgtgtggggaggaggtgtgggatgtggagcagtcagagggtggatgggggggggagcagggaatggaatatggagtgcacaaatgaattaaaaatttaaaaaattaaaagaaaaaagaaaatttcaaggaaacttctctttgcaatagatgaagaccaggagagaaaactaaaagcaataaaatgtagagtatggactttgtcttaacacatac

SEQ ID NO: 2925 - DNA, 1000 bp, mus musculus
cagaactcaaaaaggttaacaagctgaaggcccacgtgagactgtttcaatcccacttgggaggaagaagaaagcaatcacggggcgggggaggggggagatgatgaagagggagagaggagcatgggtgggagagggggcagagaagggaaaggggtaacatgatcaggtagggggcaggagtgaagccctgggggccagcagaaagaacggaaacaggcaaccttgggaggtaggaggtggggagacactctagaatgtagcagagacctaggaggtgagactcaaagggagggaccttagatgaaatgctcaactgtggggagagagaacttgtggagcccaccttcagtagaaagacagggcatcaagtggagggatggagttgccatcccacagtcaaaaactctgatccagtattgtttctgtctaaaagaactgcagggacaaaaatggagaagagactgaggaaaaggaggtccagtgacaggcccaaattgggacccatctcaaggcgaggctccaaggcctgacactgttactgatggtacctatgatgtgcttacagacaggagcctagtttgactgccctcggagaggcctaataagcagctgactgagacagaagcagatacttacacccatcgagtggtctgaagtcagggagccctgttgttgaattagggaaaggctggaagaagctgaggaggagggcgaccccataggaagaccagcagtctcaactgacctggacccctgagatctctcagacactgatccaccaaccaggcagcatacactagttgataggaggaccccaacacatatacagcagaggactgcctggtctggactcagtgagagaagattcacctaacccttgagagacttgaggccccatggagtggggagacctggtggggtggagaatggggacattttcttggagtcagtggaggggggaggggcaatgggatgaggaactgtgggagggaagact

SEQ ID NO: 2926 - DNA, 1000 bp, mus musculus
agctaatcctgtacatggctcctttacctacacactggggatttgacctctatctccactctcattagttgggtggcctatttgctcttattaaaaggaaagggggagatgttgggagccgcccccacattcgccgtcacaagatggcgctgacatcctgtgttctaagtggtaaacaaatgatctgcgcatgagccaagggtattttatgactacttgtactctacctttcccgtgaacgtcagctcggccatgggctgcagccaatcagggagtgatgcgtcctaggcgaaatataacgctcctaaaaaaggggacgggtttccgccattctctctcgctggcatctctctggctctgcgcgccctgcgctcgctcgctgcctaaagatgtaaacaatagagcgcgcgcgccggagctctggctcctaaagatgtaattgaaggggctttcgtttttggggctgggcgctgggcgcttgccctcctggctcccaaagatgtaagcaataaagttttgccgcagaagattctggtctgttgtgtctttcctggccgggcgtgagaacgcgtctaataagaccagagctggatcagtacagatgtggatgtacacagccaaatattgaactgagcacagggactcccatggggaagttaggtcaagcattgtaggtgctcatagaaagaacaataataacaaccaaccagacccccaaagctcccatggactaaagagtatacagggtgtacccatggctccagctggatatgttacagaagattgccttatctggtatcactgggaggggacccccttggtcctgtggaggcttgatgacctaggataggatgctaagacaggagtgggtgggcgggtgggggagtaccctcatagagacagggggggaaggagggggataaggagcttgtggaggggaaactgggaaggggaataacatttgaaatgtaaataaataaaataaccaattaaaatgcaa

SEQ ID NO: 2927 - DNA, 1000 bp, mus musculus
tagtaagttggaatatggtcattgggacagggatgtaccttggtcatagaatatttggatacatgcacaccaaattgtaggtttcatctacagtaacatcaaagaaaaattgcaagatgagcaatatatttgttactatccacctttattgttactcagtaaatttgttttcttaaaaatacgaggaggaaggaaaaatgattttaaaaataccctaatagatttgagttgagaacagaaaactagatgaattccacaaaaccaggtgcattgcccatagaccttcctcactctgttactccagcatcagttctcagggttgcctctaacactgcagcagaataccagctgcaacttcccttccctgttctgcacacttcttgtggatttcactgacggttatccactgcttttcctttcccaattcattgctgtgccccagcccccaacctagcagacacagcctgttcaaccacaggccacacctaccaaaacattaggtaggctgcccacagacttcctctactctcactattaccctggactcaattctcagggtttcccctagttctgaaacagaacaccagaggcaacttccctaactctgtccatgcttcctgtggatccctcagagcatctcccactggcttcccttccccagcctccagtactagcaagaattctcccatgaacacaacagtcaaacagacccataaaacagtcaacattcagccaacacactatcgctatatccagagaggagacagaaacgaagagggagggaaccctacataacaaagacaaacccagaatacagctcccagacctataatcacccaaaactagatgccaacataagaacacaataacagtcaggacaatatgtcaccaccaaagcccagctatcctacctacagcagaccctgaatattcccagcatagctgaaagcacaagaaaaagaccttaaaagcaactatgtgaagatgatagaggtctata

SEQ ID NO: 2928 - DNA, 1000 bp, mus musculus
aatgtgaagtggaagattttacattcttaaagacacaaagcctaccctggtcattaataaggttctatgcagactgcagatatcaactccttgatacttctttttgttttgttttgttttgttttgttttgtcttgtcttgttttgttttgttttgtttttgagacagggtctcctggctgtcctgagtttgctatataaaccaggtttgctttaaactcatagaaatgtctacctctgccactcaggtactagagttaaaggcatgtgtcccttcacccagcacaaaaacttagtttttaaatgaccaatatttgtttatttgtttgtttatatgagggctctgtgtgtatgtacacctgcatgccagaagaaggcattagatccctttatagatggtcatgagccaccatgtggttgctgggaattgaactcagaacctctggaggaacagccaatcgtctttttttgggggggtggggtggggttcgagatagggtttctctgtatagccctggctgtcctggaactcactttgtagaccaggctggccttgaactcagaaatctgcttgcctctgcctccctagtgctgtgattaaaagcatgtaccaccacgcccggctcagccagtcctcttaaacactgagccatcttgccagaccaaatgaccaaaccaaaataatctaaataatcttgaaaaacttggtttggaggaaatggggagcatatgtagacagccaatagttttcatgttctaatactgtgaatttaactaaaaatgattttaacccttccgctcgactcgagactcgagccccgggctaccttgccagcagagtcttgcccaacacccgcaagggcccacacgggactccccacgggaccctaagacctctggtgagtggaccacagtgcctgccccaatccaatcgcgcggaacttgagactgcggtacatagggaagcaggctacccgggcctgatctggggcacaagtccc

SEQ ID NO: 2929 - DNA, 1000 bp, mus musculus
aggaacaacaatatgaaataactagtaccctcagagctgtgtctctagctgcatatgtagcagaagatggcctagttggccatcagtgggaggagaggcacttggtcttgtgaagatcatatgccccagtacagggtaacaccagggccaggaagcagaagtgtgtgggttgtggagcagggtggggggaggatatagggtcctttggggatagcatttgaaatgtaaatgaagaaaatatctaataaaaaagtctcagcagttaagggtactgacagttcttccaggtgacctgagttcagtttctagaacccacatcagtcaactcacaaccacatatcttttgaccttcacaggaacacacacgcacacttaaaagtaaatcttttcacaactaagaaattaggggccggagaggtgtctcagctgttaagagtactcaatgttcttggagacttgagttcagttcccaggacctacatgtcagcttacagccatccataactccagctccagaggatccaatgccattttctgacttctgcaagcatcagacatacatgtcattcatgaaaaatgatcataatcacaaaataagtacatcttcaaaattaaaaagtaaattattgcaaaaaacccttccaaatctagggaaggatatggacatccaatacaggagggacttggagagctatatggtgtaaaaagataattagcctctgcaagttggcctctatcctccacatggatactatgacatgtgtatggcccaccctccaaacacacacacacacacacacacacacacacacacacacagagagagagagagagagagggagggagagagagagagagagagagagagagagttttaactctctagtttaaagaacaagtaaatgattggtttagaggcaagatccacttatctgatatctgtaagaatcacactttattggtggaaaactaaacataccaaatataaaggaatggaaaa

SEQ ID NO: 2930 - DNA, 1000 bp, mus musculus
ctgcctggaatggaggaaaagaaggaaaacagcagcagtccactagacaaagccaatgtgcaggggagacctgatgagcactgtgaagtgactgtggatgctataggagctaaggggaagcagagaacacaaggagggtgtagagactgggggagggcttcatggaggtgaggcccaggtggcccaggggcaagagggccaacactgcctgtggccagagtagcctggctgaagggtaaggcctgtgtcagggagctggaggaagaaaaggctgggaagggaagtgaagtgtgtgcattatgaggcaggacacctgccaactcctaggacaggtcaaagttgccatttctgaagatcaccatgttaactacagggaggaccacaagggcagggcagggcagcctaaaggcaagatgaccatggaggcacctgtcttcacaatccaaaccggttagtaagggtggacctcaggtattgttgggagacatgggagggaggaagctgtagaagacagacacacagcagcagagcccaatttgctgaccaatggagatggtcaaacagaggagtattaaacaagacgatactgtgcacatacaagacggtgctaagagcaaaaccactaaggggtagagagctgctagggaggatgagggtgagcacacttcacagagcctgtcctctaagaggtagcctgcactgtgggacacacagcaggagggagggatgggacatatccttctagaagtgtcaggtgtgaagcatgcatgctttgtggagggaacacaagccatcatgcagactggtcacatgtgtctttggggacagagctgggatctactgactagactgggagtccctgttgacaggactcatttcatattctaagaggacactggttcaaatggaattgatctcctggctggaggaagatcctgaaatgctaacaactttatgtgaggaaaggccaggaagaaaccctcctctctcctccctgtcg

SEQ ID NO: 2931 - DNA, 1200 bp, mus musculus
agaccaagacacaatacatgctgataaacctgcaggactaaaaataagaataggtgttctcctggaatagagagaaagaagaaaaatagcagcagtccactagacaaagccaatgtggaggggagacctgatgagcactgtgaactgattgtggatgctataggagctaaggggaagcagagaacacaaggagggtgtagagactgggggagggcttcatggaggtgaggcccaggtggcccaggggcaagagggccaacactgcctgtggccagagtagcctggctgaagggtaaggcctgtgtcagggagctggaggaagaaaaggctgggaagggaagtgaagtgtgtgcattatgaggcaggatacctgccaactcctaggacaggtcaaagttgccatttctgaagatcaccatgttaactacagggaggactacaagggcagggcagggcagcctaaaggcaagatgaccatggaggcacctgtcttcacaatccaaaccggttagtaagggtggacctcaggtattgttgggagacatgggagggaggaagctgtagaagacagacacacagcagcagagcccaatttgctgaccaatggagatggtcaaacagaggagtattaaacaagacgatactgtgcacatacaagacggtgctaagagcaaaaccactaaggggtagagagctgctagggaggatgagggtgagcacacttcacagagcctgtcctctaagaggtagcctgcactgtgggacacacagcaggagggagggatgggacatatccttctagaagtgtcaggtgtgaagcatgcatgctttgtggagggaacacaagccatcatgcagactggtcacatgtgtctttggggacagagctgggatctactgactagactgggagtccctgttggcaggactcatttcatattctaagaggacactggttcaaatggaattgatctcctggctggaggaagatcctgaaatgctaacaactttatgtgaggaaaggccaggaagaaaccctccctcccctccctgtcgtccattagtgtgattaataataaatatccccgggcacttggtgctggcaagatgcctcgtcactgctgttcattacccatccgccatccccagcttccaggctgcccattaggtgctatggtgagaggagtcataaaatgcacc

SEQ ID NO: 2932 - DNA, 1200 bp, mus musculus
aagaagctataattactgaagcacaaaatagtaataaggacctcaaataacaaaatgatcaaaaagccaaaataataaaatggcaacaaccaacacacacctttcaataatagctgtaaatatcaagggccttttcttcccaatcaaaataaaaagacacaggattgattgaggaatgggcagaaacctagcataactgtcctactagggggctctacccaacagctcaccaaaacacatgcagatacccatagccaaacattagatggagcttggggactcttatggaagaataggaggaaggattgtaggctacaaagggaataggaactccactggaagaccaatagagtcaactaacctggacacttggagctctcagagattgaagcaccaaccaaagaacatacatgggctggacctaggccccctgcacatatgggacagatgtgcagcttggtcttcatgtgggttctccaacaacaggagcaggagctgtccctgagtctgttgcctgtctgtggatcccatttccctaactgggcaacgttgtctggtctcagtgggagaggatgcacctagtcctgcagtgcagggttggggtagggtggggtggatgatgttgggttgtaaagtgaatatataaattaataaaaaaaaaaacaaaatccacttttatgttatcgacaggaaactcattttagcttaaaaaaaaaaaaaacattaccttaaagtgaaactatagaaaaagtattccaagcaaatgagaccaggaagcaagcaggtattgctaatttttttttttttttggtcttttcgagacacggtttctctgtgtatccctgggtgtcctggaactcactctgtagaccaggatgacctagaactcagaatctgcctgcgtctgcctcccaagtcctgggattaaaggcgagcaccaccactgcccagctgggtattgctatcttaatatcaaataaaattgacttcaaactaaaacttttcagaagatataaacagtgttcattctgacaaagggttaaggcattataatcctaaggatatgtatgtactattccctggcacaactttatagacatgtactactggtattaaagaaacagattaacatcaacctagtaatagtaggtgtctcagtacttccattttctccagtagacaggatatccagtttaaaaa

SEQ ID NO: 2933 - DNA, 1000 bp, mus musculus
caaactcagtggacagccccatggtccccagatgaggtaaaacttccaggtgctataacaattccaggatcttaggatccctggattcctggagcttggtcacatcaggatctcaggggctcagaggaagcatgactgccaagacctctgagacacccataatctcagcatcagaggatcacagaatcacaggaccacaaagaaagctggactcagagttctgactcaactgggattataggaaggacaggatccagtcagatatattgagggcagggagcacttgagataatcagatggcaggaggcaagcataagaacagaagcaacagaaaccaaggttatttggcatcatcagaatccaactctcccaccatagcaagtcctggatacaccatcacaccagaaaagcaaaataagtatctaatgtcacttctcataatgatgatggaggactgtaagaaggacataaataactcccttaaagaaataaaggagaccccttctggtcggcgccagcaccaggtcaccttgggcacagagccggcggacacccccgaggtcccctagaggactctccactcgatcttagtaccactggtctgtggaacacaacttctgttccaatccaattgctcgggacctgagacagcattagagaagcaggaaacccggcctgaccagggtcacaagtcccttctgatcggcaccagaactgggtcaccttgggtatggagtcagcagacacctctaaggtcccctagaggactctccacacaatctttggaccaccagtgagtggaacacaaattcttttccaatcaaatcatgcaggacctgagacagcagtagggaagcagaaaacccagccggaccagggtccaaatcccttctggtctgctccagcactgggtcacctaggttcagagtcaggcaatacccccaattccctagaggacggcttctgaggcagaccccatttcgggctcaagacatccggg

SEQ ID NO: 2934 - DNA, 1400 bp, mus musculus
ctacagaatattccacccaacaccaaaggatacacattctactcagtagtacatagtagtacaaagaccaaccacatcttgtgacacaaaataaatctttacaaattgaaaagagagaaataactccttgcatcctactgaataacaatataacaaaaactgtctagtaaaaacccaaactcatggagattaaacaactcattactgaataacaactgggtcaaagaaatcaaaatagaaatcaagaccttcatggaaataaatgaaagtgaaaacacagtacaaaaaacaaacaaacaaacaaacaaaaccaattcctatgagggaaaaatatggctctaagtgactacatttaaaacaaacaaacaaacaaacaacagaaaacctgggaaacatgaagcagctctcggtgagtccgagattcatcttcacagggaggaggctgctcttgatactggcctttgtggggctctgaggagcacaacccagctcttactttaccgttccactgccagcactgctcatttgctgtctcagtttactctcaagaggaacagcctgtcagctgtgcttgggtgtgggtgggagcttgggctaaaggcatggctgctggaagcccacctttgtgtacgtcagtcaataccacaggaatagaacaagcctggagctgggatcctaaatatgtagtaaggtctcatagacatcaggtgagagccatcctccagcatctgtgtgcctcactgtctcatttaagaaatgagtgtccacctacttgctggttagtttacactacaactccaaggttattgtttagcagtcttaataagactgcaatctagttcaaggatgacattcagagataaaacaaactttattgattttcacgaatacaaaatttatcatatcataaaaaaaagaaaagcaaaaataattgacttaatgctgcaactaaaaaatttcaaaaaagcaaggacaaaccaactctaaacacagttgatggcaagaaataataaaattcacaggagaaaacaataaaaaagaatcaatgaatccaagagctgattgtttgagaagataagcaagattgatagactccttgtccagctaagcaaaaagcaaaaacaaaacaaaacacccagaaacacaccaacctagctcaaacctctgaactttctttgtatgtctcatcttgcctttctccacttccctcaactatctgccatctataaacccatgagccgatttctaggcctgtggccatgaattcttcattcatgaggcccacttgtgtgacttaactcagatgcatagtatcttctggtactatggaaactagatggaaggaaggaggctttcaaatgagtgataacaaatatctgcctaattggcttaaggcctga

SEQ ID NO: 2935 - DNA, 1200 bp, mus musculus
tggatgttttgaattaggatctttttacattttcattttctttgactgttgtgctgatgttctctatggaatcttctgcacctgagattctctcttccatttcttgtattctgttgctgatgctcgcatctatgtttccagatctctttcctagggtttctatctccagcgttgtctcgctttgggttttctttactgtgtctacttccctttttagttctagtatggttttgttcaattccatcacctgttagatagtgttttcctgtaactctctaagggatttttgtatttcctctttaaaggcttctagatgtttacctgtgctttcctgtatttccttcttaaagtcctccatcattatcataagaagtgactttaaatccatgtcttgcttttcttgtgtgatagtgtatccaggactttctatgttgggagagtttggttctgatgatgccaagtaaccttggtttctgttgcttctgttcttacgcttgcctcctgccatctgattatctcaagtatttgctgtcctcaatatatctgattggagcctgtccttcctatagttccagttgattcaggactcctcagagtccagctttctctgtgatctttgatggtgggctcctgtgaacctgagactctgggtgtgtcagagctcttgacagacaagttcctctgagaccctgaaatactggtgtgacccagctcctgttatcctgggatcctgttgtcctaagatcttgggcgtgttaaagtgcctggaagtggtgtctcctttgaggagcatggacctgtgtggtcaatggtcctaaaattgcatggagagtcctctagggaccatgggggtgtccgccaactctgcgcccaagatgacccagtgctggcacctacaagaagggcttattttttattttaaagaatgctttattagatatattctttacgtttcaaatgctatcccgaaagtcccctataccctacccccccagccctgctccccaacccacccacctctgcttcctggacctggcattcccctgtactgggccatataatctttgcaccatgctttattttaaagtgcaagttataaagaagttggattaactgtctaaggtctcacagcaagtggtttgagggtagtttcatacatactagctacatttctaaaggaggtatatacagaggtatcaa

SEQ ID NO: 2936 - DNA, 1200 bp, mus musculus
gtacagttgctgtcattctatgtgttattgtttgaagtgatcaaccatggattctaatatggtcaagaagatatgtatgaagggggtaggttggggaagtcaaatgatttagaaattaaatatggagacatcttggatcccggactccaccaagactaatctccacaggtgagagtctggactacagaagctaatagcttctgggacaggcaggagccacagagcttctgaggcagtccccttttcaggctccagacatccgggcaccttccctgccagaggataggtgtccacccagcccgggatggctttggctgagcatctgcaggagacatcttggctcccgggctccactgagactagtctgcacaggtgagagtatggactacagaagctaacagcttctgggacaggtcctgtttcgggccttcatcttctgccaggcagcaagtctgaacaccagatatatgtgcaccttccctgaaagaggagagcctgcctgcagagagtgctccgaccactgaaactcaggagagagctagtatccccggtctgctggtagagaataagagaatcatgagaggaacaaactctaactagagacaactataacaactgactacagagtttaccagatggcgaaaggcagacataagaatcttactaacaaaaaccaagaccactcactatcatcagaacccagcactcccacctcagccagtccagggcaccccaacatacccgaaaatctagacctggatttaaaggcatatctcatgatgatggtagaagacatcaagaaggtctttaataactcacttaaagaaatacaggagaacacggctaaagagttgcaagtccttgtagaaaaacagggaaacacatccaaacagatgatggaaatgaacaaaaccatactacactgctaaacaggtagaagaccttaaagaggaagcacaaaaatcacttaaagaattgcaggaaaacacaaccaaacaggtgatggaattgaataaaaccatccaagacataaaaagggaagtagacacaataaagaaaacccaaagtgaggcaatgctggagatagaaaccctaggaaagaaatctgaaaccatagatgtgaacatcagcaacagaatacaggagatgggagagagaatctcaggtacagaagattccagagagaacatcagcacaaca

SEQ ID NO: 2937 - DNA, 1200 bp, mus musculus; identical to SEQ ID NO: 2936

SEQ ID NO: 2938 - DNA, 1000 bp, mus musculus
agatggtttttttcaattattttacctgtttgttattgttttcctctacctctttaagggatttttgtgtttcctctttaaggaattctagctgtttacctgtgttttcctgtatttacttattaaagccctccatcatcatcattagaaatgattttagatccatgtcttgcttttctggtgtgatggtttatccaggacttgctatggtgggagagtttggttctgatgatgccaagtaaccttggtttctgttgattctgttcttatgcttgcccccctgccatctgattatctcaagttcccttgatatatctgattggagcctgtccttcctataatcccagttgattcagtacccctcagagtccaactttctctgtgatcctgtgattctgggctcctgtgaacctgagattctgggggtgtcagagttcttggcagtcaagcttcctctgagacccagagatactgatgtgaccaagctcctgttatcctaggatcctggaatcctaagatcctgagcgttgttacagtgcctggaagtggtgtctcctctgagcaccatggggctgtctggtgtgtttgaaaccaaggtataccagtactgatcagaaagaacccgagctactcatcaggcagggctcccattcccttgctcctgctatcattgtcccatcacaattggattggaactgatgttgtgttctgctcaccagtgatcctaagatcgagtggagagtcctctggggaccgtaggaccaatgggcacgttttgagcccaaggtgacctggagctggagctgacaggaagggacttgtgcccctggtcaggctggttttcttcttccctgctgctggctcaggcctggtgcccacaaacatattttttatgttgcagacattctttatatcttttggactttttaaaaaattaagcataaatgtcctttattttgagggctgttttttcacttttaaataatttcctttggtaatg

SEQ ID NO: 2939 - DNA, 1000 bp, mus musculus
aatctgcctgcctctgcctcttgagtgctgggattaattcttaagacaaaggatggaactagaaaatatcaaccagagtgcggtaacccgggcacaaaagaatgcacatgtgatgcactcataatatactgataaggtatattagcccaaaagctctgaataccgaagatacaattcacacaccatatgaagctcaagaagaaggaatacccaagttaggatacttcattccttcttagaagagttaacaaaatactcatgggaggagatgcagagacaaagtatggagcagagactgaagggaaaggccatctagagactgtcccacctggagatccatctcatatacagtcaccaaactcagatatattgtggaatgcaacaagtgcttgctgacaggagccttgtatagctgtctcctgagaggctctgtcagagccagacaattacatatgtggatgctcttggccagccattggactgagcatggggtccccaatggaggagttagagaaaggactgaaggaattgaagcggcttgcaaccccataggaggaacaacaatgtcaaccaaccagacctcccagagctcccagggactaaaccaccaaccaaagtgtatacatggagcaaaccatggctccagctgcatatgtagcagaggatagcattgtaagacatcaatgggaggagaggctcttgatcctgtgaaggttgaatgccccaatgtaggggaattccaagacaggggagtgggagtgggtgggttggtgagcagggggaggaggggtgggatagggggctttcagaaggaaacaaggaaaggggataacatttgaaatgtaaataaagataacatctaatttttttaaatttttttatttttatttttatttttttattttttttgtaaaggaaagtcctttcttacactggtgttacaggatatggcctccgtgttcttctagaagttttcatgtttcaggttttagatttagtt

SEQ ID NO: 2940 - DNA, 1200 bp, mus musculus
caccctttcttcagttttacctttcccctttgttttagaaaatgggaagccatgtcctaagaggtatcaaaaattatttttgtccttcatatgtctcctggacaacatttctgccaatttattctcccttaaaaattttaagacgatccattcaggtcggggccagccccaccatcttccacctgaacccaccggagccctctaggagccctagagtactctccacacctcaggacctctggatcacctcgggatcacgagtgagtggaacacaatatcggctccaaagaattgaggagggtcttgtgccagcaggaacagggatggaggaacccccgcccgaccagtggctgggatccgatcaggtcagggccatccctgccatcttccttctgaacccaggggaggattcaaagatgtccagagtattctccatgccacaggtcctcgggatcacctctggatcacaggtgagtggatcacaacatcagctccaaagaattgtggagggtcttgtgcccgcaggaacagggatggaggaaccctgcctgaccagaggatgggatccctttaggttggagccagcccagccatcttctgtgtgaactaggccgagggtgtctattgccccagaggactctccatgctacaggaaccctagcactcccaggacctcgtgatcacctgagagcaagtggacaacagaagcaacagagcttcttggacagggtcctgtcattccttcatccttaggcaggagggagagctgagatccaaaaccttgggcactttccttgccagaggagagtaggcctacagggagggctctgaccccaggattcaggaggtagaccagagctccagacttctggacatctgccctgcaagaggagagcttgcctgcagagagtgctctgacccctggaactcaggtgagagttggactcccaggagtgatgacagaggctaagagagtcacaggaggatcaagcttcagccagagacagctaggacattaacaccagagattaccagatggcaaaaagcaaaagtaagaatcttactaacagaaaccaagaatactgggcatcatcagaacccagttcacccactacagtgagtcctggataccccaacacaccctaaaagcaagactcagatttaaaatcatatctcatgatggtggtagaagattttaag

SEQ ID NO: 2941 - DNA, 1000 bp, mus musculus
gaggtaacccagtcacaaaagaacacacatggtgtgcacttgctgataagtggatattaccccaaaggctaggaatacccaagataaaactcacagtctatatgaagctcaagaagaaagaagacaaaaatgtgaatgttccagtacttcttagaagagggagacaaagcactcatgggaggtagaggttggaagggacttgggaggaagagagaagggggagggtggaaaggagggaaagtgggggcagatcaggtatgggaggagacaggaatttgaggatcaggaatttgaacagaggtgtgtagcaattgggaatgggaaactgagggtagccaccagcaagtcccagatgccaggaaagcaagaggctcccaggactcaacagggatgacactacctgaaatgtccaacaaagtgaagggtgaacctgtagaggttaggcaatcccccatttgggggtgggggcacccactcacccccaaatttttaacccagaatggctactgtgtaaggaaacacagggacaaagtgtggagcagagactgaaggaaaggccatgaagagactgccccacctgggcatccatcccatatatagacaccaaacccagacactactgcatatgccaagaagtgttttttgacaggagcctgttatagctgtctgctgagaggctctggtagagcctgacaaatacagaggcagatgctcacagccaaacactggactgaacccaggaatcccaatggaggagttagagaaaggactgaaggagctgaagaagttttcaaccccataggaagaacaacaatatcaatcaaccagactctcccagtggtcctagagactaaaccaccaaccaaagaatacaaatggagggacccatggctacagctgtatatgtagcagagggtggcattgtctcacatcaataggaggagaggcccttgttcctttgtagtctcaattccccagtgtaggggaaatgccagggtgg

SEQ ID NO: 2942 - DNA, 1200 bp, mus musculus
tttttctagtgaatattgccaaagttagctccaaaattaaaataaaatttaaggctactatgatccaactgatttatttcattctactttttagccaaacttggcaactgatgtgtatgaacacatgcatatacttaatgttatattgctgcattaatactttatcaagtatgtgtacatacatacacatatccagtaaggctggagcaacaactacaaaggtgacagtgcttctttacttgtcctatccctgtcatttgcaccatctctgaacctgttcccattgtctttgttccccagaaattaacttagaagagagtgaatgcaggcaggcaggaaagagaaaaggaatgacgtaggcattaataataatctcaacattagctcactgtgccctgaataaatgatgctggctaaatttcttctggatgtaaggcactcatgctgctgggtgtgcagctgcttctggccaccctttgtggctgttggtcttctcaacttgcagaaatgcctgtggcatgaagcatggtctctctatctcggatgggtagaacttgtaggatgacaagtctaaattaagaactcaagactttaggctatttgctttgcctgggcagtacagaagtcctgagattaaaaaagggcaataaagatagcagctggcccatgccctacccattcctctcctgcaagctcaatcaccacccatgtgcacaggtttgtcacaaatcaaagcagttgctcagcttggccttgagaataaatctttcctttaaaaaccccgctttctaatatgtatagtgcactcatcaattccagatgtttggcctgcagttcagatgttgctgcaaacagttaaatactgtctttcagttttctcttttctggtctggcccagatccatttctaccacagctttcacttatcattttcctatttccatattatcaagcatcatatcacctttctagatcactctttgtgaagttttatatcttcttttacttagagtgaatggtcccaggtacagctctgccaaaagcaacattcatactcattgctgactcaagctacacagtcatcatgagaagtttgcttaggttaaacacttcagaccagtggtctttatttcttgttatattttggaagctccaatatatattggtatctgggtaccactaatgagtctcagatataatt

SEQ ID NO: 2943 - DNA, 1200 bp, mus musculus; identical to SEQ ID NO: 2942

SEQ ID NO: 2944 - DNA, 1000 bp, mus musculus
agcctctctagttacaagtgtttttctccactctagccacaaccacgcccccacccatcaccacaggtcacatcacctcaccaggcaggcttgctcagccaatcagggaataagggcgggccatccaccaaacatgggcttgtttactacctggaacagacttccatcctgctgaccaggaagtccagaatggctccctacaattcccccttttatattttttttgaacaaactccatgggtgaagatagaggtctgatccccagtgtgcagaaataggggccatgtacaggattgactcttaggctcacaggtttttacccagagcaaccctgacctgctcccgtgccgttttttcctgggggaaggacactaggacactcaaccctcatgtaatcagacatacctcccagagattgtcaaacagcttccagactaacctctgtgcagtgcttagccgtacaaccctacagagcgatggcttcattgttcactcttcatggcagcaagccaaatctgaggtgactgccctgcttccactgtggcaaaagcttgcaccaccatggcggcagtgtggacctgggcattccgtaaccgacacatacaccatacacataacatgcatgccaaaacaagggccatagcgaaggcacctatcccagtccattctttgcagatgccaagccaggatccactcagatagaattcacggtgacaatcgccgaccaaagctcattcatcttgccatcaaaattttatagtccactttaaacatcacggtattccccatctgggttccacacccatcaggggcagacacgtgctcatcaccagtaagatcagcttcttcattttgacagcatcgcactagctgctctggaacccacactggctccttgcgattctgtggaaacatgcaaacaaaccctctcccccaggctaacacagggtccggaccattccttgatcctgtaggcacatccttccatttagcatacccc

SEQ ID NO: 2945 - DNA, 1000 bp, mus musculus
ctttttttttcacttcagattttatctccctccaggtctaccttcatactattccacattccatacctcctccctatccccttgtctccaagaggatatcttcatccaaccccccacccacaccagacttctaaactccctggggcctccagtctcttgagggttaggtgcatcttcactgactgaaccctgatctggcagtcctctgctgtatatgtgttgggggcttcatgtaagctgttgtatgctgcctgtttggtgatctagtatctgagagatctctgaggtccaggttagttgagactgctggtcctcctacagggttgccctcctcctcaacttctttgagattttcccctaattcaaccccaagagtcagcagcttatgcccattggttgggtgtaaatatctgcatctgactctttcagctgcttgttgggcatttcagagagcagtcatgataggtcccttttgtgagcacggcatagcctcagtaatagtgtcaggacttggggcctacccttgagctggatccaactctgggcctgtcactggtcctccttttcctcaggcttctctccatttacatgcctgcagttctttcagacaggaacatttatggatcagagttttgactgtatgatgacaataccatccttcacttgatgccctgtctttctgctggaggcaggctctacaagttccctctcctcactgtaggacatttcatataaggtccctccttttgattccttagaatttctcacctcccaggtctggaggaaccccctacctgtcctatctcccaagattgcctatttccattctttctgctggaccttggggcttcagtccttttcccctacctaataccagatcatgtcatgttcctctctttcccccatccccattcctttccagatccctccctccctccttctctccctccctccctccctccctccctccctccctctcttcctccttgtgattgctttc

SEQ ID NO: 2946 - DNA, 1000 bp, mus musculus
ggtgttcacccacaccctgccagccctctccactcactggggcctcaagtctctagagggccagaccaggcagtcctctgctatatatgtgtcatgggtatcagaccaactcatatatgctccctggttggtggctcagtgtctgagagatctcagaggtcaggattagttgagactgctggtcttcatatagggttgccctcctcctcagcttcttccagcctttccctaattcaaccacaggtgtctccaacttcaggccaatggttgggtgtaaatatctgcttctatctcagtcacctgcttgttgggcctcttagagggcagccatgctaggctcctgtctgtaagcacaccataccaccagtaatagtgtcaggctttggagccttcccttgagatggatcccaagttgggcctcctttccctaggcttcttctccatatttgtccctgcagttttttttattacatattttctttatttacatttcaagtgttatcccttttcctggtttccccttcaaaatccccttatccctttccccctccccctgatcacaaacccacccactcccgtttcctgttctagcattcccctacactggggcatagagccttcacaggaccaagggcctctcctctcattgatattccacaaggccatcctctgctacataagcgtctggagccttgggtccctccatgtgtactctttggttggtggtttagtccctgggagctctggcatttctcctatggggctgcaaacccctttcagctccttgggtcctttctctaggtccttcattggggaccctgtgctcagttcaatggatggctgtgagcctccacttctgtatttgtcaggcactggcaaagccttccaggagacagctatatcaggctcccatcagcaagcaattgttggcatccataatagtgtctgggcttggtgattatataagggatggatccccaggtcgggcagtttctggatg

SEQ ID NO: 2947 - DNA, 1000 bp, mus musculus
attagattttttctttatttatacttcaaatgttatcccctttcctcatttcccctctgaaaatcccctatcgcctccccctgttcactaacccacccactcctgcttcctgtcctggcatcaccactacactggggtatcaagtgccacactgtcaagggcttctcctatcactgatgtcccacaaggccatcctctgctacatatgtggctaaagccttgagtccctccttgtatactctttggttggtggtttagtccctgggagctctggggatactgattggttcctattgttgttcctcctataaggctgcagatccttcaccttcttggattctttctctagctcctccattggggaccctgtgctcagtccaatggatggctgccagcatccacatctatatttgtcaggcacttgcagagactctcaggagtcagctatatcaccctcctgtcagcaagctcttgttggcatccacaatagtgtctgagttggtggttgttgggtggatccccaggtgggacagtcgctggatagcctttccttcagtttctactccaaactttgtctctgtatctcctcccatgggtactttgatcctacttctaaaaaggaccgaagtattcacactgtggtcttccttcttctacagctttatagaatatcttagattagcctactgactctggcactaaacatctaaaatttgtattcatcaatatctacttcaatgaccaaaataagccattaaacacaaattatcatctaatattattaaatgtgattttgtaatgtggtaaggatgggaaacataaggtttcaacatgactgatgacatttctattcctttttccccctacctatagctactttcaaaacatttaagtttcacacatattctggcaaagagactttgtgcaatgtccagttgtcaaaagaagtgtggtgaatatattttaggtgccaaatttttagaatttctaggacattttg

SEQ ID NO: 2948 - DNA, 1000 bp, mus musculus
attgttattgctacatattcataaaatatagccttttgagtctgtttagtgatacacacacatacacacatacaccacacacatacacacacacgcgcgcgcttgcacgctttcagggttgaccacttagttgctggtagttcattgctgagggatggggtcacgtgagattttccccttctataatagagtgtctgttggtgttcttgtgcatgtcttgtaccttccctctcatatctaggagacacaagctcacagcagatttcttgattctctggatcttaaaatctctctgtacccctttcaacaatgttctttgagccttaggtgtggaagtcttattgtggatgtatccaatcagtgctggttctccaccatcagttgaaatctgcatttgaaccagttgtggttttctgtaacagtctccatcttctgcaaaaaaaaaaaaaaaaaaaagctcctttgatgaggtgtgagagccacaattatctatgaatatacagataagtatttaaattcagttagaaattaagctggctttgtataatggtagtactatgttctgttctaaaatccatgacctcactagcctgggaaagatagctagattaccagtaccaggcctgattttttctcttgctgtgcagaccttaaatccagtccaacagctgctgcttactatctatatatgagttctattattgtatctgtaggggtagagttttatgctggtcattgttgtgtttcataaacatcattgctggtttgtatgattagttgcttccctcccttggccttttgcacagtactttctagtatatgaaagctactgctcagggaggaagctttcagctcagatctagcttgcatcctctagtcctgtgtccgtccataggatatagtgtctttagaaatagagactgatgttcaacctctgggaggtacccaaaggcaacaacaatagcttatatgattttgggaatctctttgggaagggatt

SEQ ID NO: 2949 - DNA, 1000 bp, mus musculus
ctatttttatttttctacatacagactgccagttataccagcactattttttgaagatgctttccttttttccattgtatactttggctactttgtcaagtgttcataactgtccataactgtgtgggtttatttctgggtcttcaattctattccattgattgatctgtctgtctctgtaaaaataccatgcagtttttatcactattgctctatagtacagcttgaagtcagggatggtaattcccgcagaagttcttttattattaggaattggttttgggcagaaagtagtctgcacaggtgagagtgtggactgcagaagctaacagcttctgggacaggcaagagccacagagcttctgaggcagcaccattttcgggctccagacatccagccaccttcccagccagaggaaaagtgtacgcactgcttttgcctcaggatccacaggtgccatcttggttcggggactccacagaaagtagtctgcacaggtgagagtgtgcacacagaagctaacaacttctatgacaggccaaagcaacacagcttctgggaaaggtcctgttttgggccttcatcttcggccaggaggaggtccaaacgccagatatctgtgcaccttccctgtaagaggagagcttgccagcagagactgctctgaccactgaaactcagaggagagagctagtctcccagctctgctgatagagggtaacagaatcaccaaaggaacaatctctaaacagaaacaactataacaactaactccagagattaccagatggcaaaaggtaaacctaagaatcttactaacagaaaccaagaccactcaccatcatcagaacccaacactcccactttgcccagtccagggcaccccaaaacacctaaaaagctagactcggatttaaaagcatatctcatgatgatggtagaggacatcaagaaggactttaataactcacttaaagaaatacaggataacactgctaa

SEQ ID NO: 2950 - DNA, 1400 bp, mus musculus
ttacccttttctttgctatctataatgaattctaaaacaggtatatattgaacatctatcctatttttcacatccaacagcttaagcacaaagacactgacttgtctaaatttacattcctagtttagtgactatttgaatctgaaatagactttatttggcaatgtaactcttttccgctgtattatgtcaatcattttgaaaccatttataatatattattacatgtgaacatgtcttttctttgttactgttattcttttcaggatacatatgcatttttaatttgttttttttgacaatttcatagatgagtgctatatttatattatttaagcagcttccacttcctctccaacttctcctatgcctcccattcactttttttaaatttttattttttatttattttattatatttttgacaatccagtggctgtcctcctcctggtccaccttcacacagttccttattccattcttcctgccccctgactccaagaggattccctcactggaaccgttcccctgccaggcttccccattccctgggacaagtcgttccagagttcatccaatcttttcccactgaagccagaccaggtagtcgtctactctatatgtgcctggggcctcagaccagctagtatatgctgcctggctggtggctgagtagctgagagatctcagggtttagttgagactgctggtcttcctcaactttccccagcctttccctgatacaatcacaggtctccctgacttttattcaatggttggttataaatatctgcttatgtctcagtcagctgcttgttgggcctctcagaggacatccatgttaggctcctgtctgttagtgcaccatagcatcagtaatagtatcaggccttggagcctccccttgagatggatcccaagttgggctggtcactggaacacctttccttcagtctcttcgtttttgttcctgcagttcttttagacatttacaattctggatcagaatttttgactgtgggaaggcaactccatgacttcctttgataccctatctttctactggaggtggattctacaagttcactctccctatctgtgaagaattgtgttggaattttggtagaagttgcattgaatctatagattgcttttggtaggatggctatttttactatgttaatcctaccaatctatgagcataggagatcactccatttttctgaggtcttcaatatatttcttgagagacttgaagttcttgtcatacagatctttcacttgtttgggtagagttaccccaagatattttatattatttgtgtctacctggaagggtgttgtttccctattttctttctcagcccatttatcacttgtgtaaaggaaggctactgatt

SEQ ID NO: 2951 - DNA, 1000 bp, mus musculus
tgcaaggtctcacaaacatcctttgcctcattccaaagtcctcatgcattcttacatatttgtaatgttgcagcctcatgtgcacttccattatctcctactagacaacaagcatgtaaaaggcagaaagtaatcatttctctttttcacctacagacacttgttgtcttcaacaagctacttttgactaattgatttttggaatcaaacttaaagtttccgacccttttaaaagaggagttttcctaattcctcagtgtggtgaacaggaaacacacctactgtgaatgggaactatagattaggaaacaggatatgctaggagtcagattttttttctcactgaagtcttatagaatgcaatcttcttaagatgtgtatggctgtatcaactgaagctcagagagcagaaagaaccttaaatgcaaggtaacacagacataacaaagctgggtaactgtagaagattaaatagtaaaaaaaacaaaaaccaccctcccagttctacagaaatttagtcatctgtcccaactactacttatcattttgggtatattccttcagaagttctatacataaacataaacaaaaatacaacaattttatttactctattaacattttgtgtatttacaaaattaaaggagatcttggagacgattccagaccccttcagctccttgggtactttctctagctcctccattgagggccctgtgatccatccaatagctgactgtgagcatccacttctgtgtttgccaggcaccagcatcgcctcacaagagacagctatatcagggccctttcatcaaaatcttgctggcatatgcaatagtgtctgcttttggtggctgattatggtatggactcccgggtggggcagtctctggatggtccatccttttgtctcactcaactccaaactttgtctctgtaactccttccatgggtgttttgttcccaattctaagaaggggcgaagtgtccacactttggt

SEQ ID NO: 2952 - DNA, 1000 bp, mus musculus
agaagcattattctcgaagcttcctcaagcaccttgaatctctgaggaggaaagaaaagggtgacagccggcagacagaacccgagcaatgccttgccacctcggaaaaggccaccaaagcttcatctttccgcacttgccgtggcttcctctcagctggatttcacagggccaagaacagggtcaccacttcagccagggtcagagatggtgagactcagaaagcctgggaggcttggcctgtagccacattccggcatcctcagcctatacgcaggcgtgactatctggtgcatgtgcctggggaccataagccaggcacgttccctcgttctctgtccattgagagcctttgtccagatgaaggtcgtcacctggcagattggcagtcaagtaggtgctggggctatgaagggcgccggggctcctgtggttccacaggcagccatgccagcacttacgacaacttgcctgagctgtacccagctgagcctatacaggctgaagctgaggctgaagctgaggagggtgaaggcagctatgcccatctagatgacatcctggagcatgtgtgggggctacagcaacgggtagagctgtggtctcagaccatgtacccagacctgaggcctggagataaggaggaagaggaggaggaggaggaggaagaggaggaagctacttcatcagtggaagtagccacagtggaggtggaaggccaggatgaagatctagctcaggcagagtctcaagcccacagagggttcccaacccaagtcaaggaggaagtcccactgattgttctggatcaggccccaaatgtggtcgaaccattggtacaggctgaggctgaggctccagctcaggcccaggatcttgagcaagaagctaactcgactgcagagccaatttctgcctccagcctgtctgtggaggaagggcattccatttctgacacagcggtttcctccagtgagcttgacagtagtggcaactccat

SEQ ID NO: 2953 - DNA, 1200 bp, mus musculus
aatatataaatatattttcacattttgcacatatgaaaaatataaaggagaagctggagcttaaaacttataacactgtggggagcgggtgtggcggcagtcccaaaggtgccaggcactgcagctaagtcatatgacttgcacctgacttcctcatataagacacaaacatcttgagtgctgcgcaggtgtaccaggatacaggtgaatccaatttggtggagatttgcccctgctgccctgattagctgaagctgcgtgcctggtgaggtggcgtggcctgctgtgcgtggatgggaactgagagtataaaagagtgagaggcccagggttcgggggagatataaacaggggagatataaaaacaagggagatataaacaggggagatataaaaacaagggagatataaaaacaagggagatataaacaagggagatatatggagaaagaagaaacaggactgaataaatgtgtgcagaaggatcctgctgtggcgtcgttcttgctggcgagttgggggcgcgcgcaacaagtggtgcagaaacccgggaagaaaaactcgggacgggacgagaagacctgggacccaggacaagggaaaagaaacatcttcaggcatgagcgaagacccactgctacagggaggattcagaactgcatcacggggaatggtggtaaagaagtgttcctgtaaaacagactgttgagaaggatctggcgtggattcagaactcttcagctggggaacggtactgatgaagagaaagaagaaagatgaagactgaataaactgctgttagaaggactggtggtcgcgtcgttcttgctggtcgagagcgggcgtgacaattggtggcccgtacggggaaccgactcccccaccgagttcagaactttcagcagtcagtggttgctggcagggtaagttcatggtgagtgaaacttgggaccccaggagtttgggaaggacctcggataaaatagaggtgagcataaagttgccaggaagtaggcacaaagtaacccaggagtttgggaaggacctcggataaaatagaggcaagcataaagttgccaggaagcaggcacaaggtaacgaaaggttcccggctttgggacaagttaaggttcccggtttggggacaagttaaggaactatgataacctcagtgtagtgatcaatagatcctcgctgtgt

SEQ ID NO: 2954 - DNA, 1000 bp, mus musculus
ctacaaaccgttatcttcagtgatggaaatagcactgctcacttccctgcaccacccatcactacttggtcagtgcctcaagaagttctaggctgcttctccgggtgcatgtctgctcccgagcacagagatcatcaaggcagaggctgctggccactgcagaattcaaacctgccgtttctctaacaccatctgcttcagccaattctcatgtaaagaagcaaagccatttatggcacctttccagatctctgaaatcattacccagtcccccaactgcttcagaatctcttacagcaatgtctaatatgttacacgtgtttctttaggtttctcttgagcacactgctccctactggactttgttactacaaattgcttttattacagcctttgcttgtttgttttctgtggcttctcactagaatgtaaattggtgaaaagagaggctacactctttaaaattattttatttctttacatccctattgctgccccatcttgttcccccttgcagagttcttccctccatctccctccacttaacctctgagaatgagccctccccccaccctggggcatcaagtctctagaggattagatgcatcctctcccactgaggccagatagggcagtcctctgctacatatattccaagggcctcagacaagcccatgtatgttctttggttggtggctcattctctgggaacacccaggagtccaggttagttgacactgttggtctggtcttcctatggggttgtcatccccttcgattccttcaatccttcccccagctcttccataggggtccctgacttctgtccagtgtgtagctgtgagtatctgcatctgtctcggtcatctgctgggtagagcatctcacaggacagccatgataggtttttgtctgcaagcacaacatagcaacagtaatagtgtcagagatcggtgcccacccatgggatgaatcccattctttcagtctctgctacatt

SEQ ID NO: 2955 - DNA, 1600 bp, mus musculus
ctttgttatcaattgtacattttattgcgtagtgttcagatagtatccaaggaattatttcaatattttttaatttataaaagtatgttttgtatcccaagatatggcctgttttagagaagcttctatgtgctgctgagaagtatgtgcattttggggtgctggagtgcaatattctatagatatctatcaagttcatttgctatatgatgccatttatttctgatgtttcagtgtttagttttttttctccagatgacctgtctaatggataaatggatgtttaaatcatgtgctattattaatagattgatgctaatttgtgtctttaaataaatattgtttttttaaatgaaatctaagtgccccagagtttggtgtgtgtacatacatatatatatatgtacacacacacacacacacacacacatatatatatatatatatatatatatatatatatatatatatatatatatatatatgcttaaattgaattgaaaatttttgatgcagtttacgattattttttaacttccatattctaggattcatttaggtaatatcattgacagtcattttttctggattggtagatattggagagaagatatgggcttgatcgttcatgttgtttctatttttgtgatgagatctgggcatttgaactttttttttttttttttgctagttttgtgtcatatgaagaaagcagtttggtcctgaggagaggatgtttgagtaggttggctctagaggtttataatgacttagaaggaatgaaattgtgtggacacaggagacaggtgtgtaggatgtgcttcctatttcaagcctggagtgttggtagatatagatctgggtttgggagagtgtacatagaggggaatatcaggcataatcactagattaggccctggagagggacttgtagtatcttggctgggtcatgtgcatgtgtgagtgagtatgtatgtatgtatgtatgtatgtatgtatgtatgtatgtatttttcctgaaacttgtgtgttaattttgtatctttccacttttcaggaaatgtcagctctaacaattttctgatggagtgtttaggttctcttatgtatacaatcatatcatttgtaaataaggatactttaacttcttcccttcttgttagtatctcctttatttctttcctctgtcatgttgctatagtagacttctagcactatactgaatagtaatagagagactctacacctttgtattcaacctgatcttagtagaattgcctttgaatttttctccatttagcataatctggctataaattttctgtaattatcttattatattgcctctatttcttgaatttttagggcttttatcataaagagatgttggattttgccaaaggccttttctgcacctattgagattatcctgtgacttctggccttaagaccatttatgtgatgtattatatttatttatttgcagatgttgaaccatccctgcatctctggaatgaagccaacttgatcatgctgaatgattttctcttgatgtaatcttgaatttggtttgcaagtattttattgagaacttttttcc

SEQ ID NO: 2956 - DNA, 1600 bp, mus musculus; identical to SEQ ID NO: 2955

SEQ ID NO: 2957 - DNA, 1200 bp, mus musculus
ttcccccatccaccctctgactgttatatatcccatacctcctccccactccctgtctccacatgcatctacccatccccaaccccacctgacctctaaactccctggggcctccagtttccttagggttaggtgcatcatctctgaatgaacacagacctggaagtcctctgctgtatgtgtgttgggggcctcatgtcagctggtgtatgctgcctagttggtggtccagtgtttgagagatctcaggaatccagattaactgagactgctggtccttctgcaagattgtcctcctcagcttctttcagcctcccctaattcaacaacaggggtcagctgcttctgtccattggttggttgcaaatatctgcatctgactctttcagctatttgttgggtctttcagagtgcagtcatgataggttcctttttgtgagcattgaatagcctcagtaatagtgtcaggccttgggacctccccttgagctggatcccactttgggcctgtcactggaccttattttcctcaggctcctctccatttccatccctgtaattctttcagacaggaacaattatgggtcagagatgtgactgtgggatggcaaccccatccctgacttgatgccctgtcttcctgctggaagtgggctctacaaattttgtctccctactgtctggcatttcatcaaacttccctccctttgagtcctgagtctctcacctcccaggtctctggtgcatttgggggtcccccaacttcctatttcctgaggttgcttgtttccattctttctgctggccctcggggcttcagtccttttccctcacccagtaccagatcaggttcccctctcccccctcctctgcccaccagatccccacccccacttctgacagctttcttctgtctcccaagtgggactgaggcatcctcacttaggcacttcagcttgttgaactttatgagttctgtggactgtagcttgggtattctgtaattttggggctaatatctactcattagggagtacataccatgcatgtccttttgggtctgagttacctcactcaggatgatattttccagttccatccatttgcctgcaaaactcaggatgtccttgttccaaattttcaaagtccaaaatgctctaaaaatcttaattttttgagtaccagtatgatgtcaaaagt

SEQ ID NO: 2958 - DNA, 1200 bp, mus musculus; identical to SEQ ID NO: 2957

SEQ ID NO: 2959 - DNA, 1400 bp, mus musculus
ttttactaaaagatcttaagcccatgtgacatggtggcatatgcttcttatcccatagtttgagagacagaagcagaaggaccagaagttcaaggccagccagcctaacttcataatcagtgtgtagcctgggctgcatactatttatctcaatcaaaatgccaatgccatccttcacagaaatagaaaagatagacttgccctttcggtcggcaccagcaccaggtcaccttgggcacagagtcagcgcataaccccaaggtcccctagaggactctccatgccgtcttaggaccactggtgagtggaacacaacttctgttccaatccaatcgcgcaggaccagagacagcattagggaagcagaaaacccggcctgactagggtcacaaagtcccttcctgtgggcgccagcaccgggtcacctttggtgcagagtcagcagacacccccaagctcccctagaagactttccacgtgatctttggaccactgatgagtggaacacaacttctgttccaatccaatcacgcaggacctgagacaacactagggaagcagaaaaccgagcctgaccagggtccaaatcccttccggtaagcgacagcaccgggacaccttgggtgctgagtcggtggagaaccctaaggtccctagaggactctccacgcgatcttaggacctctggtgagtggaacacaacttctgttccaatccaatcgcttgggacctaagacagcactagagaagcaataaacccggcatgaccagggtcacaagtccctttcgttcagcaccagcaccagttcacatgggcaaagagtcagtggacacccccaaggtccccagaggacagcttctgaggcataccccgtttcgggatccagacattcgggcaccttccctgccagaggagaggtgtccaccctgcccgggagagctttgccagagcacctggtggagccatcatggctcccgaatcccgctgagagtagtctgcacaggtgagagtgaggactacagaagctaacagcttctgggacaggccagagtgacacagcttctggacacatcctatttcgggccttcatcttctgctaggagtcaggtctgaatgccagatatctttgcaccttccctgtaagaggagagcttgcctgcagagagtgcactgaccactgaaactcagaggagagagctagtctcccaggtctgatgatagaggctaacagaatcaccagaggaacaatctctaaccagagaccactataacaactaactccagagattaccagatggtgaaaggcaaacataaaaatcttactaacagagaccaagaccactcaccatcatcagaacgcagcacccccaccttgcccagtcctgggcaccccaacaca

SEQ ID NO: 2960 - DNA, 1400 bp, mus musculus; identical to SEQ ID NO: 2959

SEQ ID NO: 2961 - DNA, 1000 bp, mus musculus
aatccgacgtgaccctgaggaagggcggggccgggaggaagctgacgtgtgggcagtgggcctgacaagatcaaagctgcaggaggatggacagtgaggtacagtaagatggaaggatcttggacctgattaatgatgcttggcgggaaaataagctgccgtaagaggatgtcaccatttcactgagcccgagcaagacaacggcggcaccacagagtctgtgaaagaacagaagattaagtggacagacctggccttacagggcctccacaagaatgtcccacccaccagaaactgatgccgggctccttcccatggatggagttttcaaacatatgtggatagacagtttcctgtctccaaatgcagatctttaggaataaatcaacactcaaaagcaaaaaaaaaaaaaaaaaaaaaaatccttaggaaaattctaaggatgacctttatagattgaaatgtttcctgaatatttctctcctgcccccctgtttctgtctcgtctctgtatgtcttcccccactcctctccactcacagagatctccctacatctgccttctgagtgctacgattaaagtgtgccacacacaacctaaattcctcttttgataaaacagtgtttttctcgggcagtgtactgttttagtaagttggagtcagtgccacaaagtgcagcttcttatgtgacattgcctattctaagtggactcctttgtatctgacttcattcacttagcctgtttcaaggttgattcatgttccctaatgccacctttgttgttccaaatgacaaaatttaatttttatcatatgtattttgtgtgtgtgcacacacaccatatgtgtgccacagtatgcatgtggaggtcagaggacaatttgcagaagttggctctcacttgcagccatgtgggtctgacggactgaacttggttgtctgaattgtcagcaaagacatttaccacctaaaccatctcactggcccccagaggttc

SEQ ID NO: 2962 - DNA, 1000 bp, mus musculus
ctggccagttgggcgcgcgcaagacttagtaataagtcttgcatgcaagaatcaatggaagccagcaccatttgctcaaagacttttgagaaaaggtatagggcagtgagctgtgcacagacagcctggtcctggtcaaacacagaccttgaaccctggtgatgctaagggactgcaggtgttcagccacacctcctgggaccctggctcctgttccggctacagcctcccaaagaccctcctgcccccaccaggcagagaggcatgtgtggccatcagtcatgtaggcaatgccccaagctcctggtattctgtctggactccacccccacagttacctggcaacagccaggtatgctcctccccacagttacctggcaacagccaggtaggccaggcccactataaaaggagctgtttgccccctcctccctctcttatcctcttattctcttgctcttactcttgctcccttgctctccctgtctctgccttccctttgcccctctctccatgtggccatggctcacctctgcttctctactctctccccctctctgattttctacaataaatgccttaaaactatggactgcctcttttcattgggatccaccatgcaggagcaatggagcaggtcttcccctaacaagccatgtatctaacctcccactgggaggcctccctgcactccagtcacaacccaagccaccaatgagcaagccaaggactttcctccctaaggaacccagccaaagctctcctccctgccccttttcccttcaggctctgggccagagtctgcctgtgccccctcccccgctctgttctcagctcttctgagacatccagcagtgtctgtggtgtcaaagacccagaacctgaagtccctggccttcttgcagcccagggacccccgaaccggctcttttgtggtacccagcagcatctgtgttacctgagagtctgagcccaactccctactccactccggcaggtc

SEQ ID NO: 2963 - DNA, 1400 bp, mus musculus
ctcttccatctcttgtattctgttgttgatgctcacatctatggttccagatttctttcctagggtttctatctccagcgttgcctcactttgggttttctttattgtgtctacttccctttttaggtcttggatggttttattcaattccatcacctgtttggacgtgttttcctgcaattctttaagggatttttgcgtttcctctttaaggtcttctacctgtttagcagtgttcgcctctatttctttaagtgagttattaacgtccttcttggtatcctctaccatcatcatgagatatgtttttaaatccaggtctagtttttcgggtgtgttggggtgcccaggactagttggggtgggagtgctgcgttctgatgatggtgagtcatcttgatttctgttagtaggattcttacgtttgcctttccccatcttgtaatctctggagctagttgttatagttgtctctggttagagcttgttcctcaggtgattatgttagcctctatcagcagacctgtgagaccagctctctccttcgtttcagtggtcagagtactctctgcaggcaagttctactcttgcagggaaggtgcccagatatctgttgtttgaacctacctcctggcagaagttgttttccactcaccagaggtcttaagatcccctggagtgtcctgtgggggactttgcgggtgtccagagactccgcgtgcaaggaaccccagtgctggcgtggaccggaagggacttgtgaccctcatcaggccaggttatctgcttccctaattaatgcagtctcaggtcccgcacgattggattggagcaggtgctgagttccactcaccagaggtcttaagatcccgtgggggatcctgtgggggtccttgcgggtgtccggagactccacaggcaaggaactccagtgctggcatggaccgaccggaagggtagtaccaaattcttaaatgagaaggaacaagaaataaagtccacaaactttaacttccttcatcctaggaaaaccaacctctttcttaaaatgcaagggcatcctccttttcttagaacacaactactagcttttgtgtgtttgtgtttcaacatagaagtgaacatttaagactatgtggacaatttagtgtttattgcagctgcccaatttctgctatgaggtgggaagtagcctcatacagtatgtaattaaatacaaaagagctatccaaaggcagcctgcagggcagaactaacctaatgttctgtgtctcctcgatgaaactaatgtctagtcagatgccctggatcccttgagatatagcactataaatatttttgacaatgaatattttaaatataaccaactctgtgtattaagacttatcttttaagaacca

SEQ ID NO: 2964 - DNA, 2000 bp, mus musculus
ggttttttattagaaatttttcataggtatatagaatgcattctgcttactcttccactttcaatttccctcccgccctggccagcaccccttattccttacaaaatgtctctgtcatatttgctagttttattttgtttagtgtttcatagttcaccccagacatagtttggaactattaaatactcatcagtggatacgtttgagtgccccgtgtcccaatcctttagttgccagtaataaatggtaaggtttcatgggcttcttggagttgggccaatgctattttccaaagatgttaagatttaccataatagattcttgtacctgcctcactcacactcgcttgcagtacctgtctatctttctcttcttgccaatcacattgtagatgaggcttttgtggttttgttggctccttgtattagcataaggtgaactgatttcaggtaaaatgttgttgcttttctggcccattcattggatggaaacgaaggcccggttttgttggagcacttctactggttagcaatggctaggcagagccatgtctaacagtacaaactctctcctgagagaatttatcttttctcctagacgcaattttgtcactttgaattttagaactatcagaggcccctttctctattcaaggacttcttgacagccatgttctttcttttcatttcatcttaccagtactcccacttttgagcctcaatattttgcttctcgtgatcttattagatttgtgttctcataatctttctcctgaacaacttaggctctaagttatgagacctcaaattacccaaggaactggctaggcctgcctggtggtgtaggcctttaatccgagcactcctgagtcagtagcagacagtgctctatggatttagggccagcctaatctacatggacttcaggctagccagatggccagggcaacataaccaatttcattacatagggaattaaaactgaggtatctggtatgataaaagggccactgagttagaaactatcatctgaaaagcaggcttagtggtacaagcctgtaattctaacacaggaggatcaggagctcagagtcattccggctacttagggacttggaggctagcctagttctggctccatgcaaaggaaaaggggaatgtggcagtggttaagataccataatagattcttgtacctgcctcactcacactcgcttgcagtacctgtctatctttctcttcttgccaatcacattgtagatgaggcttttgtggttttgttggctccttgtattagcataaggtgaactgatttaagagcactaactgctcttccaggggatctgaattacattccggctacacacaagatggcgtctgtaacttggtttccttgggatccgacaccctctgctggcctacacgggtataacacccaaacctaatgcatagacaaaactcatgcacattaaataaaatttaaggaaaatatcatatacagcacatgatgttttcaaaacaaagcattttatttaacagcaaactaccccacccactcaaccacccacccacccacccacccacccatccacccacccacacacggactcattgtgacatgttggtaagcaacagttttttttttcaagtcttcaaaacacccaagagtcaacagaagttctgtattccgcatccgttcacaaagtccaggtgttttccatgtgttttttcacagttggtgggaagatgactccagtctttcaacaacagattggtacacagttcatttatgtgatcaaagcagatgatggtaggatgtgcttaattggtagcaatattgatggcagtaactgtgaaaggaaggctttcagttattttttcctttgcaaattccagaaatgtaagcccattcctacccatacaaagggatattactgaatccagccaatttccactaattaaaagctaatattagtaacacttttgatgcccaattgagtt

SEQ ID NO: 2965 - DNA, 2000 bp, mus musculus; identical to SEQ ID NO: 2964

SEQ ID NO: 2966 - DNA, 1000 bp, mus musculus
cagacctcattttgtccccaaaccattattagaaaaccataccctgctcacctaagcccaaagaaagaaggtgacactggctggtgcttctcagagggttggcacatctgcatattgcttgtctaattcttctcattggtctggaacaactctttatattttctctagatagcctgacattgttttccccctaacaacctgatgctttccttttcttgtcagcctagggcttctgaggtagggaggatggcagtatgcatatctgtatgcatgcttattcctagggaagtttcaatagtcaggctatatacactggctggatttagttccgtctcaagtggagcagatgtgaagagaaatggaagttgtaaaacatcaacaatttaacaaatggctaagacccagtttaaaacagacccttgcacaatactatccagctaaaaacgtattcctttatgggcaatggcaacaatgaaaaattacatctcaagtgaagacagcttaaatagaaatataagaaatggaaagggatgctggggttggggggcaggtctcatcttcgaatttcccttcttggtcttggggatagaaggatagaaatatccttccagagttctgggccataggcctttatctcttaaatattctgtccatataggattgggtccttaggtcttatgcttggacttagctcaggttttgtgtcttatgacatacgtagttccccgctcttggaagtcacaggtgtcctgtagaaacagttcctcttctttgggttgtcagcattctgtccagccagctcaagacgggccatctgtgtattttggtccttttaaatctcaagtcgcaaaacttctgtcttctacttgggcgttcacttcagagccacttgaatcctgaccggacggaatgatgtattttgtcttagattatttctcagggcagtctggtgtgaggaacggctccacgggtgacattctggacctattgggaaggggct

SEQ ID NO: 2967 - DNA, 1000 bp, mus musculus; identical to SEQ ID NO: 2966

SEQ ID NO: 2968 - DNA, 2200 bp, mus musculus
caccagaaagagggtaacaagaaacagggaagggcaaagaaaaaaattgccattagtacactgtaccaggctatcaacgttaaacttaaggtttccttaacataggaccataggacacacccgtcaactcttccaaatggcctagtcatgcaactccagggcatatttgccaggctctgtactcaacactttccattcatgatttcatttgaccttcacaaacagacaggtcttagcagaactaaattgccaaagggcatacatctaggggatattacatttaaacacagaatgaacatctcaacattctgttacatggattaaaagcttctgtaagcagcaaacactataagcgactgcatatttaattgtcagcttcactctcctcttctattaaaaaaaagggggggcttggtttttacatccttcacaagtctaatggctgcttcacagatggagataagaaataaactatttaaagcttttcaatgtttaagtctgtaagaatggtagggcaccaagccaaaacaaacaacaacaacaacaaaacctagaagctaaattcctcttgtgatataactggtaagcagataatagtttgagttgctgctgtgaggccatttgataacgtgaaagcctgttcatcttccatcgtgtacatggccctgcctcacattatcacattagatgctctccacccagcaccatcttccagcaaatgcaaatcctcagaagactgcaatgctagtgacttacctcattctattgcttttaagatgctgcagtcaggcatgttgatcctcgggtcatttataaagctgccttccttttgtgtgttcacattgcttgatcacgctgaagacccagttttctgtgctgctttggggaagggtaatatttggtagatggcactacaaagaacaaaagaagctgtatgaatgccaggaaagaagtactagaacatcctggctctttaaattctgcctaatgatagatacttctgtatcaattccagccaggtttccatttgtagttagaggcattcatcatcagtaatgttagtgatggctcagtggttaagagcacctattgctcttccagaggtcctgagttcaatccccagcaaccacatggtggcgcacaaccatctgtaatgagatctggtgctctcttctggtgtgtctgaggacagcaacagtgtactcgtaaatagctaggtaggtaaataagctactcacttgtgtattatatggcatgagtagggtagcagtgcatcttgaagtatgtaaacagctggcaaagctttcctagcttctggagagagaaccaaatagagcagaatggcttcctcgaaggtcagtgccactattgcagcagcttttctcctagaagaaacatttgcactgtttagttacatttcccagatgtgggaaaaagataaaatttatgtatatatctcaagtaaaaggctgactttaatggaaaacaagatcaaagttaaaattattacactgttgcagaaaacttacctactttgatgtagggtggcattctttgagcctttgtcttccttgctgggttcaggaaagcgtctcactgaaatctgggctaggcctgttgcccagtggtggtgagctattcccctggaggatcctcatgccccatctccacctagggatcgtcaaagggaataggtcgccagcactgcaaagcagcaagcccacaattctggggggagatctggaaaagaggtgaaagaaaagccaattcttgaaatcaagaatactgggaaagttgtctcattatgtagtaaccagcagttgtgttaaatcatggggaggggcttggagagtgaacccttcacatttgtagatcttagtgttaacttagagacatgagaattgctccatccaagttctttctggcttttattctgtcacctaccaatgagagatcctttagattataggttgtgttaaagtccttgtacttcaaatactctgggaataaaggggttaaattattttcttcttttaatttgtgctttaaacaataccatgccagaacactggcaaggtgaatagcattgtttggctcagtgcttatggtgcatatgtccctagaaactggtgtagcattggacctctgagtttgaggatattcagagaccagaattatgacaggcctacagaatgtgaca

SEQ ID NO: 2969 - DNA, 2200 bp, mus musculus; identical to SEQ ID NO: 2968

SEQ ID NO: 2970 - DNA, 4000 bp, mus musculus
aggtcatcttccaaaaagttaatcatactaaaggccacacaaagattgactttttcgttttgttaaacttgtagtaaagaccaagcaaagatacttgtcttaaacattctgcaatagttgcactgatctttccacagactcatcaccctcagtacactgagacactgcttagtcttcagaaacatgacacaaatggctatttttacttcacaaaagctaatgatctcacagtcaatccaccttgcaatccaaatgcctttcttaaggaataaaattatcaataacttttctggcagttggtcctgtacagtagcaatatacaaaatcgggcttaaagtttcttaagcagacagttggctccttcctggaggaagaacggaaagaaaagtgctaagcttccttctcaggaagacaattttcagttcatactgtaaaggaaagccccaagtaaaaggtggcaatccaactccctgagctacttgcctgcaatattttgcacaataaagcattaataaaggtaggcaagaatggttcctggccctagaatgtgccagcagttggaattggaataatttagaagtgcaagttaaagattgaaggctcatccacctagttttggcctgcttttgctattcagtgtataaatacaccaaaatttattaatgacacatagggtgtttggggtaattaacattacccagaataatgtaagaattcgaggtgtctctgttcagtgggagcaaggagaaggcaactgagacactgtagccatatgaagtgagtaaactggtgttgttgactttaagtcaagagaagggctttgcccagtcaatactgttcaaacaaagaggcaaaagggatggcatgatggaattgagaaagggcacaaactcttccttaatgatgggtttgtgagaattagtgattcagaaaagtggtcaatggacaaactagaggccgggcaaaaggaacactataaagtgtgagattgtgactatttaggattgtatatattaaagcaatgcaaaaagggtcgaaatccgggtcattgttgggtgtacatactgctgtactttattatatcattgggaaactagcaggggatttgctcaagttggagtagaaaataaaccatccagaactgccattgtgcctattaagagtcccaaaatcagtttaaggaagagagcaggtcattcgtcagagcccctgtgctcattgacagtaccgggtagtttcgggggctcagcaacctctgcaataatgtaaaggggacaaaatattccagacattcatagttataaatacgcataacttagcaattaattctgggactcagtagccttgatggtatgcaaagagagcacacaggtccttgacatttttgcatagtaatcatccaaatgctgaggttactaatagttactaccactcagcagccccagtcaaaaggtaggcatttcagaacctttgctgccgcacaggtcatatgtgtaagggtacagattaatattgacaagagaagtgctcagaaataattaatatgcctctggtgtcaaaagagtacaaggatgtaaaatccaactccaaaggtaatgatggacaactaactgcattaatgcacttaagtccaaatgaagagcacttcgtacaaccctctttctgctttaaagcggagaagagggtacagtagttcttagagaagtgcttagacatgtgaactttccaaatgaaagtcttgagcttattatcacttcctgctgaaggtgctaaggaagtgagtgggatcctttcaagtgcacagagcaggtggcagtgcatacgcatacatttaatatatgataacagtccaaaagaatgcggccttgttgatcagcatatcctgatatagtgcaaatgaaaggcgaaggagtatggcctttgtttactggcaaagacaaaggaagattcactgtatattaatggtccactagcagggaccttgggagataaacggtatcccttgcaggagtgcaagagatacaatggtccgaaaagtaataaggttgtggataagtgtaattttacacattaactggccaagtatttttattaaaatgaatggatcatgtccctgttatatacattaatgttcaagggacatgttatcaattaaaaaccccatcctttatgcaaatattaagtctttaaagtaatagtcctggaaattaaagagtggaaaggaggggacagccttatccagtgtccaggaagatgaagaagccaaaagattagtgacccttgctgtactgcaaaagggtttgagagtaggatcgtatccaaatggaatgagatgtgtgcagtaaatgcatactaatatgcaaggtacatgtttatggccattacagttttacgctgttcaggtttccttctgtagtgaacagaaaaggcctactacaatcagtcattattattagcaagccacaaaatgggaccttataggtcaacaccacttctgtacttcaaagttaagagtaaaattgatcctactaaaattgccagtatgtacataaatagtttgaggaaggggtttcaagtgcacagcacatacataattccataaagcaaagaggatatgaatgatcagagacagaagtcttaccttgaaggaccattgaccgtattggaatcgtttcaatctatagtctcatgaaagaagctttatattagtgagcctctttgctttgctaagtacaggagtcctgatctaaaaggcacaactgtggacatgagaatatgtacaatagagttaacactgtgcacatttactatgttaaggatcttaaatactgctgcaatacaaataagtcttcaccagatgcagattactacagtgaaatgacatatgcacattcacaatatgaaagactgcatgcagggcatagtggtaggaaccagatatgccaacacttgttaaacgcaggctagatcctgagctcaaggctagcctgggttatatgctaagttccaggccagcctggaagttaaaaacaggacagatcaaaggtcttcttgattaccaacaaaatgacttgacttagtttggtttctttatccaatgcttaggaagagggacaaatgcagctgtgcacacaacaggcacaaatatgtttacattacaggtggcaatgcctgtaagtcccgcccagcccaggctacataagaggctgttctctcaaaccaccacacggtggggctgtagctctatgacagtgctttactagcgtacacaagactcaaggtttgattccccagcacagcagaaagaccagaacagagaagtggtctcattggttggcacccttgattgtcacccattagggtatgagggtatgggatcttggttactaacagaaggggacttgaacaactgcaattttgcacaattgtgtaagaggcattaagtaatcagcaccctctttacataaagcaagggtagtattaggaccttgagaaaagactcaattcctagtcaggattatccacataaaatgttccagtgcagaggtttttggctgaaataagaaagcatgtgagactagtatacaatatcatgagcaaataaatgtatctccatcagttagaaagatgtgacctggggcgatagcacccatgacagcatgccaacagtatatagtattctaccccctttaatggccaatgccttgaaaattgggactgagcactttaactgtctgataacagacctgtgtttgcccctttgctaaatgcacacagggctggactagctaaagtctaatccaatggacaaaatatttctgacagaattattcagtactcaaggtaatacatgagaaaagacgactgaacactgcttagaaacttgggactgtgactactacagcaatgacagaatggttttctttccttaaaggaaaggagacttgagagatgatacctccatggcaagtctctgatataaaactcttgtttgattggt

SEQ ID NO: 2971 - DNA, 4000 bp, mus musculus; identical to SEQ ID NO: 2970

SEQ ID NO: 2972 - DNA, 1000 bp, mus musculus
accttccaaactaaaactttttcaaagacatgctattatttcttatcccccaaatcttttttcctattcatctaccaggccaacatctaccaatgtgtcttcaatattcatctacaaatttatcatctagaagctcttctctatcttctctaaactaaatatgtttctctatttctgggttcccctaaaatcttacacacagcactttaaaaatacttgttacattttatttgaattgttatttactagactgttttccctcaaaatcttgatttgttgaagggcaggttatgattcattcattgctgtagcctcagtgactagttatgtctatcaaatgacaagtgcctaacaaatttgtttaaaattttaatttgtttcccagtactcataaaatagcttaagataatagtgacatggtcctttttaaatatggagctgggttaggtccggataaaacctagtttagaatgattttgctacctttgtatgcatttcaatatactaagctactagtatagaacaaagacagttttacaacaggtttattcaaatagctataaactaatttttcatccaggaaatagacaacgggtatacaaaggatcatatacaataaataagacagtatactccatcagtaggagctgtcaatcattgagctttcaggataaggagaaataaataagtcaaaagacctggtttgggactaagatgactcagcaagtaagacacctgtactagtcttaggtcttcaaatccctagaacacatatgaaaaaagctgagtgtggtcatgttatgacccggtaatccctgcagtatgttaacagaaacaggatgatcactgggcttgctgtcttacagcctatctccaagttcaatgagagaccctgtctcaaagaacaaacaaggcaagtggcagaggttaacagtcactgttttctggtctccatgcacatgcataggtaaatgcactccaacacattcatacacataca

SEQ ID NO: 2973 - DNA, 1200 bp, mus musculus
ccttccttccttccttccttccttccttccttccttccttctgcctgccctccctccctcccttcctttctttgattgagtatttgggcatctcacatcatgtacccctatcactctcatgtcccagacttctcatgtcaggcctcccttcccctgtgaacaccccctcccccccccacacacacacagaataaaaagcaagtcattttgcgttgtccatatactcactgaagcatggtcaaattcctagtggccagccccccaacgcactgagggaggatgtctttttctgcctgcatgtgcaccagaagccatcagctgagaagtgtctcctagtggccagtgaggggcagggtcagtttttccactcactgacattaatgtgacttcaagaggctgccaccgacttagagtgggttttggtggtaacaggccttgcagacagaaacactgacctactcctggctctcagcagctgcacaggcctcaacatggcctcaggtggacatgtcattcatatgaggagggccctaagaggcagcaaagtgcaaggacatcaccaaatcatcagtcagtgacaaagactgcatatgcccacatttatctcaggcttcattgggtcctggggcaccagcttggaccaacagacaccaacatgctttccggtggcttcaaggaccatggtggtcctttgaggaggtacagtccagggaatcaacctttcttcatgtcaagcttccatcactgccaagagccaagggggagtcccttagctgggtggcaggttcaggggctgagtctgtgtttgcataagctccaggctgttgtacatcatcaggcagaccctactgggtgatgacaatatgtccacctcaggcttctctttcacctgttactgcctgtactggctggttttgtgtgtcaacttgacacaggctggagttatcacaaagaaaggagcttcagttggggaaatgcctccatgagatccagctgtggggcattttctcaattagtgatcaaggggaaaaggccccttgtgagtgggaccatctctaggctggtagtcttgggggtctataagaaagcaggctgagcccttccgctcgactcgggactcgagccccgggctaccttgccagcagagtctttcccaacacccgcaagggcccacacgggactccccacgggaccctaaga

SEQ ID NO: 2974 - DNA, 1000 bp, mus musculus
catcaagccttcacaggaccaagggcctctcctcctattgatgccagacaaggcaatcctctgctacatatgcagctggagccatggattcctccatgtgcactctttgattgatggtttagtctctgggagctctggggagtgggtcaggttggttgatattgttgttcttcctttggggttgcaaactccttcatctccttcagtccttcctctaactcctccattagggccctcatgttcagtccaatagttggctgcaagcatccacctctgtatctgtcaggcactggcagagcctctcaggagacagctatatcaggctcctgtcagcaagtgcttcttggcattctctgtagtgtctgaggagtcatttctaagatgtgtccttcccatcagtaagtctataatttcttgtaaataaggatctatagattgttgtgcagaattataacattcataaatttctatagtaccattatcttgttgatatgcaattccagtaggagatgatcagaaaggagggataagtaattggtaaggaagcaagggattaattatttgagctacggctttagcagaagcattatttaataagctaatcacctcctctgctttaggtattacatttcttgtagaatttaaactgggcaacttactgtaggcatatttaagttcagtataactttagaaaatgttccctgctgtagcacaatcccatgtgcacaaggaagcatattacatcaaaattcttctcaaagcacatgtcacttcttctataaaaataggttctatagctaggccaaatgtgttatattaagggcctagatgaggacctggtatggtctcaggcatgcagatagtgcagaggtcacctagactattagccacccccagtcctgcttgtgggaacttggaggaaccaggtatgttctggtcctacagaaagcacaggggtcaccgaagctattggccacctccattcccagctttactggga

SEQ ID NO: 2975 - DNA, 1200 bp, mus musculus
ttctcctgtatttctttaagtgagttattaaagtacttcttgatgtcctctaccatcatcatgagatatggttttaaatctgggtctagcttttcgggtgtgttggggtgcccaggactgtgtgaggtgggaatggtaggttctgatgatggtgagtggtcttggtttctcttagtaagattcttatgtttgcctttcactatctgataacctctgaagttagttgttatagttgactttggttagagcttgtttctcttttcattctgttagcctctatcaccagatctgggagactagctctctcctgagtttcagaggtcagagcactctctgcaggcaagctctcctcttacagggaaggtatacagatatctggcgttctgacctgcctcctggcagaagatgaaggcctgaaacagggcctgtcccagaagctgttagcttctgtagtccacactctcacctgcgcagactagtctctgagggatctgggagctaagatggctcccccaggtgctctggcaaagccctcccgggtggggcagtcacctctcctctggcagggaaggtgcccgggtgtctggagcccaaaacggggtctgcctcagaagctgtcctctagggaccttgggggtgtccgctgactccgtgcccaaggtgacccagtgctagaggcaactgcaagggacttgtgaccctggtcaggccgggttttctgcttccctaatgctgtctcaggtcctgagcaattggaatggaacagaagttgtgttccactcaccggtggtcctaagatcgcgtggagggtcctctagggaccttgggggtgtctgctgactccatgcccaggtgacctggtgctggcactgaccggaagggatttgtgaccctggttaggccgggttttctgcttccctaccaataaattattgatgagaaaatgttccttaactcattctgtaaaaccagaaataatttgatattaaagtcagacaagacacggcagatgcctttaatcccagcactcaggaggcagagacagatggatggatctctgagtctctagagtgagttccaggatagccaggagtacacagagaaactgtctcaaacaaacaaacaaacaaaaaacaagaaaaaaatcttacacagacagaaaaccacagatcaatatttttttctgatttttctgaattt

SEQ ID NO: 2976 - DNA, 1200 bp, mus musculus
tctaataactgcaatgtgatatcttcatttatatagctgtctaattgggaaggctacacaaagggactggagagatgactcagtggcaaggtcttgctatgtaacctctgactggactggaattcagtatggagaccagaatgtccttgaacatgtggcagtacatattcatagtacacaaaggaatagtattaagccacagaaaaaaaggaagtattgtcacttgtaaccatatggatgtaactggagattattatgttaagtgaaataaaccaagcacagaaagacaagtgtggtttaaaatggtggccagccacagggctagctggaaatttatcttcgtgcaccccacgcctctgctgggcggggtgggtgtcaggctgtgagaagccgaaggaccccgctccagggggtggggaagcagtctgaggccccctcgaacctgccagaattggtggtggtggtggggtggctggctctagcttggggacaatgggtgggaggagagcactctgggagacctcccatgggagattagatgcagctctttagaggaagacctgctccattgctccagtaccatggattccggtgagaagaggcagtccatggttttaaggcgtttattgtcatggcgggaaggggagctaagagggttgtagaggcagagagagggagagagtagagaagtagaggctggccatggccatgtggagtgaggggggaaaataatgtggagggggggcaagaggccaagagagaggcaagagaaagaggagggggcaaacagccccttttatggtgggccaggcctacctggctattgccaggtatgtaactatatggagcagcatacctggctgttgccaggtaactgtagggtggagtccggacagaataccaggagcttggggccttgccctacatgactgatataggactacagaatgatggagctgaagcctatcgggatcctggtgtctgggggtgtggcaaacacctgcctttccttgcagcaacacctgctgggtctctaaggtttaaacctagctcaaccagaaaacaggctgcctttcccggtcccacagacaagtggaatcttactcagtggaatctagaagagttgaactgccctgatgttaggagtagaatgccagaggctgggggtgtcagagggagggagggtgcaggcatattgat

SEQ ID NO: 2977 - DNA, 1200 bp, mus musculus
ccattttcctttatttaatctatctctatttatctgatgttctcactgaaatcactgcttctattaggatccagactctcttaccaacatgcctaatgtagaaagagaagttgaggacgcacttgtcaaatactttttgttttcatggacaaccacaattatgcaatgtggagagagacagattttggagcactcaatcctaaagaggatatctttataaattgttcccctcaaatctcggggatctatgccaaagatgaggcacaaaagtcttaagagccagttgtgattaataactccaaggaaatagtgtccttcagacacaacaggtcatatgcatctttgaactcactgagactgtgacagtatgcacaataaatcctgttcccacatctaacctagaagctatctgcagattagtacacgcttgcaacggaaaatttaagtctttgagtggaatctcactgggtatattaatcacacttagagtaagaatactagctcaggaatagttgtgcagcacaaaatgaactcaatagagttttgatagactttttttggtctcatttttgcttttcgtaggcagactttttggtaccgttgctcttttgcttgtgcatttggttttcattttggtagttttatgaatgtgtgtttcttctttcttaaaaaattaattggtgtacctttcctgttaggggagagcttgcctccaggaagtgtcggaccccgggacttgggtgagatcgccatttctctccaatgactctctaaggcaggactacttgggagcacacaggctacagaagcagcagctaggacaggtcctatggtcctacacctgcacccaggaggtggggctgttctgcacccctctgtgtactggtcttgccaggggagagattgcctccagagagtgctgacacagactaacagactcacaggaggaacaagctccattcagtgacagcaagaacatctgacaacagagattaccagatggcaaaaggcaaatgtgagaatcttaccaacagaaaccaagactacttggcatcaccagaacccagtactcccattacagtgatagtgcaacacaccagaaaagcaagatgtggatttgaaatcatatctcatgatgttggtagaggattttaaggacataaataactcccttaaagaaatgcaggagaacacaggtaa

SEQ ID NO: 2978 - DNA, 1000 bp, mus musculus
gcaattaaaaacaatggatttatgaaattcttggacaaatggatgtatctggatgatatcatctttagtgaggtaacccagtcacaaaagaacacacatgatatgcactcactgataagtggatattagcccagaaacttagaatacccaagatacaatttgcaaaacacaaaaaaatcaagaagagtgaaaaccaatgggtggatacttcattcctccttagaatatggaacaaaatacccatgaaaggagttacagagacaaagtttggagccacgacgaaaggatggactacccaggtattaccccacctggggatccatcctataatcagccaccaaacccagacactattgcatatgccagcaagattttgctgaagggaccctgatatacctgtctcgtatgaggctatgccagtgcctggcaaatacagaagtgtatgctcacagtcagctattggatggaacatggggcccccaatggaggagctagagaaagtaccctgaaggggtctgcaaccctatagatggaacaacaatatgaactaaccagtacccccagagctcgtgtctctagctgcatatgtcgcagaagatggactagtcgggcatcactggtaagagaggccccttggtattgcaaactttatatgccccaatacaggggaatgccaggaccaagaagtgggagtgggtgggtaggggagcaggcccgggggagggtatagggaatgttcgggatagcatttgaaatgtatataaagagaatatctaattttaaaaaaagaaaaaagcaagaaaaagacttcaatgatttttatagctaaaatctacactatgaatatagtacatttgtttatacatctatttactattaaaacatttaaattgtttcttgcttttatgagctatgaacttgtatgcagttatttgtttgattgtttattcaattatttggggagagttgtaccaacaaacggaactgctgagtcatatag

SEQ ID NO: 2979 - DNA, 1000 bp, mus musculus
catagtggagcatgtgtccttcttaccagttggggcatcttctggatatatgcccaggagaggtattgctggatcctccggtagtactatgtccaattttctgaggaaccgccagactgatttccagagtggtgccgctgcagccgcttctccccctcctcctctctctctctttgctaccttcagatctagatggagaactctcagctcctctccaacaccatgtctggctacatgccgccaagcttcttggcatgctgataatggactaaacctctgaaattgtaagccagctccaattaaatgttttaagagttgccttggtcctggtgtctcatcacagctgtaaaacagtgactaagacaattaccctggtgaccactattctattaatatccttttctatgaatttgactacttcagatattcatcttaaagaaaccattcactaaatcatttttggtgagttaatttattttactacagtatctgcaaagtttatccacatcgtgacagctgtaaattatccctctttttgaaagggtaaataagacatttctatatatttatgccaaatttatctatttttccactggtagatgcttgagatatttctacctttttactgttgtaaataaaagcttttatgactaaagatatacagatttctcttgaagatcctattttcaatcttcctgggtaaatatccacaaatagtattgctagattatataattttttacaaatattttaaggaatcaccataatattttctatagtaacgatatcattttatattctaacaaagagtgctgaaaatataagatctaagagtctttggttgtggtgtcaagggttttttaagtagaagcacatgtcatttgcaaataacagtaatttgattttacttcttttcctatttatatccatttatttttttctcttgtattattgctctaaagcttcatacactatattttctaagagttgtaaaagtagg

SEQ ID NO: 2980 - DNA, 1200 bp, mus musculus
ggtttcttcattgtttgtatttccatttttagatcttggattgttttgttcaattccatctcccgtttagttttgttttcctgtaattctttaagggattttagtgtttcttctttaatgacttctacctgtagcagtctttgctgttagatctttaaggactcctacctgtttagcagtgttctcctgtaattccttgagggatttttgtgtttcctctttaagggcttctacctgtttagcagtgttctgtatttctttaagtgagttattaatgcccttcttaaaacttctactactaccatcatgagatatgagtttaaatccacatcttgtttttcgggtgtgttggtgtatccaggactcgctgtggtgggcgtactgggttctgatgatgcctagtgttcttggtttctgttagtaagattcttacatttgcctttcgccatctggttatctctgatgttaatgttcaagctgtctctggctggagcttgatcttcctgtgattctgttagcctctgtcagcactcctgggagtccaattctcacctgagtcccagtggtcagagcactctctgcaggcaagctctcctctttcaggacagatgtccagaagtctggagctctgatccacctcctgagtcctggggtcagagccctccctgtaggccaactctcctctggcaaggaaggtgcccaggggtctgggtctctgctctgcctcctggctgaggatgaaggccggacgggaccctgtccaagaagctctattgcttctgttgcccacgtgctctcagcgtcatggagagtgctctgggaccctagacaccctggaccaggttcacgcagaaggtggtggggctggccctgacctgaacggatcccagcctctagtccggtggggttcctttatccctgttcttgttggcacaagaccctcctctattctttggagctgatgttgtgttccactcacccgttttttccgaggtgatcccaaggttctgaagcatggagagtactctggagcccttagtggcctccactgggttcaggcagaagatggcaggtgtggccctaaccagaacggatgaaaattgctcttttaaggtctataaaaatatgttgcaatttttatgggaattgcattgaatctatagattgcttttggtaagatggctatttttcactatgtta

SEQ ID NO: 2981 - DNA, 1200 bp, mus musculus
aatcttctgcacctaagattctctcttccatctcttgcattctgttgctatgactcctgatttctttcctagcttttctccctttgtgattttttaaaaaattttttctacttccatttttagatcatgtatggttttgttcaattttcttttacctgtttggatgttttcctataattcttttagggatttttgtgtttcctctttaagggcttctagctgtttatctgtgttctcctttatttctttctttctttctttctttctttctttattatttatttatttatttatttatttatttatgtccctcttaatgtcctccatcattgtcataaagagtctttagatacatatcttgcttttctggtgtgatggtgtatccaggacttgctatggtgggagagttgggttctgatgatgccaagtaaccttagtttctgttgtttaagttcttatgcttgcctcccaccatctgattctctcacgtgctccctgcactccatatatctagttggaacctgtccgtcctgcaatcccagttgagtcagaactcctcagagtccagctttctctgtgatcctgtgattcatggatcctgtgatcctgagattctgggtatgtcagagttcttggcagtcaagcttcctctgagaccctgagatcctggtgtgtccaggcatgttagagtgcctggaaatcgtacctcctctaggggggcgaggtatgtccattgagtttgaaaccaagatagaccagtgctgactataaggaacctgagtcactggtcggatgggtcttgtgtctctgctcttgctggtcccaggcactccctgtgatgctggaacagatgctgtgttctactcaccagtgatcctaagatcctgggtgtgctagggttcctggggagtcgagagttctctggggctcatggaactatccaccgagtttgcctccaaggtggccctgtgctggcaccccattaactcttctttgaaagtctggtagagttctgtattaagacgactggtctagccctagttttatttgtttgtttgtttggtgattggtaggttggttgggttttggctgttgttattgttttgttttgtttttgttttattaggagacttgtagtggctgcttctatttcactatgggtgagagacctgtttaaagtgattatctgatcttgattta

SEQ ID NO: 2982 - DNA, 1400 bp, mus musculus
aataagaaaaacacactaaatctacacctagcaaaaagaaggaaatggtagatgttaaaacaaaggaatccataaacatagtcaagaaaaccaaaagctgtttctttatggaagccaagaaactagttcgatctctaactagactgaagagagatgaaagaagatataactaaaatcacaaatgtaggtggagccatacaaacaaaatagagtaagaaaatagtataaacagtcatgttaacaaattggatgatctcgataaaatcaaaaggcttagaaaatatcagagagggaagttagagacatccagcacaatcctgactcccctgagattaaaacaacaaaacaacaagtacctggctgcaggtagaggtggggtgaagggaaaacatgcatgacaacatcagtaaccaacagacacagagatcagagatcaggtcaaatccagaaacagcagcccttacatttgtgaaagaaacaaacagaaaaaggtaacatggtgaacccctgagtgcagcaacatggatagacggaacatgaagaaccccagcagagccctgagtggaagaaagacgtttaacctcagcgagtatcccagggacagaatttggtaccctgaagaaactgaagtttgaacaggagatctgtgatccacgtagtcaaactcacagtgactccataaacttcctagcgtggacattggtgcggcaatgagctatctgaagaccagttcaggcaccaaaccttaccactggggaggatgggaagctcttgagattcacagaagccctctccactccactaattaagcgacggaccaccggattgggggcaggaaattggctatgataacatagattcgtggacacaactccatgaagtaggagatgcagactactgcgcgggggttggggctcattacccttgggaaactgtagtccaacctcttgagacaagttgtgtgagtgtgaacagcacaactggtgcaggcaggatcacccagtacccctgcccctcccccaccccaccacagcataaattgctttaacttgatcacttgatgttctcagaggtacagaacatttagagaaagtgggccactgaggagcatttctcacaaccacccacacttcttgtgggaaacgcacatacaactggggagtccacagacctggacagtgggggagcggagggtggtacgagggcaactttgcactttctcaattgctggacctgtgtacagagactaatggagcgagttaagccagcagaggacattgtcttagcttgcatgccctggcaagcaaggaagggcagggccagcccctatacagccctttctggttctacctgtcaggacctgagaaagggcctcataacacccaccacacaactactga

SEQ ID NO: 2983 - DNA, 1000 bp, mus musculus
caggccagcctttccctcctgccctaaacagggtgactgaacagagtgtggcctgtgtgtcattcgttagagtcagctacaggcagttgacagcctcatgtgctttttaaggactgagcgactgaaaactatgctcagtctagaggacagcaagggaatgcaggtgggtgccagggagggacagggtgacttggcattgagaacactgctttgccatttcttggaatgtgtggtcttccactccactgacaccataatcatggactgtttgatggaaagccttcccatggtttcttcacccccacatgcataagaggcttggtggtatagcctagtggtagagctctttcctagcatgctcagggccccaagttcccacactggcaccaaaagaaaaaagcagaaaaatcacacatctaagagcattaagtggaggaagacactgtctcttcagttttacatatggaaaaactgaggcatggaatgactgagcactttctctgaggatttcatttctcgctgcaggagatgggtccatctgatgattgtctatgtgtacccagggctgcctagagttgggggtaaactcatgtcacctcaacagctcatgcccctagctccatgttagtaacagaatgttctactttttgtcccaggaattctggaatttatcagcttggctgtggggctgatcagcatcaggggagtggactctggcctgtacctaggaatgaatgagcgaggagagctctatggatcggtaagttccaacctttctatttatcagaggctatgaccaccaatgtttggacagcctgaagcaaaggataaaattgtttatcaagcacttgagagcccttttatgactgtaaaggaccggagtcttcttgttccaggctgttcagggccttgctccattatactgcttcacttgttcagccctccatccaaacaaggttttctgggatatgtttgctttcacattttccattagaggtcc

SEQ ID NO: 2984 - DNA, 1000 bp, mus musculus
ttgacgctaccaattggaaggcagtgggaatagcggagggtacatacacaattaagacagtccctcccctcctccaaatctaatggctgccaatagttcagacgtaaaagtaggggtctgtgatccctctctgcttcctcgactgactggtgatagcactggtctgccgtgcactcaatgcatgtaactacagaggttaatagttacagcagtggtatcgagtgtagtgaatggtgtttcattcccctttaccttttcccaactctttacattggtccaggtccctcttctaccattttctgcattttaggcagccacaagtctcttcctcgaccactattcactgtagaggaggacagactaatttttcagtaccatttcatcttcagtgtggctgaaatctgtgaacatgaccaagatgaatgcacacatgtgcaggctgattctacacttgctgttgtaggttactccaaaggatcactaacacagaattatttcttcattttattttgttttgcttttgaacagggtttcatgtatccccaagctttccttgaatttactatgtagccgagggtggctctgaatttctgatccttctgattccatctgggattacagccatgtgccaccatacccggatttcaaggcaatgttgtgaggctaataaaacaactttgccaactaaacaccaaagctgaaacatacaagcttcaaaataactggcagggtattttcagttgggtgggcgttacaggaggaggcataccatttacttacaaaatgtgtaccctgtaaggggattcagctgtgagaaaataatctaaagaattcaacaaaatacagaaggctcaaagccttgtattctgtccctgagcaggaaaaaaacaaaacaaaacaaaacaaaacaaaacaaaaaaaaaaagctgcaggcctcaagcaagactagcatatcgctagggcttctattctacatagtcttgaacttggttttaggttt

SEQ ID NO: 2985 - DNA, 1200 bp, mus musculus
aggactttttctgtgagttccaggccagcttggtctacatagagagttcctggtcagccaggactaaatagagaggccgtgtctcaactcccccacaaaaattccaaaaaaaaaaaccaataaaggtaaaaccaattaatgtaggtaataggagacagaatgtgaaaaatttgaagggactgtaattggaagtgagacactagatccaatcctctggagttttagcaccattttgatgctggtgccttatgtaaggtcggtgtctcagctctcctttgtagagtccgaaacctttgtccaaagagttaacctccctgcttagtaaatactactttatggaagccatcaagcttgaaactacatttcccaaagaccttcctatttcctcgcaggaactaggatgacaatttctataggtcaacccctaaatctcgcgacatctcaccaattctcatttgggctccctgctgaaagccattttgtttttcaggacgctttgcaagggtagctggggtgaatttgcaccaaggcagcagcatagtcgccgcagttccatcttcgtctccgcgatgttgcccttagccaaaaacgcactaagccgtctccaaggtgagcagataatgtgggcgagttctttacaacacccgggatccggctgtcctcgtgctcttctgccctcttcctccgccccaaatcctgcgggttttaattctaggtgcatggtcccctgcgtggtctccagtcactgggaagggaagctagccataacagaggtagctgtgacagtggctttatcatcctgtccttgtgttcctaacctcgttatgcattctctttcttcagagacctatgatttccaggaagaacgctttggcggacaccttgctcttttagcgatgatctaaattttagctctgggagtgtatttacgtagaagaactgatctcctacaataacggtggtaggaaactaaatctaccgcatctggattcatagcaaggggttgaaaaccttaagcctggcagctttgaagaagtcatctgtagattattaacggaatattaactatagcgaaaacaatcatggtcatttttttttcctgctttaaagttaggcaagtacgtggaaacttgagactagcagtatatatggaaaatacactggactggaaagaaaaaaattcatttttgtaattgcttt

SEQ ID NO: 2986 - DNA, 1200 bp, mus musculus
aatatccacataaaagcgtatacatgtacactcaaagccctatatttataacctgccaaattaaagatgggagaatgatctgaatagacaaatctcaaaagaaataggaaaaacaacaatatcaaccaaccagaactcacagagctcccagagactaacccatcaaccaaggaatacacatggctccagctgcatgtgtagcaaaggatggccttgtcaggcctcaatgggaggagaggtccttggtcctatgaaggctccatagatgccctagtgtaggagaatgtgagggcaggaaggtgggaatgggtaggtggattagaggaacaccctcatagaagcaggaggagggaggatgggatagggggtttccaggaagggggaaaccaggaagcagatttacatttgaaatgtaaataaagaaaatatccaataaaaaataaaattaaataaaatgaccaatatgataatttgtcaaggaaactcaaataaaaatacaatgagatattttactctagttatagtatctattagaagaataacaaaagaagtaacaagtcttactcagacggatgcagatacccacagtcaaacagtaaatggagtttggggactcttgtggaagaataggaggaaggattatggtccctaaggagatagtaactccacaggaagaccaatagagtcaactaacctggacccttggggctctcagaaactgaaccaccaaccaaaaagatacatggggtgggcctaggcttctccacacatatgtagcagatgtgcagcttggctttcatgtaggttctgaacaactggaatggggttatcccaaaagctgttgcctgtgggtgggatatgctcttctagctgggctgccttgtttggtctcagtgggaaagtatatgcttagccttgaagagacttgatacaccagggtgggggagtacccagtgggacccaaccactcagagaaggggaaggagtataggggaaataagtgtgggaaggagtgactgagagaggggaagtgagtgggatgtaaaataaataagtaaaataataataataataataataataataacagttttttgaataaaaaccataaaggttatttgacctactataaaaaataagaagtaagaaatctcagtcaaggtgcagaaaaagggaagagtttattattactatattttt

SEQ ID NO: 2987 - DNA, 1200 bp, mus musculus
ttctatttcttctgaattatccagttttatttctccatctgaaagatagctttggatgatatagtgttcttagttcacagttgtttacttttagatcttgaaacatttcattacatactcctggcttttatggttgttgactaaaagtctgaggtaaatatgatatttctttcaatgggatatgtaggggtgatagtagtctaatcttgcttcctagtatctcaccagaataacaattcagaaaagtgctgatttctgtagatcttgctgtacccaagagggaggagatgttgactcaagtcattttaaaacaacattctctccctggtttatatttctgtgtttgcctcacagaaactgaaatatcatgactgactggtaaaacatgttccagtgaaagaaaaattgtaaatagagaggcacgtattaaaaaattataggaagagtgcattgggtaaccatgcctatggattttgcaggaccagagatcacctagtatgcagatctcaggccagtggtcccagaggtcagtacaggttctgaatgttggccctagtgtccccagggtctcctgagagactggatctttcattccagaggtatctgttgtcaaagtctgtgtgaggttttgaagtctgaggtactaaattctgtatttttgtggtcctagaggttagtttggttctgtagttataacaccataataaaaaggcttaactgggtcaaaaatttattattcagtatctagaatgttcatagattctatgggtgaccaagattttgactccatcttgcagcttagtgtcgagaaccacccttagtcctgttggcacattgcctagactggatcacttcagcaactcattggtaatcaacaccatgtcttaccagtgctctcagctagacagcacatcagtattcctctaagaatcatagaaaccagaatcttccaattgtctctaaaaaaagaaaaagaagttgtcaaaacacacctacttcaacagatgtgtaaaatatgacaaagcaacacaaaacatatggcacaagcaccacatacaattcagcaccaactaatcagctcatttataagggaatccaaaatatcacagaaatagccaaaatgtctgaaaacaaaacttaggttctttgtgttagaagcaattagtgatcatgtagaagaacaaaaagatgctctaatta

SEQ ID NO: 2988 - DNA, 1000 bp, mus musculus
ttaattaagtcattgaagagttacattcttttcaagagacatggtatcttgccttttcatgcttcttgtatttctgtattacaacatgcaatatgcttgtttgaataaattccagttttatatggtgaactttttttttttttgagacagggtttctctgtatagccctggctatcctggaactcactttgtagaccaggctggcctcgaactcagaaatccgcctgcctctgcctcccgagtgctgggattaaaggcatgcgccaccacgcccggctggtgaacttcttattaaatagctctctgttgaggactcaataaccagtaatacttggagaattaaaagcaaactacagtaacagcacaaatatcaagctgtataaaactcagaaataaacttaaataaaatcatgaacatatcaccaatttaccacaaactcgcaaacataaagactaatgtaagcccttcctgccagtcttttctgctgggacagactgctagttagtctgctcccctgaagacatcacatcctgaggcttcccaagagatccactacactcagggcaactgacaccacagcctgaaggcatcccaggagtttctctgaacacagggaaacagaaaccacagtttgtagacctccttggaggatggcttcacattggacaacagcttgactgctcctttgaaaacacaacagtctgaaggccttccaggagatcagctgcagccaaggcaactgatcagcagcttctctgcacctctcaggaaacaacagttggaaggacccacaggaggtctgctatagccagagccacaggcctaccaggagacctgaagcaatccagggacaaaagaagcagactccagagtcactcagcccagcaaacaccagagataaccagatggtgaaaggcaaatacaaaacataagcaacagaagccaatatatgtggccattatcagaatccagttctctcaccacagcaaaccttgaata

SEQ ID NO: 2989 - DNA, 1000 bp, mus musculus
tttcaggtctagacaatatttctgcattgaaaaaataaacacagggctctgaccctaggactcagtggagatcaccattttctctcaggtgactctctaaggcaggtccactcaggagcacacaggccacagaagcagcagagcatctgggacagggtcctgtgggcctacatctgcagccaggaggtgcagctgatcctcagttctctgtgcacctttcctgccagaggagagcttgcttccaaggagtgcttggactctgggactcagaggagatcacctttttctctcaggtgactctctaaggtgagttcactcaggagcacacaggccacagaagcaacagaggagctgggacagggtcctactggcttacatctaaacgctgggggtgggactgttctgtagccctgtatgcactggtcttgccaggagagagctggtctccaaggagtgctgacaaaagtgttcagacccacagggcggacaagcacaagccacagagagcaagaccaactaacaccagagactaccagatggcaaaaggcaaatgcaagaatcttaccaacagaaaccaagacaacttggcatcatcagaacacaggactcccaccacaggaagtcctggatgtcccaacacactggaaaagcaaaatttggatttaaaattatatctcatgatgctggtagaggattttaagaaggacattaataactcccttaaagaaatacaggaaaatacaggtaaacaggtagaagcccttaaagaggaaacaaaaaaatctcttaaagaattacaggaaaatgcatccaaataggtgaaggaattgaacaaaaccattgaggatataaaaatgcaagtagaaacaataaaaaaaatcataaggggaggtaattctggagacagaaaactaggaaagaaatcgggagctatagatgcaagcataacaaacagaacacaagagatagaagagagaatctcagatacagaatattccat

SEQ ID NO: 2990 - DNA, 1000 bp, mus musculus
ggaaggaggttctatgtatagtgacctgaataggaggatttcagaaccccattcatctagggacactggacaggggtggtagaggtaagtaacgtcggggaggcaattggacctattatgtattataaattgtcctgagttgttttctgttccatgtaagatgcataaatgtctcatttagacatcctgtcaaaacaatattgtcttcttctgaaaaaaatattttaaaattaagaatgcattataaagtaataaatttgtgtgatgtttgtctattgtaaatctggaataaaaaacttaaacagtggtaaagttgaaaagtattaaataaataggccattgtcattcactgaagtctaggtaatagccattttctcaaggaaaaactcatttatcaaaacgtctcatagagtactcttttctggacatttgtgttcctcaagaatatgtttgaacatatgtgattttacatgagtgtatgtaagttgaagaagaattttaaaattatctaactatcccttagccaccatttgaatgtttttttatagcaacaccttgtgcttagatcaaataataggagagaacagttagaaagctcacgaatcaatgatttgtttatacaactcttgtaaagtctaattactcccaaagtaaaacgtgagcttccattaaagagagacagtatagcaaagtactggcaaagtactgtttgtcataaaacctgtcaaaattcaccataattaaaattctaagctgtgtatgtgtcctttaatgaaaatccttctctctatgtctctatatctgtctctctatagccatctctgccatttcttcttgtcctcctctttccctccacctcttctattctccactcactccatctttctccaaatactatgttctttatataacacttactttagtagttgttatttttttcctgctacatgtaacagcttttgatttccaaacattaggttaagtttgtcttaagaattac

SEQ ID NO: 2991 - DNA, 1600 bp, mus musculus
gtcttttccttgtgtcctggatttcctggatgctttgatttaggatctttttgcattttgcattttctttgttgtgcccatgctctctatggaatcttctctacctgaggttctctcttccatctcctgtattctgttgctgatgcttgcatctatgtttccagatttctttcctagggtttctagctccagcgttgcctcacgttggtttttttgttttgttttgttttttttgttgttgttgttttttgggtttttttgttgttttggtttggttttttttttgttttgttttgttttattgtttctacttccctttttaggtcttgtatggttttgttcaattccatcacctttttggttgtgttttcctgtttttctttaaggacatgtacctctttatcagtgttctcctgtatttcattaagtgagttattaaagtccttcttgatgtcctctaccatcatcatgagatatgattttaattccggttctagcttttcgggtgtgttggggtatccaggactagctgaggtggtagtgctggttctgatgatgctgagtggttttgctttctgttagtaagattcttatgtttgcctttaaccatgtggtaatttctggagttagttgttatagttgtttctggttagagcttgttcctcccatgaatctgttagcctctatcaaccgacctgggagactagatctctcctgagttttagtggtcagagtactctctgcaggcaagctctcctcttgcagggaaggtgcacagatatctggcgttcagacctgcctcctggcagaagatgaaggcctgaaacagggcctgtaccagaagctgtgtatcttttgtagttggcactctcacctacacagtctagtctctgagagatcctggaccagagatggctcccccaggtgctctggcaaagccctcctgggtggggtggacacttctcctctggcagataaggtgcccagatgtctggagcttgaaacggggactgccccagaagctgtgtggcttctgcctgtcccagaagctgttagcttctgtagtccacactctcacctgtgcagattctacataaatttaaattatgtgtttgaatgtgtacatgtgtgtatgggtgcccactagttctgaagagtttatcagatttccaaagctggagccacagacaattatgatcaattcattttgggtgctggaacaaaattccaatcttctacaatagtacatgcttttaactgctaagcagtctctcaagccctacaccctcacatcgtaattcttataataattaatctaaacagttactcaacttggctatcaggtgttgtacaccttgttgatccagcatcttgacttcctcttgcccctgcctactgttcacttactttcatctatgataatgattctatcaagactgtttagacaatctcaacttggctatcaagtgttgtagaccttgttgatccagcatcttgacttcctcttgcccctacctactgttcacttactttcatctatgataatgattctatcaagactgtttagatgatttttatttatgtgtcttcaactttaatc

SEQ ID NO: 2992 - DNA, 1200 bp, mus musculus
tttttattctgagatgttattgctttttgtcttttctatagtatttttatcttttatgcccataattagaaggctaggtcttttcttgctgtccccatgttctcttaatgtacttttaaattatcattaacaaagctttgcctagttatccaaaccctctgcattgtctttcttcctgactctctgttttccccataatccatgaatttgttgatgctgttcaccagagtttttatttttttttcttttttttcttttttttcaatttttattaggtttttagctcatttacatttcaccagagtttttaaatagctttttgcatttttcatatccaaccacattatagttggatttttcttcagaaattcaaattcttattcaattcaatctttatatcttagattaattcccatatctcatccaggttttctgttctctttgagtgtgtttatgttttcattgagttgtttgaacatgactatcaagtttaactttaattatatgcctggaaatttttccaggtcattctcatagaaggccactgtttggagatttgtactatttggaagagatattgatattttgatttttatattttctttatatgtggtatttgtgcatcagaaattagttgggtgagaggaagctttggacaaaacctgagttttatgtgataatataggagctaggattatgaaaaatgtataactttgtaggccagtggctggagattgaggaccccttacctgctggtgccagaagttaggggttggtagaattgagggctaagagtgcaacagacatatgatgcagttttttatacatgttagtatatgtgtagatgcatgtgtgaatgtatatgaagagaaggcatgtgcatggtatggtgctcatatggaggtcagaatatgactttggatgtttgattatctcctttccaccatagagcctgggaataaatcttatcttacccagctttcaaagcaaggtcttctgtcttaccagcccaatatcccattaaattaagtcaggtgaatttcaattagcaagaagaatgttcctggataatattgaaaataattatttgaaaaatatccatctctagaagtagcccaaatgacataaaacaaaggaagaaaatcattcaacaaaattgacttaaactgaataaaaataacaagaatctgagccttaccc

SEQ ID NO: 2993 - DNA, 1000 bp, mus musculus
aatatataaaataaatgcttatattctaaatttatatttcatatatgaaaggaaacaatgaaatatatttctgaatctgacttatcttaactattatctccagtgtggtgcattgagctatgcacagacagccatttgagggtagatattgaacccagtggtgataattcacctacatgggattgaaggagttctctcatgtctcctggaccctggctcctgtggaagttactgctcccctcagcccccacaagagaagcatggttagtagtcatgtaggcaatgtcccaaacttctgaccttcaggctagactcctccccagttacctagcaacagtaaagatcataagaggggctgtttggcccctcctcactctcttgcccttactcttcttactctcctctcttttctcctctcactcctttcctctctctccctcttcctctctagcctttcttctctctctctctctctctctctctctctctctctctctctctctctctcttcccctttctctcctcttggccattgccagtctctctctcccttttctaccttcttttctttctccctgcctttctacaataaagctctaaaaccatagactgtctctgttcatcaaggcctgctgcacagactttcacctgtgtgggaacctctctccctaagccctttctcctataacctcagggagcagggtgttgccccggggccccctagtttcgggggctgcccctgaagcctcatccctcaccccctgttgcatggggtcagtggcttagatgcccacccggggccaagttgaaattgtctggcagccctcccatgtctgcctgcccagagcataggaggaactctggcctggagtgagatatacttccccttcccctccttctcctatacccctttttgttcccacactccagttgcattcatttccttgaaaatatgatttaatttttatcagaatgaatcttcatatacattatacattat

SEQ ID NO: 2994 - DNA, 1000 bp, mus musculus
tttgttttctttagaattttggttttattcctttcagtatgttttcttttactattattataattttctgttagcataatttttcttacctaacctgattatcctgtgtgtgtgtgtgtgtgtgtgagagagagagagagagagagagagagagagagagagagagagagagagagaaattaattcactgagaattggtatgaagatagttttgaattaattatctggtaattcatttatctccgtactttaatgcaggggaggggggaggggggaagagaggagtgggagagaacccgcatcccgccagagttcccgtgctctgggcagacagatggacgcaggaggactgcacatactttccacatggccccaggtgggcgggtgtctggctgtgttaagccactggttctcagcctctggcatcctatgctggaaaaggcggaggagctgagaacagaatagaggccccagggcagcacacggccccagggatgaaaggaggagagggcagggagagaggtggcactgaatggttcccagtgggcgagagtccttggtcaggtccatggctggagcacaggatggccttctggcgggaggttaaacacagctcattagcccatcgttcaagcatgacaggccttaatgatcagagacagtctatggttttagagctttattgtagaaaggcagggagaaagaaagaaggtagaaagagagaggctggccatggccacatggagagagggggaacagagagagaaaaggagagctagagagtaagaaaggtgagagcttaagagagctaggaggagccaaacatcccctcttagctgggctatcaggctcttgccccgtaactgtggggaggagcatacctgactacagtcaggtaactggagtctagccagaatgccagaagcttgggacattgcatgactgatagtcacagaattatggacaggcacctgattctgggaacatggctcgactttcc

SEQ ID NO: 2995 - DNA, 1200 bp, mus musculus
gcttacacctatgtctcctgatcactttccaaagttttctaactccaggattgtctccctctgtgatttctttattgtttatatttccattattagatcttggatggttttgttcaatttattcacctgttataatgtgttctcctgtatttctttaatggatttatgtgttttctttttaagggcttctactcttttacttgtgttctcctgtatttctttaagggagttatttatgtccttcttaaagtcctctatcaccatcacgagaagtgatttttggtccgaatcttgattttctggtgtggtggcatatctagaacttgaaatggggagagaattgggttctgatgatgccaagtaacctttgtttctgttgcttctgttcttatgcttgcctactgccatctgattatctctagtgatacctgacctcactatatctgactggagcctgtccttcctatgatcctggttgtgtcagaactcctgatcaaagttcagctgtctctgtgatcctgagatcccaggtgtgtcagagttcctgggaataaagttgcctctgggaccttgagatcctgttgtgaccaagctcctgggatcctgtgatcctaggatcctggatttgttagagggcctgggattgagtcttcctctgagtattttgggacttactgtagagtttgggcccaatgtctgctcaggactctggcccagactggaaggaacctgtatcactggtcaggcagggttcctacctccctgggtctcactggtcccagttactcatggtggtgttgggacagatgttatgtccacctcttgaagcagcttcttaaggagttctgatcctgtgtctggaactcagtgaccagtacagtcatagcaaaatcattctgtagtccaactcccaataatggtcagcagcagctctgaatggaagttcaaggatctagcaatttctcagtcacacaaggcaagccggcaaagaagagagagtcaaccttttctaatcttatgtgaagacgttttgtggtttctattcttgagttcctagtgttggtgagagtacaggcttcatgttgtagtaagatgagatgtgacagttccacctagtttttatctcttgtcttgcaatttctggtacactatgtctttattctctgcagcctggcagctatgttcttgacatttttacta

SEQ ID NO: 2996 - DNA, 1000 bp, mus musculus
taaaacaagatgatgatatgggtaagaagatagtgtcttatatctgggtctgatgacctgagttcaactcctggaacccacatggttaaaaaagaaaaccaattactgcaaattgtcctctgacttccatatatgcactgtggcatgtgcatgtccatatgtagccttccccagcctgaagtgagcttgtgcagaccttgttgccactgaggtggggccaccagtgatgtagctttctgacttggctggtttcttttgttgtatcaactgctgctgtgcttcactgatatcctgctgcctgatgagacacctttgagacaatccaccacattgctggagtcttcgggctggatccagatgcctggatggactggcagggggatgggcctatcccctatataagcttagactctaagtaaactttaaggtgccttgaacagagtacatttgtcttgacgtctttatttctctccccgtctagtctctttcagccgcagcctgcctttcaggagtacccagttcctgtaggctgcgggcagcttacaacttacatccatacacatatacacacaaataaaataaaataaaataaaataaaataaaatcaggaaaaggaatacatgtggacaaatatacgttattattgattatagaaaaaatcaaaatggttgatgttcaattgacatatacaacaagtagcaagaatagtcactatgttcagatggaaaaatacatacatgtatacaaacatacaccacatataggcatgtatgtacatatatgatcaatacagatatttaaaaacaagttgtaattaaatttgaacatcagacaaactattttgtttttccattaatttatttacttactcactttacatcccaatagctaacacaatctctccccacgtcccctcctcttctctgagaagggtggacgcccccccagccccgagtatcaccccacccactataaaatttttaagtgcctatacatccta

SEQ ID NO: 2997 - DNA, 1400 bp, mus musculus
gaaatgattgacaacatcttctcaatgacattatctcaaccctgggacacctcctagggatagaaaatgtgaggcataggcagaagcagcaatgatccctttacacactgctttatttgagtttcacttgaactgtatccttccctgcaattctgtagtagctctcatgtttttcctttcacaaagcaccctgtgattcttgcaatatctaaatcttccttattgcattgggttagttaacctaattttctgagactacagccttattatgaatagtttggggctaaaacaccattcataaatgttttccattggtgcaggtaactgaatgttcttcaacctctaaggacactaagtacatggtttcctaggccacattcacattagggcacaggtgtccacccggccggggagggctttgctgagcatcttcgggagacatcttggatcccagactccaccgagactactctgcacaggtgagagtgtgaactacagaaactaacagcttccaagacaggcgggagccacagagatactgaggcaaccacgtttttggactccagatatccgggcatcttccctgccagaggataggtgtatgcccgtcccgggagggctttccctgagcatcttcaggagacatcttggatcccggactccaccaagactactctgcacaggtaagagtgtggactacagaagctaacagcttctggggacaggtcctgcctgtttcaggccttcatcttctgccagcaggcaattcagaacaccagatatctatgcaccttccctgaaagaggaaagcctgcctagagagagtgctctgaccactgaaactcaggagagagctattctccccagtctgctggtggagaataacagaatcatgagaggaacaagctctaaccagagacaactataacaactgactccaggctttaccagatggcaaaaggcacaagtaagaatcttactaacaaaaaacaagaccactcaccattatcagaacccagtactcccacctcagccagtacagggcaccccaacacacccaaaaacctggacccggatttaaaagcatatctcatgatgatggcagaagatatcaagaaggactttaataactcacttaaagaaatacaggagaacactgctaaagagttgcaagtccttatagaaaaacagaaaaacacatccaaacagatgatggaaatgaataaaaccatactagacctaaaaagcaaagtagacacaataaagaaaacccaaagtgaggcaatgctggagatagaaaacctaggaaagaaatctataaccatagatgcaagcatcagcaacagaatacaagagatggaagagagaatctaagttgcagaagattctatagagaacat

SEQ ID NO: 2998 - DNA, 1000 bp, mus musculus
tggacatagtactaagggaggatcccacaatacctctcctgggcatatatctagaagatgctccaactggtaagaaggacacatgctctactatgttcatagcagccttatttataatagccagaagctggaaagaacccagatgcccctcaacagaggaatggatacagaaattgtggtacatttacacaatggagtactactcagctattaaaaagtatgaatttatgaaattcctaggcaaatggatggacctggagagcatcatcctgagtgaggtaacacaatcacaaaagaactcaaatgatatatactcactgataagtggatgctcacagtcagctattggatggatcaaaggccccccaatggaggagatagagaaagtaaccaaggagctaaagagatctgcaaccctgtaggtgcaacaacattatgaactaaccagtaccccagagctcttgactctagctgcatatgtatcaaaagatggcctagtaagccatcactggaaagagaggcccattggacatacaaactttatatgccccagtacagtggaacgccagggccaaaaagtgggaatgggtttgtaggggagtgggggggacggtatgggggacttttgggatagcattggaaatgtaattgaggaaaatacgtaataaaaaatatattaaaaaaaaaagaagtaacatcctgtatggataatgtgatggtttgaataggcttggcccagggaaaggcactattaggtcaggccttattggagtaggtgtgtcactgtggtcttgggctttaagatcctagtcctagctccctggaagccaatcttcttctgtctgcctttggatgaagatgtagaactctcacctcctcttgcaccatttctgcctggatccttctgggcttccaccttgatgataatggactgaacctttgcaccagtaagctacccccaattaaacgatgtctttttaagagttgccttggttgtggt

SEQ ID NO: 2999 - DNA, 1200 bp, mus musculus
ttcaagccccattttcattgctgcttagatattttaggatgaagtctactttttttttagttggatattttatttatttacatttcaagtgttattccctttctccgtttcttttctgcaaaccccctattccaacccccttaccctatttctatgagggtgctctcccacccacccactcctgcctcactgtcctagcattcctctacactggggcatcaagcctacacaggaccaagggtatccccttccactgatgccagataaggccccttcagctccttcactgcttcccctaactcctccattggttccctgtgttcaggctgatgtttggttgctagcattacatctgcatctgtattggtcaggatctgacagagcctctcaggagacagctaaatcaggctcctatcagcaactacttcttggcatcagcaatagtgtctgggtttggtgactgtatatgggatggatccccaggtagggcagattctggatggccttttcttcagtctctgttccacagaagcatccactctttgctcttcctcttgagcttcttgtggtctatgaattgtatcttgggtattccgaactttttcccctaatatccacttatctgtgatgaggaagaatggagaaatgagcaattctttatctggtcactataaaactaatttactagtgagccaataatgtttttaaacatgtgactcctttaaaggcattgggaagtaatagacaagtcaaaggactaagagcttctgtttccctcttgaatggagtaggaattgaaaaaataattcttgctttgtaaaagaatgttaattcctaacagaggtaattcagcctggacactgtgcaggatgtcacaaactctatgactatttagtatgtgtaaatgtgtgtctttgaaccacagatttttttggaaaaaaaataattgcctagcaaagatatggatagactgaatcttccatgtacatattgaaaggaagagggtctccatatgctccctaattctactccttttgagatgtcaacatttgtgaacatactggaaggatttttgcataagtaataccaggagttcaactacccaagaagccaaataacctcctggaaatgaaatcttagggaagcaaataatgcagaattcagggtgtgttcaacgataaataggtcagttccattaaa

SEQ ID NO: 3000 - DNA, 1000 bp, mus musculus
agatttttcctcttgtgattctgttagcctctatcagaagagctgggagactagatctctctgctgaatttcagtggtcagagcactctatgcaggcaagatctcctcttacagggaaggttcacagatatctggcgttcggacctccctcctggcagaagatgaaggcccaaaacaggacctgtcctagaagctgtgtgtattctgcctgtcccagaagctgttagcttctgtaatccacactctcacctgtgcagactacactcctcggagtcccggaaccaatatgtctgccactaatgctcaggtaaagccctctagggccgggcggacacctatcctctggccaggaaggtgcccagatgtctggggcctgaaaagggggctgcctcagaagcgctgtggctcccgcctttcccagaagttgttaggttctgtagtccacactcttacctgtgcagactactctaggcagagtccctgaaccaagatgtctgccaaggccttgcttttcgccatctggatatccctggtgtttgttggtctgggtaactttctggagtctgcttcttttgtccctgggttgcttcaggtctcccagtaggtctgtgcccctggctgtttgagaccacctgtggggcctttcaattaggggctcttcacagggtcagagaagctgcttatctgtttccctgacagcagtagatctcctgggaggacttcagactcttggatcttcagtggaatagtcaaggtgttgtccaagtggtccaagtacaacttatcctcaactgctctgagtgcagagggtcttcaactgattcactgcactgaatgcagtgtgttctcaattgctgtgtgcatcgggttctctaggatggatcaagatatgagattttatcgaaaggacgcagatgtagctgtctcttgtgagactatgccggggcctagcaaacacagaagtggatgctcacagtcagctaatggatggatcacaggg

SEQ ID NO: 3001 - DNA, 1000 bp, mus musculus
agtgatttaccattatgaaggcttcttctggcggtgctggttttttggtgatgatccacaaacttcagtttggagatattggtttagtgagtataagatattttgtgatgtgtgtattaaaagtaagtcctgagacaaaaggatggaccatcaagagactgccatatccagggatccatcataattagcctccaaacgatgacaccattgcatacactagcaagcacttggtgcaaggaccatgatatagccgtctcttgagagactaggccggggcctaacaaacacagaagtggatgcttacagtcaactattggatggatcacagggcccccaatggaggagctagagaaaatatccaaggagctaaagagatctgcaaccccgtacttgcaacattatgaactaaccagtaccccggagctcttgaatctagatgcatatgtatcactggaaagagaggcccactggacaggcaaactttatatgccccagtacaggggaacaccagggccaaaaatggggatgggtgggtaggggagtgggggggggagggtttgggagacttttgggatagcattggaaatgtaattgaggaaaatacgtaataaaaaaataagagaaaaaaagagtaagtccttatctcagcttcaaaattaatctcttacatagaaattgaaggagatgctttacagtaacaatatatgtatataataaaactctcagatttggaaggcaatactatttttttttgtttgttttaatgtgtatatggtttgccccgttcatttatggccctggactttaacccatcatcactttatacatgctaagcaaacacttaacaactgccttagtcgaggtttctattcctgcacaaacatcatgaccaagaagcaagttggggaggaaagggtttatttggcttacacttccatactgctgttcatcaccaaaggaagtcagcactgaaactcaagcagatcagaaagcaggagct

SEQ ID NO: 3002 - DNA, 1800 bp, mus musculus
ccatgagagggagagcagtcaggcaaagatcaaaaacttccttcttccatatattttatataagctaccagtagaacatgcagtcaaaattaatggtggaacattaatccaggatctgaatttgaattaaaggggtatcttgcaaccacaagagatcaagtgtataagtaagtcttcttaactacagatgatagctgtctcttgtgagactaggccggggcctagcaaacacagaagtggatactcacagtcagctattgaatggagcacagggcacccaatggaggagctagagaaagtatgcaaggagctaaagagatctgcaaccctgtaggtgcaacaacattatgaactaaccagtacctcggagctcttgactctagctgcatatgtatcaaaagatggcctagttggcaatcactggaaagagaggcctattggacacgcaaactttatatgccccagtacagaggaaagccagggccaaaaaaaaaaaaaaaaaaaaaaaaaaaaagatgggaatgggtgtgtagggaagtgggggggggggcgagggtatgggggacttttgggatagcattctaaatgtaattgaggaaaatacgtaataataaaaaatattaaaaaaaagaaggaaccggaaaaaaaaagaatgctcaatatccctgattagatataaaaacatttcaacgtggaaaaaaaaaagaataaaatttcctccaggaatacccagtcacatgggttttagtttagtccagacatagtcaaggtaacagccaagaatagctatcactgccacagcctctgggggagccatcttggtttcaggattctgcctaaactagtctgcacaggggagagtgtggactacagaagccaacagcttctgggacaggcagaagccacagagcttctggggcagactgtgtttcaggctccagacatatgggcaccttccctgctgaggagaggtgcctgtcccgcccaggagggctttaccacagcatctgggggagccatcttgggttctcaaattctgccaagactggtctgagcaggtgagagtgtggactgtagaagccaacagattctggaacaggcagaagccacagagcttctgagacagaccgcatttcgagccaaagacatctgggcaacttccctgccagtggagaggtgtccgctccgccgaggagggctttaccacagcatctgggggagacatcttggttcctggatcccgcctagactactctgcacaggtgagagtgtggactacagaagctacacagattctggaacaagccctgtttcaggccttcatcttctgccaggagacaggtccaaatactagatatctgtccaccttccctgcaagaggagagcttgcctgcagagagtgctctaaccactgaaactcaggagagagctagtcttccaggtctgccgatagaggctaacagaatcacaagaggaacaagctgtaacagagacaactataacaactaactctagagattaccagattgtgaaaggcaaatgtaagaatcttactaacaaaaacaaagaccactcaccatcagcagaacccagcactcccacctcaggcagacctgggtacctcaacacaaccaaaaagctagacccagatttaaaagcatatctcatgatgatggtagaggacatcaagaaggactttaataactcacttaaagaaatacaggcgaacacagctaaagaggtataagtccttaaagaaaaacaggaaaccacaaccaaacaggtagaagtccttaaaga

SEQ ID NO: 3003 - DNA, 1200 bp, mus musculus
gatactggttgacacaggccaggctcacctcttcaacatcagctgtgagtaatgcatagattcaaaagcagaggatgtggagcaaggaagggtcaataatgttaaacttaaaaataaataaagaaagaactacagtaaatattgcctcatcattgtctcatcttacatcattacttgcattttttggaaaattactttgcttctttcctaggcttgtttatgaatagatatgtgtggggctgtgtgtatagaggaagagggggagggagagagcccatgtctggctagagttcctgtactctgggcaggaagacatggggggactgcctggtgctttccactcagcccggggtgggcatctggctgtatgaagatactgatcacacacggcgggggatggacaagaggcagcccccaataccaggttctcagtctctggcatcccatgctggatatggcagaggaggtgagaacagaatagaggtcctgaggatacaggaagagggcagaaggagagaggttcccacacaagtgggagtccttagtctgggccttgatgaacagagacagtctatggttttagagctttattgtagaaagtcagtgggaaagagagaagataaaagaaaaagaaaggccagccatggccaagaggagaaaaagggaaagggaaagagagaatgagagttagagagtaagaaaggtaaaggcttagagaaaaagaggtaaaagcttagagagtaagagagagcaagagggagagagcaacatgggactaagcagaccctcttatagtgggcttgttatcttgctgttgctaggtaactgggaggagtctagcctaaaggccagaagcttgggacattgtctatgtctatgtgactactagccacacttttcctgtgggggctttgggggcggtaactttgacaggagccaggggtccaggagacatgagggaacaccttctgccccatgtaggtgaaaattatcaccaccgggttcactgagactccacctttcaactcgaatggagacaaagctgtctgtggatagctatctgtgcatatacacagatatgtgtaaatgatctaaatcatgtaatgtctacttaactgaaatatctacagtttcttttcttattaagtacctttctaaacatacacacaaagacattaaatttgtcacatagtgaatatt

SEQ ID NO: 3004 - DNA, 1200 bp, mus musculus
tgagattctcttttctatatcttgtattctgttggtgatgcttgcatctatggttcctgattactttcctaggttctctgtctagagatttgtctccatttatgattcctttattgtttctacttccaattttagatcctggatggttttgttcaattccttcacctatttggctgtgtttttctgtatttcttaattgtgttctcctgtaattctttaatgaatttttgtgtttcttctttaagggctgctacctgtttacctatgttgtcctgtatttccttaaaagagttatttatgtccttcttaaaatcccctatcagcatcatgggatatgattttaaatccacatcttgcttttctggtgtgttgggtaaccaagacttgttgtgttgggagtactaggttctgatggtgccatgttgccttggtttctgttggtaatattcttaagtttgcctttcaccatctggtaatctctggtattaatgttcttgctgtctctggtttgagcttgttccacttatgggtctgtaagcctctgtcagcactcctgggatatcagctctctcctggcaagatcagtgcacagaggactgctgaacagccccacctgggtgcagatggaggcagtaagggccatgtctcagctgctctgcagcctctgtggcctatatgttcctgtctggtcttgccttagaaagtcacctgagagatctcccctgagccccggggtcagagcactccctggagacatgtgctcgcctggtaggaacagtgcacagagggctatggaacagccccacctcctgggtgcagatgaaggcaagaaggaccctgcccctatatatacatattcctatttaccatatattacctttctatagtctcttcctgcttcttttgaattccttcgttttcccagccagtttctctttgtgtaattttatttttaaataatccagtcaatttaatttagcatttattgaatcaacttcaaatatgggattttgctgaagtacaacttgagtggctataccattgaaaaaataaaatacttcctccttacagcaaggagtaatctttagtgttatcaaaaagaagggtggggccatatgaagttatctttcatctatatgaaatatacacaggcccaatcttgtgcagaacttgtgtaagtagcacatactgctataactt

SEQ ID NO: 3005 - DNA, 1000 bp, mus musculus
agaggaaaaacttagacactgattagttttctagggtagttaaagggtttgctcaagcaatcacaagtcaggagggagggagggacctaggaggaaaaatggttggagagggagtagaggggacaggggtacctgatctggtattgggtaagggaaaaggactgaagctctgagggacagcagaaagaatggaaacagacaacctctgaaaatacgaggttgggggaaccctccagaatgtaccagagccctgggaggtgagaggctctcaggactcaaagggagggaccttaaattaaatgccttacatttaacttacagaacccacctagaacaggaacacagggcatcaaatgagggatggggttgtcatcccacagtcaaaactctaacccataattgttcctatctgaaagagctacagggatggaaaaggataggagtctgaggaaaagaaggtccaacaacaggcccaaagtaggttccagctcaaggggtggtcccaagttctgacaatactactgaggctatggagcactcacaaaaagggacctatcatgactgcctcccaaagacccaacaagcagctgaaagaatcagatacagatatttgcacccaaccaatggacagaagcaggtgacccctgttgttgaattaatgaaggttgttagacactgagaagaagggcaaacctgtaggaggtccagcagtctcaattaatctggaccccagagatctctgaaacactggatcaccaaacagagagcatgcaccagctgatataaggccaccaacacacatgagtagaggacttctgagtctctgcattcaaagatgatacaccaaaccctcaagagactgtgtatcccagggagtttagaaatcaggtggggtgggggatggggacatctacttggagttaggggtggggaaggaggtatgtgatgtggaacagttgcaaggtggatcaggggaggaataaaatatggagtgtaaaga

SEQ ID NO: 3006 - DNA, 1000 bp, mus musculus
catattttacttatttgcccatatgtatgaagacaattcatttgattatacattttagcatttcagttggtataggaattcttatatatatttgaaactattttatttataatacccaggagtcaagtttttgaagcaaataattattactctaatttttgtggaattttcattattattaagaacatttcacagcactgtctttgaagccacaaagccaataactttctcatttttatatgtcttaataattttaactagatgtaatacccaataaaagggagggagaggctgtagagaccatatccagaagttaggcaaggccccagtttaaggaaaggggccacccactcatctccaaaattttaaaacagaatagttcctgtcttaaagaaataatgggacaaagaatggaacactgactgaaggaaaaagcataaagactgccccacctggggatccatcccatattcagacaccaaacccatacactattgctgatgccaagaagggttgctgacaggagcatgatatagctgtctcctgagatgccctgccagaacctgatcagtacagatgtggacctgatcaatacagatgtggatgcttgcagcctaccattggactgagcacagagaccccaatggaggagttacgggaaggactgaaggagctgaaggggtttgcaaccccactggaagaacaacattatcaacttaccagaccccaagaactcccagggactaaaccacaatccaaagaggatccatggctctacttgcatatgtagcagagaatgtccttatctgacatcaatgggaggggaggctcttggccttgggaaggctccatgccccagtgtagggaaatgccaagacatggaagtgagagtgggtgtgtgggtgggggagcaccctcagagaagcaaggggagggggatgtgatacagggtttgtgaaagtgaaaccctgaaaggagataacagttgaattgtaagtta

SEQ ID NO: 3007 - DNA, 1800 bp, mus musculus
ataagctttctgtatgtttaaaggcatctcttttttaggttgaaaatgttttcttctatgattttgttcgtaatattttctggtccttgtacctggaactcttcaccttcttttatttctattattctttggttaggtattttcattgtacctcagattttctgtatgattgtgtctgaatatttttttttttttagatttaacattttctttgtctgatctatcaatttcttctattgtattttctattcatgagattctttcttccatctcctgtattctattggtgatactttcatctgttgtttctgttttcttctctaggttttccatctccaggattccaccagtttgtgatttctttatttcttttgtttccattttcaggtcttgatgacttttatttatttccttcacctgcttaattattttttcctgtatatctttatattaattcattttctctttaagaacctctacctgtttgattgcattttcctgtatttctttaaggaatttatttgtttcctcttttaaggcctttataatctttataagaccagttttaaggtcattttgttgtatttcaggtaggttaacatatctagagcttgctgtagtaggagagctgggtctggtggtgccatatttctctggcttttgttgactgtattcttattctggcctttggccatgtatgtggttgtccctagtgttggcaggcctggtatttcatatggcagcaggactctgtggtaaaagtagatatggtagtcactgatagcagcaagtctctgcaatttcaggtacagctggctgctcccaaggacaacaggcttccggtgatgcaagcagagctggtcatccctaatagatccaggcctctcatctatggtgatagatgcctcctaggatgtaggcagagctgatagtcccttatgcttgcaggcatcatggatataagatagaggatggaccagaaaatggagcaccaagcagacagggcagttctgctagtcttggcaaggaaccagtgtgcagggtcttggagcttggggatttcacttggttgtcctgggtgacagtggatttctggggaatcaagcagagctgtggctggtagaaaaaatttaatatctgtacatctgacagtcaattaatatccatgatatagtaaaaataaaatcaaagaaaaaagactcagagaaacaaatcatccttttaaaaacatgtattatgcattgaaacatcatctttcaatataagacttgaaaatgcttaagaactaccttaaaaggtgttcaatatatttaccagttgtgatagtttttatatgcttgacccagggagtggcactattaggagatgtggccttgttggagtaagtgtgtcactctgggcatgggctctaggacccttgtcctagctgcctgggagccagtcttctcctagatgccttctgaacatgatgtagaaatctcagctcctccagcccaatgtttgcctagatgataatagattgaacctctgaacctgttagccgctccctattaaatgttgcccttataaaagttgcctttgtcatggtgcctctacacagcactaaaatcctaagacaccaagcaattagggaaactcaaattgaaatggctattagactttacttcacttctgtcagaatggctaagatcatcaatacaaatgataagaaattctgataagaattgctcagtgtctgttgttatatcttttcatttcttattttgtttatttgtatactgtctctctctcttttggttg

SEQ ID NO: 3008 - DNA, 1200 bp, mus musculus
tccaaaggcctgccgtgcagtgtgggcaaaaaaggcatccagagacctgcctgtcaccacatggcatgggtgcaccgaagacacaaagaagcctctctgctgctatggaatgcagcatgggaggagcaaggccttcagagatctgtcggctgccacaccaaatggattggctgaggagggcatgcacagacatgcccaccttgtggcctgtccacatacagggtgcactggttggttttgtgtggcaacttgacacaggctggagttactacagaaaaaaggagcttcagttgagtaaatacctccatgagattcagctgtaaggcattttctcaatcagtgatcaagaggggagggccccttgtaggtggtaacatccctgggctggtggtagtcttgggttctataagaaagcaagatgagcaaggcaggagaagtaagccagtaagtaacatccctccatgacctctgcatcacctcctgcttcctgatctgcttgagttccagtcctgacttcctttggtgatcaacagcagtgtgggaagtataagctgaataaacacttttttcccaacttgcttcttggtcatgatgattgtgcaggaatagaaatcctgactagacacagagccactataatgttcaaatatatagtggacagatgagagagaaagagtggaacagtctaaaaattatgaagagagatggcattggagacttgagaggaatagccttttctaagtagtcagcccagccactataagccatggtgaagtcttagccttagcctgtgctgcttctgaggaccatgtctgggtccttgtccatgcaacatcagatggtctgtttctatgtccatggttcatattaccactggtgaccaggcagacaccactggtctgagcagttgtctgggtccaggtattgtccaagggctgtggagaactggcctcacacctcacaggctgtgacattccattctacctctccctggctatagcacttaggagagctgatgttgtcctctgctggctaaggcactggttcaggcaagtttggcactgctggagagctcacactagtgatgtggatacttatgagctagcaggcctacaaattcagggaatacccaggcccaaatccagggctttgaattagcccacccccaaatctacctcatcgatgaaccgttggatcatg

SEQ ID NO: 3009 - DNA, 1000 bp, mus musculus
ccttagagaaataacaagctcaaggaagaccatggaaaaagtaaaaggtaaaaagcggtcaggtcacagttacaactggccataaaatcagtccttgaacagacacctatcatacccctcctgcttcagtactatcccactctctactcctcttttctgtgaatattcacattattcctatactttatataaacctaatgttttctggactcagggtcgcttgccagcattcaggcagtgtgtgttaggtgggcgaaatgagttcttttgtgagttgcagcaggctttgcaaatcttggggtcatttgggtttcccttggagtcagggcacaacatgggtactattattattgttgttgttgtattgcttcctaatgaagtcaaggagagtagcaggaaggtgacataaatattacctctattagaacatccaaactaataaaattcaaaatcatttcacatcgagaattaatttcctagccaactatttcaatatcttcctctcaatgagggatctaatgatcaatgaagccacttaattcctaaacactccgcttttttattatagaagtgttgactttcataagaagctttggaatgatccagactatataatcaagttgaatcaaataattatttcatcctgaagactaataagacaaataacgtttcattcttgatattcttacgaactttttttcctgggttcattttcatcaacgatattacattttctgaaagataatccctgagtagaagcaattgagagagaactgcccagggatgtttgttgttagatttaggatgctttgatctgactacagttcccacagagggcaatcaagactgacttgtgggtgaatgtttgctgagaccttggatattatttgctttttagatcattgtgactactgcttctaggtttcttggaacttgctagttgataataactgaaaatttatgagtgttcagtgtcaagaatccaatctaactggtctta

SEQ ID NO: 3010 - DNA, 1200 bp, mus musculus
atttatggttcctaatttctttcctaggatttctatctccagagttgtctccctttgtgatttctcattgtttctacttccatttttaggtcttggatgggtttgttcaattctttcatctgtttggtcgtgttttcctgtaactctttaagggatatttgtgtttcctctttaatggcttctagctgtttacctgtgtttttctgtatttctttaagggagttatttatttccttcttaaagtcctccatcatcatcatgagatgtgactttagatccatatcttgcttttctggtgtgatggtgtatacaggacttgctatggtggggagattggttctgatgatgccaagtaaccttggtttctgttgcttctgttcttatgcttgcctcctgccatctgagtatctcaagtgcttgctgccctcaatatatctgattggagcctgtccttcctataatcattgttgattcaggactcctcagagtccagctctctctgtgatcctgtgatcctggtctcctgtgaacctgagattctgggtgtgtcagagttcttcgcaatcaagcttcctctgagaccctgagatcctgatgtgaccaagctcctggtatcctgggatcctggaatcctaagatcctgggtgtgttacaactcctggaagtggtgcctcttctgggaactgtggggctgtctggttggtgtgtttgaaaccaaggcataccagcattgatcagaaggatccagagccactggtcatacagggctcctgtgtccttgctcctgctgtcacaagcctgtcactattggtttggaacagatgttgtgttcccctcaccagtgatcctaaaatcctggccatgctagggtgcctgcagcatgtagagtcctctggggaccttgggacagtctgcagagttttcacccaaggtagcctggagctggcgccaaccagaagggacctgcacccctggtcatgtgggtttcctgagtccctgctgctggcacaggccagtcatgattggtttgaaacagatgttgtgtaccactcaccagtgatcttaaaatcctgagtgtggtagggcacctgtagcgtgaagagtcctctggggaccttgggaaagtagatttctttttagctgttagagtttttcagactaatttctacaatgactgctccagtttgcaatccctccaac

SEQ ID NO: 3011 - DNA, 1200 bp, mus musculus
aagcatggactgtgagttattcttcagaggaacataagaggcttcccaaaacaatattagtttaacaagaaggcccaagtgaggatgctccaatcccacttagaaaggggaacaaaataatcatgggaggcagagggaaggaggaaccagaatggtagaggggagaagaaagtgggggaagggtcaagtatggtgaaagacaagagagaatcccagagggagagcagaatcaatgaaaatatgcagctgtggagcagggtagaggcacagaggaaacttcaagaatgtcctagagaccaggaatattaaagggtcccaggactgagtggagaggaccttagctgaaatgtctaacactgggaagatggaaccttaagagaacacctccggtagatagacaggaccaccagtggagagatggggcaacccactaaccttcaaaatttttgacccagaattgttcctatctaaagaaaatgcagggacaaaaatggagcagaggctgaaggaaaggccatccagagaccaggccagcttgggattcatcccatgcacaggcaccaaaccctgacactactactgataccatgttgtgcttgcatagagtagcctagcatggctgtcctctgagaggctctaccagcagctgactgaaacagatgcagatatttacagtcaactattggactaaggttggtgaaagagtccttatggaagaataaggactgaaggagctgaaggagattgcaatcccataggaagaacaacaatcaactaacctggacccatcagaactcccaaaggctaagtgatcaaacaaagagcatacatgggctggtctgcgcctcctcccacatacacatacttatgtagcagaggactgccttgtctggcctcagtaggagaggatgagaccaatagtgtagagacttgatgccccagggaaggggggcattgtggggcatgggtgagaggtatatgtagtaaggtgtgggtgggtgggtgggtgcctcaggggttgggtgggggagcaccctgtcagagtcaaaagggatggggcaggggggtgaagaactctaggaggggtgactgggaaatggggcaacatttggaatgtaaataaaacaattatttataaaaagaaaaaaaggaagaaaagtcagaaatagatgtacagtaagattcaacaatcttattatt

SEQ ID NO: 3012 - DNA, 1400 bp, mus musculus
atatctatatatacatctacatctatatctatatctatctatatattcctcagtcctgtgcttttactagactcaatttctgggggtgataagtatttagcctattttcaatattgttaattttgctctcaccctttggaaacttctaatattttattgaattaaccatgtgccttcttaactgatattttgggatataagcttaagttatctcttgcatatcaatccagtgaccaaagttcctgaaagattctccatcatctccattaaaatgtccaaatctcttagctctgaatgtaaaggttttgccatttgccttcatcttaaccttcaccatgcattgtgacatattctagcaaaattgctgcacgtgttattgcctctttcccttctcagacatccttgtgtggcttagtatttttcttctctcttttaaattttattttctctttcctcaattctactagcacaaaaggaccttgaagtattggcgaagattgaatggcatcggagttgagctgctcagtcttctgcaaaggaagggaagcttgcaatttctcttcagagttttgtgtttttttcttctggaattgtctaattgtccacatgtttgttcctgggttttaaattactatagcatagtattagaattttttaaacaactgaaaatattttagtgatttggggattgtaacacactatatccttttcttttttttgtttttgtttgtttgtttgtttgttttttcgagacagggtttctctttatagccctggctgtcctggaactcactctgtagaccaggctggcctcaaactcagaaatatgcctgcctctgcctcccgagtgctgggattaaaggcgtgtgctaccatgcccagcaacaattatatcctcttcttaataaattgtccatctaaaaagttgacattacagtctctaccaccattataatgtatattttctgagtatttccagagctagagaaagggtacacttaaacctccacactgactcttctactgtgtgacaaattactcacattcgatgacctgggtcagaggttaaaatatgtggttacatcatttaagtgaaaaaacaaagttgactgacccatcttggccccacttctgggagggggtgtgaaatatgaaacaacagtctttgatcaccagatcacagaccaccccacagacagttcactatggttctgatttctaaattttgtcatatacaaggtaatatttgataaatgattatagaaagagctgcatcatcttgcagtattgtctgcctgcttctacaaatattatcatctaactaattagaaaagattatacatatatatgtattatacatatatatggatcattaagaagctactaaaaattcagtactc

SEQ ID NO: 3013 - DNA, 1400 bp, mus musculus
atgtatttagaacatagtccaaatcgatggcatccattccttacttatttaaagagccttcccttatagaaaaaaaaataattcgaaatggtgtagagctgagatgaaaggatggaccatctagagactgccatatccggggatccatcccataatcagcctccaaacgctgacaccattgcatacactagcaagattttgctgaaaggacccagatatagctgtctcttgtgagactatggcagggcctagcaaacacagaagtggatgctcacagtcagctattggatggatcacagggcccccaatggaggagctagagaaagtaaccaaggagctaaagggatctgcaaccctataagtggaacaacaatatgaactaaccagtaccccccagagctcatgtctctagctgcatatgtatcagaagatggcctagttggccatcagtggaaagagaggcccattggtcatgcaaactttatctgcctcagtacagggaaaccccagggccaagaagtgggagtgggtgggggacttttgggatagcattggaaatgtaaatgaaataaatacctaatttaaaaaaaagaaatggtgtagaacaatataaactaaccagtacccaccagagctcgtgtctctagctgcatatgaatcagaagatggcctagttggccatcactggaaagagaggcccattggtcatgcaaactttatatgcctcagtacaggggaacgccagggccaagaagtgggagtgggtgggtaggggagtgggggggagggtatgggggacttttgggatagcattggaaatgtaaacgaagaaaataccaaataaataaataaataaataaataaataaataaataaataaataaatggtgtagaatcttccagaaattaaaacaaaaatgcttgttgggacctgtaagggatatgaaagtatgtaaaaaataaaattatttttaaatttcaatgctctgtggattaagagaaaagaatttttaaatagcatatcatcacaaaacaagagatgttactataaatgaaacacattagcagtatttactttgaacactaagtacttactaatataaatgttattataggtgccttcttaatatggattaagatatatcaatattttaggaattaagtaatcttagggattcagtacaaatcactgaaaaactgttttttctaaattgtgtccttgttagatcactaccttgatatgccttccatcttatcacaaagtgataaatatagatttttaagaccaatgatttgaaggatgattcttttgtataaacaatacataactataaaaggtaggaaagatgaaattttaagctctatcttctctatataaagattctgtagataaagtggat

SEQ ID NO: 3014 - DNA, 1200 bp, mus musculus
cctaaaatatagtaaataaaggcaatcttaatgaaattgccaaataatagagaaagaaacctaactggccatatcttgtcaacaaattaagtttctggtcttcggtactttactagagttgttggccaaatgagtaccatgggaattctcaaacaaactcagattgttgccataactctaggttgctctcaagtgacagcaatgtctcattgttgaagacaactcctttttttcccctttttctttttgggtttttcaagacagggtttctccgtatagccctgactgtcctgggactcactctgtagaccaggctggccttgaactcagaaatctgcctgcctctgcctcccaagtgctggaattaaaggcatgcgccaccactgcctggctaaagacaactcatacacaattcattgaacatggagaagccaggtgcctacatagagccttcacccctatgtgctaaaagccttggtatttgaagaaactttgcaggctaccaaaagttaaatgtaaaactaatcctgacacaaaccctttgatctacaatatggttctgcctgaaaaatatggtaatatgagggtagcataaagctaattacctctgtgacctaaggcccactccatgagatgaaacccataactgatactccttaagtgaccaagaatctgtggatagcctagagtcccagatgaaagctaaaaattactgttctaaataaataacatagtaataaaatgatccttactggcatttccctatactcatagatcagtgccttgctcagcatcatcagagaagcttcctcctgcaacagatgggaacaaatacagagacacaccccctcttagctagacctgcagaaaaagatagagaagcagagacagaaagagatggagacaaagacacagagacagagacaaaaatagagaggagaccttggaacactcggctctaaattggatgtctccatcaaattcttcccctgaggacttagggaaccctgtaagacgaagaagcacaaaaagtctaagagcaggggagataaaggactctaagaatataagacccactaaatcaacataatcaaagttaatatgaacttacacacatcctgaggcaggatggacagggcctgcatgggtctatactatttcatgtgcatatatattatgactttcagtttagtgtttata

SEQ ID NO: 3015 - DNA, 1000 bp, mus musculus
ggggatatctcgagtttcttctggtctgaacactagcagtatgtgggttaaaaatggggccccacatctggcccagggctcaggcctctgggaaaggcaggatgcggccggctggcaatctttggggtttgagaagctgcaggaccaagatctaggagtgtggaaggtgcagtctggagtccctgcagaactgctggaattgcctcggggtccccgggcctgcacagaggccaaggatgacaggttctcgggctctctgatatcccagatgcctctatatgcctcagaagagctaagaacagagtagggggcctgcgggtaggctctagcccagggccaaggggaaaagggcaggaggaaagaaagagctccagctggttaccaccaggaggagagtcttccttcgccttgatcggcgggctgtgtggctgggagtgcaggccgccttcctgagaggaagacttgcaccattactccagcatggtgggtccagatgagaagaggcagtccatggttttaagtcatttattgtagaaaggcagagagagggagaagagtagagaagtagaggctggccatggccacacggaaagaggagagaagggaatggggagagagcaagagggcaagagtaaaagaggcaggagccagagactaagatagcaaggaggagccaagcagctccttttataatgggctgtatctacctggctgttgccaggtaacagtggggaggatcatgcctggctagttccaggtaactgggagtggagtccagacagcctgcatgactgaaggccacagaattatgagctggtacgtcatgtcaggagcctaatgtggcaaacttcctttgatcccttgcagattaatctgatgggtctcggggtttaaatctagctcgaccagaaaacaggttgcctttcacgatcccacaagagcacactcaattcttatgagatgaatttgaagaagacacagtagtgaaataatcagtcaa

SEQ ID NO: 3016 - DNA, 1200 bp, mus musculus
tttttgagcttttgattctagagaaagactactttgctctggaagaggactttcaatatagcatactgtccgttcccttactgaacttacatgttataccacaaaccaacagacagtatcaaatattttctctaaaccttaatgtattcaacactccttaaggcacattttaaaagaatattgttgagctcatttccacttctcgaatatcctcattcagtaagtcttcctttagggtcaaagtattttcatgttaaaaataactatataactctcctgcaggtgttccactgttaaaaatctcttaaatagaaactatttctgattatacctggtatagttcaagtatcttgtttcatcatactctcttactggaaaaaaaacaaagcatactttggaaaaaaaaacaactggaataaaatatactcacttttgatgttttttttaagaaagaattattttttcttttcattataagtgtaaatttaaatatatgaaagctccactataaaatatcattttgtatgtataatagtctgttttaggccaactccaaattgaactaaaactatttcacaaatgtgacacactacatatgtttttcaactttatcatgaaagatatagaaatttgttgataattttacattttatttatagttttacttactcattttgtgtcctgttcactgcccccctctgggacaaccccttccacaatcctcccatccccttgtcctctgagtgtggtgggagggggttctccctatctattcccccctaccctgacacttcaagtctccatgcttgggcacttcctctctcactgaagccagacaaggcagcccagctagaaatccatattgcacaaacaagcagcagcttaagaacttctgtgctggttatgttttccaaaatacctaatttcgagcacataaaaaatgctcacgtagcaggcatgtttttaatgacagactttgataacttcaaaataaatataaagatgagaatagacatcagctacagttttgttttgagtatattatatgaatttaaagttaagtaaatggagcaatgctggaatttagctgtatacttcacactcataattactggaatcctacatgaaacattttgatgcatgctggaaacagctcagttcctagtatgctgacattgaatcatgttggaaacaggactt

SEQ ID NO: 3017 - DNA, 1000 bp, mus musculus
tgtttccattaggatgccccccccccaccagacttctaaactccctggttaggtgcatcatctctgattgaaaacagacccagcagtcctctactgtatatgtgttgggggcctcatatcagctggtgtatgctgcctggttggtggtccagtgtttgggagatctcaggggtccagattaattgagactgctcgtcctcctacaagaccgcccttcttagcttctttcagccttccctaattcaacatgagtcagctgcttctgtccattagtcgggtgcaaatatctgcatctgactctttcagctgctttttgggtctttcagagggcagtcatgatagatctctttttgtgagcactccatagcctcagtgatagtgtcaggccttggggcctccccttgagctggattccactttgtttctgtcactgggccttcttttcctcaggctcctctccatttccatccctgtaattctctcagacagaaacaattatgggtcagaggtgtgactgtgggatggcaaccccctccctcacttgatgtccttcctgtcttcctgctgcaggtgggctctataagttccctctccctactgtcaggtatttcatctaaggtccctccctttgagtcctgagagtctctcacctctcatgtctctgatgcattctggagggtcccccaacctcctatctcctgaggttgcctgtttccaccctttctgctggccttcagggcttctgtccttttcagtcacccaaatccagatctccctgaccactctccctcccaggtccctcccttcctccccacatgtgattgctttcttctccctcccaagtgggactgagacatcctcacttggacattttagcttgttgacctttttgagttctgtgaactgtatcttgggtattctgtactttttttttttctaatacccagttattagtgagtatataccatgcatgtccttaaaaaaaatacacacaaaaagt

SEQ ID NO: 3018 - DNA, 1600 bp, mus musculus
gggcatgcctatattcagtctggctcccccagttagcagttgagtggtattagtcaaattaatctctctaaattaattaataaattaacctccttatctgtcaaatgtgaataatgaaggcgtgcattgcttaatggcagggataagttctggtgactgtgccattagatgatttcacacttgtggaaaccccactgtgtgtacacaaactagttagcataggtcagcgggcagtgtggcttatttcatcaacgtaatcccaaacatgtgtggcatattgagctacatcttttcaggtacataattaacttgtcaaggttactactaagtcatattaccaaatctaggaatcagttgtcaatctcaagtacatgaaatccatcaataaccatgaatacagattaaactgccccattcccccttggcctctaaggtatcacttcctcttggttcttcttcatatctctgtcttaatcttaacctgaaaagattacaatattccaaacagatgtgagctgggaattgaaccggggttctctgaaagagcagtgctcttaactgcggagccatctctccagccattattgcatattcttgaacattagtagttcatcaataaccctgtatgaatacccagtctctgccagaagatcctgcagtcacctaggactgacactcagctcggatgcttcttccttgcctgaacttcctaggatgccaaaaacttttattcaaaacaaaaaagtctgagctaggggctgcaactaggggctggagctaggggctggatggtgtggtcatgctagccttgcatttaagatgcttctgcctccttgttcctgagatatgggcacacaggatggttcttatacaacccttccatagcacaatcacaccatactgacaagacccactttcatagcagttcccccactggacaatgactgctgtgaggctttgggttgccctcatgtgttcattagttgttttcaaagtttgacagagccggaattatttagaaagaggaactctcaactgagaaattgcctccatctgactggcctgcaggtacttacctggctttacataatgctgccttgctccatggttttaaatgctatctagtctggaactgtaataaaccagttgagacgtcttgggaactgtactgacacagttctagctgactacccaatatttctactcatatgttgagtaagtaattcagattccacacatctaaaatttaacattttatcctgtctcagtaactgtcagctccattcttctagtttctcaagttaaacagtcagtctctttaggaaattctgtttattttaccttcagaattattcatagtatagttctttcttatagttctcacagctgtcaaatgaagccctcagcatatcaggaactaatgcattggcttcgtatctgctacccttacttctatgtttgttcctcaatggtctctcttacttgggcaaaagttatcttattaagcacagctatgtcacacatctacttaaaaaatgcctttcaacttaaactaaaaggctagatcttaactgtgactctaaaccagcctgctgtcctc

SEQ ID NO: 3019 - DNA, 1600 bp, mus musculus
attgccattattcaggtcaactccacgcgcttggacctgtccctgatcaaaggattacccaattggatctcctcagcattttccttctttaaaaaatgggtgggattgatattatttggagatacactttgctgtggattagtgttgcttctctggttggtctgtaagcttaaggcccaaactaggagagacaaggtggttattgcccaggcacttgcagctctagaacatggtgcttcccctgatatatggttatctatgcttaagcaataggtcgctggccattcagctcttgcaccccacaaggctagtctcattgcacgggatagagtgagtgtgcttcagcagcccgagagagttgcacggctaagcactgcagtagaagggctctgctgcatatatgagcctattctagggagacatgtcatctttcaagaaggttgagtgtccaagtgtccttctccccaggaaaaacgacacaggagcaggtcagggttgctctgggtaaaagcctgtgagcctaagagctaatcctgtacatggctcctttacctgcacactggggatttgacctctatctccactctcattaatatgggtggcctattgctcttattaaaagaaaagggggatctgagaggagccgccctcacatttgccattataagatggcgctgacagctgtgttctaagtagtaaacataatctgcgcatgtgccaagggtagttctccactccatgtgctctgccttccccgtgacgacaactcggccgatgggctgcagccaatcagggagtgacacctcctaggcggaggataattctccttaaaaggtacggggttttgccattctttttttttttccattttttattaggtatttagctcatttacatttccaaaccaaaagtcccccatacccacccacccgcactcccctacacacccactccccctttttggccctggcgttcccctgtactggggcatacaaagtttacgtgtccaatgggcctctctttccagtgatggccaattaggccatcttttgatacatatgcagctagagtcaagagctccggggtactggttagttcataatgttgttccacctatagggttgcagatccctttagctccttgggttctttctctagctcctccattgggagccctgtgatccatccattagctgactgtgagcatccacttttgtatttgctaggccccggcatagtctcagaagagatacctacatctgggtcctttcaataaaatcttgctagggtatgcaatggtgtcagcttttggatgctgattatggggtggatccctggatatggcagtctctacatggtccatcctttcatctcagctccaaactttgtctctgtaactccttccatgggtgttttgttcccaattctaaggaggggcatagtgtccacacttcagtcttcattcttcttgagtttcatgtgtttagcaaattgtaccttatatcttgggaatcctaggtttggggctaatatccacttatcagtgagtacatattttgtgagttcctttgtgaatgtgttacctcactcaggatgatgc

SEQ ID NO: 3020 - DNA, 1400 bp, mus musculus
tattctggagactgccccctatcctgcacgtcatctcctgcagctggttccaggctccaatgatgaattggcgggaatgaactttcccccctcttttataaagcgtgtccgccattaaaaatttgaaccttgagcagactagttgtcttggttccattatttctcaacctgcctaggctccctcttttctttcatttctaagatgccttccaggctcgaacccggacatgtgagctgctggccggcctgaacaatttggcaaaccaatgcggggcctggggagaaggttggtatgggctaagctagatcagcactaaacctgagcactggattcaattaggttcagcagtgagttattgggaactaggaactcaacaggcaggcagtcggccgcagcttccagaagctgcttttttaggtgagataaataaaagggtataataaaagggattttataatcaggcggatggctgtagttggaaactgcattaggtgggaggaaagtagattttgaaactctcccagggacagagagaaaattggggaatccccacttgtgtgcatgccagctggtgtcttttttctgagtgtctgtcttatgtttctggaaacgaacatgtgctcgttgtgttggtttgttttctatgttttgtcccatgtctctgaaacatggtgcagtctgagtttggtttctctggtgtttatagacaatggggttttctgaaatgcgcactttgtatttgcacctgtccctttaggctgtaaggaccagaggactgtggtcagcagatgtgctaggaagatggtcaactcaccaggggatgccatggggagtagagagagacagagatgtctggcagtctccggagatcagtcagagggaccaagttttgtttatgaaatggaagcttactcttctaattcttttgcctgctcgtggaagatgagaaagggttgcatgtgtctggatctgttggtttctgttttgtgtgttttgtgtatgtgtttagagctatgtgaaaatttagagaagtgctagtgtgactggaaaagccctgctgggagctgattgcaaacgcagctcctaaagggcagacagccttttgcttgtaacagaaatttagcttaaaattggtaactcagagttagagtcattctaaacaacacatggcaggaacgaacccaggaaaacaggactttaaagatacttcataatagggataagctttgggccaggactctggcagagtgctcagattgagaaatgtttgcgtttgggtggacgtggagctcagctcagagcagcctcagggaggtttgtctggcatttcttttgtttcttcaaaccatgactggggaagttcctgggacctcacctctccctgccttcagggaagctt

SEQ ID NO: 3021 - DNA, 1000 bp, mus musculus
accttaatgagaataattcaatttttaaaatttggtactaatactcacaagacattctcagttgtcaaatttgttaaatttacaaattgtaaattcaaattaagagatggtaagataagctcaggaaatcatacgtcctagataattgtggtttgaaagaaaatggccttcataggttcgtagggaatgtcactattaggaggtgtggccttgctgaagtaggtgtagcattattggaagaagtgtgtcactgagagtgagctttgagctctcagatgctctagctaggtccaacatggcattctctcttcctgctacctgctcgtctggatgcagaactctcagctctttctccagcactatgtttgcctctccagcactagttcaccatgctaaaactctgaagctgaaagccagtcacagttaaatgttttccactataagagttgccatggtcgtggtgtttcttcacaataataaaatcctaaaacaataatatatgaaaatatctaattaagtaaaatactccttatatacaaaatactattatgatgacttactttctccttataaatcaatatcatttcaaatagttaagtaatctttctctattataaacagttctgtgaaaatttctataaactcaagatcattgctgcattttcaatatgttatatctctgcatatattttgcatcaagtaggttattagttatcattttattgatatataaataactaaaactttatcttctgtgattgacctaattctgaatttctaaagaaaatttattatgtaaattatcaaggcaaaatagtccctttgccatgataacttcttggtctttctctctttcttgagccagggtctcactttgtagccttgatttgcctcaagtttaaggtagtcctcctgtgttgggataataggtatgaagcaaccatgcatccaatattcaaaaacactgaagtctaaaaacactgaagagtctcattagctg

SEQ ID NO: 3022 - DNA, 1000 bp, mus musculus
ctctatttctttaagtgagttattaaagtccttctttatgtcctctaccatcatcatgagatatgtttttaaatccgggtctaatttttcaggtgtgttggggtgggagtactgcgttctgatgatggtgagtggtcttgatttctgttagtaggattcttatgtttgcctttcgccatctggtaatctctggagttagttgttatagttgtctctggttagagcttgttcctcaggtgattatgttagcctctatcagcagacctgggagactagctctctccttagtttcagtggtcagagtactctctgcaagcaagctctcctcttgcagggaaggtgcccagatatctggtgttcaaacctgcctcctggcagaagttgtgttccacttaccagaggtaccaaggtcctgtgggggatcctgtgggggtccttgcgggtgtcaggagactctgtgggaaaggaaccctggtgctcacatggactggaagggacctgcaaccctgatcaggccgggccctctgcctccccaatcaatgcaagtctcaggtcccatgggactggaccggagcagatgctgtgttctactcaccagaggtcccaagatcccacggagggtcctgtggggggtccccacgggtgtccggagactccacaggcaaggaaccccggtgctggcgtggactggcagggacccgtgtccctgatctggccgggcattctgcttccctaattaatgcagtcttaggttctgcgtgattggattggagcagacactgtgttccactcaccagaggtcataagatcccgtggtggatcctgtgggagtccttgggggtgtccagagactctgaggcaaggaagcccagtgctggcatggcccagaaggcacatttctatttttaatgtagcagccttttgcattggacaattgaatggagaaagtgcaaagcaaacacatgggtgatttttttctatattgtttgtagtttaggag

SEQ ID NO: 3023 - DNA, 1000 bp, mus musculus
ttgtagatccacattagagcagatggttgctaagggatagctttctctctcatatcaatgtaaaaattctctctctcaaagtattcaaggagctaaagaggtctgcaaccctatgggtggaacaacgatatgaactaaccagtacccccagagctcatgtctctagctgcatatatagcaaaagatcgcctagtcggccatcaatggaaagagaggccccttggtcttgcaaactttatatgtcccagtacaggggaatgccaggtccaagaagtgggagtgggtgggtatgggaacaggccggggggagggtataggggacttttgggatagcttttgaaatgtaaatgaagaaaatatctaaaaaataaatttaaaaatgttaaaagaaaaaaagattatttctctctatatctatctatctatctatctatctatctatctatctatctatctatctatccatgccagtttttaactagacagtgagaccagagaagctagtctgaacatatgagaggaaattagatacttcagagcatgatcaagtggagcaacagcaatgatgccacacaactaaaccacagctttggatggaaatgttggaaaaataaaaagcaggatgcttttcacggtggtcctctggagggagactgtgtagaagggggctccatgaaggcaggggagagttttgctgtagagggaatgaggcttctgccctgccacctgagaaggcagacaggcacacttcagtaaccagcaattcattgggttgccaatgaacagcttccctggctggctgtacaagggagtgtgagctgacgcaccacacacactttcttgacacagtcccatttgagtgtttgaggaagtccttggatctagtctggtgttttcacaaagcaaccaaagcaatttctggctgatatttcatcacctaatcagtgatttcttgctttatgctttggaaatttaagtctttgatctagtgtaaatattt

SEQ ID NO: 3024 - DNA, 1000 bp, mus musculus
cttggagcagacatcttggtcctctaactcatacagtttttccaccaccttttccaccacgtttcctgagctttactatgagttgtgttgtggatgcatcagctggagctgggcactggcacagtccattgttctctgcattttgaccccttgtgactttctacaatggtttctatttgctacaaagaagcctctttggtgaggggtgacagccccgtttatctgtgggtataaagataagttagaaattatactggtttaaactaaggtcaagagaaaaaaatcactaggctagggagatggctcagttgagagcacttgctactcttgtagagaaatagtttgtttcccaacattgcatagtgactcacagccatttgtaactcaaattccatagcaactgatgcccttttctgaaatctattgtcaccaggcacacatgtagtacatttacgaacatgcaggcaagatactcatacgtgaaaattaaatctaaagaagaaaagcagagcaaaaaggaaacaattgagagcaaatgcttgaaaagatatggggaaggaagaacctttaatcactgctgtggggattacaaactgatgcagtctttttggaaatcagtctgaaaagttaaatataaatctaccatgttatatactttcaaaaagcttttcaagataatctgtcaacgatcaggctactgggagtttgtttgtttgttaaattggatattttctttatttacacttcaaatgttatcccctttcccagtctccccctggagcccccctataccattctccctcccctgcttctataagagtattcccgcactcacacacccacccactccctctgctctgccctcgcaatcccctacactggggcattgagccttcacaggaccaacggtctcccctcccattgatagcagacaaggccatcctctgctacatatgcagctggagccatgggtttctccatgtgtactctttgattggtg

SEQ ID NO: 3025 - DNA, 1000 bp, mus musculus
gaataatcagaataaagaacgaagattcccagctcaaatgacctgaaaatgtcttcaacaaactcatagaagagctttcaggcctgtgccagctctgagccaccttgtgcacaaactcagtggacagtcccacggtccccagaggactctccacaccataggcaccctagcatgcccaggatcttaggatcatgggtgagtggaacacaacatgtgttccaaaacaatcctgaggggcctgtgccagcaggaacagggacacaggaaaccagcctgaccagagacacgggttctgtccaatctgtgccaactctgggccaccttgggcacaaacttagcagacatcccactatccccagaggactctccacacctcaggcaccctagcacgccccgaatcttaggatcactggtgagtggaacacaacatctgtcccaacacacctgggagtgcctgaggccagcagaagcagggacacaggaggcctgcctgaccagcagcttgggttccttctggtctgcactggtctaccttggtttcaaacacagcagatagcctcatggtccccagaggaggtaccacttccaggtactctaacacacccaggatcttaggattccaggatcccaggagcttggtcacaccaggatctcagggtcccagaggaagcttgactgccaagaactttgacacaccccgaatctcagattaacaggatcccagaatcacaggatcacagagaaagccggactctgaggaattttgactgaaccgggattacaggaaggataggctccaattagctatattgaggacattgggcacttgagataatcagatggcaggaggcaaccataagaacagaagcaacagaaaccaaagttactttgcatcatcagaaccaaaccctcccaccatagaaagtcctggatacaccataatgccagaaaagtaagatatggatctaaagtcacttctcatgatgatgaaggaggactt

SEQ ID NO: 3026 - DNA, 1000 bp, mus musculus
ttgatgcccagcccactgtgggtggtattatactcaggaatgtggttctgtgttttataagaatttgcattggccagtgaagcgggtaagacaattgcagatcttcacctctctctgtgttccttcaagtccaatcccccaagtttatcctcagctcagtggcaaacttcctgccttagttagcatttccattgctatgaagagatgccatgaccaaggcaactcttataaaggacaacattttaactggcgttggcttatagtttcagagactcagtccattatcatcaaggcaggaagcatggcagcatccaggcagatatggtgctgaagaaggagctgagagttctccatcttgatctgaagtcagcaaagaaaaagaatgactcacgagcagctaggagggtctcaaagaccatcccacagtgacatacttccttcaacaaggccacacctactccaacaaggccacacctcctaatagtgctactccctgggccaaagatatttaaacacttctgggcccaaatctgttcaaaccattactttccaagtttacctttacctctcatccccatctccagtagatcacacagatattcccttccaaacttcctttccattactcattactttattccagccccgaactcttgtaagcactctttgcgaaatggtaggccactcaggtctggggaagaagggagcacaactgctgatcttcacctattcttactcttctccaaatcaatccaactccccagtctcatctccagctctgtagcagaccacatgctgcagcatccccctccaattcctgcaagcagatcttctcctcctacccacctccccacacatactgttatcccagaccctaagtgaagcaggctttctctgggaacctgtgaggcaagcccatcagagaagcaagtaggttggccagcttcagatctttactcttcctctgctccctattccccagtctcatactcagctttgt

SEQ ID NO: 3027 - DNA, 1000 bp, mus musculus
aacaaaacaaaacaaaaacctaacatctaaagtcaaagttatttcaacacaaaaccagaaacaactactcataaaatttgttttggaaaactgctatcactcacaaggtatttaggaacacatggggtttccactaagcagtacacagaaagacacagctgattgagacagtctacctggactctttcgtttttctgctttctatatgtgtaatgcgaaggcagtttctctctcaggcctcagtgtcctgatgactacgcaggggagtagtgttaggtcatctgcccaagcagtgctaagtcttaggaagccaacccctacttaaaaccatatttaaaaatgatagcagggggactggagagatggctcagcagttaagaggtcttctggagtttctgagttcaaatctcacatggtggctcacaaccatctgtgatgagatctgatgccctcttctggttgagtctgaagacagctacagtgtacttagatataataataaataaatctttaaaaaatgataatagacgtttcaaccaaaaatggatagcattaatacctgaatattaaccatgaataagtaaatggctattgagaaaggttctgaagttagaatgcactgaaggtggaattaggtcgaattcactacctacaagcccacaaagctgttccaaagatttttaagggattttgcatcataggctagtcaacaaagtgtgttttgttgtataagcaaagaaatcataatttatatgtataggggctgatgtggctcataacttatctttcacatgtagtcataaagccagctgtaatttatgtaagatagcacaaataagaatacatggctgtgtccataaaagggaaagggtcagaaaacatatttcctttatagtgccaaatggggaactgagtttgacatatatcacacaatttagttccaaaatgcaaccttgaaaaacttgacccaacttgcactttcagagaaagatttcaggtc

SEQ ID NO: 3028 - DNA, 1200 bp, mus musculus
ttctctagaggaatagaatttgatagaatgaatacatatttgtagggaaatttattaaattgtcttttatgcagactgcagaagcaacatagcttctgggacaggcccattttgagccatgatcttcagccacaaagcagatctgaactccagccccctgtgctccttcccaaccagagaagagatggctgccagggacagctctaaccactggagcaggtgagagagcaatcttgtatcctgggtcaccttagagcccagtctgcacaggaaagcctgctgactgcagaagcaacatagtttctgtttcgggccttcatcttcagccaggaagcagatctgaactccagacatctgcgctcctctcctgtcagaaggtaggtggcctgcagagagtactctgaccactgagactcaggagagagttggactcccaggagtgctgacatagaatcacatagagtgctaacagaatcacaggaggaacaagctcaaccagagacagctacaacaactaacaccagagattaccagatggcgaaaggcaaacataagaatattactaacagagaccaagtccactcaccattatcagaacccagcactcccacctcagcgagtcctggataccccagcacaccagaaaagcaagactcggacttaaaatcatatctcatgatggtggtagaggatttcaagaagggcattaataactcacgtaaagaaatacagtagggagacgaaaggatggacaatctagagactgccacacctggggatccatcccataatcagcctccaaacgctgacaccattgcatacgccagcaagattttactgaaaggaccctgatatagctgtctcttgtgagactatgctggtgcctggcaaacacagaagtggatgcccacagtcagctttggatggatcacagggcccccaatggaggagctagagaaagtacccaaggagctaaaggggtctgcaaccctataggtggaacaacaatatgaactaagcagtacccgcagagctcacatctctagctgcatatgtagcagaagatgacctagccggccatcattgggaagagaggccccttggtctagcaaactttatatgcctcagtacaggggaacaccagggccaagaagtgggggtgggtgggtaggggagtggaaggggagggtatgggggact

SEQ ID NO: 3029 - DNA, 1200 bp, mus musculus
attaaagtccttcttgatgtcctctaccatcatcatgagatatgcttttaaatccgggtctattttttcaggtgtgttgaggtgcccaggactgggtggggtgggagtgttgcattctgaagatggtcagtgttcttggtttctgttagtaagattcttacgtttgcctttcgccatctgataatctctggagttagttgttgtagttgtctcttgttagatcttgtttctcagatgtttattttagcctctatcagcagatctgggagactagctctctcctgagtttcagtgctcagagtactctctgcatgtaggctctcctcttgcagggaaggtgcccagatatctggtgtttgaaactgcctcctggcagaagttgtgatccactcacagaggtcttaagatcccgtggagggtcctgtgtataccttacggttgtctgcagactccaagcccaaggtacccttgtgcagcgtgggccggaagtgacttgcgcccctgcttccctaactaatgcagtctcaggtcccacgcgattcgattggagcagaagctgtgttcctctcaccagaggtcttaagatcccttggggggtgttgtgggtagcttgcgggtgtcagccaactctgtgccctagctacactggtgctggctggaccagaagggcgatacttaacttcttttaacttagatttcacttccagacctaaataatatacaagagaattagcagtatgatcaagaacaaaaagtattttatattactttgaatgctttgcatgacatgaatatgttagcctttataattcttcaataacagaataattgatgcagcattacatatatataattacaagctatttaaaagaagatgaccaagttagccatcatcgggaagagaggcacattggtcttgcaaactttatatgccccagtacaggggaacgccagggccaagaagtgggagtgggtggtcaggggagtgggggagagggtatgggggacttttgggatagcattggaaatgtaaatgaagaaaatacctaataaataaaaaaagaataaagaaaaaaagaagaatgttgtagtttaaaaaaaaaagcaaaaaccataatctaaccacagaccaaatagtcctgctgaattgaattctaatgttcccagtactatgactgaaatatcattaaggcacctttc

SEQ ID NO: 3030 - DNA, 1000 bp, mus musculus
tacaatttgcaaaacacatgaaactcaagaaggaggaagaccaaagtgtggatacttcgttccttcttagaatgggaagcaaaatacccatggaaggagttacagagacaaagttcggagctgagacggaaggaaggaccatccagagactgccccacccagggatccatcccatatacaaccacaaaacccagacactattgcatatgccagaaagagtttgctgacaggaccctgatatagctctctcttgtgaggctaagacagtgcctggcaaatacagaagtggatgctcacagccatctatttgattaaacacaaggtccccaatgaaggaactagagaaagtacccaaggagctaaaagaatatgcaaccctataggagggacagcccagagctgtgtctctagttgcatatgtagcagaggatggcctagtcggccatcaatgggaggagaggcccttggtcttgtgaaaatcatatgccccagtacagtggaatgccagggccaggaagtgggagtgggtaggttggggagcagggtgcagggagggtataggggacttttgggatagcatttgaaatgtaaatgaagaaaaatatctaataaaatagtactattcttgtcatgtatggtgactgtcttacacctttaatcccactttagggaggcagaggcaggcaggtctgtataaagaatttcaggcatacatagtaagaccttgtctcaaagaaataaacacccaaaaccaaaagacaacaacaaaaacagcttaacattcttgaaaatgtcactttaaaaaaatgctacagtattgatttgtgtatcatttttttaattattaggtatttatttcatttacatttccaatgctatcccaaaagtcccccacaccctcccatacccactccccccacacaaccactcctacctcttggccctggtgttcccctgtactgaggcatataaggtctgcacgaccaatgggcctctcttt

SEQ ID NO: 3031 - DNA, 1000 bp, mus musculus; identical to SEQ ID NO: 3030

SEQ ID NO: 3032 - DNA, 1000 bp, mus musculus
ttatagttgatcctacaaagaagtgcaacagtagcactttaatatttttaatattcttgtttcttttccatacaaaagtaaaaacagtctccaggattgttttccactgcctcagagttaccattaatcaatcaccctttctattatttattactgtcagaggaacttgaggttctctcttttcttttgcttgcccttaatattatttgaaataaaaaagcccatatcagtaaatagtttacattatattcaaaaatcaaacatgacatctaaatgaattcaactttggcaagtaggtttatgtaacaaaaatgccttgtgtttatgttagtgactccccaagataattaagccatatttgctttgctattcctcaaatattctaaaaatgatgcttttctagtagcttttagttatacatcatcaggactgaagaatcagtttttaaaaagtgaatgaagatgagcgaatacaaagatagtctgtgaagtgtataatatgccattgaaatttttattaatatataaacacatatgcgtagtatatgcatatgtatagtaaaggaagtgttcagtaaaacaaaaggaggaggtctgtaaaaacagaaactgttggaagtatgtttttgcagtctgcttaaggaactgacaaaacaagctttttttgagataaagatgaaaaatgtccataggggcagatgttgccatttgccctcctgttgggactgacagatcagtgctgaagcaacatcagggcaaagaggcatcagcttcagtaatggagagttgtctaggggaaagattgctctatcacagtgatgggctcctgcatgttataaatcgaagattgttctttcctgccactgagatgagcagctctttcgccttttcagaatgaaatgttggaagagacaaggaacggatgaaaacaaaaaaagtgggagaaagttttatctcttcaacataaatctccactggaaacagacaggatagtgccaatc

SEQ ID NO: 3033 - DNA, 1000 bp, mus musculus; identical to SEQ ID NO: 3032

SEQ ID NO: 3034 - DNA, 1400 bp, mus musculus
gagagagagagagagaaagaaagaaagaaagaaagaaagaaagaaagaaagaaagaaagaaagaaagaaagaaaaatatatgcttttatttcattgaacatatgtttatggaataatttcttctgtagtaaaacattacaagataatataacactaaaatacattttgagaattataattttctcaaattccacctagatatattccctagtgatctttgaatgaagatgttagatcatactttagtttcatgtaattgaacttatgatattatcatactgtatatattttatatgttttgttaatttttagtttttatccactttacatcctgatcacactcctcactcctcctttcccagttcccccttatacaaatccccagctatagctccctttcttttccttcagagaacagggagccctccttgtctactacccaactctgggacatctagtctcagcaggactaggcacctcctttcctactgaggcccaaccataaagtccaagtagagtaagggtatctaatctcatgtaacagaacctgagacaggccctgctccactttttaggggaaccacatgaagacctaactacaagtttgctacaaatatgtaggggacctatgttcagacactgcaagctccttagttagtggccctgtctctgtgagtgcacatggacccaggttagttgactctgcatcttcttgtggtgaccttgacccctttgacttgctcacttttatccccttctcttctacaagactccctgagctccctgtgatgtttgactgtggaactctgcatctgcctccatcttactcttctgtgatcaatatcttagtccccagacaagagtattcatacaagtaactttttttcttgtaatatacaagagtgaaaaagaaaaacaatctcttttgcatctcttgatctatgtaacttgcaatttactggaagatgtctactctcttctccacagattataaagtctttcaaaaggaccgatgtggaaacaggcctgagcgtgctttaaactagtagattacaaggaagtaataaaataattctgatgaaatcttgtagtattcactcctgaaatggtggtcaaatctttagtttgcttgattgttttccatcttggtatattgtgacaaagtattttttgaatatcacctgccatccaaatccccatgaaattaattccacaaaaaaacccccagacatttgaataatcaactcaaggcagaagaattatgactggttttgattgcatggtgtcattttcattttctaattacatcattgggatgaatattgctcatttttaatgatgcattgtatttttgcacttaagtttagaatctaagaatcagtcataaagatatgtctcat

SEQ ID NO: 3035 - DNA, 1400 bp, mus musculus; identical to SEQ ID NO: 3034

SEQ ID NO: 3036 - DNA, 1200 bp, mus musculus
tttacattttacatcttttttccctttttttctttatctaatttttttaaagtccagattttatactcctcctggtctaccatctgactgttccatatctcttacctccttcccccatctcaacgaggatgtctcaagcctcccaacccccaccctgccagacctccccactccttgtggcctcaaggctcttgaggtttaggtgcatcttctccaaatgagtccagatcccgcagtcctctgctgtatctgtgtccagggccttggacacatttatgctacctttttggtggctcagtgtctgagatatctctggggtccaggttaattgagactgctggtcttcctatggggtcgctctcttcctcaggttccagcttttccctaattcaaccacaggggtcagcagcttccttccattggctgggtgtaagtatctgtatctgactcagctgcttgttgggtctttcagggagcagtcatgataggcccgtgtttgcaagcactccgtagcctctgtattatcgtcagctcttggggcctccccttgagctggatcccaatttgggcctgtcgctggacctcgggtacttccttttcctcgggtacttctccatttttgtccctgcagtttctttcagacaggaacaattatgggtcagagttttgactgtgggatggcaaccccatccctcacttgatgccctttctcttggaggtgggctctataacttccctttacccactaaagggcattgagtgaggtaactcagactcaaaaggacatagatggtatgtactcgtttataagttgatattagaccaaaaaaaaaaagtacaaaatagttaggatacaataaacagagctcaaaaaggttaacaagctaaagagcccaagtgagaatgtctcagtcccacttgggacagagaagaaagcaattgcaggaagggggagagagggtgggagggacctgggtaggaaaggagacagggagcggaagaggggaacatgatcaggaattggctgggggaacaggacgatagtcttgagggcagaaagaatggaaatagtcaacctcaggaggtaggatgtgggaggaccctcgagaatgtaccagagacctggaaagtgagagactctcagtacacaatgggagggaccttagatgaaatgccctacagtttggatcttaagaaaaa

SEQ ID NO: 3037 - DNA, 1200 bp, mus musculus; identical to SEQ ID NO: 3036

SEQ ID NO: 3038 - DNA, 1000 bp, mus musculus
ggggaggtcccaaggcctgacactcttactgaggctatggtgtgttcacaaaaataggacctatcatgactgccctccgagagatgcaacaaagagttgaaagagtcagatgcagatatttacacccaaccaatggacagaaactactgaaccctgtggttgaattatggaaggctgaaagaagctgaggagatgggcgaccctgtagaaggaccaaaagtctcaatcaatctggacccctgaggactctcaaacactggactatggggctgtgtaccagaggctttccatggaaatctgtggcctggcctggtgggagagttccagtgaagggaagtgagtgcagacagggatggcaagtcacttctgctgctgcagttggctccacctccatctctgctgtgccttccaggttactcagttactccacactgccctgcactgaatcggattgcactgggctgatgagagaccaactgagtgaagagtgaggaggcacttcaggcagcatttttcaagagcagacctcttcctaagtgttacagctcttaggacataaggctcagaccatggagtagttctcgcataaatttcatccttccagataagattcttatatacagttttgaggtgggtaagggtttgaaaacaagtacttctcattggtcttgtttgagagctttggagaaaccttatttgctgtgggaaggcttggtgctgctcctacacgactgatgtccacatacccctggaggggggggggtgtgggaggctgtagctgtcacaggagcctggggctcaggaggtatggcccaacacatgccaaataagcacctactgggtcactggggttccagacatttgcttgaccagggaccaggctgtctgagcacagcctaccgctccacactggaccaccaaacagacaacatacaccaactgatatgaggctcccaacatacatacagtagaggactttcgggtctgtgttcattcagag

SEQ ID NO: 3039 - DNA, 1000 bp, mus musculus
aaaagtcccctctacccttccccggctctgctccccaacccacccactcccacctcctggccctggttttccctgtactggggcatataatccttgcaagaccaagggcctctcctcccaatgatggctgactaggccatcctcttctacatatgcagctagaaacatgagctctgggggtactggctagttcatattaagttcaggacacttttaagtaatattgtaaatgacttccaagaatggatttctttacttaacatgactttaattatccattcttttttttcaggttatatgatatagtctttttttcatatctcaaactctataaccccttccaatccccacctcccaaagccctccccccccttatgcagctccttaccttgcatattccttcttggatcatcaagactctgtagggttaggtacatcctctcatagtgctgccagaaaaggcagcctcaagtgctggggaggtcagtccagtccatgtatgtgctttgctttctggctctgtttctgagtgctgccaagggtccaggtgagttgactctgtttgtcttcctgtagagttcccatttccttcaggaccctcaattcttcctcctgttctcccataagagtcctcaagctacatccactctttggctgtatgtatctgagtcagctgctggttggagcctcttagaagacagcatgctcctttctaacaagcattagagtggcactaatagtgtccaggattggtgtttgccaatgggatgggtctcaagatgggccggttattggatagtctcctccagtctctgctccatctttgtccctgtatttcttttagacaggacaaagtttgtgttgaaagttttgtagatgggttggtgtccttatctctccactgagggtcttacctggctaaaggaggtggcctcttctggtttcctgcccccactgctaggcttctacactaaagtcatcacattgactgctaggagct

SEQ ID NO: 3040 - DNA, 1000 bp, mus musculus
ggtctctaaatttgggatcctacattttgggggctcgtcctggattttgggggcacccagaaccccaagaataccccttggaggtatgtctgtgtgagtttggtgtgtctgagtgcggcgccactgaatctgtgtctcggtttcccagttctagtattctggcagctgccgctgagatccgtgaggatccagtgtgtgtgcgcggaaggagacatcctgagcccgcaaagctgcagccctggggagacgttcctagggcgatcctagaggaggaagtgcccagggttagagacagtcgggaagacctggctgtcctttggcagagtgagggagataaggtactttttctgccagagcgggagtggacgtggaatcccaccccgtcagaggcagcgtttggctggttgtacaagtccaggcagggacgagtgtgcttgaacgttctggtgtcccttgtctctgttttcgttttgtctctgtttctgtttcttgtcatgggacagactgtctcaactccgttatccttgactgaggaccattggacggacgttagggcaagaggacaaaacttatcaatagtagttaaaaagaaaccctggcagtcctactgcaccttggaatggcccaccttcagagtgggatggcctccgggagggacgtttcatctccccaccattagggccgtaaaggccatggtctttcaggaaggctccggatagtatccagatcagtagccttatatcacagtgtgggaagatttagcgcgatttctgcctgcctgggttcgcccatttctcccgcccccacgtccaggtaccaaggtcttgacggttcaagagaatgctgagaaggagaaattaaagctactacttgaaggagccagtgagaaatccaccccttcgcaaccagcagccgtttttaaaatctatccagaaatagaggaacctcccgaatggcccaattctctacctccaccttatcccccagtccttcaacatgt

SEQ ID NO: 3041 - DNA, 1200 bp, mus musculus
aggatccaagtgaggatgttttaatcccatttgggaagaagaagaaagccatcacaaggggcctgaagcgggaggggtctggatgggagaggctataggttggggacgggggaaacaggactgaagccctgagagccagcagaaagaatggaaacagacaacctcgggaggtaggaggtggatggaccctctagaatatacaggagtcctggttggtgagagactttcagaacttgaagtgagggaccttggatgaagtactgtacagtggaggggtgacttgtagagtccctctccagaaggacaggacaagtggaggttgcccttccacagttaaaagctctgacccagaatttttcctgtctgaaggaaatttttcttgtctgaagggacaaaaatggagaagagactgagcaaaaggaggtactgagaccagcccaaattgagatccagctcaaggggaggtccagagtcctgacactgttactgatgatatagtgtacttgcagcctagcatggctgccctctgagagacccaacagctgcttaaaagagtcagatgcagataacagcacccaaccaatggacagaagctgtggaaccctgtgattgaattgggaaaaatctgaaagaagttgagaaggagggcagctccatgggaaaaccaactttcctggaactctgagatctctcagacactgagacacaaaccaggtagcatacaccacctgatgtgaggaccttgacacataaatagcaaaggactgccttgtctggccccagtgagagaaaatgtacctaactcttgagagacttgaggccccagggagtagggaggcctgatggagtttggggtagggatgggaacatcccccttggagctggctggagttgtagaggtagggagtacgggatggggagcagtttggggataaaccaggaggggaatgaagtctggacagtaaagaaaaaaaatgactaaagaataaatgaatctatcaatcagttaatcaaccaaagagtcttttggctataagctctgaacaattaaatctggaatttgatagctcagtttctgttttgaggcctcaatattaacttccaacttgtctatatacaaccttgatggtgtataaggattcccctcccccatatcctggctgtcattatctgttttcttgataatagcatgaagaaaag

SEQ ID NO: 3042 - DNA, 1000 bp, mus musculus
tggcacatagtatttcataagcttccttaagagacttttataaatagtaagtttaaataaatttactttttaatagggcaacaatgtccatataagaaaaatgacggcttcccagccagaggacaggggtccgcctggcctgggaggtttttgcctcaggatctgtgggagccatcttggctccgggactctgcagaaagttgtctgcacagacgagagtgtggaccacagaagctaacagcttctggaacaggcgagagccacagagtttctgaggcagctccgtttttggactctagacatccggccaccttcccggccagagaacaggggcccgcccagcctgggaggctaggattttgactcaggagcagcgggagccaccttggatcccagactcagcagaaagcagcctgcacaggtgaaagtgtggactacagaagctatcaccttctgggacaggcaagagctagagagcttctgaggcagcgtcattttcgggcttcagacatctggccaccttcccggccagaggtcaggtgtctgcccggccagggaggccctagcctcaggatcggcgggagccattttggttctggaactccgcagaaagtagtatgcacaggtgagagtatggactactgaaattaacagcttctgggacaggcgaaagcaacacagcttctgggaaaggttctgttttgtcccttcatcttcggccaggaggaggtcaaaacgccagataactgtgcaccttccctgtaagaggtgagcttgcttgaagagactgctctgaccactgaaactcagacgagagaaatagtcccccaggtctgctgatagagggtaacagaatcaccagaggaacaatctctaaacagagacaactataacaactaactccagggattaccagatggcgaaaggtaaacgtaagaatcttactaacagcaaccaagaccactcaccatcatgagaacccagcactcccactttgccc

SEQ ID NO: 3043 - DNA, 1400 bp, mus musculus
atgaatttatgaaattcctagccaaatggatggacctggagggcatcatcctgagtgaggtaacacattcacaaagaaactcacacaatatgtactcactgataagtggatattagccccaaacctcggattcccaagatataagatacaatttgctaaacacatgaaactcaagaaaaatgaagactgaagtgtggccactatgcccctccttagaagtgggaacaaaacacccatggaaggagttacagagacaaagtttggagctgagatgaaaggatggaccatgtagagactgccatatccagggatccaccccataatcagcatccaaacgctgacaccattgcatacactagcaagattttattgaaaggacccagatgtagctgtctcttgtgagactatgccggggcctagcaaacacagaagtggatgctcacagtcagctaatggatggatcacagggctcccaatggaggagctagataaagaacccaagtagctaaagggatctgcaaccctataggtggaacaacattatgaactaaccggtacccgggatctcttgactctagctgcatatgtatcaaaagatggcctagtcagccatcactggaaagagaggcccattggacacgcaaactttatatgccccagtacaggggaatgccagggccaaaaaggggaagtgggtgggtaggggagtggaggtgagtgggtatgggggacttttggtatagcattggaaatgtaaatgagctaaatacctaaatgtaaattatgaactaataaaaaatgggaaaaaaaaacaaaaacaaaaacaaaacaaacaaacaaacaaacaaaaaaaaagactcagaaataatacattgtccaacaaattaccaaggtaacaatgataacatataaataaggagagggcctggtgcataaccatgcaggccccatgcttgctgctccactctctgtaagccaatatgagtcctgcttatttgattcagtggtccatattctccttgtgtctcccatgcctctggcttgtgcattctttcctcccccacttccatgagatgaaatttacttttccatcttttattcttatttttgaatacattgtcctttcattttaatttggcatgaatactttggagagatattctttagcttacaaatctttgtctcattttaacataatgtacctattgaaattctggccacttagaatgagttgaaatgtatgctttcatttttagttatactcaggtgttggaacagacatttgtgagtttcttcatcaaatgtatggtaaattttgctagcgagagaccagtacttctgggtactttgtggaaggaattttagccaaaataatttatttaaatcatactagtcgattt

SEQ ID NO: 3044 - DNA, 1600 bp, mus musculus
tatctgggtcagggacatgaggaagtacataatttaagattacagaaaaaaaaaaagattacagctatgcattagcttcggttgtaaaagctgattactagggaaaactaaggtaagtaaggtttattgctacagttttctgttcaaagcaagttaaacaaacagtttgagtaaacagcaggctaacattattaagtgccctaatgtatattattgactttggctgtgaggtcagcaaaaattccagtctcttagaatgtaacaaatattttcacaatatttcatcattatacaattttaatactgctttggtttataaagctactatagatttacaagaattcccaaattatctggtgtataaatcgttgttaatttagtgatatcatagattaatggaggattgcaactccatagcccaaagtattcctgatgttttcctcaggtttttattttataaagttgaagctacaaattgtttcagatatatcccataagaattggtatacatcttggttcccagaaccctcggagactagtctgctcaggtgagagtgtggatacagaagctgacagtttctgggattggcggaggccacacagcttctggggcagaccccatttcgggcaccttccctgccagaggggaggtgtccacttcacccgggaaggctttgctggagcacctgagggagccatctctggtccaggatctctcagagactagactgtgtaggtgagagtgccgactacagaagctgcacagcttctctgacaggcaaaagtggcacggcttctgggacaggccctgtttcaggccttcatcttctgccagaaggcaggtccgaaggccagatatctgtgctccttccctgcaagtggagagcttgtgggcagagagtaatactctcaccactgaaactcaggaaagttctagtctcccaggtctgctgatagaggctaacagagtcacaggaggaacaagctctaaccagaaacaactataacaactaactccagagattaccagatggctaaaggcaaacgtaagaatcttactaacagaaaccaagaccactgaccatcatcagaaaccagcactcccacctcagccagtcctggataccccaacacaaccgaaaagctagcctgggatttaaaagcatatctcaagatgatgggtgaggacatcaagagggactttaataactcacttaaagaaatacaggagaacactgctaaagagttataagtccttaaagaaaaatgggaaaacacaaccaaacaggtgatggaattgaacaaaatcatactagacctaaaaagggaagtagaaaaaataaagaaaacccaaaatgagacaacgctggagatagaaaccctaggaaagaaatctggaatcatagatgcaagcatcagcagcagaatacaagagatggaagagagaatctcaggtgcagaagattccatagagaacatcatctgcacaacaatcaaagaaaatgcaaaatgcaaaaagatcctaactgaaaacatccaggaaatccaggacacaatgagaagaccaaacctacggataataggagtgaatgagaatgaa

SEQ ID NO: 3045 - DNA, 1200 bp, mus musculus
gattgtttgagtgacatgcacttgaaattgcagcactcaataagtttggattagtaggattaccagttcaagtccactagacgttttgacataaaacattcctcctacctcatagtgaataataaataatctattctgaaccaaatatgtgtggggcactgactgtgggcaaataaagggggagggggtagatgacccacatcccaccagagctcgggggcgcaggacactgagtgggcagacatgggagttggactgtgtgcactctccatgcctcaaggtgggtgtctggctgtgggaaggcacagaactccagtcagtgggggtgaggagggagcagtctggagtccctgggcctcacagaggccagaatcaacaagttctagctcttgggcatcgcaggaggttgctgtacaccatggaagagctgagaacagatgggggccccaaggggagtgttggttcagttagccccatagcgaaaggtagaaggggcagaaggagagagcactgggtagttcctgtgagggcaagggtccttggtatggtctggcggctggaaatgctaggaggcctcctggcgagaggttagatttatggatcattagagggaagcctgctccattgctccagcatggtggatcccgatgagcagagatggcccatggtttttaggcatttgttgtagaaaggcagagagaggaagaaaagtaatgaagtagatggtggccatggccacgtggagagagaggggaggtagagggagataggtgggagagaggtgagtgtaagagacaaaaaagagaggcgagagctaaagagaaagaggagggggcaagcagccccttttatagtgggctgggctaccttgctgttgccaggtaactgtgggacagggcatacctggttgtagccagataactgcggggttcgtgtccatccagaataccaggagcttggggacactgcctacgtggctgatggtcacaaaattatggtgttgaaggctcatgctatcagaaccctaatgtctgggagtgaagcataaagctctgttctttgtagaattttctactaggtcttcggagtaagccttgctcaaccagaacacagactgcctttccaggtccaacaaatatgaatcctttataacactactctaaaaccaaactcaaatatgaaaaagattccatgaatttt

SEQ ID NO: 3046 - DNA, 1000 bp, mus musculus
ttgtatgagaaaacagctgtgtttgaaagtgacaactaattaaggggcagacatagtcacaattcagagaaagatttgacagaaaaaaagataaaaaacaattatcctcaggagcacagcacaggaaagagaggctatttagaacattgctagagagaagtgggggtatttgacaattttactgagacagtttgacagagtcaggttgcagagagaatcagctagacacgggtgattgtagggtttgtaggctatgtccaatcagccactagttatggccactttgggaggctgaacgctggaaatttgactgcacttactcctctccaacgccacggcgggtgctgtgtcatagggaagcaccaagtcaccgctccaggggtgggaaattgcaggctgactccttaactacctattgatgtacattggttttattaactacaataatcacaagttgtcctctggtgccccacccccacccctggtacttcaagtctctgcaaggctaggtgcttcctctcctattaagaccagacaaggcaacccaggtagaagaacacatcccaagtacaggcaacaggttttgggataacctccctcccagctgtttggaagccacatgaagaccaagttgcacatgtgcagggaggcctaggtagctcgtgtatgttctctgattgttgtttcagactctaagaggcccaagggtccaggttagttgactctgttgttgttcttcctgtggagttcctgtgcctttggggagcacaattcttcctcctattcttccttgagagtccctaagctccatttactgtttggctgtgtgtttctgtgtctgtctgagtcagctggtgggtggagcctctcagaggacaacttgctcctgtttgtatagttcaggagtctgacggaagtgggggagagatggtgggatcacagaggtccttctgggatagcaggttgctcagagtatcttgttcagaacatccattcttta

SEQ ID NO: 3047 - DNA, 1000 bp, mus musculus
ggacccagatgtagctgtctcttgtgagactatgccggggcctagcaaacacagaagttgatgctcacagtcagctaatggatggatcacagggctcccaatggaggagctagagaaagtagccaaggagctaaagggatctgcaaccctataggtggaacaacattatgaactaaccagtaccacagagctcttgactctagctgcatatgtatcaaaatatggcctagtcggccatccctggaaagagaagcccattggacacgcaaactttttatgccccagtacaggggaacgccagggccaaaaagggggagtgggtggttaggggagtggagttgggtgggtatgggggacttttggtatagcattggaaatgtaaatgagctaaatacctaataaaaaatggaaaaaaaatgaaatttgagttggaaatttcatggggattgcattgaatctgtagattgcttttggcaagatatccatttttactatattgaacctactcctccaagaggagtagactgcaggaaaaaatcaaactcaggggtgaaatcaaccaagcggaaaaaagaagaactatacaaagaattaaccaaatgaggagttggttctttgagaaaatcaacatgatagataagccctttgctagacactctagagggcacagggacaaaatcctggttagcaaaatcagaaatgaaaagggagacataacaacagatcctgaaaaaatccaaaacaccatcagattcttctacaaaaggctatactcaacaaaactggaaaacctggacgaaatggacaaatttctagacagataccaggtaccaaagttgagtcaggatcaagttgaccatctaaacagtcccatatcacctaaagaaatagaagcagtcattaatagtcctcccagccaaaaaaagcccaggaccagaagggtttagtgcagagttctatcagaccttcaaagaagatctaattccagttctgcacaaac

SEQ ID NO: 3048 - DNA, 1400 bp, mus musculus
tcaaacttctaactaaaataattagaagccaacaactgagaaagactaacaacaattgagatgaaaatgtcaataaaaagccttaaatcgatgaaaattctaggaccagatgtattctcaggggaattttaccaggcattaaaagatagagacaactcttcttaataaaaatagcaacagacacagaattctaaaactccttctatatagtatcacctaaatacccagaccagatgaagaaacaacaataacaacaacaacaagctataagacaatatgcctgatgaacagagaataaacaataataaataatacttaaactaaaaagtaataaaaaaaagacaggcattaaagatgttatacatcatcatcaagactgttttgtccctgatattgaactcatgtgctaataaaaaatgtcttaaaaattacagggatggaaatggagaggagcctgaggaaaggtaggtccaccaaccggaccaaagagggatccagctcaaggggaggtcccaagacctgacactattactgaggctacggagtgctcataaaaagagacctttcatgactgccctctgaaagacataacaagcagctgagtcagatgcagatatttgtccaaccaatagacagaagcagctgaccctgtggttgaattagggaaggttgaaataagctgaggagaaggacaatcctgtaggaggaccagcagtctcaattaatctgggctcctgagatctctcaaacactggaccaccaaacagatagcatacaccagctgattcgaggacaccaacacacatagagtagaggactgctgggtctctcttcattcagagatgatgaacctagccctaaagtgactggaggccccagggagtttagaggtcagatgggatggggcgtgggggcatccacagggagacagggatatggggaggaggtgtgggatgtgtatcagttagagagtagatggaggtacagggaatggattatggagcgtacaaataaattaatttaaaaataaataaataaaagcatttttacattaaaaatgaacaaaaatgcactaaagatataatataaatattgttaaaagtgtggagaagtcagaatccttatattcattgatgatttaaaaataaatggtcgactcgagccccgggccaccttgccagcggagtcgcctgacacccgcaagggcccacacaggattccccacaggatcctaagacctccggtgagtggaacacagcactggccccaatccaatcgcgcggaacctgagactgaggtacatagggaagcagactacccgggcctgcactggggcacaagccccttctgctccacttgagccccgggctaccttgccagcggagtcgcctgacacccgc

SEQ ID NO: 3049 - DNA, 1200 bp, mus musculus
tggatattagccaaatagtacagaaagtccaggatataccccataaagtctaagaagttaaaaaacagaagaaaggcccttgtaaggttgcttaaatcccacttagagggaggaaaatagtaatgggaagcaaaggaagggagagtcctagatggggtagggaagagggagggtaaaatggggcaggatcaggtttggaggagacgggaaaaaagttcagagggccaagagaatgaatggaaatatgcagctaccagggttattgggttggggggggctttagaaagttccagagacctgggatgggagaggcttgctcccaggacacaatgtgggatcttttttgaaatgcccaagagtgggtagatggaacacacagtagtcagacaggaatcccagtggacggttgggttcaccaaaccatgtacaattctattgacccaaaattgttcctgtctaaaaaaaatgcagggacaaaaaggagcagagcctgaaggaatggtggaccactgactggtccaaattgggatccatccaagggggcagcaccaatccctgacaaaattactgatgttatgttgtgctttcagacaggagaataacatggctgtcctctgaaaggctctaccagaagctgactaagacatgcatatactcacacccaagccttagacctaggtggaagatgactatagaagagttagagaaagattgaaggaactgaaggagatggcaactccttaagaagagcaacagtgtcaactaacgtggacacctgggagctcaaatagactgagtcctcaaacaaagaacatatgcaggctagtctgaggccccagcacatatatatagcagagggttggcttttcacaggcctcagttgcagaggatgagcctaatcctgtagagacttgatggccagggtgggaggaaaccctctcagaggcaaagaggaggaaggtagggagaagaactcagcaaggggagacttggggtgtgtgtgcaacatttgggttgaaaataaataaaattattaattaatataaaagagttatattagatttcactatgggatgtgtgcaacatttgggttggaaataaataaaattattaattaatataaaagaattatattagatttcactatttaactataatttttgagtgcattaaaatatatgaattttagtattttttcca

SEQ ID NO: 3050 - DNA, 1600 bp, mus musculus
tgaccttcactgactttgcaacctcacttgttgccttggaagcctctcctgttaatccactaacagcaaggaaaatactcccaacctacaataccatcatcctgaaaaccacacttgtttttgagctccagcttgacaagaaaaaagaatccttaacatcccactaccacctccccaacacacacacacacacacacacacacacacacacacacacacacacacacactgctctactccacaaagcttgcagtattaaaaggacccaatacactgttggtgaccttcacaacaactgttctggtgtgtttttttgtttttgtttttttgtttgtttgtttgttttttgttttgttttgtttttgttttgttttgttttgttttttgagacagggtttctctgtgtagcccgggctgtcctggaactccctctgtagcctggttgtcctggaactccctctgtagaccaggttgtcctggaactcagaaatctgcctgccatttgggattaaaggcatgcactaccttgccaggctctgtttttttttttttttttttttttttttttttgtttgtttgtttgcttgtttttgtttttgattttttttaactcagaaaacctgcagtgtaaaaggctggaacattctgaactgcctatctccttctgccttcataactgcccctggtattatgaggcctacaggataagggacttcagcactacacttttccagcagaagacactaccccaatggctttggcatctctttttctcttctgcttcatgtggcctgcttggtaatcaaataagaagcagcccacctctcccagtcccctaactacctgctcacacacacagaacaaaccacaataggaaccatgctctatatgacccacgttggaaggtatcctaaatgctgtgcccttcatcctaccacctcctcacatcccctatttatctcttctacttacatctcaccatcccacgtgggagacatcgctcagcaaacaaaagcatagagtgcttttgcagatgacctgagcttatatcccactgtacatgctgtgtggctggcagcagcctataaactacatatagctccagggcatctgatacccacacaatctaagtaaattggaaacagaaatgtatatttggaaaaaggagatgatgactggattggaaaacaggatctctatttgaaggtgatgtgattctttatattaagagaatctaaaaattccaattactctgagagcagatccacactttaacataaagtgtgaaattataaaattaacagaaaagtcagtagactgtctatatattagtaacaaacatattgaataagagatcattggaatgatcccatttataatagacaccaaagctaaataaataaacaaaatgactggcaaaaacataaccaaggaaacaaaagacttctacaataataatattaatacaattaagaaagaaattgaaaaaaatcctaaaagttactcatagataagaatcaatagtctgaaaatgggcaagttatcaaagacaaaattcaaatttgatgcaatccaatttaaaactctaaggccactttac

SEQ ID NO: 3051 - DNA, 1200 bp, mus musculus
ctgcatacctagctcaaatacttttcttttctttttaacatataattttctttaaaaaattttttattggttattttgtttatttccatttccagtttcccttctgaaaaccctgataaagctgtctcctgagaggctctaccagagtcttacaatacagaagtagaagcttggagccaaccactggactgagcacagggaccccaatggaggatttaggggaaggactgaaggagcagaaggggtttgcaacaacataggaagctccatagtagaagacttcccagtctgtcttcattcacagatgatgcacctaaccctcaagagacttgaggccccagggagtttagaggtcaggtggggtgggggcgtgggagcaaccacatggagatggggtagggtggagaggaggtgtgggatgtggagcagttggagggtgggagtgggcagggaatggaatatgaagtgtaaaatacaaattaaaaataaaattaaaataattattcaatcattttttacagtcctgattttatacccttctggtctcttgaggggtctcttccaccgtgtctaaaagaagatgtgtgaccctccaccttacaagatttcctcacaccctgaggccccatgtttcttgagagttaggttcatcttctgactgagtctaaaccctgggagtcctctgctgtttatgtgttggcagactcatatcacctggtgtattctgcctggttggtggccccagtgtctgagagatctcatgggtccaggttagttgaaactgctggtcctcctacagggtcactctcattcccagcttctcccagcttttccgtaattcaaccacaggggtcagcagccaggttggtgccttagtgtgaacccaatgtgtgcctgtctctggaactcctattcaaaacagtagggcatttcatctaagtgtccactttgaatcctcacagtctcacacctcccaggtctctggtacattatggacagtcctgccacctcctacctcctgaggttgcctgttcccattctttctgctgcactgcccccttccccgagcttcactcctgttcctcccacccaacacgtgatcatgttcctgtcttcccttccctgtccccttttaaacctaggtccctcccttcctcctgactcccgtgattgcttccttcttcctcccaaatgggattg

SEQ ID NO: 3052 - DNA, 1000 bp, mus musculus
tgttttcctgtttttctttaaggacttgtaactctttagcagtgttctcctgtatttctttaagtgagttattaaagttcatcttgatgtcctgtaccatcatcgtgagatatgcttttaaatccgggtctggctttttggttgtgttggggtgcccaggactaggtggggtggtagtgctgcgttctgatgatggtgagtggtcttgatttctgttagtaggattcttacgtttttcttttgccatctggtattctctggagctatgcaggatacactcggcggggtcctggaaccaagatgtctgtgcagggtacacttggcagggtcctggaactaagatatctgctgccaatgctcaggcaaagcgctcctgcgccgtgcatgtccctatcctctggccgggaaaaaggtcaaatgcctatgcaggatacacttggtgggatcctggaaccaagatgcccgctgctgatgctcaggcaaaatgctttcaagccaggcagatccctatcctctagccgagaaaatggctagctgcctatgcaggatacactcggcggagtccctgaactgaaatgtctgctgcagatgctcaggcaaagcgctcccgcgctgggcagattgcaatcctcagaattcttaagatcgcgtggctggtgttgtagctggaggtagtcagccgactctgcgccctagctaccccggtgctgcttggaccagaaggggcttgtgcccctactcagactgggttttctgcttccctgactagtgcagtctcaagtcccgctcaattggattggagcagatgctgtgttccactcaccagaagtcttaagatcccttggcaggtgttgtgggtagctggcagtaatcagccgactgtgtgccctagctacccctgtgctgctcggaccggaagggccagttctatttctttcatctacctctatgtcattgtacagtaccatgcagtttttaccacaattgctctgtagcacag

SEQ ID NO: 3053 - DNA, 1000 bp, mus musculus
tagatatgcttttaaatctgagtctagctttttgggtgtgttggggtgcccaggactaggtggggtggtagtgctgcgttctgatgatggtgagtggtcttgatttctgttagtaggattcttacgtttgtcttttgccatctggtaatctctgaagctctttgttatagttgtctcaggttagagcttgttcctcaggtgattaagttagcctctatcagcagacctgggagatgagctctctccttagtttcagtggtcagagtaccctctgcaggcatgctctcctcttgcagggaaggtgcccagatatctggtgttctaacttgcctcctggcagaagttgtgttccactcaccagaggtcttagcatcccgtgggggatcctgtgtgggtctttgtgggtgtccttagactcctcgggcaaggtaccccggtgctggagtggatcggaagggacttgtgcccctaatcaggccgggttatctgcttccctagttaatgcagtctcaggtcccgtgcgattggattagagcagacactctgttccactcaccagaggtcttaagatcccgtgggggatcctgtgtgggtccttgcaggtgtctggagacccctccggcaaggcaccccagtgctggagtggactggaagggacttgtgcccctgatcaggctgggttatctgcttcccttgttaattcagtctcaggtcccactcaattggattggagtagatgctgtgttccactcaccagaggtcttaagatcccttgggggatctcgtgtgggtctttgcggggtctggagactccacgggcaaggcaccctggtgttggaatggaactgaaggattgttttgattttatatttgttgttttgtttgagataccaagtgaaagagacatagatagatagataaacactacctcagagtaaaatgctggaaaacaatttttccaagcaaatcccccccacatgccccactcccccccaaaaaa

SEQ ID NO: 3054 - DNA, 1200 bp, mus musculus
tcctatcacatcctgcctctatgagagtgctccttcacccacccacccacccactcccacctcaccaccctagcattcccctacactggagcatcaagcctccataggaccaaaggactcccttcccattgatgccagataatgcaatcttatgctaaatatgcatgtggagacatgagtctctccatgtgtactctttggttggtagtttagtcctgctctagtggagcaggggaagttccatttagttgatattgttgttcttcctatggggttgtagtctccttcagctccttcagttcttctcctaactcttccaatggggttccttgggttcagtccaatggttggctgtgagcattcacatctgtattgctcaggctctgacacaaactctcaggggacagttataccaggctcctgtcagcaagcacttcttggcattagcaatagtgtctgagtttggtgtctgcagataagatggatccttaagtggggtggtctctggatgacctttccttcagcgtctgcttcactctttttccctgtattttctttagacatgcacagtcccggtttaaaaattttgagatgggtgtgtggccctatccctcaactgtggtctgtgcctatccattgtatatgttctctgcaggttctatctcccctttgttggatatttttgctaatgttatcctcattgtgtcctgagaacctcttgcatctctggtatctgagaatttttagtggtttgccaccacttccacatcccccactgctacatacttctattcaatttcctgaccctccgtacttctttcacatctcatcccacacatgatcctggccccccttttcccttccccttctctctctcaaccaggttcctccctccctctaactcctataattattttctcccccttctaagtagaactaaagcagcctcactttggtcttctttcttcctgagcattttatggtctgtggattgtattctgggtattttgagctttggggtaaatatccatttatcagtgagtgcataccatgtgtgttcttttgtgactgggttatctcacacagaatgatattttctagttccatacatttgcctttgaatttcatgaagtcattgtttttattacactccattgtgtaaatgtacaacttttttttttaatccattcctccattgag

SEQ ID NO: 3055 - DNA, 1600 bp, mus musculus
gtttcctggatgttttgagttaggatctttttgcattttgtattttctttgattgttgtgttgatgttttctatggcatcttctgcatgtgagattctctcttcgatctcttgtattttgttgctgatgctggcatctattgttccagttttctttcctagggtttctatctccagcgttgcctcactttgggttttctttattgtgtctacttcttttttttaggtctagtatggttttgctcatttccatcttctgtttggatatgtttttttctgtttttctataaggacttgcaactcctttgctgtgttctcctgtatttctttaaatgagttattaaggaccttcttggtgtcttctaccatcatcatgagatatgccttttaatctgggtctaggttttcaggtgtgttggggtgccctggactggttgaggtgggagtactgggttctgatgattgtgagtcatcttggtttttgttagtaagattcttaagtctgcctttcaccatctggtaaactctggagtcagttgttatagttgtataaggttacagcttgttcctctcgtgattctgttattctctaccagcagacctgggagactagctctctcctgagtttcagtggtcagagcactctctgtaggcaggctctcctctttcagggaaggtgcacagatatctcgtgttcagacttgcctcctggcagaagatgaaggcccgaaacaggacctgtcccaaaagctgttagcttctgtagtccacactctcacctgtgcagacttgtctcagtggagtccgggagccaagatgtctcctgcagatgctcaggcaaaatctccagggctggtcggacacctatcctctggcagggaatgtgcccgaatgtctggggcccgaaaagggggctacctcagatgtcctgtggctcccgactgtcccagaagctgttagcttctgtagtccacactctcacctgtgcagagtagtctctgtggagtctgggatccaagatgtctcccgtagatgctcaggcaaagccctcccgggctcttagctaattttctactgttatggttacagaacaaatagcaaggaatcttatgctcataccaaacattttattcttttcataactttccacataaataaattagcaagttattggatagaccattttcatgaggtaattatcctgaatttgatagaaatgtcaatttgaagttgtgcttattgtaatatcattcagctagatttttcaaggcatcctttttccattgttagctgtctatcttgactgttctctcaaaactaggctaggattgttcattggagcctgtacatatgtccctttagcttgtgtttccacatagcttgaaagctgcacagcattgagacttcttagatgttagatcagagttccaaatatgagactacaggtaagagaaaagctaaattactctctatgtatcatagactctgcctttcattaggaagagaatcaaagtgtctgtagacttgctttaataattttgtatcttctgttattatatactctatttcaattggtttcaaatgatgaaagcatatattgc

SEQ ID NO: 3056 - DNA, 1200 bp, mus musculus
ggacatccagagttttgcaggcaaatggatggactagaaaatatcatccagagtcaggtaactcagacccaaaaagacatgcatggtatgtactcactaataagtacatattagccaaaaagaaaacaaaaatagtacagaataccaaagatgcagtccacagaactcaaaaagctcaacaagttgaagtgcccaagtgagtacacctcagtcccacttgggagagaaagagcaatcactagtcaggagggatatgggagggaaagtggacagggtaggaaggagttggtgggagtggggaaattgatctggtattattgggtgagggaaaatgactgaagccctaaaggccagaaaaaaagaatggaaacaggcaacctcaggaaataggaggtttggcggacaccccaaaatgcaccagagacttgggaggtgagagacaggaaggcctggctgtaggagagggaacttaaagaccccacctccagccagaaaactgaacttcaaatgagggtgaggtttgccatcccacagtcccatctctgatcagtaattgctcctgtctgaaaggattacagggatagaaatggagaggagcttgaggaaaagaaggtcaagtaacaaactcaaaatgggatccagatcaaggggtggtcccaaggcctgacgctattactaagcctatggcgtgctcacaaaaagggacctatcatgactgccctccaaaagacccaacaagcagctgcaagagtcagatgcagatatttgcacccaaccaatggacagaagctgctaacccctgttgttgaattagggaaggctgaaagaagccaaggagaaaggtgatcctctaggaggaccagcagtctcaattaatctgaaccccccaagatctctcaaacactggacccccaaacagacagcatataccagcttatatgaggctgccaagaaatatacagtagagatctttcagatctgtgctcattcagagatgatgcatgtaaacctcaagagactgaaggcctcagggaattgagaggtcaggtggggtgggggtggaggcatccatatgggaaagggtgggttggggagaaggtgtgaaatatggagcagactgagggtggatggagggggcggggaatggaatatgtataaaaataaattaaaaataaaataatttttttaaaaaagaaaaaa

SEQ ID NO: 3057 - DNA, 1000 bp, mus musculus
attagacagagtgtggaatgcccacaatacaactcacagataatatgaaactcaagaggaaggaagaccaaagagtgtatgtttcagtcctacttagaaggtagaacaatataatcaagaaaagtaggtgggagggtcttgggaagaagagaggagggaaaggggggaaaagaggggcagaatcatgtgtgggaggagaggaaattgttgtacagcgggtcagaaaattgaacagagtcatgtagcaatgggggatggaggactgggggtagcaaccagaacatctcagatgccaggaaagcaagagactcccaggacaccacggggatcacattagttgaaataccacacaaaggggagggagaacctgtggcgaacatatacagaggttagatatgccccccaaagttgaagaatggggccacccacccatctccaaaactttaactcagaattttcctgtctaaaggaattacagggaaaataatggaacaaagactgaaggaaaggccacccagagactgtcatacctgggaatctatcccacatgcagacaccaaacccagacactattgctattgccaagaagtacttgccgacaggagtctgatacagatgtcttctgagaggctcttccagatcctgagaaatacagatgcagatacttacagctaaccatctgactgaacacagggaccccaatagaggagtttgaggaagaagtaaaggagctgaaggggccttatctggcatcaagggagggaaggcccttggccctgtgaaggcttgatgccccagtgaagaggaatgctaagccagtgaggtggaagtgggtgggtgggtctaggagcaccttcatagaagcagggtaaagggtgatgggacacttggtttgcagaggagaaaacggcaaagagcaaaatatttgaatgaaaacaaataaaatatcaaaaaaatagcaacaaaatagcatataaactgcctgtggaagttgatattt

SEQ ID NO: 3058 - DNA, 1200 bp, mus musculus
gttctctatggaatgttctgcacctgagattctctcttccatttcttgtattctgttgctgatgcttgcatctatggttccagatctctttcctagggtttctatctccagcgttgcctcgctttgggttttctttactgtgtctacttccctttttagttctagtatggttttgttcatttccattacctgtttggatgtgttttcctgtttttctttaaggacttcaacctgtttggctgtgttttcctgcttttctttaagggcctgtaactctttagcagtgctctcctgtaattctttaagtgacttatgaaagtccttcttgatgtcctctatcatcatcatgaaaaatgtttttaaatctgggtctagattttcggttgtgttgggttgcccaggactaggtggggtgggagtgctgcgttctgaagatggtgagtggtcttgatttctgttagtaggattcttatgtttgcctttcgccatctggtaatctctgaagctagctgttatagttgtctctgttaagaggttgtacttcaggtgactctgtttgcctctataagcttttacatttcaaatgctatcccctttcctagtttcctctctgaaattaccctataccttccccctgccctgctctccaatccacccactcctgcttcctggccctggtattcccctgtactggaacatataatcttcacaagaccaagggcttctccccaattgatggccaagtagaccatcctctgctacacatgtatcagacacaagctctgaggggtactggttagttcatattgttgttcatcctatagggttgcagacccttttaactccttgggtatctcttgtgaggctatgccagtgcctggaaaatatagaagtatatgctcatagtcatctattggatggaacacagggccccccaatgaaggagctagataaagtatataatgttgtttttagttattcttaccatttattttaaagcctggaattgtcatatttcttttgtatatctgggatttttgtttgtttgtttgtttgtttgcttccacatgaatatttggatagattttccattttgtgtaaagtgagatggggttttgattgttattacaatgagtttttaaatgcttcctacaaatatagtcattttcacaatgttattctaccaatcaatgatgacca

SEQ ID NO: 3059 - DNA, 1600 bp, mus musculus
tttacactttgtattttctttgaccaatatgtcaatatcttctgtagtattttctatgcctgatattatctcttcgatctcatgtattctgttgacaatacttgcatttgtagctcctgatctctttcctaggttttctgtctccagagttggctgcagttatgatttcttcattgtttctattttcattgttaggtcgtggaatgttttgttcaattccttcacctgtttgattgtattttcctctatctctttaagaaattttcttttctttctttctttctttttcttcttttctttctttctttctttctttctttctttctttctttcttttttctctttctctctctttctttcttcctctctctctctctctctctctctctctctctctctctctctttcttttctttcctctttaagggatttacctgtttttctaaatttctttaatggagctatttattttctctttaaaggcctctatcatcttcctgagttgggattccaggacagaatcttgcacttcagatatgtttaggtatccagggcttactgtgataaaagaactaagttgtgatagtgcccaattacaatggcttctgtttcttatgtgattgcacttgccttttgacatctggttatctccgttgttaactccccttgttgtcttggatcagaccaggcctccttgggaccaggtacagccttgtgacctaggttagaacaggccttctaggaggcaggcagtgcttgctgtttttgattagagcaggcatcctgtgtccctggttaggacagaccttcaagaagacaggctggctgaggggtccagagagagcggtggcagtaagcattccaatctgcccagggtgtaggtataggtgcaaactgaaaggatggtagtctaaatcttcatttttaaagcagcagttaacatacattataatccaaattcttctaagaaacctcaaagtacatttgaaaaaaaattccttcacaattcattaagaaaacttgtttttcttcatgtgcatcatgggagttttacaattcaatggaatagtgtctttgagactatttatcataatgttcctaatcatcatgattaggagcaaaaatatggacatgtttgtgtgtgtgtgtgtgtgtgtgtgtgtgtgtgtgttccagaatagaagaggtatcactgattcactgatgttctttttatggcacagtatctttttatccactatttttttgttgttgtttattcaattttagcttgatcgtggtccctctccctcctctccttctagtcctatccttacatctttcccctgatcctcttctctctttatgcccagggaagtggaggccatttttagggaagcaatatattttctgatgcttggaggcaatcaccaaacttagaaatagaaagtagaatttgcaaaaaaaatagaagaaaattaaaataaatatgaaaataagagtaattacaaataaggaagaaaaaggtttggtctgaagacatttacatgtgttatgaagcattaacatctacttaaaataaagcataaagctagtattaacttcacttaatacaaattat

SEQ ID NO: 3060 - DNA, 1000 bp, mus musculus
ataaaaaacacaagagattagaaataaaaaaaaaatgagatcttcctgagcccagtcgaggctgctaagggctccagagggctcttcacactgcaggaccttgggatcacctcgggatcatggttaagtggaacacaacatcacctccaaagaatccctgaggctcttgtgctggaaggaacagggacaaaggaaccacacccaaccagaagctggggtctgttctggtcgggaccacccctgccatcttccttctgagcccagcaaaggtcactaagggctccagagtgctctccatttcacaggacctcaggatcacctcgggttcatgggtgaaaggaacacagcatcagcttcaaataattgttgagggtcttgtgccagcaggaacagggaagaaggaaccccacctgaccagaggctgggatccattcaggttgggaccagcccctacatcttctgtgtgaacccagtcaagggaatctagggaaccagaggactctccacactgcaagacccctagcacacccaggacctcctgatcacctgagagcacatgggcgatggaagcaacagatcttcttagtcagggtcccatagagccttcatcctcagccaggaggcagagctgagacccagactgagcaccttccttgccagaggacagttggcctaaagggagggctctgacaccaggactcaggaagcagatcagagctccagactgctggacacctcccctgcaagaagagagcttgcctacagagagtgctctgaccactggaactcaggtgagacttggactccaaggagtgctgacagaggctaacagaatcacaggaggatcaagctccagccagaggcaacttgaacattaacaccagagatttccagatagtgaaaggcaaacctaagtatcttactaacacaagtgccttctggttgcaccttgggcaagtagtctgcggacagccccaaggtccccacaggactctccacg

SEQ ID NO: 3061 - DNA, 1400 bp, mus musculus
ttatttgatttccaaaataaagatacatgagcctctttacataagccaagatgtgtgtcctactcattcaaaaatgtcaaaagtgttgttctttattatttaggatccctctttgaatcgtctatttctaataatttattatatgggatgttaaataaaatgtttctgatggattgtccatattttaaaataattggttattttgtgtgggggggaattggttattttatttatttacatttcaaaagttatccccgttcccaatttcccctctctaaatcccctatcccattcccttccccacctcctgcttctatgagggtgctcccccacccagtctagcattacagccctagtattcccctaaactagagcattaagcttctacagaagcaagggactcccttcccactgatgccagataaagcaatcttctgctacatatgcagttggagttatgggtccctccatgtgtattctttggttgatggtttcattcctgggagctagggtgtgtgtgtgtgggggggtctggtttattgatattcttgttcttcctatggggttgcaaaccacttcagctccttcagtccttcccctaactcctccattggggtccccgtgctcagtcagatggttgattgcaagcatctacatctgtattgttcaggttctatctcccctttattgagtatttcagctaatgtcatctctgttgggtcctgggagactcttgcttacctggcatttgggactttctagtggctacccctagatccccatcccccactgctgcacaactgtgttcaattttctgaccctctgtacttctttcctgtatcctcctacacctgatccggagccacattttccctccccctcctctctcccttctaggaccctccctccctcttcttcctttgattatttttccccttctaagtaggactgaaaagtccatacttcatatttttttaaatgctttttactttcaaaattttactttggtgtttttgagtgttctcttacatgtccatacactgaatgcatccagtgaccacagaggccagaaaaggatatcatgtcccctggaattggagttagagattattgtgggcagccatggagattcttaaaatccaacttgggtcctatgcagctcctaaccacaaaaccaactccccagccttatttatttatttttttatcattttgaaaaagagaatttcttgggagtgcattccatatacttccaaatttgttagcaatctattcatcacatattcttttcaatgtcttcagcacctcgttcattttttcatttttatttcaaagagttagtgtttattctttatttcttttctgcagctatcttggtaaaagttctcagttgatgttga

SEQ ID NO: 3062 - DNA, 1600 bp, mus musculus
ctcacaagagacagctatatctgggtcctttcagcaaaatcttgctagtgtatgcaatggtgtcagcatttggtagctgattatgggatggatcatttttaatactatcatattataaaacatgcattcactaatcttttaaaaatacaacatgccagcatctcctatttggtgaagagtgagccatcagctggtcaggaggcccttcagacaagccacttgttcacaaaggcagatggaaccttgctggacctaggctagtgcagcagctagaaactatcccagcctcctgagagctgtgcctttttcacctctcttgaagttgggattgtgagggcctgcctaaatttctcggagaaacagaccacacttagtcttaatctcttcccttctccctgttttactttgcttagtttttagcagcagtataccccatctttatatatcctaagaaacacgaatcctaggtttctattaaccaaataaccaaataaccagaagatgtgaggagctctgactgtaatttcctgaagtttaccaggttgtgaggacagatggggttcttggatgttgactgccttggagttcctgtcccagaggaaggcagagaccactctggcttttctagagagcccctgatgcttaccaggcttccacacctctcctgagtggcttcacccatcctttgctgtgcaagtggagtgagagatttgctttttttaggggactgttttcctaggctctgtctcctgcctccctctggcttactatactccaggagacccagcaacctcatgtatcaccctgaggtattgcaaggaaaggaacatgacagcttcattgaatttgtggtttgccaacttgtaccccacctgtctgtgagatcccataattgctgcaggatactacagtaagggatgttatgaggatgagggatttgttgttccccacagtgcactgagcaggggagggaggagggaggagccatgctgctaacattctggcattcccccctcctagaataaatcagggcatttgaagggtagagcagtctcagcttaggttgcttgtaagataaatctggagaagcacggttgttccattgaacaatatttgagacaaaagcctattgtaaataactgctttttttcttttgtcaaattgtttttgtttttatgtttaaaaaatacaacacacgatcagttctaaattacaatgttaacttataactattaaaataattttctaacatcaagttaaataatctagatttttgaaaaaaatatttataggatgggatgtattttactatgaaacaaataaatgtaaattctgaccataaaaaggaatctttatgaacaaaatggatagtatggtctgtaattggtactttaactgttgaggtttaaagacaagactgtgttgcaattttggtatgtcgagaatcaacttagaaaataatttccttagaatcattataattggtttagggtaataaagttatttcttacatgatattttaacaaatcagtctcctgaatttatattgatctgacagagctgagcatcaatgatgcatatggtttaacaacttgtattt

SEQ ID NO: 3063 - DNA, 1200 bp, mus musculus
accaatgcagagatggaaacaagggtattaacctcaaacactaagcctatacagacttcctctgtcttaatgtttgcttgctgtgaagagacaccatgaccatatcaagtcttttttttccctcatttaaatgtttattggatatttcattgatttacatttcaactcgtatgcccatttctggttttcccgctgcaaacgccctatcctatcctcccttcacctgcttctagaagtgtcttccacccacccatttcaaccacaccaccctggaattcccctatatttgagcaccagtccttcaaaaggaccaagggcctctcctccaattgatgccagattaaggtcatcctctgctacatatgcagctggagccatgggtccctccatgtgtattcttttgttggtggtttagtcactgggagctcgggggtggggtggggtctggttggttgatattgttgtacttcctatgaggttgcaaaccccttcagctccttcagtcctttctctagctccttcattggggtcccggtgctcaatccaatggttggctgctagcatctgcatctgtatatgtcaggctctggcaaagcctctcaggatacaactatatcaggctcctgtcaataagctcttcttggcatctacaatagggtctgggtttggtgtctgtatatgggatggatactcaggtgggacaatctatggatggcctttccttccatctctgctccacattttgtccccatatttcctttaggcaggagacattctgggttaaaaaattcggagatgagtgggtggccccatccctcaaccttgcctaatgtctggatatggtctctacaggttcttctgcccatttgttccatatttcagctaatatcatccttgttgggtcctgggactttctggtggctacctccagttccctatcccccactgctacacacctgtgttcaatttcctgaccctctttctatcattcctgtctcctcccatacctgatcctgtccacttttttccactccccctcctctcttcctcccaaggaaagtatttaattggatcttgcttacaatttgagaggtttatttcattgccataatggaaaatatcatagctatagtaattaaaaacagtatcatgttggcataaaagtagaagaacagaccaaggcaacagcatagaaagtta

SEQ ID NO: 3064 - DNA, 1000 bp, mus musculus
ccaagatctgatcccccccccccacacacacacacggaagaggaaattctcacatataccagattctgtaggcaaaaactttactccccaagtttaattggtacacaggcaaataagtctgtgattggacagtagatagaggtaggtaggttttcacttacatagctcggggtcacaggtagagagaaaaaagaggaaaaagccagataaaggtggacactttgatgagacgaggtggaccacaagcaaatgtccaggaaagacaaaaagtaacaagggacatatgaatggggtataagttaaatagaatagctacacaacttgcccaatctagctttatagtttgtaaatagaatacctgggttgtgtgtcttttttatggggtagctagaatttataattccatttacaatactcttattttgttggatattttctctaattacatttcaaatattatgtcctttacatgcccccccccccggaaaatgccctcctcatatcccctcccccctccccctgctcaccaacccacacactcctgcttcctgaccctggaattcccctacactggggaatagagccttcacgggacaaagggcttctcctcccattaatgtccaactaggccatcctctgctgcatatgcagttggagccatgagtcccaccatgtgtgctctttgggtgctggcttacctggcagttagcatgtagaagaagacaaattcttatctccttgtacaaagctaaagtccaagtggatcaaggaccttcacataaaaccagatacactgaaacttatagaagagaaagtggggaagagcctcgaacatatgagcacaggagaataattcctgaacagaacaccaatggcttttgatgtaatatcaagaatagacaaattggacctcataagattgcaaagcttctgtaaggcaaagaacactgtcaagaagacaaaaaggccactgacagattggaaaaagatcttcactaat

SEQ ID NO: 3065 - DNA, 1000 bp, mus musculus
gaatagtatcacgacagaaaatcttgtccaactggagacacacataactcctagcttgcacctgcacacaggagcagatcctgtgctccatctccacttaccagcccacacccaaagacatcttgaccctcaggagttatgacatacccaggaccacaagtaaggcccaaaaacccactgcaatacctgacctaactgggacatcccatgggcccagagaaagcaagaagaacccctagctagagacacatgttccttccagtttgcattagtgtccaggagcagatcctgtgctctgctttcccacaccaaccacatccagagagagcttgacccaaaagggttctgacacctgcaccaaagatctgcgctccagacccccactggtacctagagacatcctgaccgaaggaggtccaacataaccaggctccagtcagagaaagcaagacaattaacatcagagataaccagatggcaagagacaaacacaagcaacagaaaccaatgctagtttgcaacatcagaacccagttttcccaccatagcaaatgctggatattgcaataccactgaaaaccaagattcagatataaaatctcatctcatggtgatgatagagtgttgttgccggccagtggctcacatgtctgggttctagtctgggaaggcatcttggaatctgcaagagaagggcgtggtggtggtgggggaactaggcggcacaataaagatggaaccaagacaaccagtctgatcaaggttcgattttactatttccgacactcagttatgaagcaggggaaggggccctttccctccaaatcatcctggagtaaagtagcaggtgaccacatgtttgactccagaacagcaaggtggcaggcagctgcagtgggagtggcagaacagtacaatagggctgcaagctccaccctgactctctcttctgaaacctgagcaaacaggtttcaggctagggaggttacaatagaggatt

SEQ ID NO: 3066 - DNA, 1400 bp, mus musculus
cttgtacagagctcaagtccaagtagatcaaggacctgaacataaaaccaaatacactgtttctaagagaagagaaaactggcaagagccttgaacacatgggcacagagaaagtttcctggacaggaaaaaaaatggttcatactctaagatcaacaataaagtaatgagacctcataaaggcaaaggacactgtcagtggaacaaaacagcaaccaaaagattggggaaaaaaaaatcttttccaatcctacatccattagagggctaatatccaaaatatccagagaaatcaggaaggtagactccagattaacaaatagccctatttaaatggggtacaaacctaaacaaagaattatcaactaaggaacactgaatggtgaagaagcacctaatgcaacatttaatatccttagtcattggggaaatgcaaatcaagatgacactgaaattccatctcacaccagtcagaacagctcagctaaaaaactcaggtgacagcagatactggtgaggaagtggagaatgagaaacacccacacatttcaaatattatccccgtttccccttcagaaaccccctatcccatcctgcttctataaggtgttccccctaacacccactcccacctccctgccctggcattccccactacggggggcaacaagccttcacagaaccaagggtctctcttcccattgatgcccaacaagaccgtcttcagttacgtatgtgtccctccttgtgtactctttggttggtagtttatcctcagggagatttggggcctctggtttgttgatattgttagttctatggggttgcaaacccttttagctccttcagtcccttctcaaactcctccattggggaccccatgctcatttcaatagttggctgcaagcatctgcctgtgtcaggctttggcagagcctctcaggagacagctctataaggttactgtcagcatgcccttctgggcatccacaatagtgtcttggtttggtgattgtatataaggtggatgcccagatggggcaatctcttcagtttctttctttccttcagtttctgttacataatttgtctccatatttcctcctgtattttgttcccccttctaaaaaggaccaaagcattcacattttggtcttccatcttcttgaggttcatgtggtctgtgaattgtatcttaggtattctgagctttagggctaattaagtacttatcagtgagtgcataccatgagttttcttttgtgactgggttacttcactcaggatgatattttctagttccatccatttgcttaagaatttcatgaagtaattgttttcatagctgagtagtactctactgtgtaaatgtaccacattttatctatccatttctctgt

SEQ ID NO: 3067 - DNA, 1200 bp, mus musculus
gaaagtatgtaatctgatttttgactttgatttcatggggtgttacaactgagagattgcctggcgtctctgaagagactttggactttgcagcagttacaatactgaatatctagtggtacatttgaagttggttttaaggcattttgcattatatgcctaaaagtctatggggggccagatcatggaatgtgataacctccatatgttcatgtgtggggccatgaaaggcagcctgttttggttgaaggaggcttgctctggagacccagtagagacccattaggaaactctacatgggacagaacagtgagccatgttcccagagacagatgcctgacaccacagagcccccaactccataattctgtgactataagttactcagacaatgtcccaagcttctggcattctggctagtctccatccccacagttacctgactatagacaggtatgctcttccccatagttacctagtgacatcaaggtagcccagcccactataaaaggggctgcttggcccatcttctctttaagccctcacatttcgtactctcatctctagccctccttcgctctctcccttcccctctctttccctgtggccatggccaacctctctacctctttctaccttttctctttccccctgcctttctacaataaagctctaaaaccatagatggtctctgttcatcaacacctgcttaaatgatgagataagcttttccctaaagagctgcttctatcctctccatggaagaagaccttcctgagttccagccacagactggaccaaggactcttgaccctgtggaaaccacccagcgtcccctctctccctgccctctcctcttttcggccctggggattaccaagtcatctccgggtaacctcccccattttgttcccagctcttcagcggtatccagtggtgtctagggtgcctgaggccgagaacctgttttctctggcctcagtgaggcccagagacctaggactgctccttggccaacccctagaggactgggctcagtggcttcctacaaccagacacccacccaagccatggggagagtgtgcagcagtcctcccttgtctgcccatccagagcacgggaactctggctggatgcgggttttctcctactccctttgtacccccacacccactgccctgctttcatgtatttgaaagc

SEQ ID NO: 3068 - DNA, 1200 bp, mus musculus
taatcaactcttaaatgtgttgcattttgcataatttctgagtttttaatataatagcagtatctggaagaatactactaacagaagtgtggactaataaaatccaagtgattcctaaataaatcaaaccaaacaaaatgataaaaataaaattaaaagtcatcatttaacttaaacatttagaagttcagaaaaaaattcaatattttccatacttaaaaaaatattaaaacaagaaacagccatttaaaaaagatagtagtgaaaagatgaggacacctaatatcaaccactggcttctgtaggtgggatcctgctcacatgaatgtgtgcacacacatgcacagtggctctgaacactgcaggggtcatttccaggtcttctccacttagtaagttaaaacggatgtcaggccgggcttggtggcacacacctttaatctcagcacttgggaggcagaggcaggcagatttctgagttcgaggccagcctagtctacaaagtgagttctaagacaaccagggctatacagagaaaccctgtcttgaaaaaccaaaaaaaaaaaaggatgccaataggctccaagcaaaaaaaaaaaaaaaaagatagtagtgaatcattttaacatttcaaactctcctttcagttcttactgtgtcaagagttttggttttaaatttttgctattggttcccacattatttcagcaagatgcaggagagtacatacatattgcatgcccattattttgtgaatgtgttcgaatctattggttttttttgttttgttttgttttttttttttttttgattagcaaaggagttatttattctgtctgaaataagttgttaaaaatttgaaatacatgtgaacattatcaatgaaagatataaaaagacctggagtggatggtttagttaataaattgccttttatgcaagcacccatataaaagctgggatagtcagcacatatatgtaactcgagagcaagagatattgacaggagaattttaagaaatcaatggccttatagtttagacaaatttgcaagctttaggttcaattagaggtagactcaaaaataagggtataataaatagtagacaaatatctaatattttcctcttttatgcacacacatgcaaacacaagaacatatgtacattcatacactagaaagagagagaaaggtgggat

SEQ ID NO: 3069 - DNA, 1000 bp, mus musculus
cgctgtgttccactcagcagaggtcttaggatcccgtggggagtcccgtgtgggcccttgcgggtgttgggcaagactctgctggcaagcggaaagtggattttgaaactctcccagggacagagagaaaatcgtggaatcccgtctagtgtgtgcgtgctggccggtgtctttgttctgagtgtctgttttatgtttcctgaaatgaacatgtgctcattgtgttggtttgttgtatgtgtctcatcctgtgtctctgaaacatggcacagtctgagtttagatccgcctgagtttgttttctctggtgtttatagacaatggggttttctgaaacacacacttggtatttgcagctgtccctctgggctgtaaggaccggaggactgtggtcagcagatgtcctaggaagactgtcacctaaccaggggatgcccaggggagtagggagagccagagacgtctggcagtctccagagatcagtcagaggaaccaagttttgtttatgaaatggcagcttacccttctaattcttttgcctgctcgtggaagacgagaacgggttgcatgtgtctggatctgtttgtttctgttttgtgtgttttgtgtatgtgtttagagctatgtgaaaatttagagaagtgctagtgtgactggaaaagccctactgggagttgattgcaaatgcagttcttaaaggggcaggcagccttttgcttgtaatagaaagttagcttaaaattggtaactcagagttggagtaattataaacaacatgtagcaggagcaaacccaggaaaacaagtctttaaagatacttcaaaatagggataatctttgggccaggactctggcagagtgctcagattgagaaatgtttgcacttgggtaaactctgagctcagctcagagcagcctcagggaggtttgtgtggcatttcttttgtttcacaaaccttcatggggaagttcctgggacctcacctctccctgccttca

SEQ ID NO: 3070 - DNA, 1800 bp, mus musculus
tggaaagccatcctatagacatatcactttgtaggaccatttattttactatattttacaaaacgatcatctcagacaggagctacttctaattgggttcttttagtgttctgagtgtggtgtgtgtgtgtgtgtgtgtgtgtgtgtgtgtgtgtgtgtgtgtgttagttctttaatctcttcttaccaaactttcttatttatttatttttttattttatttttaattttttatctttttggttttttgagacagggtttctctgtatagccctggctgtcctggagcttactttgtagaccagactggcctcgaactcagaaatccacctgcctctgcctcccaagtgctgggattaaaggtgtgcgctaccacgctcggctccaaactttatagttacctgtgatgtaagtatgtactccactgaaattattgtttggaaagtgagtattttatatttgaatatggggaatttgggaagtaaacagaactagatgaaataataagcttgtcaatagtgatgtcaataatggctatattaaaaatgaaaacaggtattgaatcccttccatgagattcattccttcaacctcaaactatgtgatagtttgaggcttagccataaagtgtaggcataagttattttgcaatctacttttaataaggggtcaagctcttctctaacccaacacccagctgaggtagtagaagagaaaagttattaagatatgggggaattggacttgctcagccacagttctttagggagtgaacaggatcttctgtggcagtagttcagtcctgtagcaaacaccaaatatgactcagcagctctagacatgtcctctaggcaggcagattccacacatgaaccagcagcttaagtccagtactttaggcaggcagacactaggcacaaagcagtagctgcagttcagccctgaagaaaacttcaagactcaccaacaggcctgaggagaggccatggaagtggcaagctgctacaggaacctcatgagctgttgtcctttggtaagtttttctcaattgcagtgttaccacaagttgagctcaacaacactatataatgtgaaccaatacatgtgtgtagttattgaaggactgtgaggaggagtaaaccaaactaatgctcagttctcatctcccactgtctgtggggtcatatctatactccttcatgaagcgttctttcacatgtgtgttatatctaaacatgctttaacatgtatctgcttcagaaaacattctttcatatatctactttagcaagacatcattttacctgtgtgccccatcaaaacatcattagacataaatatctttccaaagaaactagaagctttctcttcaataaacaacacagaaacaatttctaaagttcagagagcactgtagagtgagagcaggaagtatgtaaaaaccagaagatacagtgaaaatgcttcaaactttaataacctagacgcaacaagaccattgcaaccattaattcacaaataagtgtggttgcctcaacttggcctatcttactgattgggtataaattcactgactcataaactcagtaagtcacaaaccaaactatatagagatgactataagaaaagaatgtataggaagaaggaggggcatacgcatgtaaaaagaaagtatgcattgtttacatgtatggatttgagaataattttaattaatgaatatgctaagtagagcagaaaataacttagaaattgtcaaatccaaagcaaactctccaaattccagtggttatacaaaag

SEQ ID NO: 3071 - DNA, 1200 bp, mus musculus
ttcagagatgcagtagaaaactctacaaggccgggggtgggtaataggggacttttgggatagcatttgaaatgtaaatgaagaaaatatctaataaaaatgaaatgtaaaaaaataaagtagcaaagtgatttatagaggaaaaaacaaacagacaaacaacaacaacaaaaaaccaaactctacaagggacagaacagtgatccatgttcccagacaaatgagcctgacacgatggcgcccccaactccataatcagtcactcagacaatatccaaagctcctagcattctggctagactccaccatcacagttaccaggcaatagccaggtatgatcctccccacagctaccctgcaacaagaagttagcccacaccattatacaaagagttgattggcccctcctctctctcttaagctcttacctcttttattctcatctctagccctccttctccccctcccttatctcctctctccacatggccttggctggcctctccttttctaccttctctctttctctctgcctttctacaataaagctctaaagccatggaccatctctgcttatcaagaaccactatgcttgaacaatggaataaactgtcccctaaagagccacaactaatttccccggggaaggcctcccagcttcttcagcctccagactagaccaaggactctgtcatgtgagaaccacccagcaccccctctatgcctgtcccctttcccttcagcccctgagctgattgagctgcccctggagccctcactttgttctcagctctttggtgacatacagcaacatctgagatgtccaagactgagaacctgtcatctctggcctccgtgaagtgcagagaatctgtactgctccctctctacccctgtggactgggggtctgtggcttctcacagccaaatgcccacccaggccggtagagagtatgcagcagttctccacatccaccttcccagatcaccagagagactgctgcccaaaaaataaccagatttcctctcctttcatttttgtttttgtttttctgtatacaaaaagttttcagcaattcatatgttgacagattttaaattaatttcaaacctttttttagaaatgcatgtctgaataagaaagtgcaggtgcttctggaagattgcttccatttccttcagatatgtatgcaaaagtag

SEQ ID NO: 3072 - DNA, 1600 bp, mus musculus
attctaaaagatacaaccaattaccacaatcctcataagagcagtatgaacatttcataaaccctggttaggatatttttctgtcataatgaaatcttatgtttactctttgtatgtgtggtgcatgtgtttactcatttattatcatgtttagggtcttagtaacagacaatactgtgactttttaaaaaattaaatctactctgtaaagcaaaaagatattgaaaaaacactggccccattattatttccttgaaagttgaaatgttttgcaaaagaataatatgaaccattgtgtctggaataagttgatacatttgtgcttgtagttactttctttttttttttttttgcatacatgtgtgtatgccttttgcacttgtagacatttttcctttacattctctttttttatttttgacttccttaatattattttttgtattattttattttaattagatatttcctttatatacatttcaaatgttatcctgaaagttccctatacactccctctgccctgctcccctacccacccactgtcgtttcttggccctggcattcccctgtattggggcatataaagtttgtaataccaaggggcctttcttccaagtgatagcagactaggccatcttctgctacatatgcagctacagatatgagctctgggtatcccgagcttttgtccccgctggcaagaacacactcaggacaaccagaattttctgcggcaaaaggctttattgcttacttctcaggaggaagaccccgaaaccagaaaatggcgctgcttttatagcctgcagagtgacgtttcagcacctgatgtggtgtgacagcttctgattcgttgctcgcccatcaccccattattacgccccgagatgggcagtgactaggcgtgaattcactcttgcacttgcgcataaggcttgtttactagttaggcgcagtggaagccagcaccatcttataatggcgattgctcatggcatggctctccacatctggggatactggttagtccatattgttgttccacctatagggttgcagacaccttcagctccttgggtgctttctctagcttctccattaggggccctgtgttccatattatagatgactatgagcatccatttctgtatttgccatgcactggcatagcctcatatgatacagctataactgggtccctttagcaaaattttgctggcattgtgcaatagtgtctgggtttggtggctgcttatgggatggatcccagggtggggtagtctctgcatagtccatccttttgtcttagctccaaactttgtaactcctttcatgggtattttgttccctattccaaggaggaatgaagtatccacccattggtcttccctcttcttaattttcttgtattttgcaaattgtattgtgattgttctatgtttctgggctaatatccacttatcagtgagtgcatatctaatgacttcttttgtgattgggttacctcacaaaggatgatatcctccagatactggcgaggatgtggagaaagaggaacactcctccacggctggtgggactgcaagcttgtacaacc

SEQ ID NO: 3073 - DNA, 1400 bp, mus musculus
ctagagattaactgtatcttaacaattagtgccatcgttactttttttactgctttagtaacccacctggaacacggaaattttagaagaaggaggatatttatacttacaatcccagagggaaaagttcatcatgatttttcttttcctttttttttttatttgcttcaggtagcaataattatatcaatagtgtccttaaagtgtgaggatgaaacagagagaatggactggggatttgaaagatccagtgtacatttcctccagcaaggtcttttaaatctacacagacagcgttacaaactgagaccaatattcaaatggcagagccttgggggacattctcattacaaaccaccatacttagtcaatgactctattatataagtggatatgttttgacaggtcataggccctaggagaaaatttagtttttttctattaaatattattaaacttctttttaatttttttatttgttctttaatagtttttttttttttcagcccaggcactatctccctcccagtccatcctatgactgttccacatcacacacctcctccccatctccaagagcatgcctcaaacccctactcccacagacctcccaactccatggggacccacgcctcttgagggttaagtgcatcttctctgactgagtgtagacctggcagtcctctgctgtatatgtgttaggggtctcatatcagctggtgtatgcagcctggttgataactcagtctttgagagatcctgggggtccaggttagttgaaaatgttggtcttcctagagggctgccttctacctcagcttcttccagcttttccctaatttaaccacaggggtcagcagcttctgtccattgattgggtgcaaatatctgcatctgacatttccagctgcctgttgggcctttcagaggacattaatgataggccagtgtttgtaagcataccatagtatcagtaatgtgaagacttgtcccaccccctagcccctgagctggatcccaattttggcctgtcactggagctctttttctccaattttattcttgtaattctttcagacaggaaaaattctgggttagagtttttgactataggatggcaaccccatccctcaactaatgaattctttttatacatacagattagtgtatctgtaaatccatagaaatttcttttgtagcacatggtagttaacacaatcttggaactcaccaaagtccaaaaaatatgagacggtgtaatgctcagctctaaactaagcatatatactatagctcttctttccaattctcaggacctcattgcaaaaaaaggtcaagaatagtgtaagtgggagtggaggtcaataactacaaggaaagtgtgatttctgaacatgtca

SEQ ID NO: 3074 - DNA, 1200 bp, mus musculus
aataatgaagttactgcatgaaaatttgccattgtatatattattaaaccaaagaggtagaatagtagcaaaaaagagggaaattaactggctgtcatattttgcctgtttgattctaaaatttatactgtagacctttggcatacatactgcaatatacataatttttatttagaatttatgacaagtttctatttaaagttaataaatctccaatgcattcatgtttaccatgaagagattcgtagttctagttaaaatttagagggttgtttttcattttgaaataggggagatcttggttcctggatcatctagactaggctgcacaggttagagtgtggactacagaagctaacagcttctgggacaggcaaaacccacagagcttctgaggcaaacccattagggtctccagacatccgggcaacttccctgccagcagagaggtgtccaccctgctggagcacctgagggagccatcttggttcctggatcctgctgagtctagtttgcacaggtgcgagtgtggaatacagaagctaacagcttctgggacaggccccgttttgggccttcatcttctaccaggaggcaagtccaaacgccagatatctgtgcaccttccctgcaagaggagagcttgcctgcagagagtgctctaaccactgaaactcaggagagagctagtctcaggtctgctggtagaggctaacagatcacgagaggaacaagctctaacaagagacaactataacaactgactccagagaataccagatggtaaaaggtaggcttaagaattttagtaacgaccttgccagcagagtcttgcccaacacccgcaagggcccacacgggactccccacgggaccctaagacctctggtgagtggaccacagtgcctgccccaatccaatcgcgcggaacttgagactgcggtacatagggaagcaggctacccgggcctgatctggggcacaagtcccttccgctcgactcgtgactcgagccccgggctaccttgccagcagagtcttgcccaacacccgcaagggtccacacaggactccccatgggaccctaagacctctggtgagtggatcacagtgcctgccccaatccaatcgcgcggaactcgagactgcggtacatagggaagcaggctacccgggcctgatctggggcacaagtccctt

SEQ ID NO: 3075 - DNA, 1400 bp, mus musculus
tgcctctaggtcaagccacctctcaagctggcaagcatcattcacagttttacttcacctgaaaatcttgtaagccaaagttctctctctagtgaagtacatatgggagacaaaatgagtagtttctgttggattcagtcctccaaatctgattaaatatagcaagtttactgactcatcaataaatgaggtcagagacctcagcagtagtaaaaagaatgttgtactcaagtgataaatattttacctatatcaaatctttatcaaattacacttgtcaagacaatggtttgtaaatattattcatgaattaacataaaaaataactttaatttttattacacgctaacatttcattgcaatttagaaatatattgaggatagcaattaggactcttgttgagccccattttggcccaggtttgaaccttgaggacaaatctgagtctggcttgagtttctgtggccttgtgggagagcttaagcctggcttgagttttgagacctgtctcagtcacttccataccggggtgagtcagtaagatctgtttggccctgcctctgccctgcttttgctgatgtatagcttttacattggccttgtcagtcactccataccctccatcacccttctctgcctccttatcccaccaaaaatccacctgcctatgttccaaatttatataagcaagaggctgatgccataaagttgccaggctctgtgtgttccttttgggccgtggacacttgccatcctgctcaggccaaaagagaatccagtgggatcagaacctctctgctctcacctgaaactgctggcaaggagctgcaggcagactcttagtaattgataacattgttcctgatgctataataccaatgctcagtaatagaactatatgtttactttagtaaatatctactgagaaaaataaatgtgttttctgaggctaaagttatagttaaatgttgtacttagagatacatttctactaattaataatatatcaatgttaaatgcatatatttaccttatattttcctatgtatttgtcataatattttgtcttgttttactcattgtcttttgtttaataatcatcttgtggtcctcatgtgttcactaacatctatgtgctattatgttctatggatactctaagaccctatgttgaatgagtcttttggtgcttccgtggatgttacttggtgaggacaccttcaaatcaagaggtccttcctctaaatagttgtacttccactcgaaagtattctgcactctaatgtttagtagtagtgagtaaggctgccagatttctagatagtgagtaggaaaaaggatactgcatgtgttagtattgttttgtttactcttttcactccatccttttaagagccca

SEQ ID NO: 3076 - DNA, 1200 bp, mus musculus
gaaaagctcttatatgatccctgcctggcaggtctacttgaggcacagccagcggaggtgagctccatgttgtcttcctgagttccatgactttcccacctgaaaaggcctgctgggtcccaggaatatctggttagacaattcttcaccaattccctgcctacccagtccacttagggcacagccagcagaggtgagctatgttctgtcccctaggctccatcatgagccttaaagctctgtcttccttccagacccggaagaccccaggaacattcagttccacatggggcacaggcagcagagttgagcactgagctcatttgtcaggctcaaggctgtctgcctcccagaagactttttctggcatcagaatcttccacccaacaccaaagacaaccagatggatagagaagagtgtaagaacagaacaaacaagagcccagacaatatggtatcaccagatctaagctatactaccacagcaagccttggtaatcctaaaacagctgaagcacaaggtgaccttaaatccaatcttatcagcgtgatagaggcctttaaagagtaaatgaataaatctcttaatgaaatcatgtaatgcaacctcagttaagaggatatcaatgattataatagttaagtttgagagacaaaaaaaatgtccctcaatggaccttgctacctattctcaaacatgtgtttgtagttgcatgaagaatagttatatcatgctaagtgtaattatgaaatcgctggcaagtccacttcttcactggcattagagccttcatagttggttgggattctgatgtgtactgaaggccagctgaaacacacagcccattggactgagaaattagtggattcgtgtaccttgcaatagtagccagccagcattaaactagttggacagtattcattctataggttctatgcctctagagaactctaattaatacactcactccattcttgtttagtctggtatgttagggcctgtgtagcccagagcattgggcacctctttaattcttaacactctgtgatggttaaccctgcttgtcaacagagtctagaatcatctaggagaaaacttttgggtgtacccctgagggaattacaagattgggttaaggtggaaacaccaaccctacatgtgggtgcctggggtaggactgaataaaaaggagaaagaaa

SEQ ID NO: 3077 - DNA, 1200 bp, mus musculus
ataaaggattcttttatggatattatcatgcccaaataaatattcttttattctggcctatatgtgaacatgtggtggcagttaatgatatcacagataaatatttatgcttccttttaataaaataattttaaaaatggtcatttagacactgtattcactacataaatatttggctgtcttgttcaagtggaggataacatcatacctgaaaataattaatggaatttatcctatatatttttccaataataattcctaataataatttttaattattgataaataattgataaataatcttagatgactagaacaaataaattcctgcccccccccaaaaaaaatcaaaaagaaaagctaggacaatcaggtagaaatgccaaaccacagggcactgtcttctgggtacccagcaagcccaggaatattgaggtctgtcctggctcctttgtgtcccttttctcagtccatacatctaaccaaaatccaagatagctgcagccatcactgaccaccagatgagatccccaccccaattttgtgcctgccagatacccatgggggggacagcaaaagcaagccccactcagacccctctgtactccatttcccaggtcacaaattgtactgcatccctggaggcctgttgctgcccaggataaacataggcctgcaatcatcagggacaagtagatgtacaactatctctggaggtctgccccaaatcagaaaattcagcagcccaaagtcctctgattgcttccctggaagcctgctactattaggaaataccaggcctgtcagcactaaggacaatcaaatggctaaaagccagcagcataagtactcaataaacaaaattccaagaaatcttgcaccacccaaacccacctatcatactacagcaagccctgaatatcctgacaagtcatagttcctgaaaactggacttatatcttatattataaagatgatagagacagttaaaacagaaatgaaaaaaaatccttaaagaaatacaggaaatacaataaaatatataaaagaaattaataaatctattcaaggcctaaaatggatatagaagcaataaagaaaacacaaatggagacaatcctggagatcaaaagcctaggaacggttacaggaatgacaaatataagtatcaacaacaaaatataagacatggaagaaaat

SEQ ID NO: 3078 - DNA, 2600 bp, mus musculus
cttgagtgggctgaatcagaccttgcttctgccacagtcagttagctcagctagctcacctagggtggagtcttctgacctaggtaaagtctattgagggccacatctgcagcttcctgcaagaagccaccacctgctgctttcctgaggagatccctacaaagcaaggagatcctggcaaagtggaggatgggttcctccaccctttaaattcaagaccctacaattaaagaatgagcctctatcagagaacagttttctggcacattatttctcttgtagtccttcccatccatccccagctttcctttcaggaacctagcaacctgtggctgctagcagctacaggtggcatcaaaagagtggcctgaatatggaaagaatgactgagggacactgtcttggtgggactccagagtaaacagaagaagatggaaaaccagaataaaaatgattatgaaaagtgtaacattaaaacaaacaagcaaacaaaaatctaggcctttaggcccaggcttgaaaatgtgacttttgtgactcaatgctccaagacatgctaatcgtaaaacagatagcgacattcttccacccacccgcttcctgggttcagggagggtttgttcaaaaagagtcaccctgaccattgctggaacctgctatgcaaatgtgcaattgttagaggctcatagaaactgtcttgaaaaataaccacacaattaccaagtatttttcttgtgacttccacttactggtgactcttaactggtatttttgatattttccaacaatgccctccccacccactggagttgtagtttcttcctttaaataccctcttccccagctacttgggtgctccatggccctctacctctgtgtagtgtacaactgtgggcccctaagtgtgcttggaataaaagtcttcttgcagtttgcatcaagaccatttcggcgaataatttggtgtgtcgcctctcctgagttagaacgtgggggaatcctcacattgtgggtctttcatttaatgatttaaaatcagttaaatgacttaatttaactttgattattcatttgtatgacattatataatttaattttactgatgagttaaaatatttgaagaaaggacataggattctccaattttgaatgtatataagaggcattaatctttatttcaataaagcattttagaagaatccaatattgaatacaatatggtttatagaaaaatactccatgggttttctttaatacataatatgctcagaatgacataatattttcccatacaaatattctacttctttattcttcatggttatacatagtagtcaacaatgggatacatatacatttctttctccaaaagtttccatagcattttgaaattgttttagtcctttatggtcaatttagattccatacattagcagacacaaatgagcatggagtcatgttgaaattcaaagaggttatgttttctagaaagcaccatttctctctctttaaaaagaagaaagaaataacaccctaggcagtaaattcatacaagcaaggcctatgtatatatgtatccatatatagccactcacagctacatgaaccaggttcccaaaaggagggctggggctgtatgagccaagacaaagtattctgatcaagggcaatgtttacttaagagtctgaacttataaaagggggaatatgccccccccccaataccaggatctcatttcatcaggatagtgtcaggagaacagattcagcctcttagcaggtaatagagtcttggaggaaactgaagatgtggcagaacaatagacctaatctaggtcagaagaatccacccgagataggctagctgacagtggcagaacaggtctgagccagactgctcaaggctggaggaagctatttacttattcactttacatccagcacactcctcctcccagttaaccctttaacaattcttctccatcactcctcattcttttctgagtcggtggggccacacttggtgccccatccccaacctagcacatcaagtatctgcaagactaggtgatcctctcccactgaggctagacaaggaagactatcaagaagaacatgaccttgtcacaggcaagagcttttggcatagctccctcactcccattatttgggacccacaggaagaacaaggtgcacatgtgctacatatgtgcagaaagccctgggtctactcactgtatttgattagtcgttcagtttctgagagtctaaagaaaacaggtttgttgactttgttgttcatcctgtgaagttcatatcaccttcagcttgcaacccttccctttctctgcatgcactgtttcgtcgtagatatttacatcgacctgagtcagttgctttgtggagcctctcggaggacagccatgccatactcctctctcaaagcataacagagtatcatcaatagtatcagaaattggtgcttgtcattgagatggctctcaagtttggctcattattggatggtcatttctctagtctctgcttcatctcctgtgcctgcatttcttgtagacaggataaatttgggtgaatgtttt

SEQ ID NO: 3079 - DNA, 1400 bp, mus musculus
ccctaggaaagcagagagcaaagggctaagttaaaggcttttttagccaaagtgctgtctggcctgtgccacaaaggtgcagcactttgccccgcccacgcagcgtcaatcactgcctagctgggccccacacacagctcaaagctgagagcaaagggggaggggctacagagttggaaaaccaactttcttctagctgaaacctgaggagagacttttacctaagggggctgaccacccgaggcaccagccctcctgcctgcaaaaaacttcagaaatcctttcaccagccagcataggaaaacagctcacagcaattactgccctcaccgggcagagtcattcaaagcctagagctggaggggtggagggactacagagcttggtaaagccagctgcttatagttgaaacctgagagagcaagagggggccagggcaggagggggaggaagcttgccaggaacacttgggagagagagagagagaaaaggtaaaaaagcctagtttttgaactagattactcacagtctcttgggaaacttcaagatctgatgtaggtctctgtgcaaagcattcttcagctggttctgtcccacatagatgacataaccatccctctgctaccatttgttgggaactaaaaagggggccctggggaagaggggaaaggggaaaacccacacctcaacagagttttacctattctctggtctgtcaggcatgggagggctgctatctaccttccactcatctctggctgggcattggatcctctgacccactcttaagggggtagctagggggcatccctacctgggaacccctgagctattttgctaaagccaccagggttataggagagagggatgagggaagggaggttcccaacacctggagagtgagtgcagtggatcttgactggagcacaggaagaggccttccatctggagattagaaagagctcattaggagaaagcctgtcccatcctccaagcacaggttttagagctttattatagaaaggcaggggaaaagagaagagagaagagaggagagagaagagagagagagagagagagagtaagagggagagagtgaaaggagagaggagaggagaagacagagaggagagaggggtgagagtgaggggtaagaagtaagagagtgagacataagagagagatgagtaagagagtgaggtgggggcctaacaggcccttttatgatctttactgttgctaggtaactggggaggagtttagcctgaaggtcagaagcttgggccattgtctacatgacttctagccatgcttctcttgtgggggctgtggggagcggtaacttgggcagggtccagagttccaggagcattaaagaatccctacagtgtcatgaaggt

SEQ ID NO: 3080 - DNA, 1200 bp, mus musculus
ctgaaaatgtagaatgtatgaaccttgttgaaagtaagaatttttttcaaaatagaaatgagggtttaaggaaactcagttctttcattgaaagtattcacaacctaagagagaatgtaactaaacatatgctcttcgtgggctacaaaatcaaactaatttataaaattatcgaaatatttttaacatgtaaaggaacaagttattctgagttactgatctgcaactttatatgcataggaactaagatgaagaaagcccatgagaaggtaaattttgagagacagagagagagagagagagagagagagagagagagagagagagattattttctctcagacacgtattgcaggcaggtgaaatggagtctataacttcttggcttccagacacacattcaaggcttgccttcccacacattctgactagatctcagagctctttggttacacactatcagttgcctctttctttccaagacctttaagctcagagtggcaacatctgatttctaaggaaaatttgcagggttcttctactgtagaatgacctaggctgtcacagagcttattttgtatgttttcgatttgatttcgctatgatttaaaaggatttgttttgttttgtttcttcgtagaaagaataactcaatatcaaatatcatttatgaaaaaattaaaacaagctcaaattatagtataggaacagctacataaagatcatcgtgccagaagttaggggaaggaatgaaggatctgaaggggtttgcaacatcataggaagaacaacaatatcaaccaaccagacccccaaaactcccagggactaacccaccaaccaaagagtacacatgggtgggcccatggatccagctgcatatgtagcagagggttgctttatttggcatcaatgggaggggaaccccttggtcctgtggaggctcaatgacccaatatagggaaatgctagagcattgaggtgggagtgggcacgatgagtggaggagcaccctcatagaaacagggggaggggataagggagttgtggagggaaaactgggaagggagataacatttaaaatgtaaatgaataaaataacacaaaaatcataaataattttccacattaataattgttggtttgcattagcatgttatgttactcaggatatatagataattacctgaaatattccca

SEQ ID NO: 3081 - DNA, 1600 bp, mus musculus
attctttaagggatttttgcgtttcctctttaatgtcttctacttgtttagcagtgttctcctgtatttctttaagtgagttatttaagtccttcttgatgtcctctaccatcatcatgagatatgcttttaaatccaggtctagcttttcaggtttgttggtgtgccctggactgggcaaagtgggagttctgggttctgatgatggtgagtggtcctggtttctgttagtaagattcttatgtttacctttcgccatctggtaatctctcgagttaattgttatagttgtgtctgtttagagattgttcttctggtgattttgttaccctctatcagcagaccagggagactagctctcttccctgactttcagtggtcagagcagtctctgcaagcaaggtctcctctttcagggaggtgcacaattatctggtgtttggacctcctcctggccgaagatgaaggcccaaaacaggatctttcccagaagctgtgttgctttggcctttcacagaagcctatgtttcagtagtccacactctcacctgtgtagactactttccgtggagtcccggaaccaaggtggcccccgaggaacgtgaggcagaagcctctcgggctgggcggacacctgtgctctgaccaggaagatggccggttgtctggagccgaaaatggcgccacctcagaggctctgtggctcttgctcgttccagaagcctctgtgttccacactctcacccgcagactgcccgcctcggagtcccagaaccaaggtggcccccgcagaaagtgagggagaagcctctcgggctgggcacacccctgtactctcaccaggaaggtggtaggttgtctggagcaggaaatggcgccacctcagaggctctgtggctctcacctgtcccaggagctgctggcctctgtgttccacactcccacctgcaggctgcccgccatggagtcctggaaccaaggtcgctcccgcggaagctgaggcagaagcctctcgggccgggcggacccctgtgctctcaccaggaaggtggtcggttgtctggacaagaattattattttcaacaaatgatgctggaacaatttggaatcctctttcaaatattttaggtgaaacatacaccttacacttctaagaaaaaagaattcttaacccaaatatatcacagacttaaatgtagaacaaaaaatataagcatcacaataagctacataggagcaaataaacataaccacagacacagcaatgactttccatataacacaaagaaagtctgtgaaataatttcttagctggattccattcagattataaacttcaacattgtagaaatcagtgttaacagaagaaaaaacataagatgagattttttccaagtaatcatcatgaacaactactatccaaaactaaacatgcagagagagagagagaaagagagagagagagagagagagagagagagagagagagagagaagcagtggtggctcatgcctttaatcccaacacttgggaggcagtgtcaggcagatttctaagtttgaggccagcctggtctacaaactgagttccaggacagcc

SEQ ID NO: 3082 - DNA, 1000 bp, mus musculus
ggtgacaacacatgtagagacagaggaacactcctccattgccggtgggactgcaaactagtataaacactctggaaatcaatctggaggttccacttgcgaaagagaaaaaagcaaccacaagggtagggaaggagtgacctgggagggaaagtggatggggtgggggaggtcaggggtagagggaaacctgatcttgtattggataagtggataagactggagccctgagggatagcagaaagaatggaaaaagactcaggaggttggaggttgtagggacactccagaacacaccagagacctaggaggtgagatactaccaggactcaaaggaagggactttagatgaaatgcctaattatagggagatggattttatagagcccacctctagcagaaagagagggcttcaactgagggatggggttactatcctacagtcacaactctgacccaaaattgttcctctctgaaagagttacagggatggaaatggagaggagcctgaggaaaagaaggtccaatgacaggccaactcaaagggacgtcccaagggctgacactatcactgaggctatggagagctcacaaaatgggacctataatgactgccctccaaaagacccaacaagcagctaaaagggtcagatgcagatgtttgcacctagccaatgagcagaaactgctgactcctgttattgaattagggaaggctggaacagactgtagagaagtgtgatcctgtgggaggaccagcattctcaattaatctagacccctgagaactctcaaatattggacaaccaaacagacagcataaacctgatgatatgaggcccgcaacacacatacagtgaaggacatttgagtgtgtgctcattcagagatgatgcacctaaccctcaagagactggaagccccagaatctttagaggtcaggtggggtagggggtgcagacatccacgtggagacatgcagtggggaggaggtatggga

SEQ ID NO: 3083 - DNA, 1200 bp, mus musculus
tataagaatgtggtggatgaaggaggtctgttaataaaaacttctgacttttaagtgcaagagtgttctttatgtacaagagtgttctttatgttctttttagctggcagccagaagcttgtcttgtccttacagtctagtggatgtatactgggaaacgagagttttgtcataatatactccattgctacaataccatgaagaaaatcctttccagaaaagtactttgttgggaacatagtttttagaaagttttttttacacatcagaatacaacctggttatgttatatatggtttgacagctgatcattatgcattggacaaccaataacaaaccttatatctgagaaaggctagtagttttccttctcacagtagtctactagtgtagcatgaaatattaaaaaaaacaatccatgataccgctggcctagcatcagcagacaggtcagcctgttctcagcccagccaactctgactcagagctctgaaatctctccacccagcttgctaagtttccatgacaggctgctgccacgcacacttcacgtttccaaattcccattggctggctgcggttccctgccagtgtacttttctctggaacccagcagagttgctatgggaaggaaaacacctcaggatcttagtttagaatcaataggtaaaaccatcactgggcagagcaactagaatcctaatttgtaagctattcaaagttatatatcctccagtagcagatttaagcagatctgtaacctgaactgggggccttccttaactacattgtatcctccatgttctccagtccaaaaagaagtctttcacctgtcttcctcttcctctctcctacctggaagtcccgcctactcctcacccaatgattggtcctttgatatctttattaattaggggaatgttctgccaaccactagctgcctgtagttttttctttacaacatattccctctgccacattaacaagtccatttacattgacatcattctgtttttgtttatgaatccattcctagtagacactcttttgaggaaaactttctagtattgtggcccttacaatgtttctgcccccttcttctgtgttgccatcattataaatgtaggagttgtaatgtagttgtatctgttgggactgggtttcccacattcctttgatctcttcatgggccctagttgt

SEQ ID NO: 3084 - DNA, 1200 bp, mus musculus
ataaaagtaggaaactttacagccaaatagaaaatggtatgtaaatgtaaaatgtttaagtaaatcttgaaataatatttgtaatttttatagtgaatagaaccaaactaaataacagtggcagaataaagcttgcataagaacttgtaaacatagaaggtttcttagcagaaatactagataacatggtttgtgggaccatgaaaggcagtctgtgttctggttgagtgaagcttactccatagacccagtagaaaactctacaagggacagaacagtgagctatattcccagacatagatgcctgacaccacggaaccctcaactccatactcctgtggcagtcatgtagacaatgtcccaagcttctggcattctggctagagtccaccctcacagttatctgacaatagccaggtaggtatgctccttcccacagttaccctgcaacagctaggtagccctgcccactataaaaggtcaagcctctcttattctcatctctagctctcctcctcctcccttctcccctctctccacatgtccatggctggtctacttctcttcttctcttcaggaacttaatgtgccatagctggttgatatccatgagaggcattccattttctggagagaaaaggtagagaataggatgggcatagagttggggggagtggaatttggggaaggaaatgtgactagaagagccaagagaaatatgcaatacattattaacacattgataatgacaatattagaattctaaaaattactacagcacaagcacacacacatatacaaatatatatattgagagagaacaagagaaaaaacatataacaaattttattatttctagcatatcatttgtttatctactttaatttttctgttaaagcaatagacatatatgagttaatgatgtttatcactaacttaaatttatcatcattgatatgtaaaaatgtaattgtaggttttaagtaaatgaatgcaaactattttgagtaaaaatgaagtagacatttgaaattatctacatagatttataatttcaaacatatagaagatatgatgcaatttgaatctcacatttcaataccagtgatgaggattttgcaagaatagttgatgcaagtctctgagaataccattaaaatcctctctactgtctaggggtggtctttcttggtattttag

SEQ ID NO: 3085 - DNA, 1400 bp, mus musculus
ttagcacaagcctaataaaataattcaatttatttcaaggacttgtctagataatatagttgataacagcacaaacatagataactctgatgataataaaatgaattaaagttcaaactgtggggataagttcacttactttgataatatggtttaatttttgcttactaggttcttagatttgtactatttattcttttttcagcagtttacacatttcaaaagatatatatcattttgtttaaatataagtatattctatgtatttaccaacccattatttttcaaatgacatgctaaattttaaaatatgtatagaggaatagtcacattttgagaaattgcaattccattaaattagcatattgtaagccaaatacaacctgaaagtctgtcatatgattgctactttatccagattttcttgtgtaagtcaatatgtgcataaaagtgatagcaaaatgtgtgaacaaaaaagggggggcctggggagtcccagggagaagtgggggaggaaaaatatgccaagtccccccagagtttctctgggcaggaggatgtaggaagactgccaggagctttccacacgccccccaccccccacagggtagagatctaaagcctctggatgtactggttagttcatattgttgctccttcattttgggcgctctgttccatccaatagatgattgtgagcatccacttctgtatttgccaggcactggcatagcctcacaagagagagctatatcagggtcttttcagcaaaatcttcctggcatatgcaatagtgtctgcgtttgctggctgattatgagaaggatacctgggtggggcagtctctggatggtccttccttccatctcagctccaaactttgtctctgtacctccttccatgggtattttgttccccattctaaggaggaacaatgtatctacactttagtcttccttctccttgattttcatgtgttttgcaaattgtatcttgggtattctaagtttctgggctaatatccacttatcagtgagtgcatatcatgtgagttcttttgtgattgggttaactcactcaggatgatatcctctagatacatctatgtacctaagaatttcataaatttgttgtttttaatagctgagtagtactccattgtgtaaatgtatcacattttctgtatccattcctctgttgagggacttctaggttctttccaccttcttgctattataaataaggcttctatgaacatagtgaagcatgtgtccttattaccagtgggaacatcttctgagtatatgcccagaagaggtaatgctggatcttctggaagtactaaatccaattatctgaggactgccatactgatttccagagtggttgtgcaagtttga

SEQ ID NO: 3086 - DNA, 1400 bp, mus musculus
tcagaatgctttctagcctcctggttattttatattgaccaaaatagatgtcaaattacatgccagttaaacataatgcttatgaaatatgcagttacatctgtgatcagatttgatttataacatggaatgaaacattactatctttatagaagtatagttcactgtgtaaaatgattatatcagggcatggattaaaaataaaaatagtgtttcattaagtaactcttttattttatttatttatgtatatgtatatgtatatgtatatgtatatgtatatgtatatgtatatgtatatgtatatgtatatgtatatgtatatgtatatattcattcactccagattttattccccttcccggtccaccctttgactgttccacatcccatatttcctcccgacccctgtctccacaaggatgtccctgccacccacttcccaccccaccagatttctaaactccctgggttcctccagtctcttgaggtttaggtgcatcttctctgactgaacccagagctggtagttctctggtatatatgtgttggtggcctcatagcagcctggttggtggtgcagtgtctgaagatctaggtagtccagataaattgagacgctggttctgctacagggttaccctcctcaacttctttcagctttccactgattcatcgacaggggtcagcagcttctgtccgttggttggttgggtgcaagtatctgcatcttattcttgtagctgcttgttgggtctttcagagggcagtcataatagatccatttttgtgagtgctccatagcctcagtaatagtgtcaggccttgggtatccccttgagctggatcccattttgggcctgttacctgaccttattttcctcagactcctctccatttccacccctgcagttctttcaaacaggaacaattatgggtcagagctttgactgtgggaaggcaacctcctccctccttccctccccccttgtgattgctttcttctccctcccaagtggaactgaggcatcctcccttgggcccttcagtttgttgaactttttgagttctgtagagtgtatcttgggtattctctactttttaaatttatttatttttttatttatttatttatttattgatttttaggctaacatccacttattagtgagtacataccatacatgtccttttgtgtgtgtgttacctcaattaggatgatattttctagttccacccatttgcctgcaaaactcaagatgtccttgttcttaatagcggagtagtattccattgtgtaaccttttttatgaaaagtagtgtacttgataccttacatatgttactttattatctcagagtcactgtacagttagtaagtgttggaataagggccttgg

SEQ ID NO: 3087 - DNA, 1000 bp, mus musculus
ttgctggtgggattgcaagctgatgcaaccactctggaaaccagtctggtggctcctcagaaaattggacataggaccttaggacccagctaaaccactcctgggcatatacccaaaagatgctccaacatgtaatagggacacatgctccactatgttcatagcagtcttatttaaaataaccagaagctggaaagaacccagatgtccttcaacagaggaatggatacagaaaatgtggtacatttacacaatggagtactactcagctattaaaagcaatgaatttatgaaattcttagcaaatgtatgcaactagaaaatatcatcctgagggacacaatccagtcagtcacaaaagaacacacatggtatacactcactgataagtggatattagcccaaaggctcagaatcccaaaatacaattcacagatgacattaagctcaagaaggaagaccaagttgtgggtgctttggtccttcttagaaaggggtataaaatactcacaggagcaaatatggagacaaagtatagagcagagactgttggaaaagccatccagcgactgccccacctggggatctatcccttatatagtcaccaaacccagacactattgtggatggtaagaaatgcttgctgaaaggagcttgatatagttgtctcctgagaggatctgccagaaccttccaaatacagacgtggatgctctcagccaaccattggactgagcacagggtccctaatggaggacttagagaaaggactgaaggagctgaagagatttgcaaccccataggaaaaacgacagtatcaaccaaccagacccccccccccagagctcccagggactaagccaccatccaaggagtacacatggagggacccaatgctccagctgcacatgtagcagaggatggccttgtaaggcatcaatgtgaggagaggctgttggtcctgtgaaagattgatggatgccctagtgtaggtgaattt

SEQ ID NO: 3088 - DNA, 1200 bp, mus musculus
atttttcctaaatgctctataagcatgtctcaaaaaataagatggagaacaattgagtaaactattaatgtttactgtggcagagattggcaacatttgctaaccattctaagtttagggcaagagaagcgatagcaacactgtgcaaaattcaggttatgatacatctatttaaatcttaatccatttatttatttatttattttacactccaaattttattctgctcctggtccaccctctggatattcccataactgccccagcatccccctcagtctccacaaggatgtcaccacccctattcgtgtacacctcacaggatctctatgttctctaaggcctccaatatcttgaggtacttcatctcagactgaacacagacctggcattcctctgctgttaatgtgttgggggcctcatatcagctggaacaggctgcctggttggtgttcaagtttttgagagatctcaggggtccagattaaatgagactgctggtcctcctacagggtcacccttctcctcagcttctttcagccttccctaattcaaccacagaggtcagcagcttctgtccattggttgggtacaaatatctgcatctgactctttcagctgcttgttggatctttcagagggcagtcatgataggtccctttttgtgagtgttccatagcctccgtaatagtgtcaggccttgggacttccccttgagcaggatcccactttgggcctgtcactggaccttcttttcctcaggcttctctccatttccatttctgtatttctttcagacaggaacaattatgggtcagaatttggactgtgggatggcaacactctccctcacttgatgccctatattcctgctggaggtgggctctatgagttccctgtctccattctatggtatttcatctctccctttaagtactgagaatctctcacctcccaggtctcccagcctcctacctctggaggttacatattcccattctttctgctggccttcaggggtttcagtcattttccctcacccaataccagatcagtttcccctctctgtcccccatcccctttccctcacaggaccctccccccttgtggttgctttcttctctgtcacaagggggattgaggcatccacaaatccaggcctacaaaggataatagaaaactctagcacaccattaaaaa

SEQ ID NO: 3089 - DNA, 1200 bp, mus musculus
cactactctaaaatcttctagtttgacataatttccatagtttcagtcattaattcttataactttataatatatatataaatataatatttttctaattcaaaacttcttttcaaatattcatgtgggtacaattacttacagttcataataaaatagttctgcattaagaatctttccaggttataggaatgggtcagccattaggataattgaatagccttctacaggcctctctctttgagtctgagtgtctctcacttcccagttctctagtccatcttagagggtccccccaactcctacctcctgagtttgcctgtttccaggtaggattgaggcatcctcacttgggctctttggcttgttaatcttttgagttctgtgggtattcggtatattatggataatgtccactaagtgaggacataccatttcatgtccaattgggtctgagttacctcattaaggatgatattttctagttctgtccatttgcctataaaactcaggatgtcctcgttcttaatagctaagtagtattccactgtgtaaatgaaccacattttttttaatccattcttctgttgtgggacatctgggacttttccagctcctgactatcacaactaaggcctctaagaacatagagaaacacatgcccctgtggcatggtggggcatctttttgggtatatgcccaagagtagtatagctggttagttcgtactgttgttccacctatagggttgcagacccctttagctctttatgtgaactaaccagtacccccagagctgtgtctctagctgcatatgtagcagaggatggcctactcagccatctatgggaggagaggcccttggtcttgtaaagattatatgccctagtacaggggaatgccaaggtcagaagtgggagtgggtgaattggggagcagagctggggagggtatagagggctttgtggatagcatttgaaatgtaaatgaagaaaatatctaattaaaaaaatgaaaaacaaaagattagcatactgtggtcttgtaaatatcatatgccctagtacaggggaatgccagggccaggaagtaggagtggatggattggggagcagggcagggggacagtacagggggctttagggatagcatttgaaatgtagatgaaggaaatatctaataaaaaatatgaaaaaaaag

SEQ ID NO: 3090 - DNA, 1400 bp, mus musculus
atctgagagtaattttgcaatatcatggtaatttctacaccatataatagaaaaatactacatttgaaaatatattatattttgtatagaatctactgattttgcactgtaaatagattaaggcctgggctagagttcatatattcttaaagaagccttagggtttcagcaaaaaaaaaaaaaaaaaaaaaaaaaaaaaaaaaactggaaataaattacgtattcaaagctctcacctcataaattaaaagttttacaaagtaaattttgaattaaatttatgtttctatatataaccttggatattttatttcattaatctcttcattatatgctggatatttttatttcattaatctcttcattataagctatgcactttaaattttactatgaatagtgtttatgtagacccatagagtcaaacacaaaagaaaatgcttgaaagtatcataaatttaataaagacagcaataattcctcttaattattaatatcatgtctgtaaaagagcagtttaacagggtagaactttaaaaatcttgacaaatgtgaggatagtcaataaaatgataactagttcttcaaaattttgtccgatacaaaatttaataatcaatatgaaagagaaccagagatatatgaacaataaatgcataactgaaagcaaaaatcttcattatgctaacctataatcaattagtaagttttattgcgttaactttctagttgtcttttgttttcttcagagctgaggaccaaacccaggctcttgcacttgctaagccagcgctctaccactgagctaaatccccaaccccgggttgactttctaaaggaatgcatattcttggaatctctttctccttttgcttcttataaaatttatgctgattgattttcaggaaaaaaagtgttgaaacaatccctattttaaaaaaaatggagaaggttctcatatatatatgaacctctaggctgatagtggtgttagcatcagacaagaaaaatacaatgcaaaatataaatctataataatatcaatgaactaatttgatgaataaatttaaaataaaacaaataaacaaataaacaaagctaaacctgaaagatacatttgaaaagtgagcctttcaaattattctatttattttaaaacccagcctaggccaatttatgctatctatgtttctccaattttccatgaaaatcttaggagacttggctttggtatcctctatcatcttaaaacctcttccttttttgttatatattcttgatcacaagcatatattatatttcaagtatagatatcaaaggatattgaggtgagcacagatttatgtaatattctatttttatacactttttatttttattttttattttttattttttta

SEQ ID NO: 3091 - DNA, 1200 bp, mus musculus
cttatttatttacttatttgcaattcagcagtttccccctcccccaggcctccctgggagctcaagtctctggataattgtgcatcttctcccactaaggctagaccaggaagtcctattctatatatgttttgggcaccttggactagttcatgtttactgcctggttggtggctcagtgtcagagatctcaggggtccgggttagttgaggctgctggtctttctattgctctccctcttctgcttcttccatctttcccctaattcaaccatagggatccttgacttcagactattggttgggtgtaagtatctgcatttgtctcagtcaactcttggttgggcctctcacaggtcagccatgctaggctcctctgtaagcacatcatagcatcagtaatagtatcaccttttggtgtctctccatgaggtggatccccacttgggtctgtcagtagactgcctttccctccttcccctcaatttcttctccattttttgtccctgcagttcttttggaaaagttcacttcctggtcagaaattttcactgctggaggtcagctcttcgagttccctcttctcactattaggtacttaatctaagataactctcattgagtactgggaatctcttacttcccaggtctctggtactttctagagggacccccccccctttaccgaagctacatattttcattcactttgctggctacctgggcttctctcctgttccccctccctgaatatctgatcctgttccccttactacttctcctaccttctcccacacaaatccccctctccctctgcctcccctcattattttcttccccctactgagtgggactgaagcatcgacttagaatttctgtttgttaaatttcttaaattctgtaggttgtatcctagatattctgctcttttgggctaatatccacttattagtgagtacatgctatgtatgtcctttggggtctgggttacctcaatcataatgatattttctagttccatacttttgcctgcaaaattcatatttattgttcttacaagatacatccttatcagtttaaactctaaatatcattcatatttgaatagaatagcattgtaattctataactgggctaatatctttgaaaatcacaattaggtgtactccacaatgtttctatgttttctttataagaaga

SEQ ID NO: 3092 - DNA, 1200 bp, mus musculus
ttcctttcctattgggatttctcatctactatgcatataatttaatattcaaaaaagtaatctgaagatatttttattcagttttttttttatcttttcatttcttatagtgctttttccccagccattcgtcccctccctgctcttcatgtgactttaggaatatttcttgatagttggacactagtaaagacactagaattctccaatgtgtttaaacaggctgccaacttttcagttagatatgacttattttatgtagatgataataaaaaatattttgttttgttttctgtaccctgacagctgcagaaataacagtgcagccaactgtggaagaagcctctgatacctgtactcaagaatgcctcatcttgggacactctgactcctgctggatgccagctactttgaccaatcctagcccttcacagataaagacctctgctatctgccacagcccacccaggccccgcttgtcagttcgtcgctacagccctccagtgacacagacggtcactatttgccacagcccccctgtgacccaagctattgcactgtgtcacagccctccaccagtacaggttactgtaccccgccatagtccaccaccagcacaggcctctgcagtcagctacagcccaactctagtacaggctgtggtaattcaccacagtcctcctctgccacaggctgccacacaccatcgcactcaggcacaaccaccaatgggtttgcagcagggatgggtgcagggtgctggagcagatggactgtatcctattgatcagggagtacagggcagtacaagagctcagttttacaccatggctgaaagatttcatcccgatgatgactcaattaaagtcattcccttgaccacctttacttcaggtcaacaggccagatcctcaagaggtgattctccaatcatagaggaacaccccttgtaaagcctatatggatacttcacattttaaaaaagatgtatataaacatactcaaagattaacattcaattttaatgaatattccaaattggcagatttgtaaatagctgtgtaaatagaaacagataccagaataagactagagctagacccttagtcacaagataataaaataaatttaaaatttaatttggtttgtgaattttcaaaagaagtaaatactttatattcctttgtacagaaaggctta

SEQ ID NO: 3093 - DNA, 1000 bp, mus musculus
accacatattcttcatctattaacccattagcagacatctaggttgcatctgattgctagctattatgagtagagcaacaatgaacacaattgaagagttgtctttatagtaggatgaaatatattttgggtatatgctcaataattataaagctagatcttgaggcacatcaattcccagcttcctgaggcactgcctcccttatttccacagttgttgtacaagattttataccaatcatcaaaagatacaatttttgcttgctcttcatcctcaccaacatgagctgccatttattttattgccaatggctattctgagtggcataagataaaatgtcaaattagtatttgtgtgaacttccatgagtaatgatattgaccatctttttaagtgtttctccaccccgggatccatcccataatcagccaccaaactcagacactattgcatatgccagcaagattttgctgaagggaccctgatatagctgtcttgtatgaggctatgccagtgtctggtaaatacagaagtggatgcttacagtcatctataggatggaacacagggccctcaattgaggagctagagaaagtacccaaggagatgaagtggtctgcaaccttataggtggaacaacaatatgaactaatcagtaccccccagagctcatgtctctagctgcatatgtagcagaagatggcctagttggccatcatttggaagagaggcccctaggtcttgcaaactttatatgcctcagtacaggggaataccagggccaagaaatgagagtgagtgggtaggggagcagggcggggggagggtatagggaactttcgggatagcatttgaaatgtaaataaagaaaatatctaataaaaatttttttaaaaaagtgtttctcaaacatttttgtttactattttgtatattctttgtttagacctgtacctcatttttaattggattgcttgttttcttgatatctagtttttt

SEQ ID NO: 3094 - DNA, 1000 bp, mus musculus
acttcagaggtggaaagggaaaatgaagagtttcagactagcatcagttatgctaggtttctgtctagaaacatagcagagtggcagtaatagtgtcaggggttggctctctcccatggaatgggtctcaagtcgggccacttattagttgatcattccctcaaactctgctccatttttacacctgcacatcttgtagatatgacaaattttggttagagggctttatacatgggttggtgtaactctctatccactggaagtctcatctggatacaggaggtggccccttcagtacccaatgttcccagattctaggagtctcagctagtgttacctccacagactctccagatcgtaccccatactatgcctctggctagtctcatagatgccccacatttttctctcccatccctctcctaagaccctttcccccagacctgatctcatcccagttcccctacttagcccctctcctacccagttctcttcctccattcacttagatgtcgattttatttccccttctagcataactgtctcctgagttgcctcatctatctgcaaaccggtgcagagatccacagacaaacatctgttgcagatctatgagtcttgtggaagactggaagttatgattgagtgaaacagaggggccaagggccccacaagaagacctgcagagtcaatgaacctgggcccatggggactcacagagactgaatcactaaataaaaagcatgcagggactggtcatatgtctcctacacatttgtagtagatgtgcacattggtcttcatgtgagtaccttaacaattggagcagaggctgtctctgttatctgttactgcatcccctttccctagaataactaccactgactcagcttcagaaccaagccatgatgtaggttttaagctctcactgctttattcactgctctgggcagtggtcacagtgcagtacacttgacaatgagcacctatccgcaggctc

SEQ ID NO: 3095 - DNA, 1000 bp, mus musculus
tggatatccctggtgtttgttgatctgtatgactgtatgtagtctgcctcttttgtctctgagttgcttcagatctccttgtaggcttgtagccctgtctttattagaccacctgtgggtccttccaacttgaggctcttctcaggggcagagaagctgcttatctgttgccctggctgcagtagatctcctgggaggctttcagactattaagtcttcagtggagaagtcaagctctgttccaactgtgctgagtacagccaatcctctactgctctgagagtagtggatcctcaactgctccaagtgcagagggtcctcaactgctcaactggtttgcatgtagtgggtcctctagtatagtgatatgtagtattaggggagtagaccaactagggccccaagtccgtggctcccagcagcagctccaggactggatgaaggtggttgagggggtttcttaccaactgctctgagtgcagcaggtcctgtaggttggataggaatataaagtcttcacgggagcagaccaactaggagcctgctctagccatgtaaaaatttgcttggataattataaattatggatagaagtaaaaatttgtttagtgactggggaagttaaatatcccctccttataggctaaaacgctaaatcaaaatggtccaaaactgtagaagcttgtgctggatttgtgcttctgcactcaggctaactgcattgccttcagcttaaggttatatattgtaattatatacacaattgaaagaaggtgttggaggaggctcattgcttaaatagggctttacttccaaaataaaattgccttaaaattcagaaattttgaccctacaatttacattgtcttatgttaatagatttgaacgtatttataatttttgcaatagaaattcaccaagagcttttaaaacaggctaattgatcagtaggctgtccttcatcttggcatttaaaaagtttgtgtacctttcttattct

SEQ ID NO: 3096 - DNA, 1200 bp, mus musculus
tctcttgtattctgttgctgatgcttctatctacagttcctgatttatttcctacggtttatatttccagagctgtgtccttttgagttgtctttattgtttctacttctattcttttatcttggatggttttgattaattttatttcctgtttggttttgttttcctgtaattctttaaatgatttttttttttgtttcttttttaaggacttttacatgtttagtagtgttttcctataggtcaagtgagttattaatgtctttcttaaaatcctccaccagcatcatgagatatgatttttaaatccaggtctagcttttcgggtatgttggggtatccaagactggctgaggtgggagtgctgggttctgataatggtgagtggtcttggtttctgttagtaagaattttacatttgcattttgccatttggtaatctcttgtgttagatgttctagctgtttcatgctgaagcttgttccacctgtgattcagttaggctctgtcagtattcctgagtgtccaacactctcctgagtcccagtggtcagagcactctctgtaggcaagctgtcctcttgtagggaaggtgcatagaattctggagctctgatccacctcctggctgaagatgaatgcccaaagggacactgtccaataatttctgttgcttcttcagccagcatgctctcctgcgatcactggtctctgagagacccgggacacaaatggagctctcacctgagtcccagggtcagaaccctctctggatacagactcttctcagtgatcctaagttcttgggtatgctagggcacatggggcatcaagagtcatctggaaaacttgggccagtcttcacagtttgtgcccaagatagcacgaggctggtgctgattggaaggatccccagcctctgcttgggatggtttcctttgtccctgttcctgttggcaaaacccctctgggttgttttggaacagatgttgcattcaactcaccagtgatcccaagatcctgggtgtgctagggcacctacagtgtggagaggcctttggggaccttaagactgtctgcagagattgtgcccaagatggcttggggctggtgccaaccagaaagatcaacaattccattttgaagtcgtcaatattgttaagaaattcctgtaagcattgttaactgtagcagttttca

SEQ ID NO: 3097 - DNA, 1000 bp, mus musculus
ttcagattagcatttttagatgctctccctgtaaaaatgcagtaagtatatttcacatttaatagcacagacttgaatttctaccaagacaaggatatacccttataatgaagaaaaataataaaaattacttcagcaggttgatctaaatttgtaaagtataagtcatatttatagtttatacccttgatgtattatttaaatataccgtgtcttatgaaattaacaccaaaaataatgactatataagaagcagattcaccactggggaaaaaatgtataaaatacttaatcatggggctggcgagatggctcagcggttaagagcacctactgctcttctgaaggtcctgatttcaaatcccagcaaccacatggtggttcacaaccatccgtaatgagatctgatgccctcttctggtgtatttgaagacagctacagtgtacttactataacaataaataaatctttaaaaaaatacttaacaatatactgtaaaagaatcatgattatcaaaaccaaagaaaatctgtatagcggctagaaggacctgataacatgttcatcaagggaaaaattaaggaaatttttatataggattacatttgtatcgtcatctgcctctctgcctgcagtaactggatgtcgcctctagaacagggagtccataacccacctttcccactggtacatcagatgcaactacatgccagaccagaatgggaaatagatatgggacaaacgctgtggttctcagtctcctctctgggtgcccagaaattgcccgtatactgccaggagaggaagtcagaaatggagttaaaaattctaccgttctcctctgggcatctgcttgccaggtagaaaatgagaagtggaacgggggatcagtgggattcagtctgattaggaacaagtgccaagtaccagagggactggagaaacgaaagccttcttcagcagtcttaggcatcactcttataagtgaaggccttccct

SEQ ID NO: 3098 - DNA, 1000 bp, mus musculus
ctcctccaaatactccctccccctacttagtccccctctctttactcacaaacccacccactctgacttcatggccctggcattcccctataatggggtatagagccttcacaggaccaaaggccactcctctcattgatgacggactaggatatcctctgctacatatgcagctggagccatgagttccaccatgtgtacactttggttggtggtttagtccttgggagctctgaggacactggttagtttatattgttgttcctcctatggggctgtaaacccttcaactccttgggtaatttctctagctcctttattgggaaccctgttctcagtccaatggatgcctgtgatcattcccttctgtatttgtcaggtactagaagagtactactcagctattaaaagcaatggatttatgaaattcttaggcaaatggatggaactggaggatattctgagtgaggtaacccaatcacaaaagaacacatatgatatacactcactgataagtggatattagcccagaagctccgaatacccaaggtaaaattcacagacctcatgaaactcaagaaggaagaccaaaatttaaacagattcttggtttattttctgtttctaagaacagaaaaataaaagtgtggatacatcgattattcttagtaggtggaacgaaatacccatttaaggaggcaaagtgtggagcagagactgaaggaatgtccatccagggactgccccacatgtggatccatcccatatacaatcatcaaacccagacagtattgtggatgccaacaagtgcttgctgacaggagcctgatatagctctctcatgtagaggtattttaatccagtaacatgactatgctggcaagagattacatccacacaccttcttggtttgtgctctggctggaattcatgcagagttctactagaccttcaaagaagacctaattccaatactccttaaactattctacaatataga

SEQ ID NO: 3099 - DNA, 1200 bp, mus musculus
tagatattctacacaggacaagaatttttgctagactaagacaataagttgaatatcatatcatactagtcactattatttattctaaaatataactattactaaaataaaacagaaaaatctcactatattgaaatcagtacccaagtttttgttaattactttatttacatcccaaaagttgttcttccttccagtccatcttccttctatctttcttcccttttgcctcaaagagggtgccccctgtttattacccacaagctggggcatcaagtctctacaagattaaatgcatcctctcccactagggccagacagtttcatttgtccctggctaggaccaggccctgtatgctttttgattggtggctcagtctttgggggttcccagaggttttggttagttgacactgttggtcttcctatggtattgctaccctccttcagttcctctaatcctttccccaagtcttccatttgggtccctggtctctgtataatgcttggctgtgagtatctgtaccagtctcagattctggtagagcctctcaggtaacaaccatgctatgctcctggcaacaagcacaacatagcaacagtaatagtatcaaagattggtgcatgcctatgggatagaactcaaattgggccggtcactggtcagctattctttcactctctgtttccttttgttccttgcatttcttttagacaagagtaattttggtcgaaagttttgtagctggattagtgttcccatccctccacagggagaactgactattggaggtagtttttgttgggtacttagattaaggtcacctgcattgagtcctgggatcctctgccatcccaggtctcttagaatttctagaggtcccccctatcacctgtcactgaaagcttcatatttccattaattatcctggagctcttggcctctcttcagtattcccccatgtttggtcctgcccctctttcctgtgaaccctctgcactcccattttcctccctctgcctcccatgattattttgtcccacatataattggattgaagcatcttgatgtgagtttttctgctgggtaaacttccaatagtttgtgggttgtatcctaggtattctttaatttttggctaatattctcgtatcagtgtgtgtataccgtgcatgtccttttgggtctgggttatatcc

SEQ ID NO: 3100 - DNA, 1600 bp, mus musculus
aaccacgattgaattcttaacaaagacacacattcttctctttagtatacaaatttggttttacccataattgtataaataaaaaaattatttgaaaaggaattgcctaacgttttaggtacagtaaatattttatttttataattattctacacaaacacacacacacacacacacacacacacacacacacacatatatatatatatatatatatatatatatgtatgtatatatatatatataaaatgtttggaaacatttttactgagataaaaacagtgaagagtgaacaagtttaaaacctgctctaacaaaggctatataaaagcccatatctcaaatattcatcttcaaaaactcaaggattttatcacccatgacagattcacggtaaagtttcacaattttttttttactttaattcatcatagtcttggaagttctagcaatagaagttaaacatgtaaaataaatacagaatacataaaagcctaatgagggccctgaccagcctgtcagcccaggggtaccctattttcctacttcttctcttgcacctctatcaggttcctgcaccatacaggtaagcttcccttctcccatccatttttcctgttctatgggctctctggcccaagccaggctgccctgatcagcctgctatatcatgtcaacctgcattctcccactgtctctcctctaccttcattagactcctgaaccatataggtaaacttccttcacccacctaacttccctgctggctaagctctctgggacaagccaagctgcactgagcagcctgtcctcccaggtggacctccatcctcctgattcctctctgcccacctgcatcagacctgaagctcctgaaccatacagaactatagatttggaaaacatatcccaaggacatccatcagaggcctgccacaccatgaccattgagatacacctcttcccaatacctgctacaacaagaacatgcagggactgaaaccatctagttggctataggccctagaaataaaacaatcaataagagccaggggaatttaacacctccaaagtacagtggcacaactagagcaactctggatatcataaatcaactgaaactccagaaaatgaccttaaattcaatcttatcaagatgagagaagactttaaagtggaaatggatatataccttaaagaaacacagaaaaatacaatcaaacaaacagagatccatgaagggaaaacaaataaatcccttaaagacatacaggaaaatgcagttaaacaggtgaatgcagtacatagaactgtgcaagacatgaaagtggaaataaaatcaatgaagaaaaaacaaactaaggagattctggagatggaaaacctagggaagaaaagaggaaaatcagatgctagaccaacagaatacaggagatggaaaagacaatctcaggcccagaagatccaatggaaggaattgatatatcagttaaagactatgctaaagtttaaaaaaaaatcctggaacaaaacacccagcaaatctgggatacttagtaaagacctaacctaagaataatagaattagaaggaggtgaaa

SEQ ID NO: 3101 - DNA, 1400 bp, mus musculus
cctttttaggtcttggatggctttattcaattccatcccctgtttggttgtgttttcctgcaattctttaagggatttttgtgcttcctctttaaggtcttctacctgtttagcagtgttctcctgtatttctttaagtgagttattaacatccttcttgatgtcatctaccatcatcatgagatatgcttttaactcagggactatcttttcaggtgtgttggggtggcccaggactgggtggggtgggaatgctgcattctgatgatggtgagtgtcttgttttctgttagtaagattcttacgtttgcattgcaccatctggtaatctctggagttagttgttgtagttgtctctgtttagagcttgatcctcaggtgattatgttagcctctatcagcagatctgggagactagatctctcctgagtttcattgttcagagtactcccagcaggcaagctctcctcttgcagggaagatacccagatatctagtgttcgaacctgcctcctggcagatgttgtgatccactcacagagatcttaagatcccgtggagtgtcctgtgggtactttgcatgtgtttgctccagactccatgcccaaggtaccccagtgctggcatgaccagagagacttgtacccctgatcaggccgggttttctgcttccctaattaatgcagtctcaggtcctctgtaattggattggagcagcagctgtgttccactcaccagtggtcttaagatcctggatagggtcctagaggtagctcccgggtttctgtagactccgtgctcaagcaacccaggtgctgctagggacgggaagggacttgtgcccctgatcaggccgggttttctgcttatctccatcaggcaatttttttttccgtattttcctcaattccaattccaatgctatcccaaaagtcccccataccctcccccccaccactcccctacccacccattcccactttttggccctggcattcccctgtactggggcatataaactttgcctgtctaatgggcctctctttctagtgatggcttactaggctatcttttgatacatatgcatctagagtcaagagctccgggatactggttagttcaaaatgttgttgcacctacagggttacagatctctttagctccttggttactttctctatctcctctattaggggccctgtgatccatccaatagctgactgtgagcatccacttatgggttggctaggctccggcctagtctcacaagagacagatatatcagcgtcctttggtgtcatcatttggaggctaattatgagatggatccctggatatggcagtttctagatggtccatgcttttgtctcagctccaaactttttctctgtaactccaat

SEQ ID NO: 3102 - DNA, 1000 bp, mus musculus
actagcagaggctattagacatgatagagtccctgaagatgaatcaacatatggaaacacaaaaaaatgatgctacaaaccagcacatcagccttggcatatctacctctacgagtactgtgttcatttttctggtttgttctcacaaaagtgattatttcagtcaccataaacaagtacttcttaatgaggtacagtctccattcccagacatgcctttagaccattttatctagaggtaaattatattatatgagttaggttaatcaacttctggcctctgaaatgttgaaaaatttcacaacattcttacatatcattctgcagcagccagtttacaacctttgtggttagaccaataaaccactttcttcatgatggtgatagattgctcacagatattagaagtcacttatcatgcagacagtatattatcagtggggcttttctaccagcaaagttaatgtcatgatctttgtaagactcttattaatttagttgcttttaaatacaaatctgttattagcatatgttttttctgcatatttgagatactttacctgtatttttgtattatatgtaactactatcccagtacctggcagacatttcaattgttctcagaagctcttaggagacaagggtcttgagtttaaagactaaataaggtcattgctggaggtggcttctctatcactggctctcacaatatgtataacaactatatgtatagtacccacatggtcattcttgaacatgcctacctatttatcaatgaatattcttcttagccactctcatttaccactgaactggttgatgctcctgcatcattggaaggttttatatccccttaccacatgagcattatactgtgggtgtatactaactacctatagcaccacaagtcttggtatcacactattgtcaatcaaaatgtactaaagtgatttgtagatgaacttccttgtcagggtgtggtagtagaggtcttttcaat

SEQ ID NO: 3103 - DNA, 1200 bp, mus musculus
ttattgattaggagtggcagaagagcagtagtataatagggggaacagtggaaaagaaaacttaattaacaggataaaataattgagtgtaaatattttttctctgacaaatcatgctttattaatattaatattaataaccactgagccatttttacatgccatacatcaatgggatctgctcacatgaaaatttgggataaaagcttctactttcctttcatcattttactcatgacccatgacagcagcctagcaccttcatgtttatcatcccattagtcaagaaaacagatattaggttatttttgatattttacagtcaagttttgggaactgttaactagaatttctggaaagaaggtatataggtagggactgattgactgaacagaatttcagtgatgttgaccatttgaaatgttgcaggtttagagactaactaccttatttcatgctaatgttagcaccaacaccactgggccattctttgctaacctgggtgacagatgaacactttgtgacaaatatacttttaacaaacttttaacatttattaacttatcaggcacatagtgtccaacaatgaaaacataagaatgcaatcaggtaaattttattttcattttttgttatgtatatgctatacatacatgttccactgtctgtctatttctgtctttctgtctttctctctgtatctccatctctatctctcctccccgacccatatgcaagagttggacatggggactctttttttaatcactctccaactcaaattttcagagtcctttgctgagtacagagctcactgcttgacttgccagagtgcctcatggattttttttatctttgcctcccttaatgatgtgatttataaatatatcccatcacttttagcttttggttaggtgctggagctatgaatgcaggtcctcactcttgaatagtctctctaacacattcacagataacaattttttcccagaagaattccccaaatgtggtttggatttattatgactaaattagtgcagtcatgtatcttccaactttaactcaataatatgtgtcctgaaacttaggtattaaaagttatacttactaatatgttacaaaatatgttatggagcatatagttgtgtggatttgtacaatgctccattacataagcttaggtatcaatcattcaattat

SEQ ID NO: 3104 - DNA, 1000 bp, mus musculus
atatattatatcttaaaacagctgtctctacataattctttaaagggaaaattgttattaaaatttgctaattccaaggtcacattgttcaatgaataaatatcgaaaacgtaacgtggaagggttaaatatatacacttacaaatatattgcccgagcttttgtccccaccggcaagaacacactcaggacaaccagaatcttctgtggcaaagcttttattgcttacttatcagatgggaagaccccgaaccgggaaaatggcgctgcttatatagcccgcagcgtgacgtttcagcacttgatgtggcatgacagctcctgatttattgctcacccatcaccccattactacgccgcgagatgggcagtgatgaggcatgagttgactcttgcacttgcgcataaggcttatttactagttaggcacagtggaagccagcgccatcttataatggagattgctcacggcacacacgcgattgctcgcagcacggttctccacacaaatacacacaaacataaacaaatataaagcatacaataaaggcttgtgctttaaagaatttaaaatttgattagtttctgaaatctaaacagttaacatgaatgatataagagagttatgtgattgaataattttattgtatatgtctggatgctacaagaattttgagaaggaatcattaagaaaaactgccataggcattaaaggttctgctatgttttatatgtggtatttcttaaaacctagcatttcatataacagtattacgaaactgagttttgtgtatgtggttatgtcatgaagcctctacccttataaaatgctatttaaatcaatttaagatctcaacaaacactaaatctgcttttgccttatcatgaaatttgaattcccattctctaaaatgaagagaatgtagtcatcatcctggaaacataaagtttgaagcatttacttgtgccacctaaatgaactaatataggtattaagttg

SEQ ID NO: 3105 - DNA, 1600 bp, mus musculus
tctgtgcttcctgatttctttcctagggtgtctatctccagagttgtctccctttaggttttctttattgtttatatctttttagatcctgcattgttttgttcacttccatctcctgtttggtaatgtttttctgtaactctctatggcatttttgtgtttcctcttaaatgattcaagctctttaactgtgttttcctgtatttccttcttaaagtccttcatgatcatcattagaagtgactttagatccatgtcttgtttttctggtgtgatgatatatccattgtttgttatggtgtgagagtttggttctgatgatgccaagtaaccttggtttctgttgcttctgttcttatgcttgccttctgccatcttattatctcaagtatttgctgacttcaatatatctgattggagcctgtccttcctatgatcccagatggtttagggctcctcagaatccagctttctctgtgatcctttgcttgcgggctcctgtgtacctgtgattctgggtgtgtcagagttcttagcagtaaagttcctctgagaccctgaaatactggggtgaccaagctctttttatcctgggatcctgttgtcaaagatcctggatgtgttacagtgcttggaagtggtgtgtcctttgaggagtatggagctggctggtcagtagtcctaagatcatatggagagtcctctagggaccttgggggtatcagctgactcagagcccaaggtgatccgatgctggagccgaccctggttggaaaggacttgtgaccctggttaggcaggattttctgcttccttaatgctgtctcaggtcctgaaggattggattggaacagaagttgagttccactcatcagatgtcctaagatcgggtggagagtcctctagggaccttgggggtgttagctgactccgtgcccaaggtgacctggtactggcaccaactcaaagggacttatgatcctggtcaggctggcttttctgcttccctaatgctgtctcatttcctgcgctattggaatggaacagaagttgtgttccactcacaggtggtcctaagatcgggtggagagtcctctagggtacttgggggtttccacagagtctgcgcccaagatgacccggtgctggcactgactggaagggaccagaaaaatctactcttaagacaaatatatgtatatatatatatatatatatatatatatatatatatatatatacatatatatatatatgtatatatatatgtatatatatataatcaaaatggtgaattaatagggataattagaattatctgcatattatatttctaacagtagtattcaatattgttacttggtttgtgatgactctactagggaaaaaataatcttgtgtattccattctacttaataccttaacatgatacataaacctacaacagatacctccctggagactgaggtatcagcacacatataattccaaatatttgattcatttacagaagacctaacttaaaacttgaagaaaaaaatgtatttctttcacttttcttattcttgcttctaaacttctcataaattctagcacatg

SEQ ID NO: 3106 - DNA, 1000 bp, mus musculus
ccaattctttcccacttgccctccaatctagatccaccatttttctgtctctgcttagaaaacaaacaggcttctaagggataataataaaagtaaaacaaagcaaaacaaaacaaaacaaaacaaaaactcacatgtcagagttggacaagagaatgtaaagaggtcaagaaaaggcaaacaaatcatagacccacaagttcacacactcatgaatctcataaaaactctaaaatatgtatactcggcacatgaagccgacttagaccaggccatgttcatgctgtttctgtccactgaagttcatatgagctataatcatgtttatttacaggaccgtgttttcttgctatcctccatcctctgtggctctctcttccactctttgtgccttctcttccttttaaaaaaattatttaatttttaattttttattagatattttcttcatttacatttcaaatgttatcccaaaattcccctataccctcccccctgccctgctcccctacccactcactcccacttcttggccctggctttcccctgtactggagcatataaagtttgcaagaccaaggggcctctctttccactgatggccgactaggtcatcttctgatacatatgcagctagagacacgagctccggggtactggttagttcatattgttgttccacctatagggttgcagaccctttcagctccttgggtactttctctagcttctccattgggggccctgtgtttcatcctatagatgactgtgagcatccacttttgtgttttccagacactggcacggcctcacaagagatagcaatatcagggtcctttcagcaaaatcttgctggcatatgcaacagtgtctggttttggtggttgtacatgggatagggtagggcagtctgtagaaagtccatcctatggtcttagctccaaattttgtctccgtaactccttccatgggtattttgctccctattctagggatgaat

SEQ ID NO: 3107 - DNA, 1000 bp, mus musculus
aggggcgaatatggcccatctgtaactattcttgaactaattctttagcagcctgtaatttctctgagggcaaaggccactgaggaacccatactggaccctcagtcttccaagtaatggggatggcctcctcagtggcccctaggaaaaacccagtccagcacgacctttcttcgaactcacaggaataggggatttcctgccctgcaagagaggccttaatccttttccaggttgatatccataattctgcaactcaaccccacacttgcacttctccctgtccttaatacagttacgtactaacttccatactggaagcacccccttgaggaggacccttgctcctcggcaaacttcagatccttccctaatttctcccaactaggccctgtaagatgccctgacacagggaaccatggagccacctgatcaacggcctttagaaagttttctaacgtctcctttttcaacccgattccttttactttcaacaaatcctttaatgcctggcgaacggactgccctgatgttttatcttaatcgtccctaaccgggaaccttatttgtctctaaccgagaacttgaatcatcccacttacctgggagctttccagctggctaccctgacctcttgaagttctggacctcttgcgcgcgcacgctcgactggccaggaagaacgacgctgcaacaggatccttcttcacacgtttattgggagagcttgattgtagaggcgaaaagacctcgagcccagaactggtgctgtttttataggcctaggaggggcgtgtctcacacccggattggttatgcactaagccttatttgcatgttcctcatctgattggctactctctctcagtaccttacagaacctcattatcatacctcatttgcatgtctcacatctgattggttatactctcagtaccttacagaacctcattatcatacctcatttgcatgtctcacatctgattggttatactctcag

SEQ ID NO: 3108 - DNA, 1600 bp, mus musculus
tctgttttgcgggaacctttattaactgctccttccccgtgatgcagttctgaatcctccctgtagcagggggtcttcactcatgcctgaagatgtttcttgtcccgggttttggcaccacttcttgcgcgcgctcgactgaccaggaagaacgacgctgcaacagtatccttctgcacacgtttattgggagagcttgattgtagaggcgaaaagacttcaagcccagaactgatgctgcttttataggcctaggaggggcgtgtctcacacccggattggttatgcactaagccttatttgcatgtccctcatctgattggctactctctctcagtaccttacagaacctcattatcatacctcatttgcatgtctcacatctgattggttatactctcagtaccttacagaacctgattatcatgcctgggccaggcagtgtctttgcaaaaaactttactgcatatgtacacattggttgtttgtccaatcttatgcgtggtggccagcagtagtcagtgccactcagcaacggcacatgtggcttcccacatggacccactgcgctcttgtgaagtagaagtccctgtacgggccaccacttgtcgcatccacgcagaccagcaagaaagactcgacaccacgttgtccttcttcaagcaggtttattcaggtactcttcacattgcaatgcaggaatgggaatcccccaaacaaccctgaggaacaccttgaatacccttctgactcctcccaatcaccccagtcacgtaacggcagtccattctttcacaacaagtgaggacccctcaggcgagctggcaaggcatggcgtctgtgcagtgcaggtggctgggatgtggctaagtctgaggtaataaggaagtcaggtgcaggtcataagacctggcaagccctcctgggcgccatcttgtggcggcggccgtacccgctcctcacatctctgtttgtctctgtctttgtctgtctgtctctctttctctctctctctctgcttgcttcttttgtattggatgtaagctcccatttactgctgcaacattaagcctgaatgcttgctgccttgcttctcatcattatcatcatggactctaaccctctgaaaatgtaagcaagtgccacaatgaaattcttccttctataatttgatttggtcatactttctctttacaggagcaatagaacagtaactaacacaatatacatcaaaaaagaaataaagcatcatatatgcacatagtagaattttatgcagctgtaataaaaatgagatcatggaatttgaaaaaaaaacgaatgcaatgaaaatcattatgctaagttgtataatacagtctcagaataataaaaccatgtcttctcttatatggaacgtgtatgtgtgtttatgtgtgtgtttctacatatgtatatttgcagatcacaaaactaaaaggcggtcatgagaggataggaacagatattaaaggatgtaggaaaaattagtgtattaaaatgcatgtaaaaggaaagtagaatgtgtgattaactgtgagggtagagattcaactagagccaaagagctacctgacatggt

SEQ ID NO: 3109 - DNA, 1000 bp, mus musculus
atgcagcctaagttgctagaggctgaagctggggttccctgactcctgggaatctagtcagtactgaaaaactgcagaggactcaggaacagaggattgggggtctctggtcctaggatgaggatcctgggtacaggggctccaaaactcctggacatccagacactgctaaatcgtttgaaattgggactggagttcaggcctgtgggctgaggatgagcctggggactgtgggatggagaactctggcttagttcattaatggttgtcatactgttatttatctatctatctaccaaccatttatttatctatcactctgaccatatggaatttattgaaggaaaaactaatattaaaggaaccaaacaatacaattcttcttactagaactacaaagaaagaataaatggtatttattgctgcaaaattcaattgatacaaattcttccatcattcataatttttaaaactttacaaaggctaaatataagtttcttcaatcatagagaagctatgcacaaaaagttggatgatgactttgtatttactaataaatgattcagtgcttactccttcataagagaaacaacaaaagcatgtctgacctttacagagatgtttattataatgtctaatgaagcaagataagaattttctaaatgtcgatagaagaaaattaataaaatatttatttacactttattatctacaaaaatttccaactatttcatgtgcacaaaacaaaattgttctaaatacctagaaaagtttttttaaattttttcagaagaaattattgtataaagatcatttttgccaggcagtggtggtacatgcctttaatcccggtacttggaaggcagaggcaggtggatttctgggttctagtccagcctggtctctagtacagtgtgagttccaggacatccggggctacacagagaaaccctatctccaaaaaaaaaaaaaaaaaaaaaaaaaaatgtactatatataa

SEQ ID NO: 3110 - DNA, 1200 bp, mus musculus
ctgagtgtgtgtgtgtgtgtgtgtgtgtgtgactatatacatattaatctgcacatacacatacatgtatatatgtgtcttatatagagattcttttttggatattttctttatttacattaccaatgttatttttttatttttattagatatttcctttatttacaatttaaatgttatccccttttttagtttcccctctgaaaatcccctatcctctcccccttccccctgctccaccacccaccgactcccattcctggccctggcattcccctatactgaggcatagaaccttcacaggacctagggcctctcctcccattgatgaatgactaggccatcttctgctacatatgcagctagagtcacaagtaccaccatgtgttttctttgattggtggtttagtctcaaagatctctgggggtactggttagttcatattgatgttcctcctatggaactgcaaacaccttcagctccttgggtactttctctagttccttcactggggactctatgctccatccaatggatgactgtgagcatccacttctttattaatcaggcactggcagagcccctcaggagacagctatatcaggcttctgtcagcaagctcttgatggcatctgccatagtgtctgggtttagtggtggtttatgggatgcatccccaagtggggcagtctctggatggtcactcctttagtctctgctctgaactttatctcctttcctttcccccagcagaaacctcctatctcatccaccttccccctgcttctaagagggtgttcccacccacccacccacccacaccggcctgcttgcccttgcattcccctacactgggacattgagccttcacaggtccaagggcatcttcttccattgatgcctgacaaggccatcctttgctacatatgctgctggagccatggctccctccatctgtactccttggttggtcttttagtacctggtggctcttagggtatctggttggttaatatttttgttcttcttatggggttgcaatccccttcagctccttcagtcctttctctaactcctctattggggaccccatgctcagtccaaaggtttgttgtaagcatctgaagaggtataataagaaatgtatgtatggaaatgggaagtcatccatcctatggttcatgggaacttatgtgact

SEQ ID NO: 3111 - DNA, 1000 bp, mus musculus
tgtaagacagggatgaaagaacagagaaaattgtatgtataaggctatgtaaaagaaataattttgaggcagtgaactgtgcacagacagcctggtatccagtcaaacacaagcctggaacccccagagacctggtgggccatgacttctgccttcatgggatggtaggggtttgtccatgcctcctaggcccctggctcctgttgcagttacagcctcccacagccccatgcagagaattgtgtggccatcagtcacttaggcaatgccccaagcttctggtattctgtctggactccacctcaatagttacctgtcaacagccaggtatgctcctctccacagatacctggcaacagccaggatggttcagcccactataaatggagctgcttgccctctccttgccctcttgctcccttacctcttattcccttgctcccttgctctccttcactccaccttcccttcctccctctttccatgttgccatggctgccttctacttctgtacacttctccgtctctctgctttctacaattaacaccttaaaaccatgaaccatatcttctcttcagatccactaacaagctgccttgtgtctagcatcctgccaggagacttccctgcactccaatcatggccactagccaaaccaagccacacaccaagcaaacagcctgtgctagccaattgctctcttccctgtggtaacctgttagatttctccttcctgccctttttccttcggccccaggccagagtcctcccaagagttcccactttgttctcagctcttctgctacatacagctgcatctgtgagttcagagcaagaacctgttttaactggcccctgtgtggcccagagaccccagaaaaagctcttccacagtacccagcagcatcagttgtgcccaggagactcccaactccaacagttcaacggagccccagcctgtgtgttttcccacccccagagcaggatcccaaggcttcc

SEQ ID NO: 3112 - DNA, 1000 bp, mus musculus
cttttggagatagaggcttgctggaggtgttgtgacccactgagtgagaactgccaatttatgtgctctcaatggttatattttctggaaaaacttaagtttgtaaaatttatcaattgaggatgaaaagctctgttttaataattgtagtggatatagtactttacagtttataatcaaagagctgttataagaagggatgatttaggtcccttccggttggcaccagcactgggtcaccttgtccacagagtcggtggacacccccaaggtcccaagaggatgacctgtgaatggaacacaccttctgttctattccaatcatgcgggacctgagacagcattagggaagaagaaaacctgccctaaacatggtcaaaattcccttctggtcagtcccagcacctggtcacctgggcaaggagtcacaggacacccccaaggtgcctagaggacagcttctgaggcagaccacatttcaggctccagacatccggacaccttcactgccagaggacatgtgtcttccccacccaggagggctttgccagagcatctgggaaagccatcttggttcccagatccctctgagcctagtctgtgcaggtgagagtgtgaactacagaagctaacagcttctgggacatgccctgtttcaggccttcaacttctgccaggaggcaggtctggaagccagatatctgtgcaccttccctgcaagaggagagcttgcctgcagagagtgctcagaccactgaaacttaggagagatctagtttccaaggtctgctgatagaggctaacagaatcacagaaggaacaagctctatccagagacagctataacaactaactccagagattaccagatggcgaaggcaaacataagaatcttactaacagaaaccaagaccactcaccatcatcaaaacgcagcactcccaactcacccagtcctgggcaccccaacacacctgaaaatctagacccggttttaaaa

SEQ ID NO: 3113 - DNA, 1400 bp, mus musculus
aaatggtcgctatccaattccacccaaattccttgtctaggcacaattctgtcttctcaaattttattgaagcaatatagaaaatcactcttgttttcctaggacagtaaatcagctgtttctaagtcaaccaatctggcatagtaagaaataaaatccaggagctacagtcagacataaaagaacttcaaggaacttgagacgtccagttctgggattctcaaaaatcttgtatggaagtggatactcgctttcataccagctttcctagtcatcttcctggcattattatttgttccttgcttcattaatcttgttactatattccttcaatgacaatacataaaatttctaaccaaaatattaatcagctcctgttataggattatcagccactgctcacagaagagacactgtccacagtggaacctggatcctgatggtgaaagtcagctacaccccaaaattaacgatgcccctagacagctggaagcagcttatgagacatggctccctcattcccttttcaccattggcttccccctcttctttttctcttctctttataataacaagaggggacatatgttggtatcagaacctctgaaacttgtgacatcacatcagctacagcaagacctatatacctgttgccaagacaatggccaccttattcgcagaatccattgggctcaccttccaactttacctatgaccatgttaccatccataatatataagaggaatggccccctcttcctctcccccccttctctttctactgccaccttccttgcctctctttctcccaataaacctcttacacgtggaactgttttggcctagtatgctgtgttcagatgtgagttgctattctaacacatcaactgtcacatgtgagataagttcttctcgcttggctgcattgtgtagcctcagcgaaagataatatgcctagcctcacagaagtttgatgtgccagggttgggggataaccaggggtttccatcctctcagaggagaaggggagagggaatgagggaaaatgttgaggggggggagtaaatggaacagagccagtaagagggatgtaaagtgaataaattaagaaagaaaattaaaatcttaaaaatgaaatgttcttgtattagtatgttagtttttaaaagtataaaaatcgagggaattagtctgaacaggtgagagggtgcgccagagaacctgacagcttctggaacaggcggaagcacagaggcgctgaggcagcaccctttgtgggccggggacagccagccaccgtccggaccggaggacaggtgcccgtccggctggggaggcggcctaagccacagcagcagcggtcgccatcttggtccgggacccgccgaacttaggaaatt

SEQ ID NO: 3114 - DNA, 1000 bp, mus musculus
tactggattgtaaagtaaacacaccagcaagactttattcatgactcaaaacataggaataatattctttcaccacattctttaaattcacttaaatttattgcagaggtgtctgatagtttccaaaagagactgcattaaagctagagttcagagcatattttcattacaattttcatcaactaaaaccacaaagctattaagtgttttattttatttttttgaagaaagtataatttatttattgttcacttctaaaattaatggtgttacttgtgtgtaataatgggtttgtcatgactttttttttcctttttgaattaggtattttcttcatttacatttcaaatgctattccaaaaatcccccatacccccccccactcccctacccacccactcccacttcttggacctggtattcccctttactgaggcatgtaaagtttataaggccaaggggcctctcttcccaatgatggccgactaggccatcttctgctacatatgcagctagagacatgagctcttggggtactggttagttcatattgttgttccacctatagtgttgcagacccctttagctccttgggtactttctctagctcctccattggaagccctgtgatccatccaatagctgactgtgagcgtccacttctgtgtttgctaggccccggcatagtctcacaagagacagctacatctgggtcctttcaataaaatcttgctagtgtatgcaatggtgtcagcgtttggaggctgattatgggatggatcccgggtgtggcggtctctagatggtcaatcctttcatctcttgtctctgtaactccttccatgggtgttttattcccaattctaagaaggggcactttaaacaagaaaatagaaacaaaaggaagtcactatatatggcagataaataagacaaatacacatgcactttataaaatgaaattaaaaattaagaatacctcaatgcacttaaagtactt

SEQ ID NO: 3115 - DNA, 1200 bp, mus musculus
tgtttccatttccttcttcaattaacatgaccacaaattacattctttatcacaactgataaacaccaaataaaattcaccataatttggaaaattattaccagtccataatgatagtcattgaatatatccagtaaattacaatgctgttttctaaaaatttttaatataatctgttttcaatggtctggaaacatttttattaaaatgtaaaatatttctgtttgaaaaatctcatctctggaagcaaggccatctttgggacactaaaataatcttgaactaagaacaatttggggaccttgaggtagcttggttagccccggggtcaaagggaggaaaggacaggggggagaggggatgctgagtggttcataggctggtgagagtccttggtccagtcagtggctagagctcaggaaggactccaagtgggaggttagatgcggctccttaggggaaaagcctatatagcattcttcaagcacagttggccttgatgatcggagagtctatggtttttagagctttattgtagaaatacagagagaaagagagtaggtagaaagagggagagaggctggccatggccatgtggagagagaggggaaggaagagagaggaggagggttagagaagagagtaagaaagataagagattaaagagagtgaggaaggaccaagcagccgctttttatagagggttggactatcttgctgttgccaagtaactataggaaggaacatacctggttatagttagataactgtatgggtggagtttagccataataccaggcaggagcttgggacattgtcttcatgactgatagtcacatacctctcctgcagggtctttgggggctgtaactttgacaggatccaggggtccaggagacatgagcaaacacccaaatcccatgtaggtagaaatcactatccatcgggtcccttgggttccagacctttgttcaactggagaccaggctgtctgtgtgcagcctactgccccacaagaaatacttcttaactaattctgtaaagccacaattactctgataccttaaccatacaaggacccaactaaaaatgagaacttcagaccaatttcgcttatgaataccagtggaaaaataataaaatttctgcaatccgaatccaagaacacattaaaaccatcattcaccacgatcaagtagg

SEQ ID NO: 3116 - DNA, 1400 bp, mus musculus
taaaacgagtcttaaaatcaaatcatctgatgtaacaaagaatattgacaagtggcttctaataattgaaatgtttaggacttcataatttagcaactccaaaagaagtaataaactcctggcactgggattcatatttgttaggctatgctgtctagtagaagcattattaccatattacagagtaaccacattttaagtcttatgtatatatgcatatatattttaaaatgtttctaaagtagaaggtttccatataacctcactatgtctgttggatatgactttataaggggaaaagagaattactctggatacagactatatgacatcttctggtgagtcaaatgtgggggtcacaaggcttatgtaatgagacatgaaggtctaatgcaagagaggagttgctctgttcctgccaatctcaggaaaatatttcacagggttggacacacaacaacccactatttctctaggactggttccatatttcttggccctacaccagacattcttttttcattgaccaatcaacagacccaaaggtagatcctgtctcttggaccctgcaagtagggttgtagtagacatgaaaattgagaaatatctttatacgataagatggaccatccagagactgccccacccaggggtccatcgcatactcagcctggcaaatacagaagtggacgctcacagtcgtctgtaagatgcaacacagggcccccaatggaggagctagagaaattatccaaggagctaaagaggtctgcaaccctataggtggaacaacagtatgaactaatcagtacccccagagctcgtgtctctagctgcatatgaagcagaagatagactattcagccattattgggaagagaggccacttggtctagcaaactttatatgccctagtacagttgaacgccagggccaagaagtgggagtgagtgggtggggcaacagggtgggaggagggtacaggggacttttgggatagcatttgaaatgtaaatgaagaaagtatctaataaaacgtttttaaaaataagaaatattaaaaatatctttcatatattgagtgtgtgtctgcttaagagttttaattgaatacattcaagttgttctcaggatatttttattaaaagcagagttttaaaaatcatgcaaatatgtatacaaatataattatgaatgtaggtgttttgtgaaggagattactagaaggaaatgctggatcaaaatgtagactttttttttaaagaatttcattgaacttcaaatgatttctaaatatattcagagaaatatttatcctgtgatgacaaatccataagaatcattattaccttgttttcctaagatctaaaaccttgtctgtaatattcagagaggtcaac

SEQ ID NO: 3117 - DNA, 1000 bp, mus musculus
tttgttttgtttttgttgttttttttttgttttttgttttttgggttttttttggggggaggggttcgagacatggtttctctgtatatccctggctgtcccctggaactcactttgtagaccaggctggcctcaaactctgaaatctgcctgcttctgcttcccaaatgctgggatgaacggcgtgcaccaccatgctcagctcatgtgtaaatgtgttttgtttttttcttgttacacagctcttaaaagcaatgagtttacgaaattcttaggcaaatggatggatctggaggatatcattctaagtgaggtaacacaattacaaaagaacttacacatgatatacactcactgttaagtgcatattagaccagaagctcagaatacccaagatacaattaataaaccacatgaaactcaagaagaagaaagaccaaagtgtggatacgttgatcattcttagaagtggtgataaagtacccatggaagaagttacagagacaaagtgtagagcagagactgaaggaatcaccatccagagattgcccgacctggggatccatcccataaacaatcaccaaacccggacactattgtggatgccaataagatcttgctgacaggtgcctgatatagctgtctcctgagacgcttttccaatacctgacaaatacataagtggatgctcacagccatccattggactgagcacaaggtccccagtgaaggagctagagaaaggacccaaggagatgaaggggtttgcagccacataggaaaaacaacaatatgaattgaacagtacacccatagctcccagggactaaaccaccatccaaagagtagacatggtgggacttgtggctccatctgcatatatagaagaggatggcctagtcagtcatcaatgggaggagaggcccttggtcctgtgaaggctctttttccccagtgtagggtaataccagggctaggagccacgagtgagtgggttgat

SEQ ID NO: 3118 - DNA, 1000 bp, mus musculus
tggcctccaacaacgcaggtggcagttattattattgttcatcaagaagaattctaaatacatattgtggctttggtctgctttgggaatatggtgtgcgatgaggccctgacagtcagttgaagggcaaccagatcacgtaatcataccaatctaatacaggggtacatgccaaaaggtcgtggttgttgataagacaccacagtgccatgtttgtgtaaattattacacatacaactgcatgtagccccctatgatggaattggatggttcgggaggatctgagatcccaagacaggcagagctgccagccaccataattccaaggcatgacttcagagcataaataaattttatgcctcattccagttttatttaatattatttaaagggggggaaatattacctccttccggcctagcaagactggctgagaccaactgcccctgaggcaattccacctgctgtgttgcttctcatccctctcttttgatatgccactacctgccacctgcctgaggctgaatcacttctccaagatcttccagagttaacaaggaactgtgattttcctgggttcttaataaaaggctgatctgacaacttcgaaggaaccttttgtggctgggaatgggcctcccctcttctttataaagcgtgtttgcctacattaaagttgagtcttgatcagaattcagtcttgactccatttcattctttacccgcctagattccctcttttctttcagtttcaaaatgcatcccaggctagaacccagacatgagagccgcaagccggccccaacagtgggagacttcaacaccccactgtcactaatggacaggtcattgaaccagaatctaaacaatagacacagtgaaactaaaagaggttatgaaacaaatggatttaacagatgcccactgaacatttcaccatccatttgcctaagaatttcactaattcattgtttttaatagctgagtagtactccattgt

SEQ ID NO: 3119 - DNA, 1200 bp, mus musculus
ctttcagactttcatctgtcaagctgactccactggagtcccgtggcagtatatgttggagtatacttggttttgttgatttctgtactgtactgtccttggcaataaacggccatctagtagtatcatttctacccctgagaatagaactaccaaccactatgtcttccatagtccacatttaaattttctacaaagtttgtgacatgttcactcttctaagttatagattattttactcaaactttatgcataagattacttctcctggtttgatcctgcactcaccacttctggtgagtgcaggatcaaaccaggagaaatagggttaacacagacagcactagaacaaaaggctttcagtgctgccttccagttaaggggagggattaagaaggatcaaagttactcacagtatcctctctgagttgaatccaccatggttctgaacctgctctggttggtcggaggttctcctctctggtgctgtgccttgttaaggcgtttttccccagggtttcgagcaccaagtatcctgagcttatccctgtcccacaggaaataaacacaggacacgccagattcttccgtggttaactttacttcataaaatattgaggtagacaaagaaggctcagaaagtgtgtggcttaaatactttttggtgacatgtctaaactaggattggtagctacacccacgaatctcatgcaccctagggataggcacacctagaagctcattcattgggggcccttgttccatccaatagatgactgtcagcatccacttctgtatttgccaggcactggcagagcctcacaagagatagctatatcagggtcctgtcagaaaaatctttctggcttatgcaatagtgtttgaatttgttggttgattatgggatggatccctgggtggaacagtctctgaatgatccttacttctgtctcagctctgaacttcgtctctgtaacttcttccatgggtgttttgttccccattctaaggagcaaaatatccacactttgttcttccttattcttgagtttcatgtttattgcaaagtgtatcttgtgtattctaggttcctgggcaaatatccacttatcagtgaatatatatcaagtgacttcttttgtgattgggttacctcactcaggatgataccctccagatacatccacttgcctgagaatt

SEQ ID NO: 3120 - DNA, 1200 bp, mus musculus
actgaatggagtacctggacttcttcaaagaagttttatacttttgtctttcacagtcacacctttgtttttcaagcaggtcagttaatgcagttaagcctgtctgcaacagatgtaaaacctggcctccaacaacgcaggtggcagttattattattgttcatcaagaagaattctaaatacatattgtggctttggtctgctttgggaatatggtgtgcgatgaggccctgacagtcagttgaagggcaaccagatcacgtaatcataccaatctaatacaggggtacatgccaaaaggccgtggttgttgataagacaccacagtgccatgtttgtgtaaattattacacatacaactgcatgtagccccctatgatggaattggatggttcgggaggatctgagatcccaagacaggcagagctgccagccaccataattccaaggcatgacttcagagcataaataaattttatgcctcattccagttttatttaatattatttaaagggggggaaatattacctccttccggcctagcaagactggctgagaccaactgcccctgaggcaattccacctgctgtgttgcttctcatccctctcttttgatatgccactacctgccacctgcctgaggctgaatcacttctccaagatcttccagagttaacaaggatctgtgattttcctgggttcttaataaaaggctgatctgacaacttcgaaggaaccttttgtggctgggaatgggcctcccctcttctttataaagcgtgtttgcctacattaaagttgagtcttgatcagaattcagtcttgactccatttcattctttacccgcctagattccctcttttctttcagtttcaaaatgcatcccaggctagaacccagacatgagagccgcaagccggccccaacagtgggagacttcaacaccccactgtcactaatggacaggtcattgaaccagaatctaaacaatagacacagtgaaactaaaagaggttatgaaacaaatggatttaacagatgcccactgaacatttcaccatccatttgcctaagaatttcactaattcattgtttttaatagctgagtagtactccattgtgtaaatgcaccacattttctgtgtccattcctctgttgagggacatcggggttctttccagcttctagctattataaa

SEQ ID NO: 3121 - DNA, 1800 bp, mus musculus
ttgtaatcagttcattattatttatacatataaaacatgtataagacatatttgtgacatataactttaaaaaaaaggtaatacaaattttacaaatattacagaactctgcctatttattctggatgctcttaaatgcatattaataaaaaaccagccaagaatccctaccattgaaaaattaataaagttgtagtacaatttaccctattgatccatgaaactcattgtactacagaagacatatttcataaagtacaaaataggtgaattacagtattttaattacttttctgttgtaataataagacactgtggcaaataaaacttacaaataaagagtttattaggggtttattcttggtttcagtggcttggactccgtggtcatcataattgaaagcttagcagcaagtagacccacatggtattgggataacaatttgaaggcagacagattaatctaaccaggaatgatagaagcttttacatctcaaatcccacccccagtgacacaacttcttcaacaaggtcatatcaactaattattcctaaaaatttacactaacataggatcaagtactcaaatatttgagccaaatgagatcattcccatccaaagaagcccccaaagcatacttattttgtttttcagatcatctgttaatgtgtttctgaaattatagtctgttgtggtgtttccttttaattgtcatcttgacacaaactagaatcacttgataaagcaattaaaattgtgtggatgagactgacatatgggctaggcatggtgatgcacacatttaatcccatcacttggaaggcagaggcaggcagatttctgagttcgaggccagcccagtctaaaaaggaggtccaggacagccagggctatacagagaaaccctgtctcgaaaaaacaaaaaaacaaaacaaacaaacaaaaaagactgacatatgtttgtgaggaactgtcttgattattagttgatgcaggaacacccaccctgaatatagttgacacaattatttatttgggctgtggaatcttctgtgaatgtaaaaaatagctaagtcgcaagaacatacaaggatatactcatttcaaaatctttctgaatgcagacatgtgaccatctgcctaggcaagtttcatttgatgaaaactgacaaattgtaacttctaattataagccaaactaagcctttctccctaatttggtttatttacagcattttattgtagtaatagaaataagactggaagactcataaagtaacaagacaaagttataagttctcatcatgtatttttcaagttctgtggcattttttacacaaaataatttctacacaccctttgattaacatggatgcttgctgaaattataaacaaaaagtctagaccaacttcaggcaccccaggtaacattccactctaggctctaggctcaccaattccccttcaagtattttgaacaacaataaagtgcaacccatgacctgactcaatattccttctcacaacttgagctgaagatctctgctttttttttttttttttttggagtctctatctagggaacccagaggtaatgttgacacccaaaacctcagaagacagaggagtcacaaaactctcagcaaagacaccctcctggacctgaagacttcctggtcactagaaccccaaggcattaagaccagaaaacctggaggaaacaagagaccaagggaataaaaacatcaacaaaacaaatcaaaaaaccatgcatctgacaattacatatgtagaaatca

SEQ ID NO: 3122 - DNA, 1400 bp, mus musculus
aaaacatcatccacagcacacaactaaattatctgtgctgaagcagggggatgttgaaaagaatacgcacgtgatctaattcacatgtactgtttcccatagagaggttgtttttaaacacaataattgggatacatgcatgcatgcatgaatttatagaagatacaaaagcatgcataaaaacaattttttaacttacctttgagatattgtttgtcaattttatttaaaatgatggtatataatagattaattattaatattctgtaataaacaaattaaatgctttttggaacaaggaacagacattttgtcaagttcctaaggcacaatttttgttaaaggcttaccaaaatacacgaatatatcttacaattctttattagcaccagagtagttttaatagatttttgaaactgtgctttgaggtgagtactacctcggccctgcccacctgccttgatgaggctccatggtttcgggcatgacacccacagggtatctcaggggggggcagtttgccctaagtcctccttgtccctggccacctgccaccctggaatgcggagtcactctgaaaaggactctggattttaacctgctgttgagccccacatctctgaaacggaggtggtgtgtgtctgctgtgtctgctgcagtgatgtcaagtggcagctccttcatcctggaactggcagtagattcagccttgctgtagcagccacttctgtcaccgctgcagccaccttggccttcctctcaggctaggaaacacaagggagggtggcggagcaccccgggccttagtgggaaaaatatggctaccccagcagagacaggcagaggctcatgggccaatggcaggcaaggccctccccactgagttggctacaaggcctcccgctttttggcagcttctcgtatcaccatgcccagggaaagctgtgcgcccaagggtctcgccccacagctgccagcagtcactggccctgagccagagaatacagaaattaaagagggtaggagatcacagcaggcaaaatatttagaatttacctgacttggaaaaaaaggaatgacttcaaatgtattaacaggaaccagataaatgtttacagtaaggataaagctgctctgcctagggttagcttaatgacacctaaggttttaagcaaaattccttcgagaggcattagctaataaaatattttctacttagaaaacaatatacactgaaagattcaaactcttggcttcttgcatagaagcagaaatgataaaaattcctcacataatgtagacctatatttagccatacctagaggtaaaatattccagtaattacaaactcactagaagcaaaacctttacaatcattaagatacaaagaaaaaaaaaac

SEQ ID NO: 3123 - DNA, 1200 bp, mus musculus
tgtttgagtctgttttcctgtatttcttaaagggatttaattctttcctctttaagagcttctacctgtttacctatttttttcctgtatttctttcagtgagttatttatatcctccttaagggaaaagattttagttcaacttcttgattttcaggtgtgttggtgtattcaggggttactgtgatgggaggactggtttctgatgatgctcatatatattggcttccgttgcttatggtcttgtgctcacctctcaccatctggttatccctggtgtttgctgagtgactttctggagtctgccatttttgtccctgggctgcctcagatgccctggtaggcctgctgcccatagctatagcagaactcctgtggggctttccaacctggggtcttcagaggggcagagaatctgctgatatgttgccctggctacagcagatctcctgggaggcttttaatctgttgggtcttcagaggaggaatcaagctgttctgggacttatggactttggtttctgtttctctgtgtgtagcaaaactcaaaggagactttcattctgttgggtcagtttccctacatgccatgaagcccctgggatgtcttcagactgtgcagtcagttgcccagttgtcttgtgtccaaaggcttttaagctgtggtgtcaattatcctgtgtagagtggatatcctgggattcatataggcagttgttatgtgtgcagtgtatcttctgggatgcctcaggctgtaatgtcttcaggggagtggactagctgccagtctgccctggcagatggtgctgaccagaagagaagtcagggaggggagcttcagggtgtgatgaatcccaaggccactgggctcccacaggcagctgtgggacttcagaagggtccttactagttactctgtgtgtagtatatctcctgagatgccttaaatcagattttaagcatctcataaaaaaccattatcattctaccgtatatagttttaaccagaggagctggattttcactctgaactcattatagcacatctttctgttcttaccctgcaatataccacctctctttaatccccactgaaaacttcaaaagagttcacaaaaggaataaatttcctggcacctctgctacgaggaaaaaaaaaaacaaacaaacaaacaaacaaaaaaaaacagagagaacaac

SEQ ID NO: 3124 - DNA, 1000 bp, mus musculus
cttcttttttttttcatagaaaatagtaacatttttttaattaggtattttcctcgtttacatttccaatgctagcccaaaagtcccccatacccacccccacaatcccctacccacccactccccctttttggccctggcgttcccctgtactggggcatataaagtttacaagtccaatgggcctctctttgcagtgatggccgactaggccatcttttgatacatatgcagctagagacaagagctccggggtactgcttagttcatattgttgttccacctatagggttgcagttccctttagctccttgggtactttctctagctcctccattgggggccgtgtgacccatccaatagctgactgtgatcatccacttctgtgtttgctaggccccggcatagtctcacaagagacagctctatctgggtccttttagcaaaatcttgctatttactttcaaatgttatcacctttcctgatttcccctctgataaccagatatcccctctccctccccctgcttctataatggtattccccacccacccacccactcccacttcccagtcctggcattcccctgcactggggcatcgagccttcataggaacaagggtctttcctccctttgatttcctacaaggccatcctctgctacatatgggactggagccatgggtgactccatgtgaactctttgcaaagtggtctattgcctgggagctatgggggcagagggggtaactctggatgtttgatatctttgttcttcctatggggttgcaaatcctttcagctccttcagtcctttttctaactcctccattggggagcccatgaccactccattggttcagatattataggtatacaacagtacctaccttgtaagtgttgccaaatgtattttacagtcccaaatttcagtttctttttctgtcctgtgaaaattaatgttctttgttgtatgactataaaatagaaaagccaccg

SEQ ID NO: 3125 - DNA, 1200 bp, mus musculus
taatgtttgtttaaatatccttttttctggatcaacttgtcaccaacagtagtatcattttaaatttttcaataagcacaagtctaacaaccctagcttatttgtaacaaatactctagatatagtcagttctatacaatgtgaatttatttgtagtattagtagccagtgttgctctaaattactctatgcagaacagggacttgtctgctcctctgaagacacaacagtctgaaggcctcataggagggttactacactcagagcaacaagtaagtgaccttcctaaataactgcagcagctgggaaacatcatgagcacagcagaagcaggaaccatcccctccacttgaactctacctcttttcactcctgcgccttcaaacagataagcagcttgtctgtccctctgaagatcccaaagtaaaaagacctcctaagagatcttttgcacccagtggaagagatcatcagtttgtctgtccctctgaagaccccacaatctgaaggcttcacatgagatctgctccacccagggcatcagaacacacagtgtgaaagcctcacaggaaatctggtgcatccagagagacagggtagatcaatagtgtgtctgacactctgaagagcccacagtctgaaggactcctatgagaactgcttttcccaaggctacagaacctactctctgaattcctcccaggagatctgctaaagccatggacataggtctcccaagagaactgcagaaacacaaggacaaaggaaccaggctccagagagaaacatccaggccagttaacaccagaattaatcatatgtctgcaggcaaatgcaaaaccataagcaacagaagccaatatactctaacaccatcagaacccagttcttccaccacaacaagccctggatacaccaacacacctaaaaaccaggaacctgacataaaatcctatcttatgaagataatagagtcctttaagggaagtttaaacaactcactgaaagaaatgcaggaaaacacattctatggaactgtctgcctggtacttgttgctgtggcagactcctagatggtatgctcttgtgaagactgtatatccccatacatcctaggggacccactgtactcagagcagttggtaagaagtcccctccctcccctgcccctagtctcagagctgctgcagggagcctgat

SEQ ID NO: 3126 - DNA, 1200 bp, mus musculus
aaagagatcttgataccaatttcccttatgaacatcaatgcaaaaatactcaataaaattcttacaaactgaatccaggaacacatcgaaaagatcatccttcatgattaagtaggcttcattccagggatgcagggatagttaagaatatagaaatcgaccttctgaggcggcgccattttcggctctagacaactgtccaccttcctggtgagagcacaggggtctgcccagcccgacaggtttctgtctcaggctccgtgggagccaccttggctccgggactccgcggagggcaggctgcatgggtgagggtgtggaatacagaggccagcagtttctgggacaggcaagagccagtgaccttctgaggcagcgccattttcggctccagacaacaggcaaccttcctggtgagaacacaggggtccgcccggcccgagaggtttctgcctcaggctccatgggagccaccttggttctgggactccgtggagggcaggctgcatgggtgagggtgtggaatacagaggccagcagttcctgggacaggcgagagccagagaccttctgaggtggcaccattttcagctccagacaaccagccaccttcctggccaaagcaacacagcttctgggaaagatcctgttttgggccttcatcttcagccaggaggaggtccaaacagcagataactgtgcaccttccctgaaaggggagagcttgcctgcagagactgctctgaccactgaaactcagaggagagagctagtctaccacgtctgctgatagagggtaaaaaaatcaccagaggaacaatctctaaacaaagacaactatatcaaataactccagagattgccaggtggcgaaaggtaaacgaaagaatcctactaacagaaaccaggaccactcaccatcatcagaacccagaacgcccacttcgcccagtccagggcaccctaacacacctgaaaacgtagacctggatttaaaagcatatctcatgatgatagtagaggacatcaagaagaactttaataactcacttaaagaaatacaggagaacactgctaaagagttacaagtccttaaagaaaaacaggaaaacacaaccaaacaggtagaattccttatagaaaaaacaggaaaacagatgatggaaatgaacaaaaccatactagacctaaaaagggaag

SEQ ID NO: 3127 - DNA, 1600 bp, mus musculus
gattttttacaactatagtacaaagcctagtctttagataaaatacaggtaaactttcttttctgtctgttgagatagaatatgacatcatgattatgtataatgaagaaggtgacattatgattctatttttcatttcaagttatgatcatgtaaatggataaggaatgagaattctcaattggctatgaaaatgatgtcatggaaagcccaagttgcctgagacatgtcaaccattatcatattttcatttcaaaattaagaaattaactttaatgatgctacctgagttgttgaaagaataatgaatgctatcactaataatgaatactactactaaatgtttcaaactggtaaatgctttgttcattaattatttatacaaatgactcatgtttgtcacttctgtctagtacagtgtcttagttagggttttactgctgtaaacagacaccatgaccaaggcaaatcttataaaaacaccatttaattggggctggcttataggttcagaggtttagtccattatcataaagataggagcatggcagtatccaggcaggcatggtgcaggcagagctgagagttttatgtcttcatccaaaggctgctagtggaaaactgacttccaggcaactagagtgaggatcttatgcccacacccacagtgaaactcctacttcaaccaggtcacaccttcaaatggtgccactccctggtccaagaatgtacaaaccatcacatacatgaaagagctagtaggactcatttcaaactacaaatgttttcctatatttcaaataaagtgatttcaagaacagttagtattgccacagatgttggtagaatgttaaatgttgctaattaatgaagagaataagacaagggctgtgaataaaatactaagcaaaagtaaactcccactgtgactattccaacattcattactgttagaaagcaacatcttttttttttaacaatttgcattctcccatggtggaggtggtgattaaaaggtccatatgccaacaatatgggcatccagctgagcaacagaagagtcaattctatcggtcaaggcatgagcttattctttgatagtttaagtaacttcaaacttcaacaatttctgcacagttgggtaaactcatgataaagtacaattagagttatttaaaagctttaagaataagtatgaaaaactgtctatctttagattgatgttgttctaatattaaacatgcaataaggaaattttaatcaaagtttcaattcagcacctaaataggcagatccatggattcagatgtttacatacaatacctgctgcattatcataaacatcaaaacaatctgtcccccaagtttcacaaagttactatattctttggcaacaaatatcataaaattataccaaatagtgtaatacatccataagattttttaaaagccactttgaacaagtgttaacaaaatgtaagttgacaaagtgagaaagcatggttgagtctattgtatcagcagccctctcctcagtaaactcctcagatctccatttccagttctaattttctactcctttagttcctttgtgtcctgt

SEQ ID NO: 3128 - DNA, 1200 bp, mus musculus
agtctaagaacactgggaaaaggctttagctatgttagaatacaatcttaaaaggcatttactataaggtaatgcttaagagagtgagcatgaatctatacactagactaatgcaggaatggaaaaattaattttatggtttatatagattagggagaaaatgccaggcccccgggaaaggagtttccttgaaactctttgcttcatgaaccagcttcccagcttttgctttgtcaagctgactccaccagagtgccgtgacagggtcccttcgggcctacatcctcagtcaggaggaagagctaagatctagacctctgtggaccataccccccagaggagagtaggcttccaaggaggactctgaccccgggaatcagggaagagcaccaacttgaatcccaagtctctcagagaccagtcctcacaggtgagcacaccggctgcagaagcaacagagcttcttggacagggtcctttcaggccttgatcttcaggcaggaggtagagttgagctccagccctcagtgcaccttccctgcaagaggagaacttgcctccagagagtgctctgacaactgggaatcatgagagagttggactcccaggagtgctgacagaagttaacagaatcagaggaagaaaaagctccagccagacacaactagaacataagatataagagattaccagatggcgaaaggcaaatgtaatgattttattaacagaaaccgagaacactcagcattatcagaacacagtactcccaacacagagagtcctagataccccaacacacccgaaaagcaagatttgaattaaaattcacatctcatgatgctggtagaagattttaagaagggcattaataactcacttaaagaaatacagagctgggtgtggtggcacacacctttaataccagcactcaggaggcagaggcaggtggatttctgagttcaaggccagcctggtctacaaagtgagttccagtacagccaggctatacagagaaaacctgtctcaaaaaaacaaaaacaaaaacacaaaaagaaaaagaaaaagaaatagaggagcacataaaacggtagacgtccataaagaggaagaaaaaaattccctgaatgtattaaaggaaaacaaaaccatacaggtgatggaattgaacaaaaccatcaaagatcttaaaagggacgtaga

SEQ ID NO: 3129 - DNA, 1400 bp, mus musculus
gtatacaggacataatagatgtgaaattggggagtagcctgtaattcacttgcacagtagcatacattctgaacagaataccaataggacaggcactaagagtatcagttaataaatgagacctaatagatctgaaaatcttgtttaaggcaaaggtgaatatcattcagataaagcagcaccctatagaatggattttttttttaccaattccacatctgaaagatgattcatatacaaaatatataaagaacacaagagattagaaataaaaaagaaaagagagagatcttccttatgagcccagcggaggctgttaagggctccagagtgcttttcacactgcaggacctcgggatcacctcgggatcacgggtgagtggaacacaacctcagctccaaagaatcgctgagggtctttggctggcaggaacagggacaaaggaaccccccacctgaccagaggctggtgcccgttccagtctgggtcacccccaccatcttccttctgatcccagcagagaccagtaagggctccagagtgctctccgtgccgcacgacctcgggatcacctggggatcacgggtgagtggaacacaacatcagctccaaagaatcgaggaggttcttgtgccagcaggaacagggatgcagaaaccccacctgaccgtagcctgggatccattcaggttggggccatcccctctatcttctgtgtaaacccagcctagggtgtctagggtaccagaggactctccgcactgcaggacccctagacacccaggacctcctgataacctgagagaacctgggtgatagaagcaacagagattcttggtcatggtcccattgggtgttcttcctcagccaggaggtggagctgaggccaagaccctgggaacctcccttgccagaggaaagttggcctaaagggaaggctctgaccccaggactcaggaggcagatcagagctccagactgctggacacctggcttcaagaagagagcttgcctgcagagagtgctctgacaactggaactcaggtgaacattacactcccaggagtgttgacataggctaacagaatcacaagaggatcaggctccaaacagagacagcttgaacattaacaccagagatttccagatggctaaaggcaaacataagaatcttagtaacagaaaccatgaacaccgggtatcatcagaacccagtacactcaccaaaatgagtcttggataccccaaaacacctgaaaagcaagacagattaaaaaccatatctgatgatggtagtagaagatcttaagaagggcattaataactcacttaaagaagtacaggagaacactgttaaacaggtagaagcccttaaagagctcaaaaatccttcaaggaa

SEQ ID NO: 3130 - DNA, 1200 bp, mus musculus
ttatttatttatttatttatctacattccaaattttatttcccaccccttgtacacctacccactgttccacatcccaaacctcctccatacccctgtatccccaaggatgtcctgaccaaccagatctcttaactccctgtggcctccagtctcttgagggataggtttatcttctctgactgaacccagacccagctgccctgtactgtatatgtgttagaggcctgatatcaactggtgtatgctgcctgatttgttgtcgagtgtttgagaggtctcgggggttcagattaattggaactgctattccttctacagggtcaccttcctcttcagcttcttccagcctttaattcagccacaggggtcaacagcttctgtctggttggatgcatatacctccatctgacttttcagctgcttgttgggtcttctggagtgtggtcatgctaggtcaatttttgtgaacactccatagcctcaataataatgtcaggccttgggacctcccctttagcttgatcctactttgagcctgtcactagaccatcctttcctctggcttttctccatttccatccctgcagctcgtcacacaagaaaaactatgggtcagagttttgactgtgggatggcaaactcctctctccctggatgtcctgtcttcctgctggaggtgggctccaaatgttccctatccttactctcctacatttcatctaaggtccctccctataagccttgagagtctctcaccttccagatctctggtgcattctggagggtcccttcaagctcttacctcccaaggttggccgttttcattctttctgctggccttcaggactttagtcattttccctcacccaataccagatctggttccctctcccccacacctccccatacactttccctccaaagtccctgccttcctctacaactgtgattggtttcttccaccttccaagtggaactgaggcatcttttgaatactgtggactgtatcattggaattctgtactttcttttttttttttttttttttggcttatatccactcattagtgagtacataccacacatgcccttttggatctgagttatctcactcaggatgagattttctagttccatccagttgcctggaaaactcaggatattctcattcttaatagctaagtagtataccattgtg

SEQ ID NO: 3131 - DNA, 1200 bp, mus musculus
tgcatacactagcaagattatgctgaaaggaccctgatatagctgtctcttgtcagagtatgcctgggcctagcaagcatagaagtggatgctcacagtcggctattggatggatcacatggcccccaatgaaggagctagagaaagtaccaaagaagctaaagggatctgcaacactataggtggaacaacattatgaactaaccagtaccccggagctcttgactctagctgcatatgcatcaaaagatggcctagtcggccatcactggaaagagaggcccattggacacgcaaactttatatgccccagtacaggggaacgccagggccataaaaggggagtgggtgggtaggggagagggggtgggtggctatgggggacttttggtatagcattgcaaatgtaaatgagcgaaatacctaataaaaaatggaaaaaaaaaaaaaaaaaaaaaaagaaatgtacatattttgtatatgctgacacaacacttgtgagttaacaagtgcagctttcctgactccagaagatagttgtcttaggattttactactgtgaacagacaccatgaccaaagaaattcttataaggacagcatttaattgggactgtcttacaggttcagaggttcagtccattatcaaggtgagagtatggaagcatataggcagtcatggtgcaggaggagctgagctaactacatgttcatctgaaggcagctagtggaagactgacttccaggcagctaggaagagggtcttaaagcccatgcccacagtgacacacctaaagcaaggctctcagtcttggccatctacttcaacagagattgcaccttcaccaatggccttcgatggccacttacagttccaagcctcaactgttcttcatgaccccttcatgtttcaaaaccaataccacctgggtgactcttacacattaccaagcagagctgctgcaggaggtagaaatttggttatctgggaagaagccaactaggacatggtgaacaatcctttgatgtgttcttgaatttagttttcaatttttttgagaaaatcttattctatggccatcagagttattggcttttaatttccattttctgaccatcctctagtattaataccagtataatactgtctccataaaaagaattttaaaatgttctgtttatattatgggagattgtgtaa

SEQ ID NO: 3132 - DNA, 1000 bp, mus musculus
atcaggacagggcatctagggaggtgtggaatagaacttcatggtctggggattacttatgtgttggacatcaaaagctatgcagatctggagactttcagtccacttgacagagactgaagggcctaccttgtttgttctgtaagcagagcagaagtcttcctgtacttatgtctttaaagttttaggatgaaaagtcctaatgatatatttatcattatcacatttaaataaggtataatttaattctttaaaagtatcatgtcatcgaggaccaggttttgtcctctctctatatatattttctgaagaatttttctgtgcatgtgcacaaatgtctccaacaaatattaacaatgcataatctcttgtagttgttaaatgttttaagtacagagggcataattctataaagttataaaattgtgtttaataatttagttattactatatgtttattctagaacacaattgtatttttaaatctgctggaaaagtgtaaaggtaattgaattatgattatctactaatagttctataggtactctgaagtttttcatcaatatgaccaattcaactatgagcattttgataaatgtttgttgctttatgtagctatgcatttccaaacaattaatagtagatggtagggttatggccaagtgatagagtgcttttatggcacttgattgctatcagtaaatgggaaaaagattaatttagttagttttttcattgctgtgaagagacagcatgaccaagacaactattataaaggacaacgtttagctggagctggcatatagtttcagagctttactccattattatcatagcaggaagcataacagtgtccaggaaggtatggaggacctgagatttctacatcttgctccaaagtcaaacaggagaagactgtatccatgtgactaggaagaggatttcaaatcccacacccacagtgacatgcttacttcaacaaagccatacttcctagtaa

SEQ ID NO: 3133 - DNA, 1000 bp, mus musculus
acagaagaaagcaattaaaagaggagagggagggagggacttgggagcgaaagtgaatgaggtgggggttaatggggggttagaggggaccctgatctggtgagggaaaagtactgaagccctgagggccatcagaaaaatgtaaacaggcaatttcaggaaatagaaggtttggggtacccccctcccccagaatgcaccagagacctgggaggagacagattctcaagactcacatcagagaaggaactttgatgaaatgcatgacagtagggggaggtaacttatagagcccacttccagcaggaagacaaggcatcaaatgagggatggggttgccatcccacagtaatatctctgactagtaattattcctgtttgaaagaattacagggatggaaatagagaggagcctgaggaaaagaaggtccagtgacaggcccaaagtgggatccagctcaaagggaggtcccaaggcctgacactattactgaggctatggaacacttacaaaaagggatctatcatgactggcctccaaaagactcaacaagaagctgaaagagacagatgcagttatttgcaccaaaccaatggacagatgcagctgacccctgttgttgaattagggaagactggaagaagctgaagagaaggacgattgtgtaagaagataagcagtcttaattaatatggaaccttgagatctttcaaacactggaccatcatacagacagcatacaccatctgatatgagactccccaacacacatacagtagagaacttttgtgtctgtgtactttcagagatgatgaacctaaccctcaagagcctggaggtcccagggaatttagaggtcaggtgggatggggagtggggacagtaaggtggagatggggtgaggaggagtggatgtgggatgttgaatagtggaagggtggatggggaggggcagggtaaggaatatggagtgtaaaaaatgaattacaaagaaaatta

SEQ ID NO: 3134 - DNA, 1200 bp, mus musculus
tgtttttcctctttaaggacttctacctgtttagcattgttgtaattctttaaatacttctacctgtttagtagtgttttcctgtatttctttaagtgagatatcaatgtccttcttagaatcctctaccagcatcatgagatatgattttagatctgaatcttgcttttggggtatgttggggtattcagtactcactgtgatgggcatactgggttctgatgatacccagtggtcttggtttatgttagtatgattcttgcatttgcctttcaccctctggcaatctctggtgttagatattctagctgtttcaagctggagtttgttcctcctgtgattctttacctctgtcagcactcctggaagtccaactctcacctgagccccagtggtcagagcactctttgcaggcaagcactcctcttgcagggaaggtgcacagaaatctgaagcttagatccaccccctgagtcctggggtcagaacccttccttgaggccttccctcctctgatagggaacatgccaatggggtctgtgtatcatctgtgcctcctggctgaggatgaaagcctgaaatgaccctgtccaagaagctctgttgcttcggctacccatgcattctcctgcacagactggtctcagtggtcccaagattctgggtattctcaggcctgcctttgtcttttgtccctgttccttttagcacatgacagtctggttttgttttgttttgttttttgctttttgttttttgttttttgttttttgttttttttgtttttttgttttttgttttttgttttttgttttttgttttttgttttttgttttttgttttttgttttttgttttttgttttttgttttttgttttttgttttttgttttttgtttttgttttttttttttttttggaacacatgtgttccactcaccagtgatctcaagatcctgggtgtgctagggtacctgcagcatggagagtcctctggggactttgggaccctccactgagttcgtgcccaactacttgactatttataaacagcctagaaactactattaattaaattaattaatttcatgtgaagtatgttatgcatgataaataaatacactgcatgatcttgatcatacgtgtaacataaaacactgactttcagatgatagacaataatgtttcaggtactggaaac

SEQ ID NO: 3135 - DNA, 1200 bp, mus musculus
tttctgaaagccattttcccttggaaataatccattgagagactgttatactgtaattacagactcctgaaacatacaggctactgctattgctcttagttgcatgccagaggtataagaaaactacttaaattcacattttaacatgtcttattttattttccttgaacagctcatttcctttgtaaacctatgcttacgcttacattaaagtgtctgtgtcaccaggcaaccttgagaggtaggttgggggaacctctagaatgtaccagagacctgggaggtgaaagactttccggactcaaagggagggaccttagatgaaatgcccaaaggtggaaagatggaacttgtagaattgtttctgtctaaaagaactgcagggacaaaaatgaagaagaaactgagaaaaaggagattcagtgacttgcccaaatcagctcaaggggaggctccaaggcctgacactattactgatgctatggtgtgcttacagacaagggcctaagatggctgtcttctgagaggcctaacaagcagttgaacaagtcagatgcacatacttacacccaaccagtggacagaggcctgggaccactgtggttgaattaggggaaagatggaagcagttgaggaggagggcaaaacctgtaggaggaccagcagtctcatttaacctgaattcctgagatctctcagacactgaaccaccaaccaggcagaatactccacctgatatgaggtccctaacacatatagaggagaggacttcctagtctgacttcattgagagaacatgcacctaaccctcgagagatgtgaggccctggggagtgggaaggcctgctgggtttggggtggggacattctcttggagaaaagggaggagaaatggaatgaggaactgttggaggtcatactgagagccagataatgactggactgtataaaaaagattaaagataattttaaaagtaaataaaataaatgtctgtttaataaaatatatttttaaatttttctttcctaattaaagccacgaatccatatttagcctgtgtcaggactctaacaggagaactcttcagactgctaggggtgacaacttggaactggtgtcccagtcccatcattgataatattctgtagattggtactgaggttagttgggttaattttcctactttctgctttgtggtt

SEQ ID NO: 3136 - DNA, 1000 bp, mus musculus
ggaacttcaagtctagttgcttcctttcttactgaattcaaacaagacagcccagctggtagaacatatcccacatacagactacagcttttgagatagcccctcttccagttgctcaggaaccacatgaaagtcaaacacacatttcctacatatgcttggggatgcctaggtccagcccatatatgttctttggctagtggttcaaactctgagaggtctaagggtccaggttaattgaaactgttggtttttctgtagagttcctatccaatttgggatcctcaatccttctgcctattcttcagtaagaatctataagctccatccactatttgtgtattgttggagcctctcagagcacaacttgtggtcttgtctgcaggcttaacagagtatcattaataatgttagggattggtgcttgtgcattggaagggtatcaagttgagatggttattagttggccattccctcagccactgctctctgccttgtgcctgcattacttgtagacaggataatttttgagttgtaagttttgtgtatggatggtgtctctacctctttactggggttcttgtttgactataggaggttggcctcttaaggttccatattcccaatgaaatagctgaggccacctccactgattcttgggctcttccattttctaagaccatgtcttgtcctagagatacccatcagctcctcatccccatcaatttcagattcccattcattttcagggccatctagtcatttctcctgtccatcaccacacctgaccctgagtcccccattcccttcccctcccagttaactgcctccattggcctcttatggctactttattcactcgtctaagtgatattcaagctgttttgcttgggcctttcttcttgtttagctcctttgaagtctgtgaagtgtaacactgtacctgtatttttcggctaatattcagtaataagtgagcacataccataaataccatgca

SEQ ID NO: 3137 - DNA, 1400 bp, mus musculus
aattcttaacattgaaataacaccctgaatatactctgaatactatgaatcaaagttctataccaacaattttaaaaaagtacacaatatttaaacttatggaaggtgaaacactcactactgaaaattgtatcaaaacagatataaaagaagaaagaaagaaagaaagaaagaaagaaagaaagaaagaaagaaagaaagaaagaaagaaagaaagaaacaaagaacggagggagggagggagggaggaagaaaggaaggaagaaagaaaaagaaaaggaaaaagaaaaaggaaaaagaaaaagaaaaagaaaaagaaaaagaaaaagaaaaagaaaaagaaaaagaaaaagaaaaggaaaagaaaaagaaagataggaagaaagagccttcctcccggtccttaaagatggggcagactcctagttggtctgctcccttgaagacaccatatcctgatccaacctagaggacccgttgtattcagagcagttggtacgaatctcctcccactgccgctcaatcccagagttgctgatagaagcctggtggactcaggacctatgacccaccaaaactcccaccctctagaataccattacccttccttcccctcaaccacttcttcctagtccttgctgctctggcagactcctaattggtctgtttccgtgaagaaactatatcctaatccaccctagaagacccactgcactcagagcagttgaggatccactgcactcagagaagttggacaacagctagacttctccactgaagatacaacagtctgaaggactcccaggaaatctactgcagccagggcaacagatcagtaccttctctgaccctgtgaagagcccccagttggaaggctccacatattgtctgttacagccaaggatgcaggcctatctggagacctgaaccaacccaaggaaaaagtggcagactccatacagtcacccagaacaacaaacaccagggataaccagatagtgaaaggtaagcacaagaccataagcaacagaagcaaaaatacatgggcatcatcaggcagcaagacctgaatacactaatacacctgaaacaggaatctgtccaaaaatgttttctcatgaagacagtagagtcctttaagatggatataaataactcactgaaagaaatatagaaaaacataagaaaacagggaaaggaattggataaagtgatccaagacctaaaagtgaagaagaaacaataaataaaacagaaatggaggcaaacctgaaaaaggaaaacctaggaaagaggtcaggaaatacagatgtaagtattaccaacagaatacaagagatagaagagagaatctcaggtatagaagataagggagaagggattaacacaactgtcaaaga

SEQ ID NO: 3138 - DNA, 1000 bp, mus musculus
tataccatatttcctctccctgcttcaatgagggtgttctgccacccacccacccactcctgcctcccagccctgatattctcctataatgaggtatcaagccttcacaagatcaagagcctctcctcccattgttgtgcttcaaggtcatcctctggtacataggcagctggagccatgggtccctccatgtgtagtctttggttggtgatttaacttatgggagatatggggggttctgattaattcatattgttgttccacctaaagggatgcaaaccacttcagctccttcagacctttctctaactcctccatttgagaaccctgttctcagcgcaatggttgactatggtcatctgcttctgtatttgtccagatctggcagagcctctctggagacatctatatcaggctcctgtcagcaagcacttcttggcatccacaatagtgtctagttttgatgactgcatatgggttgggtgcccagatggggcagtctctgaatagcctttccatcagtctctgctacacacgttgtctccctatttccccccttgattattttgttctcccttctaagaaggactgaagcccagatacttaaaatacccaagatataagatacaatttgtgaaactaatgaaactaaagaagaacgaagactaaagtgtggacactttgccccttcttagaattggtaacaaaacacccatggaaggagttacagagataaagtttggagctgagacaaaaggacagaccatctagagactgccatatccgaggatccatcccataatcagcctccaaacgctgacaccattgcatacactagcaagcttttgctgaaaagaccctgatatagctgtctcttgtgagactatgccggggcctagcaaacacagaagtggatgctcacagttagctattggagggatcacagggcttccaatggaggagctacagaaagtaaccaaggagttaaagggatatgcaa

SEQ ID NO: 3139 - DNA, 1200 bp, mus musculus
gaaagaaagaaagaaagaaagaaagaaagaaagaaagaaagagaataaaacatcatcactttcttagaagagataatttgtttttgatttttttttttttttccgagacagggtttctctgtatagccctggctgtcctggaagtcactttgtagaccaggctggcctcgaactcagaaatccacctgcctctgccccctgagtgctgggattaaaggtgtgcaccaccacccccggcgataacttgtttttgaaataatgagagtatgcaattagaaagcgcatatttctttaaaaggatgcaagtttgaagaacataaaatcagataatgaatttagcatatacacatgcaaaattaagtttccttaagtatatataatatgagactttccacagtaagccaaaactccacagggcacatgccattatctaaaataagagggcatgtattcacagaagtatatactaaaattaaagttacttttgctctctttctgaaattatatttaaattacttttacatttcagctagcatcaaaggaatatgagaaatatatttagtaaatgataattgcattttaaaatgtttcaataatggttttaggatttttctaggttgagacagtagagatgactgcaaagtatgttgaaaattattatcggtatcaagtttgtagagctaatgctttttgaagcaggaatctgattattaccaaaaagcatgattccagtattgtgaagtaaaagatctcaactgagaattagaagaacaaacatccagtcttggtttgtcactaaaacttagatcaaagaaaagtgacttttggtctctctttttgacttttcatcctttttttttttttttttttttttttttcttttttgacagggtttctctgtgtagccctggctgtcctggaactcactctgtaggccaggctggactcaaactcagaaatccgcctgcctctgcctcccgagtgctgggattaaaggcgtgcgccaccactgcctggtcttttcatccttttttgaacaatgtgcttctgtaggagcatttctaagattcaattcagctctaataatgtgtctattttccactttggtcattgctgaagttcccatactttttctcctttgggttaaaacattaagtggtttattaaaagccaaatattacctgagaagtattacacatt

SEQ ID NO: 3140 - DNA, 1200 bp, mus musculus
atgctcagagctagccatcagactaagcatgggaccccaatggaggagttaggagaaggactgtaggagctgaaggggtttgcaacctcataggaagaacaataatacagccaaccagaccctccagagcttcttgggactaaaccaccaaccaaagggtacccatggctccagctgcatatgtagcagagttctgccttatctggcatcaacgagagaggaggcccttcatcctgtggaggctcaatgcccaaacatagggagatgcaacagtgtggggagttgaacaaagggcttggggagcacactagaaaggctcagacactaggggtatgagagatgtacatgatctaatggggatggcattagttgaatgctcaactgtggggagaaggaacctgaagataccacctccattagatagacatggctttcagctgagggatggggccacccaccccccatctcaaaatttaattcagaattgttcctgtctaaaggaaatacaggaacaaaaaagtggagcagagactgaaggaaagggtatctggagacagccccacctggggatccatctcatgtgcagacagtaagccccaaaattattactgataacaagatgtgcttgtggataggaacctgacatggctgtcttctgggaggttctgctagcacctgactaagacagatgcagatattcacagacaaacattgtattgaacaccaggactagaatagacgacttaggagaaggactgaaggaaatgaacaagattacagccccataggaagaacaacagtatcaactaatcagacccctcagagatctcaggaaataaaccaacatcaagagtatacatgggtgggtcctaggccacagctacacatgtagcataggagtgccttgtctggcttcagtgggagagtatgcccttggtcctgtggaggtttgatggcctgacgaaggggaatactagaagcattttgggagtgggtaggagggtggggaagcatgatcttagaggcaaatgaaaagtagatggagtgaggggttcctggagtgagacagggaaaggggacatttgaaatgtaaataaatcgaagaaagaaagggagaaagagaaagaaaaaagaaagaaagagagagagaaagaatgaaagaaagagaaagaaagaaagaaaataaaggtatgaaggaat

SEQ ID NO: 3141 - DNA, 1000 bp, mus musculus
gattttcttcagtgtgagctaagagttgtaagatgaactaaattatttcctccaaaattttcttttggttatggtgtttcatcatagtagtaaaaaacctaactaagcccccttcttccagaaatgagcaaaaatacctttgtggcagtagtgatgtcagtgcaggtgtacatgtgcagagaagggaagataataacttctcccctaactccatacctcaccacctgtagcagtcaggagatctggccacgagagtgggtgagctgtgcctatcccttgacagctgcagaattggggagagtgggctctgcacttcatctgggcagcacagtactattggccctggtcgagagaacacagatgagccagacacaagggcaagagtgaaggagaactagtctcagccaatcatcttctatgaggtagagtaggtacaaagggatgacctctccccagctagcccctcaacacctgtagtagtcagaagatatggcctcaatggcatgagagcataactagccctgcctgctcgctggctgtagcgtttgggagagctattcctgaacccttacatggacaacacaatagaacttgacctggtggtgaatgaataagagagctatccagaagggtctgagaataggagagcagttacatccccctcataggcagcacacagtggagctggcttcggaggcatgggtgtggaagagccagccccaaagacacaatagtaggaaagcttccctgcatcctatactggtgatgacattatatgtcctagctggagcagtgctggagagctcaccctggtggtgcagataaggaaaagctgaccagttgaccagctctgctactactcaggcacagattcaggtttatgagttgccccaccccaaaatctataccatctatgatcagttgggatgcatgagagggccaacccttcagattcaaatctgtaagatctccatgacaaaagacaacagaagaataatca

SEQ ID NO: 3142 - DNA, 1200 bp, mus musculus
ctagcaaacttgtactgaaagaaatttggagtggcctgtactggtctggcgagtatgaagttgaactgtcctctgtgaggggagtgaggattatagaaaagatggaaaaagagactcagaaacaaagattaaaaattgggagggatttccaatcagtactgtagtggccttgagtctaattcttttaggttttctatactgtacaggattataggaaacaaagtcacaagccagcagatacaatggctgacatacattcgatatctgtaaccctctgaaggccaccctattcctccctgttccttactccaagattacctgaaaattcattcccttaccttcaagtatatcctcttttatcattccatgcatcagcaggccaggaaatctgacagtagaccagcctgacttgactctgcttgacaggccagctttcacagaatcaggcaaaatgacccccaaaagtgtccttatctgcagtggattaaaaaaaataattccaacttagctaagcttccaacttgtgaaaggaaaagacctaagaatgtttctgctcttagaaaggaataacaaaagcttcaccaaatgtgactcagtttgaccaaggttcatcccatgctgatagatgaatttgacaatattgtgcaagtggtgctggctccagatttatgaagaatacaaaaggaaaggtatattggaatctttctctataatttgagaatactgctaagaccaggaatgtggcaaatgggatcctatatggaggctactgtgtgaaatctgagttgcattggagaccccaagatgctagaaataccagagcctcatgatatctgccaagaaaaactgcacatggatacactggaaccttctggagagagagatctgtgttgaatatgacaaaggtggaaggacagaaccatccctttgacatcagaaatgaagttaaaggatttggaatttgccctgctaggatctgttcttgattttgaccagcattttctcactattgctaaacccctcccttttcaaatggtaatatataatcacttacaagaataatttgaaggcttgtaatctgcttttggatttgacaggcttatgtctcagtggaggacttggactttaaaacactgttgtgactataaataactttgggaactttcaaagtttgaactaaataaatttcttattatatgt

SEQ ID NO: 3143 - DNA, 1000 bp, mus musculus
ggggaggttcatctctttttttcttttttaattagatattttctctgtttacatttcaaatgtcatccccttttctggtttctcatctgaaaaccccctatcccctccccacttcccctgctcagcaaaccacccactcatgtttcctggtactggcatttccgtgtactggggcatagaaccttcacaggaccaagggcctctccttccattgatgactgactaggccatcctctgctacatatgcagctacatctttacactctctcctaagttgcagttgataatatgaatgtatatatcataaatatcctctaatggttcaccagtactaaaatggctaagtttacattttgaacattttaaatgattaatcccttattcaagcttatacttctgagatgttgttaactatcagcatccatgccttcatatttagatgattagcagcatttcttcttgctaatacattgtcttaattagagatttattgctgtgaagagatatcacgatcactgcaactcttatgaaggaaaacatccaattggagctagcttacaatttcataggtttagtacatcttatggaggaaagcatcacagcacataagcagacacagtgcttcagaaggcactgcttcagatcagcaggcagcagaaagagaaagtcacactaggcctggattgagcaccttggacctcaatgccatttcttccaagaaggccacatcttctccaacaagaccacacatactaatagtgctactatattatataaggtgggtaagttttaagaaagtgaaccttgggaaaaagttggatgtagaaaataaaatactacttctgagaaaaagtgttatatctaaattagagccttttacttttaatccactagattctatagttcacattcttacaaacatgatggcacatcttcccaattctatgctgaaaaactagctgtaggatacacagtggattttataatttgcattaattac

SEQ ID NO: 3144 - DNA, 1000 bp, mus musculus
gcaataagtagctgggtatggtgtctcatgactatgatcccagcactagtgagacaaaggcagcagaactctgttagactgaagtcagcctggtctatggagtgagtttcaggacagccattgatacacaaagaaatcctgctaagttatgtttctcattttattcagtacaataccataacccagagaatggtgctgttgagcaaccatggatcttagcacttcagttgaacaagatgatccctcacaggcatgcccaatggcttgtatgtttggtgattctagatttaaagacgttttcatgagtatcatgtattatttaccctgaatatcagatatttacatgatgactcataacattagcaaagttactattattactgaagtagcaaagaaaaaataattttatgatttgggggtctccataacacaaggaactgtattaaagagaaacagcattaggaaggccaaaaagcactcctaaagacaatgctaagttgacagttgatattagacataaagttcttgtatcctgggtatcttagaggccagtctgcacaggagaacacatgggccagggaaatgacagaccttcttggacaggacccttcatcctcagccaggaggaagagctgaaacccatacctctgtgcaccttccctgccagaggagagttgttcttcagagagggctctgatcctgggactcaggtgagatcaccatcttgtatcctgagactctcagagaccagtcgacacaggagagtgcacaggccacagaagcaacagagcttcttggacagggccctttgggccttcaatattcagccaggaggcagagctaagacccagatgtctgtgcaccttccctgccaaaggacagcttacctggagagagtgctctgaccactgggactcaggacgaagttggactctcaggagtgcagacagaggctaacagaatcacaggaggaacaagcttcaaccagagacagctagaa

SEQ ID NO: 3145 - DNA, 1600 bp, mus musculus
cttcacaaaaataacaaaaacacacattggagaaaagatagcatattcacaattggtgctggagaaatcacaagtgacagcacatgttggcaaggatgtagagaaagaggaacaatcctccattgctggtaggattgaaaactggtacaaccatcctggaaatcaatctggagattccttagaaaaatgaaaatagatctacctgaagttccagcatatacccaaaagattccccaccatgccacagtggcacatgttctactatattcatagcagacttatttgtgataaccagaagctggaaacaacctagatgtcccataacagaaacatggatacagaaaatgtagttcatttacaaaatgggatactactcagctattaagaaggaggacatcctgagttttgaaggcaaataggtggaactagaaaataccattctgagtgagctaacccagacccataaggacatgcatagtatgtactctctaatgagtgcatattagccaaaaatgtacagaatacccagaatacaatctacagtactcaaaaagtttaacaagcctaagagtccaagcaaggatgcctcaataccacttgggaggttaaagaaagcaatcacagaaggggatagggagggaggggcatgggtggaaaagaagacaaggagaggaagaggggaacatgatcaggtattggattgggtcgaggaacaggaatgaagccgtgaggggcagaaaaaataatgaaaacaggcaacctcaggaggtaagaggtagaggaaccatccagaatgcaccagagacctaagaggtgggagacactcaggactcaaagggagtgaccttagatgaaatgccctacagtaaggagagcgaactcttagaacccacctcttgcataaaggcagggcatcaagtgaaggatggggatctcatcccacagtcaaaaactctgacccatgactgttcctgtctgaaataactgcagggatggaaatggagaagagcccgaggaaaaggaggttcagcagcaggcccaaattgagatccaactcaagaggaggccccacggcctgacaatattactgaaggtatggcgtatctatcaagtactcacaaaatgagatttatcatgacttacccctccccctgcagaaagacccaataagcagctaaaacagtcagatgcagatagttgcacccaaccaatggacagaagctgctgatccctgtggttgaattaggaaaaagctggaagaagctgaggaggagggcaaccctgtagtaggaccagcagtctcatctaactggaactctcaagatctctcagatactgggccaccaaccaggcagcacacaccagctgatatgattcccccaacacatatacagcagaggactgctgggtctggacttaatcagagaagatttacctaaccctcaagagactggaggtccctgtgagtagggaggtctggtgggttgggagtgggaggtgggaaattctcctggagatgggggtagctataggatgtggaacagtcagagcatgaacccaggagatacaatctggattgaaaaaaaaaaaaaagattata

SEQ ID NO: 3146 - DNA, 1600 bp, mus musculus
gaaaaaattcaatattaaatatgaaaatgctggtattacataaataatggaaagaatatgtaagcaccatggttattattgttgaaaattaggaaaactattgctgattaggtgactgccctagcctgatttttgattctgtgataaaacacatagcaaaccgaactttgagaaggaaaaggtaagaaggacgagtaaaagaaaagttaatctgttagcactacttgcccaaggatatacaatttcctggaatactggaggatattttttatgggagataacaaaatacatgtttttgctcccctaaactagttcatttgacttgattgtatcagatgttcatcataggatgcagaagttacatgggcaggaaatcaggatatatgcttccctctgattgaatcaggtggaaaatatggtggaattgtgggtttgccttttaaattctcagtaaaatgtggcttgttgccatttctgggaacccatcatcctggccagaattaaatattgcttcaaatttgattaaaaaattatggaacttgtctttctagaacaatttggcttatatttccatgccacaacctcactttaagggaagttagaacagaaagaagttagagcaataactcaagcagaggccaaaaaaaaccaccatatttataataggcctttatcagcattagagctgggtagtatctatcctctatttgccagtcaataatcccattatataatttgccatttttcatctggattgcccttaactctaatttgcaagcccatatggtcattattttaagacttttgccctgtggtggcttctcctgtctccactccacctctctctctctctctctctctctctctctctctctctctcgctcgctcgctcgctctcgctctctccctccctccctccctccctccctcctagtggtctcctccaatcacaagcctgggaacctcaaaccccaccaatctcacttctgcccagctgtaggctataggcatctttattcactaattagaaataacttcaggacaaggtcacaaagcatcatttgagtctccttgaggactctcttctctctggggcaattaggccttgtgggactgcagttaacattgcaatacaacagaataaacctcaacaccaaaaattattttcactttaagtcccatagttttgttttgttttgtttttttaaccatgaaggaagttagagaagacaaatattttataaatggatgatgaaaagaaattttaagtgaagtaaatgtgacatctaagtagattatagccatgggttcttcaattagaaacagaagttagaaaacaatatctgaatctggtaatgtcactagccagatgaaaagtgaatgataaactaccaagcataatttaagacattattttgggtggagaaatgagtcaactaaatttatgacatagtcacctcaaaattaaaaatgtgagcccttaaaaagtccattttattcattatacatttctaacagtcagtcatatatacaaaaaaatgtttaatacgtgtgtcctcccttgctttggatacatattaattaatattatgatcttttt

SEQ ID NO: 3147 - DNA, 1400 bp, mus musculus
gttctgatgatggtaagtggtcttggtttctctaactaagattcttacatttgcctttcactatctggtaatctctggagttagttgttatagttgtctctggttagagcttgttcctcttgtgattctgttagcctctatcagcatacctggaagactagatctctcctgagttttaatggttagagcactctcttcaggcaagctctcctcttgcagggaaggtggtcagatatctggatgtttggacctgcctcctggcagaagatgaaggcccgaaacagggcttgtcccagaatctgtgtagcttctgtagtccacactctcacctgagcaaagtactcttgtcaggatcctggaaccaagatgtctccaccagatgctgtggcaaagccctcccagatgggctggacaccaatcctctgacagggaaggagcttggatgtctggagcctgaaatgcagtctgccccaaaagctctgtggcttctgcctgtcccagaagctgttagcctttgcagtccacattctcaccctcacagaccagtcttggggggaatcagggaacccaagatggctccaccagatgctgtggtaaagccctccttgggcaggccggacacctctcctctgacaatgaaggagcccagatatctggagcccaaaaagtggtctgccccagaagctctgtggctgctgtctgtcccaggagctgttagcttatgcattccacactctcccctgttcagactagtctcagtggaatcccggaaccaagatggctcccacagatgctgtggcaaagccctcctgggcaggggtggacacctctcctctggcagaaaggtacccaggtgtctggagcctgaaacatgttctgccccagaatctttgtgggttctgctgtcccagaagctgttagcctcttcagtccacactctcacctatgcagaccagtcttggcagaatccagaaacccaagatggctcccccagatgctgtggtgaagcccttacaggcagggcagaaacttcaggagtgttgctctttctccacaacctaaccagcatctgctgtcacctgaatttttgatcttagccattctgactggtgtgaggtgtaatctcagggttgttttgatttgcatttccctgatgattaaaaatgctgaacattttttccggtgcttctcagccattcggtattcttcaggtgagaattctttgtttagctctgagccccatttttttaacggggttatttgattttctggagtccaccttcttgagttctttatatttattggatattagtcccctatctgatttaggatagataaagatcctttgccaatctgttggtggcctttttgtcttattgacagtgtcttttgctttacag

SEQ ID NO: 3148 - DNA, 1600 bp, mus musculus
attcgagggagctcattgatctttgttaattttagctttggaataaaagactagcaatgctttgacaggcattaattttttgcttcatatagcttccaaagctgatgtattattgtcaggagctctttttatgatttgcaaagtattattaaagcacttgatctgttctcatcacagaaaatgggtaatataatttacttgtttctccatgcagtagacatagctcaaattataaatggaaacttattattttagatttgagtctggttttctgtcacgaccaacagtgttttccagctaaaattaaaaaaaaaaaaagtcgatgggatcaatgatcctttcttttaaaaagcttcatcagaagtagtcagaaattctgtgaagtccaactactaatgtttaacagaatttcaaaccaattctctcatggaaaaactatataatgaattagaaaacatatagtgcctgtcttaaaacaaaaagtgtattcattcttttaactttgagctacatcatgacatagttaaagtacatgtattacccagaaaacattgtagcttatttttttaattacccttcatgtgattttaatacttgttaccatcttaaatggatttggactaacctagagcatgtctctgagggtgctcctagagacaacaaactgaggaggaacaacccaccccgagtgtgggttatggcatcctgcgggctgaggtggcaggctaaatagaagtggaaaaggagaaaggtacatgatctcgagcattcatctttctccttcctgattattcttcaatgtgagcaagcaactccctacccacacatccctacctactaccacaacagtgagactcttccattcccacagtttttctgccataatgggcaggatcctcaaacaatatgttaaaataaacccttgctctcttcaggtggttcttggctgctacttggtcacagaaatgaaaaaggtagctataatactttacatccccagcaaacctatcatttttctcttaggtaacaaatcaccttctgtaaagaggattttcttctttgcgcagtctctgaaagaaatttacattgcaataggcattagtaaatgctgtttcaatatggcattaaagatggagagacttcaatgtcttaacattatacaatttattcatatgctacctatgtaataaaatcctggagtattgaaaatgtatatgtgattgtcaagtgtttcctatcaattccaaactagagttgatgtccaattccaagcctatctgtactagcgccttcctttctcccttaacagttcttcgtgttgtctcttctctatggaaagcaagagaaacacacagatatatgcacacacacacacacacacacacacacacacacacacacacacacacacattcaatttcatgaaagcagaaaatttactgcttaaccaggttcaggacttttctgaacattggctacatctgactacagagattagacattcatgaagttgattgttgataatattggtcttgcactaatgtagctaactacagttaatatgaattaattactacaatagttgtattgagtttagaga

SEQ ID NO: 3149 - DNA, 1200 bp, mus musculus
ttccttgagggttttttgtgtctcctctttaaggacttctacctcttagcactgttctcctgtgtttctttaagtgagttattaatgcccttctttaattcttctactaccatcatgagatatgatttcaaatccacaacttgcttttccggtgtgctgacttatccaggacttgttgtggtaggcatactgggttctgatgatgcccagtgttcttggtttctgttagtaagattcttatgtttgcctttcgccatctggaagtctctggtgttaatgatcaagctgtctttgtttggagcttgttccacctgtgattctgttagcctctctcagcactcctgggagtccaactctcacctgagatccagtggtcagagcactctctgcaggcaagctttcctcttgcaagacagatgtctagcaatctggagctctgatccacctcctgaattctggggtcaaaaccgcccctgtaggcctactctcctctggcaaggaatgtgctcagggggctgggtctcagctctgcctcctggctgaggatgaaggcctgagggtaccctgaccaagaagctctgttgcttctatcaccccgggctctcaggtaatcaggaggtccctctgcgattctttggagctgatgtagttcactcacccatgttcctgagatgatcccgaggtcctgcagtgtgaagaaccctctggagcccttagcagcctctgctgggctcagaaggaagatggcggggctgtccccgacctgaatggatccctgcctcttgtcgggcagggttcctttgtccctgttcctgctggcacaagaccctcagtgattctttggagctgattttgtgttccacttacccgtgatccggaggtgatccgaggttctgagctgtggagagcactctggaacccttagtggcctctgctgagctcagaaggaagatgttgggggcagggagggaggctgatttattgatcttaaccattgggattggtataaaatgaaatcccaaagtactttttatttgtatttccttgatggctaaggattttgaaaatttctttgaatgtttgtcagtcatttgaatttcctcttttgagaactcatttctaattgactttgttttattacgtccatttttttttagttctttataaattttggatgtcaggccactatcacatgtatag

SEQ ID NO: 3150 - DNA, 1200 bp, mus musculus
ttatattatgaaaaatatttaaatatacaggaaattacaatgaacagtaaaacatgagtataattagggatcttttataacaagcaaactattttctcataacttcttgataatttttctctacttgaaaattaagtattacagattattccccttcctatcctacccagagacatcaatgaccatgaatttggtgtatatccatcatatcatgttcttaattatacctaatcatgaaatattttgtgatattgcttagactggttttgaagttacccatcattcttcagctttttttttcacattaggcttttcagttctatcaatattgatgtataaaaattcagtccattgacttgtatcattttattcattttcattacatagtattacaattaatcaaaactgctttttaattaactgtgttatttaaatatttttttctttggggctattataaaaattgacacaacaaccaactttgtccatgtatatatgtcatagtcagggtttctattcatttgatcaaatatgacaaaagcaacttggggagaaaagggtctacttcatattccaaatcttagcagacactccattgtccagggaagtcagaacagcaactgaagcaggacagaaatctggagacagaaattcaagcaggagctatggaggagtgctacttagtggcttgctatgcctcatggattgctctacctactttggtacagaatccagaagcacaatttcagtgctagcactgcccaccgtgtgaatggccctctcacatcaactaccaaccaagaaaatgtcctgcagacttgccaacagaccagtctgatagacacaattcctcagttgagctttcctcttcccagatgacagtctcttatgccaaattgacaagaactagccagcacagtattaatgggagaaattgcatcttcttgggcctgatacctttataatgagatcagactgaggaaaatgttatttttgtttgcattccaatacaatgtctttcgtggtaatcaagatagccaatttttaaattttttactctcttcatatatatgaaccctatagatttctaagctatggaaaatataattaatggtcataactcttatgtgcaagtcagtcagtgctcggtgtcaaaaaaaaaagtgctgtgtactctcgtattaaagttaataaacaaat

SEQ ID NO: 3151 - DNA, 1600 bp, mus musculus
tacacatttataaaatcttgtgactttccaatatatgtacatcatgtataatgactaaataagggtattagcatatctatcaccacaaatagttatcattatttttgtgttgggaaggttcaaaacacctccttcaggctattttgagatgccccaaaattattgatgtcatcctactttattgaagagaacctgagtgcttgagagatggctcatccattgagagcttttgccgttcttacagagagaactgtactttcagtaactctttattgattttttgtaaatttcacatcatgtaccccaatcctactcatctctctgtcactggtcatctgccctcaacccttgcaacctcctcccacgaaagaaaaaaaaattaaaaaacaaaccaagcaaacaacaaccaaaaaaaaaaaaattctcattgtggaagctcattgtactacagtgtatcacatattatccttttgtcccttagtccacacatctctgcttgcaaaggttcattgcaatgagtctttggtctggtttgaggcctctggcttctgctacactatcaatactggatcctcaccaggattcctctcagatatcccgttgttaccctgtgtcatggagatcctgcagctttgggtctgcaggattggccccttcgcatgctccagaaattcctgaatggggtagatgttgctgagggcttgagaataggagggctggcttaccctcacaagctgcagcactctagagagtggggcctgaatcttgcctgggcagcacagtaaagctgaccctgatagcctgtgcactggctagtcaacccccaaggtatgagagcaagagaactaaccctgccccttgcaggctgaagcattgggcattgcatgagctagctggggcaggtaaggagagcttgtcctgttgttgtgggtgtgggagagctggggatcctgatgaactcagcggccacccatgcccagatccagggctttgagttcctagaattcttatgaggtatctcacaaacagctctaactctagttataagagatcagacattatcctctggtaccctccatgggcacctatacacatgtacatacatatagtcacacagctacatacactcacacataagtgcaaataaatctataaaaagaaaagataaactctaacctcacaattgaacatttcaccaagtaacatttcaaagagagctgggtttgcttacaatgcagacatttcccagcccaacttaattaggatttgtaaggctacgcaaagactttgatccagacacttactccatctttgaggaagttagtcttcacgtgactgacaattgttgacagctattggtaacagatgaaagtgtaagctgaaaaatattaagaaaccaatggaaaggcagacaagtggccttcctccttgactggatgtgtgtttattaggacaataagtcaaggtggcaaggatgactccctctgatgcaggtattagaagattattgtaactctaggaagagtttggacaggcccgtgtcactttcagcttagcaatatattgcactatttcttagttgctaacttttgtttatttt

SEQ ID NO: 3152 - DNA, 1000 bp, mus musculus
tcactttatgtccctatcacaaccccctccttcctctcttcccagtcccacccttgcaaatccctattcccattgccctcttcccttctccccattacataactaaattagtaagcctaggcctcatgtcacacaccacagaatgtcatgagctcatagaggccatcctaagctactaggtgaaatcttgtctcacttaaaacagctattgtgtatgttcacacagaattctgttcagctatggtaaaaggaacaaatctggttttatggggacctccttgaacaagtgtgacaatgtcgatataaaatttcagaaaataattgatactcatatttttagtcctgacaattaacttaataagaaataggttggagtttgccagctgtgattgaagaagcaacaaccattttctcaaatgttcaatggatgaaatgatgacatgttgattgtaaaatgcaattaattcttttttcccttttttttttaattaggtattttcttcatttacatttccaatgctatcccaaaagtcccccatgctctcctctcaactctcctcctccccacccactcccacttcttggccctggcgttcccctgtactgaggcatataaagtttgcatgaccaatgggcctctctttccactgatggctgaataggccatcttcggatacatatgcagctagagacacgaactccggggggtactggttagttcatattgttgttccacctatagggttgcagatccctttagctccttgggtactttctctagctcctccattgggggccctgtgttccatccaatagctgactgtgagcatccacttctgtgtttgctaggcccaagaatagcctcacaagagacaactatatcagggtccttccagcaaaatcttgctagtgtatgcaatggtgtcagcgtttggaggctgattatgggatggatccccgggtatggcagtctctagatgatccatccttttgtctcagc

SEQ ID NO: 3153 - DNA, 1000 bp, mus musculus
tataaaatataaaaatgtatcaaaatgaaatcaatgcttaaaatatagtttttaggtctcaactacagtttgactgcaaatgctttatgaacataaactccagcagaagagacgttggtttggtcagtcattttcaagaccagtactactcttgaaagcatgattcttaaaccatggggacactttggtatggtactctaatgaaatagtctccagcagaagagaagttggtttggtcagtcattttcaagacaggtacatatgaaactaaagaagaaggaagaccaaagtaaggatacttcgttccttcttagaatggggaacaaaatatccatggaaggagctacaaagacaaagattggagctgagacagaaggaaggaccatccagagactgctccacccggttatccattccataaacaaccaccaaatgcagacactaatgcatatgccagcaagattttgatgaaaggaccctgatatagctatctcttgtgagactatgccagtgcctagcaaatacagaagtgaatgctcacagtcatctattggatggaacacagggcccccaatggaggagctagagaaagtacccaaggagctgaagggttctacaaccctataggaggaacaacaatatgaactaaccagtacccctaaagctcatctctctagctgcatatgtagcagaagatggcctagtcagccatcattgggaagagaggccctttggccttgcaaactttatatgccccagtacaggggaatgccagggccaggaagcatgagtgggtgggttggggagcagggcagggggagtgtataggggaatttcgggatagcacttgaaatgtaaatgaagaaaatacctaataaaaaatagttaaaaaaaaaaaaaaagacaggtactactcaaaagcatgattcttaaaccatgggaacactttggtatagtactctagttaaaacaattagagattgttttattatctaagaga

SEQ ID NO: 3154 - DNA, 1200 bp, mus musculus
atcctggatgcttttgttcaattccttcaactatttggttgtgttttcctgtaattctttaagggatttttgtgtttcctctttaagggcttctacctttctcctgtatttctttaagagtgttatttatgtccttctgaatgtcctctatcatcaccatgagatatgattttcaatctgaatcttgcttttccaatgtgttggggtattctggacttgctgtagtgggagagctgggttctgatcatgccataagccttggtttttgttgcttaggttcttgtgcttgcctcttgccatctggtgttagttggtcttgctgtctctgactagacgttgtccctcctgtgggctttgggcctgtgatcttaggtatgtcagcactccttgggagaccagctctctactggcaggatttgtgcagggagagctgtggggcagccttatgtctggagtgcaggtagagaatggaaggatcttgtccccagctgctttgctgtttttgtgccctgtgtgctcttagcaggtccttgtttgtacagtgattggggtgaaagtggtaatcttgcctctgagtgagatcactcctgggagaccagatctctacaggcaggatttgtgcactgaggactgtgaggcagctttaagtctggagtacagagggagaccactcagataaaattttaaaacccatcacatatagtaaagaccttcatatgcattaaggaggttattgggtgtcatctttatagatcttattttaccccttttgattgatcagttcagtgtaatatcttaaaatattactttacaacttcagataggcaattgggttttagttctccaatgttataacagaatttcacaaactgattggtttaaataacaatttgatgttgcagagataacttagtcattaatagcacttactgtacttgcataggacctgagttcagttccaggcatgcacccagtgattcaaagcctactataaattcagttccaggacacctgacatccccttcccagcttccaaaggcacagtataaacatagttaaaaaatatacatgcagacaaaaatactcatacacttaaaatacaaataaattaatttttataacaccaagaagcttaatatttcatgatgattctaagttaaaaaccccaaaccaatatgtaagaaatgtggtttccttttg

SEQ ID NO: 3155 - DNA, 1000 bp, mus musculus
aggtgatctagaaattgtgggagtggctcaccctcttgagatcaatctcagtggagggtcccaaggtccccagaggactctccacagtgcaggcaccctaggatacccaggatcttgacatcattggtgagtataacgcaacatctgttccaaaaaaaaacccagaaggtcttgtgctagcagcgacaaggtcaaaggacaaaggcaggaactagcacgcccaaaaacttggaatcactgagaccagtctacacaggcaagcacgtgggcagcagaagcaacagagcttcttggacaaggtcctttcaggccttcatcctcagccaggagacatagctgagacccagactcctgggcacctttcctggtagaggagagtcagcctcaagggaggactctgaccccaggaatcaggaggtggatctgagctccagactgctggacaccttccctgaaagaggagagcttggctgcagagagtgctctgaccactgggacacaggagagagttggacccccaggagggctgacagaggctaaagaatcacaggaggaacaagctccatccagagacagctagaacatctaacgccagagattaccagatgacaaaaggcaaaatttagaatcttactaacagaaaccaagaacactgggcatcatcagaacctagtacatccaccacagcgagtccaagataccccaatacacctgaaaagcaagattcgcatttaaaatcatatctcatgatgctggtagaggattttaagaagggcagtaataactcacttaaagaaatacaaaataacactggtaaacagatagaagtctttaaagaggaagcacaaacatccctcaaagagttacaggaaaacactgctaaacaggtagaagtccttaaagaggaaacacaaaaatcccttaaagaattacaggaaaacacaaccaaacagttgatggaattggacaaaaccatccaagatctaaaaatggaagtaga

SEQ ID NO: 3156 - DNA, 1000 bp, mus musculus
atctgtgttgtcttgggagttagtcatcgagctcctatgaagaagtcacaccaaaagacaacactcttagccacatattgtgtggagatctaaccctgtcaagtcatcaaacctccccaagtccttgagaaataatgagtaagggcaggtttgggagtgaagacagtgtctttggtggtgacggggctagtggagctagtagaagccatatgagcaatccagagctcggatgttggggtttcctgactggaatatggaggcccaacacacacagcattgtgttatgttaagccagtgctaagtgccactgaaattgacagtgtgttcaagattaggtcatttagagttccctgggtctccaacatgaggatgatcatggaggctgaaaaagcttcatagtaaattgtgtacaaaattaatgacatgacctcaacggctattgagggcaggcaggctttggctaaaaggagatccaagtaggatctgattcctatttggaatgtatgtcaaagtgcttggcatcctgcagtcctccgagggaaccagatgagtcaagatcttgagcatctgcatcctggaaaatgtgaacaagctgtccacacaccctggagattgtagatggccattcattgctgtatcaaagccgtgcaggcacagccacagaacgcccgtccacggcccaggcctgagtctgccagggtttccagggtgtctgctcttaacttcatccctgtggaggttctgcatctgattggagagtatcctcaccaggtgggaaaggctatcacctagattcgaacagagctccttggagttacagatgatgccatcacacaagtcatccggcatctgagtaggaagggacacgtatatcccagcctggatcgccagcacctacaagtttctggctgagaaaaaagaactgactgtagtttcggaggatgcttctgttctgctgttttgataattaggatgtatcgactatttcaaacaaaaaaga

SEQ ID NO: 3157 - DNA, 1000 bp, mus musculus; identical to SEQ ID NO: 3156

SEQ ID NO: 3158 - DNA, 1000 bp, mus musculus
aggcccttccggtcattgccagcacccagtcacctagggcgcagagtcggcggacacccccacggtccatagaggactctccatgagatcttaggatcactggtgaatggaacacaacttctgttccaatccaatcgtgcgagacctaagacagcagaagggaagcagaaaagcagcctgaccaggggcacaagtcccttcaatctgtaccagcaaccggtcacctaggggtcacctaggacacagtcagtggacacccccacggtcactagaggactctgcacgcaatcttccattcactggtgagtggaacacaacatctgttcctatccaatagcaagggacctcagacagcaaaagggaagcagaaaatcctgactgaccaagggcactagtcacttccggtcagcaccagtactaggtcatctagggcacagaattagaggacacccccacagtccccagaggactctccacaggatcttaggatcaatgaccagacagctttttggccctcaaaagagacaccacttccaggcactataaagcaaaacgcctaggatcttaggacaacaggatcccagggtaacaggagctgggtcacaccaatatttcagggtctaagaggaagcttgaatgccaaaaattctgacacacccagaatctcaggttcataggagcccacaatcaaaggatcacagagaaagctggactctgaggagaccttaatcaactgggattataggaaggaaaggctccaatcagatatgttgagggtagcaagcacttatgataaacatatggcaggagacaagcctaagaacagaagcaacagaaaccaaggttacttggcatcatcaaaaccaaactctcccaccatagcaagtcctggatacaccatcacacgagaaaagcaagacatggatcaaaagtcacttctcttgataatgatggaggactttaagaaggaaatacaggaaaacacaggtaaacagctaga

SEQ ID NO: 3159 - DNA, 1000 bp, mus musculus; identical to SEQ ID NO: 3158

SEQ ID NO: 3160 - DNA, 1400 bp, mus musculus
tgcagattcccttccctttctcctttttacctttgaccccattcaccacctctgccctgcttctccatttccccttcccattccctcttcctccatccccatcccttcccttcctcttccttctagttctattttgctttgcttctcatctccatcttgtctgtcttctctctatgtctgccatctccctctgctttccatttcctctttttatttctaatagaaatttaaaaaaaaaacatatttgtggattagaaggatggattctgaagccagatctcccacgcattcataaatctgagattctttctagaagtaacatattctggtaaaacctactctaccacctacatttttttttgcggggggaggggggtgaggagggcttctgcggcttttatttttacatgtaaaccactggggaagtcttgatggtgggcaccctagagattgcactggagttccgagggctccagatactagctgtgaagtcaggtgacagaaacaatgattcagaccaatcacatgattacaaagctgggtctccaggagggttcctctggtcaggtgtggacgtctaaggaagcagtgacatggaaggggcaagcactgggccagtcttgagccacctggatgacatcagggacagaggacctagcagctggtggctccaggggtctccagtccatgctttacttggccagggggttccagaaggacctgccagcaaacttggctttgctgtccagctcttccttgattctaaggatctgattgtacttggccaggcactcagatcaacaagggaaaccaatcttgatctgccctgtgcagatcttcagtctccccaaatcaatgggacactatgatgccccagtcattgaactgggccaacttacacgcctgcagagactcggtcacagagctgatctggttcactttgagcaggaggcagttgcaggatgtcttgtctgcagccttggcactctgcctagggttggtcactgtgagatcatcccctaccacttgggtgcctgcactagctgtgaacttctgccaggcatcccagtcgtcctggacaaaggggtcttcaatggacaccactgggtagtcttaaatgaaggacttttataggtcagctagctagtcgggtgtgatgtattggctggagtcatctggagacttgaagttgaggtcatacttgccagacctgtagaactcggaggcagccacatccatgctaataactacctggtcagtgatgccagcctttgcaactgcagtcttgagcagcaacagtgcttctttgttctccaggatgttaggtgccaattcgccctcattggcacctacattggtggcatccttcccatacttcttgatgttttttcaagttgtag

SEQ ID NO: 3161 - DNA, 1200 bp, mus musculus
gcagtttctcctcctagtctctttcccctgcatcccctctgtcccccacccctgctcttctaatccaccttcttcgcttctattcagaaaaaggcaggtcaatcatggatgtcagctaaacatggcatatgaagtttcagtaagcctaggcacctcaccttgtattaaggctggacaaggaaacacattatgaggaaaagcatgctaaaagctggcaaatgagtcagagatagtctctgctcccagtgttaggagtcccacaagaaaaccaagctacacaactatagtatatatgcagagagcctaggtcagtcccttgcaggctccctggttgaataccaagcatcttatgctatccattgcaatgtcttcatgagcaggaaagattttcacatgttaccaaatatctcagcattcccattactttcttataccattgattacatatagcctttaacttatgttcttgggaatatcatttttatttttagtcactgtcttttagtggatcacatgtgtgatttatgttagcatcattgacttggtgtgtgcatttgttttgctttaaaagaaaactcagcacttgagttgtcagtgatgaacatgtcaaaaggatgtcttaatagctatatagacatatgtagatatgtagagatatgttttcttctcttgaggtctgtgaattaccctccactctggtgcctttgaagtgctgctcaactatagtggtcgacccattcttagacagataagtgttatccaggatgtttttgcagttactggcttctcttagtaattgtcagaaagaaagcagaatatttgaaattatctgtcttgacatgtcttgaaatgtactagttgactttgcatctcctaaattactctgcactcattcaacatcacgaatcacaatgataactgacttttttgttttggttttactttcctgggcattaaacttgcttgctgtttgacctttgagcatcaggcagaccattccccagcaccttgctctatctttagtaccaaacgctcaaattattatctatcttgaggatgtaccatgccgtagaggtactctgatatttgctaatacttcccattggaccttacagacatttccagatcatgacagtgtcaattgatatcatggttttaaacattatcaaaatggcttctgctaaagaataaaaagaaaat

SEQ ID NO: 3162 - DNA, 1000 bp, mus musculus
aaaataaagaaagcttaacagcttagcccatgtatttatgatccctttcaaattccttattttggtctcttacctcagcacactgacgtccttctggtctacttctaatctgtttaaggtctgtgcctgtccatcatagttaaggtgtgctctcccattctggttcatatcaagtttattccctgctcatgttatttgctccttttgtttgtccattttttttttactagagtggtctcctattctttcctgaaattttccatccttatcctaatattactaccattagctctcagttcacacttcattttctctggcaagtgttccctgattttcagaccaagttcttctcttaagcatgtttttcttacctgaaaggaagctagtatagttgaagcaaattgaacaagagtagcaatctaatgtgaggttggagaggtaggtgtgggacaaatgatgaagcagtgcctcattggcagagacactgacaatttggttagtagtaggttaagtgcaataaaaaggcattagagagagtaacagagattttacttgatgtgttggttagatttacatggatttgacacaagctagagtcatttggaaagagggaaactcaattgagaaaatgacctcatcacatggcctctgggcaaaactatgggacatgttcttgattgatgtttaatgtccatgggatcccagctctctctgggtggtgccacccctgggttgcttgccttgagtgctgtaagaaagcaggctgagcagcccatggagagcaagacagtaggtagccctcctctatggtatcagtttctgtgcttgaagttccctggatgatggtttactaattataagatgaaaaaagttttgataattgctttctcacggcaatagaaacccaaattaagacacttgggttttaacaagagcaacaacaacaacagcagcaacaacaattcatactgtctatggacaactgtgaagaatattcaca

SEQ ID NO: 3163 - DNA, 1200 bp, mus musculus
accagcatcatgatatatgatttttaaatccgagtcttacttttccagtgtgttgtggtatccaagactgggtgatgtgggagtgctgttttctgttagtaagattcttacatttgcctttcgccatctggtaatctctggagttagttgttatagttgtctctggttggagtttattcctcctatgattcttttagcctctttcagcagacctgggagtctacctctttcctgagtttcagtggtcagagtactctctgcaggcaagctctcctcttgcagggaaggtgcacagatatctggcattcggacctgccttgtggctgaagatgaatacctgaaacagggcttgtccaagaagctgtgttgtttctgcctgtcccagaagcattgtagcttctgtattccccactcttacctgtgcagactagtctctgatggatccaggacccaagatggctcccccaggtgttctggcagagtcctcatgggccgacacctctcctctgtcagctaaggtgccaagatgtctggagcccaaaacggggtctgtcctagaaactgtgttgcttcttcccatcccagtagctctgtagcttctgtagtctgcactatcacctgcacagactagactctaagggatccaggacctcagatggctcccccaggtgctccggcagaatccttcctggtggggtggacacctctcttctggcagggaaggcgcctggatgtctggagcccaaaacggggtctgtcccagaagctgtgtggcttctgcctgtccaagaagttgtgtagtttctgtagtctgcactttcacctatgcagactagtctctgcaggatctgggacccaagatggctcccccaggtgctctggccattttatattcttaaaatgaaaactgtaaatgtatattatttgacaaaattatagtatattgtctcaagtttggggtattatatgtggttttctttttattatgtgtttatatttctctgtgttgtgacttcattcacttacacgttttgttcttttgcttagggttaaacttggagcttgatgagtaaaactaaagtactcttccactgaaatacatcaccagccccttctatctttatttttatcgtttttacttttatcataaaagaagtaatttttatattattagctaaaagtgtatgaagcaaaaaagta

SEQ ID NO: 3164 - DNA, 1000 bp, mus musculus
ttattctgatcttcttttttttttaaatactttttattattacgcatttccctcaattacatttagaatgctaccccaaaagtctcccataccctccccccctccacttccctacccaccaattcccattttttggccctggcattcccctgtactggggcatataaagtttgcatgtccaatgggcctctctttctagtgatggccgactacgccatcttttgatacatatgcagctagagtcaagagctcctgggtactggttagtttataatgttgttgcacctacaaggttgcagatctctttagctccttgcatactttctctaactcctccattgggggccctgtgctccatccgatagctgactgtgagcatctacttatgtgtttgctaggtcccggcctaatcttacaagagacagctatatcagggtcctttcagtaaaatcttgctagtgtatgcaatggtgtcattgtttggaggctaattaagggatggatctctggatatggcagtctctagatggtccatccttttgtctcagctccaaactttgactctgtaactccttccatgggtgattgtttccaattcgaagaaggggcaaagtgtccacactttggtcttcattcttcttcagtttcatgtgttttgcaaattgtatcttatatctctggtatactaagtttctgggctaatatccacttatcagtgagtacatatcatttgagttcttttgtgattttgttacctcactcaggatgatgccctacaggtccatccatttgcctaggaatttcataaattcattccttataagatcagacattcaggtgacagcagaagctggcgaggatgtggagaaaggggaacactcctccattgttggtgggattgcaagcttgtacaaccactctggaaatcagtctggtggttcctcagaaaattggccttagtactaccggaggatcccgcaatacctctcctgggcatata

SEQ ID NO: 3165 - DNA, 1000 bp, mus musculus
taaccccttacaagattcctctccacaagctgcctatcacctcctacctcccccctgaccctacgaggatgcttcccaactcacccacccactcctgcctcagcagcctagtgttcccctatcctgggtaatcaagcctccacaggaccaagggacttctctccaagtgatgctagatgaggcaatcctctgctacatatccagctggagccatgggtcccatcctctgtgctctttggttggtggtttagtccctgggaggtttgagagatttggttggttgatactgttgttcttcctatggggttgcaaacccctttagatcctacagtccttgccctaacttctccattgggctctccattattagtccaatgtttggctgtatatatctgcctatgtattagtccagctctagcagcaaatctcagggacagctatatcagtctcctgtcattaagcacttcttagcatcagcaatagtgtctgggtttggtggttatttatgggatggatccctaggtggggcagtctctggatgacctttctttcagtttctgctccactctttgtccctgcatttccttttgacaggaggaattatggattcatatttttgaggtaggtgggtagccccatctttcaactaggggacatgactatccactcgataaggtttctacaggttctacctaccctctgttatgtatttcagctaaagtccttcctgttgtgtctctggcatttgggactttccagtggctcccccatctccccgccccccccgcactgctacacacttacttccaaattcctgaccttctgtacttctcccccttctcctcccatatctgaactggcccccctttttactccccctcctctttccctccaagatacctctccccctctacttcccagagattattctcttcctcctactactgtagtatccacactttggtctgatcttctttcttcttgggtttcatatggtctg

SEQ ID NO: 3166 - DNA, 1000 bp, mus musculus
gggtctggagtattgatggagcagccttagatcagctctgattagtagactggttagagatgaagagagattcactggctgtggctccagactggccacttggggtataatttccttgacaagcaaagctgttggccaggactcacttgatgtacttctcctgggctgccttcaggttctccttcttccaccacaggcctttagtgcaaaggcctacagggctcagccataggagaaagtcaatgccccatggcttcagcaggggacacttgttgataccattgaggttgatggatgcctcctcctcactctgccctccagacaggaaagtgatcccaggcacagaaggggacactgtgcgatgaaagtttctgggtgcaagcatggttggggatgatcatgttgggcttcagcaatgtgccttccagatagtcatggtgataactcagagccttgtagacagtctccagtaccatactgccagttgcatactggcagcgcttcaagtaatggtccccatcagggataatttcaggctccacaatgggtacaatgccattctgctggcagttgctggaataagggccagaacattggcattttccatgatgtcaagggatgggagagtatgttccccaatctttagcacacagggccacttttcagtcaaatccttctttcttatactgggcacagcattcagacacccaatccagtccttgggcaggggtctcgtcattggttccttccaggggcaccacacccttatctaccttaatgcccacaacatcaacgttggacttgataacttgggggacaggatgtctatcatctgccttctggtacagtgtctagtggaagaggatcaccccccctctcagtgcagggattcacacggtcatcaggagtcagcagcaactggccctagaagcacatgttcttgttggtgttcttgctgccagtggactgcaggatcttggctatgtttccagtgtactca

SEQ ID NO: 3167 - DNA, 1200 bp, mus musculus
tttatcaaatttatatcctaaatatattaaagcaattatcagagcagtgactagaaacactgtgctgagaatgatcctttcacagtatttcatctccattttttactacatactagacccccagtttcctcttagaaaattcctacaatattattttaaaatctttttgtgatctgttgatgttcagtagttcattgcttctgataagtttaaaggatatatatctgtttttgttattgttgttatgttttgttttattttgtgttgcattttcttttcttctttactccttttttaaagtccagtcttcatgcccctcttgctctgtctcctgagtactgcccatcccatatctcctccctcagtctttaagagaatgcccccactctacccaccctcaccaggcctccccattccctggggtctcaagtctctcaagggttaggtgcatcttctctcactgaggtcagacctggtagtcctctgctgtttatgtgttgggggccgcatatccactgctatatgctgcctggttagtggctcagtgtctgagagatctcaggggtccaggtcattgagactgctggtcttcccatggggccaccttcttcctcagcttcttccagcttttctccaattcaaccacaggggttgccagcttctgtccattgaatgggtgtaaatatctacatctaactctttcagctgcttgttggccctctcagagggcagccatgctaggtttctgtctgcaagcataccacagtatcagtaatagtgtcaggaccaggggcctccccttgagctggatcccaatttgggcctgtcactggacttcctttctctcaggctcttctccatttttgtccctgaagttccttcagacaggaacaattctgggtcagagcatttgactatgggatggatggcaaccccatccctccactggaagtggactctacaagttctccctccgcactgtagagcacttcatcttaggtccctccctttcagtccagagaggaaggagtggggggacatgtcagttttataaagaaactatttcatagaagaaactagtttataaatatgtaagaaattacttcttgctactatctgctcacatgcttcaaaaaatagacatgtgtaatgattttaaaatagaaatattagctataattaaaatatgaaatattcttt

SEQ ID NO: 3168 - DNA, 1000 bp, mus musculus
gtggatattagctaaaatgtacagaatacccaggatacaatccatagaactcaagaaggttaacaagccaaaaagccaaagtaaggatgcttcaatcccacttgggagggagaagaaagcaatcatggcaggggagggcagagggaagaagcaacatgggtgagaggggacaggaaggggaaagggggaacaggatcaggtattctggaggggaaaacaggagtgaaaccctaagggctgtgaaaacagacaacctcaatcctatgggaagtaggaggtaggaggagcccctagaatgtaccagagacctgggaggtgagagattctcatgactcaaagaaaggaaccttagatgaaatgcccaacagtgggaaaagggaatttatagagtccacctccagtagaaagacaggacatcaagtggagggatggagctgccatctcgcagtcaaatcctctgacccagaattgttcctgaactgcagggacaaaaatggagaagagacaggaaaaggaggcccagtgactgtcccaacttgaaatccagttcaaggagttgttctaagacctgacactaatactgatgttgttatagacaggagcctagtatggctgccttctgagaggcccaacaagcagttgaaagagtcacatgcagatacttacacccaagcaatggactgaaggaaaggctggaagaagttgtggaagatgtgacctcataggaaaaccattagtctcaactaacctaaaaatcccgagatctttcacacactgagccaccaaccaagcagcatagagtagctgatctgaggtcctagacacatacacagtatagggctgcctggtttgcgctcagtgagagaagacacaactaacccttgagactcaagacttgcggtcccagggagtggtgagacttggcaggttagggagtgtgggagtggggtggaggacatcctcttggcgatgggggaggaggaatgggactaggaacttt

SEQ ID NO: 3169 - DNA, 1200 bp, mus musculus
tgactggacaggataaggggagtttatgaggggatgactctacctgatattcctaccagaggggaatgtagagactgcctagcaactaggcaagacttcccaatgaaggatgggggcacccatctacccataaatctttcaatccaaaatttgtcttgtctacaatatgcagggataaatatccaacaaaaaccgagggaacaatcaatgaatgactgtcccaacttgagacccaacctgtagtctcccctcccccagcctgaaacctgcttgctcaggggtggagcttcccgctcaatctttctgccatgcctactgatggaacctgctgctttgctgttctgaagccatcacatgatcaccctgctactggaccccaagattatttggcgggaattgggccccacccccttcctttataactgagtgccgaaatactaaaaattgtaccttgagcagagagctttgtcttggttccttccttatgtcccgcagcccagcccctctactcttccaggtttccaaaatgcctttctaggcaagaacccatgttgtgatctattggtcagacacaacaccaacccatgtgagaaagagagccatctcctgacactactaatgatacagtgatggtttgtatattcttggcccaggaagtggcactatgagtgtggccttgttagagtaggtgttgccttggatgaagtgtgacattgtgggggtgggctttgaaatcctcatcctagctgcctttgaaacaagatgtggaactcttagctcctacagctccatgtttgcttggatgctgccatgctcccaccttgatgataatggactgtacttctgaaatcgtaaaccagccccaattaaatgacctttataggagttgtcttacttatggtatctgtttacagcagtgaatctcttagacagatactctgtgaggcccattggtcatggacactttatattcctcaatacaggggaatgccagggccatgaagtgggagtgggtcggtgttggagtgggtgggggagggtgtggtggacttttgggatagcattggaaatgtaaatgaaataaatacctaattttaaaaaaaagacagatactctgctatactttcagacaggatcctagcagaattgtctcctgtgaggcttcatccagcaatggatgaaaacacatatagaaaccca

SEQ ID NO: 3170 - DNA, 1400 bp, mus musculus
gatttttgtgtttcctgtttaaggatttctacttgtttagcagtgttttcctgtaattccttaaagacttctacctgtttagcagtgttctgtatttttttaagtgagttactaatgaccttcttaaaatcctctaccaccatcatgagatatgactttaaatctgagtcttgttggggtatccaggactcgctgtggtgggcatacttgattcttatgttgctcagcagtcttggtttcagttaataatattcttaagtttgtctttgccatctggtaatctctggtgttagatgttctagctgtctctggctggagcttgttcctccagtgattctgttagcctctgtcagcactcctgggagtccaactcatacctgtgtcccaaggttcagagtactctctgcaggcaagcactcctcttgcagggcaggtgtccagaagtctggagctgtgatctacctcctgagtcctggggtcagagccttccctggacaccaattcccctctggcaaggaaggtgtccaggtgtctgggtctcatttctgcctcctggctgaggataaaggtccgaagggacactgtctaggaagctctgttgctcctgccatccacatgctctccagtgataccaatgttctgggtgtgctagggggcctgcggcgtggagagtcctctggggaccttgggaccctctgctgggttcacactgaagatagcaaggggctggcctggaccaaatgaatcctggctctggtcgcacagggttcctttgtcactgttcctgctggcacaagaccctccaggattctttggaactgatgttgcattacactcaccagtgaaccaaggtgtgctagggggcctgcagcatggagagtcctggggaccttagcaccctccgctgggttcgcactgaagatctagacttcttagacatcaagagagttgtcattcctgaagtagagtataatttatttcagtttactaattagtattgaaaatagtgataaaaatgtctttagttatgaacatagctttagtattcaaaatgattagtttgcaaatttacattttttgatgtttaaaacttttgcccacagtatataacacctataatagcagctaaaacataatttcagaaaaaaataattttgttcaatagagtctcactggatacgcaaattatatttcatactcaaaggcagatcccatgacaaccaatagatgggcaactcaaaactacctcaattgtagtttggaagattgtgttgtctcacaataatttattggggcattctatttttcccttagtgagtttttgcttacatattattatttctgattttgtgttttgttcacttgtctatgtatgtgtatgtgtgtttgtgtctgtgtct

SEQ ID NO: 3171 - DNA, 1000 bp, mus musculus
agaaagttatagtcaaatctggaaaaaaagaggacaggtctttttaagttatagctaaacagcatgctttttacattcatgtcatgatccaatccactttgtacctcaacttgcagtctctcagagtcagacaatagcttcctgttcctttcatcatttatgcatagtgtcactgtttttcccaaaatgaactagtgtacttttcactcaaatgactattttcttggcaagtgggttactaagaattgcctaaggctagaaggagattttgagaaggaataatatacacatcaagaatttcaggtaatgaaagcttcatagctaggaactacttttcatggaaccagaaggtgctatagaaccttccaaaagagaaaaccagccaacggttctacttagctatgatgccaatgaaccataacaagagtgcacatggcaccattaaccttaatggtacaatagctagacacataccctgataggaaccattttctaattgaacctcatttcaggaagaagcccatacctagagctggaaacctagtgaactgcccaaggcagtcatggttcttgaaggaaaatatccaactgctacttttactaactcaaaataatctctaagcatatttgaaacatctataaatctacccacaaattaggatagctccacccatcatcaaggaaaactttctttacaacacaatggagacagaaaacacaactgataaaatgcagagaacaatagaccatgcgatacacattctcatgtattgcatctacaacacaactcctgtatctaagactcagcaatcattgcagaagagtagtggggaactcatagaagccagaggaacagggagtttattgtgaagctgaaacttataaaaatttcagaaactgtaaccatggagtcccatctacatggctgcctaaacaggacttaaatatttcatcaatagacatactaacatggaaaggagaaagttcacatgacaccaac

SEQ ID NO: 3172 - DNA, 1000 bp, mus musculus
gtgaacagcaccatcttacatgtcaggagtatgaatggaacaaaagaaaaaaatgggaaaatccatctagcacagccattttccctttctgactgctggtcagcatgctataagctgttctgctctagcatgtcttcactgtagtgatgaacagaaacttctgatatcatgagccctaagacagtcttttcttctttatatttccccttgactgtatacctttccatactgagaaaacgtttatcatatacacaaccataaagatctttgttgatttgctgcagacaaagtcaatcacaaggagctggagaaaatgttcttgcagaggacataggtttactttcccgcacttatttcaggcacctcaaaacattatgaaattccattgccagcagaactagaacttgtctccccttattttccctttcccctgagacctgcaagtatgtggtatacttatgcacacacgcacacacacgcgtgcgcgcgcacacacacacacacacacacacacacacacacacacacacacaataaataaacacccactccaaagcttaacggtcatcaatcacaaaaaaaggagccaggaagactgtatgattcagagctcagggggcctagggtgagacagtaccttctggatatgagaaggtcactacatgcatgaactcacaacaactgttttgctaagcaagatcaaatcaaccaacaatgcacctgtgatggagagggattcataaattgctacacatagctggggagctaggaaaggttgatggctgcttagggagaaggggttttctttacatgtgtgggtctctgaatcaaccatgcttcagaagatgatccctgacccatgtatatatatatatataggcagaataaccttggactttgaacgttattaaaacataaaagaagatatgatgctggtagagatgaggaggaatcagttaaatctgcgaggaattgggggaggaaggaaaagtgaatatga

SEQ ID NO: 3173 - DNA, 1000 bp, mus musculus
tttattagatattttctttatttacatttcaaagttaccccctgtcctagtttcccctctgaaaatcccctccccactctcacactgcttctcaacccaccccctgcagattcctggccctggaattcccatatgctgggtcatagaaccttcacaggactaagggcctaccctcccattgatggccaactaggacatcctctgctgcatatgcagctagtgctagagtccctccatgtgttttctttgattggtggtttagaccaagggagctctggggttactggttagttcatatttttgttcctcctagggggctgcaaaccccttcagctccttgggtactttatcaagctccttcattggggaccctgtgctctgtccaatggatgactgttagcatccacttctgcactagtcaggcactggcagagcctctcaggagacagctatatcagggtcctttcagcaaaatcttgctggcatgtgcaatagtgtctgggtttggtggttgtttatgggaagaatccctaggtggggcagtctctggatagtcattccttcagtctcagctccagattttgtctatgaaattccttccgtggagaattctctgctacatatgcagctagagccacgagtccctccatgtgttttctttgattggtggcttagtcccagggggctctgggggtactggttagttcatattgttgttcctcctatggggctacaacccccttcagctcctcgaatacattctctagctccttcattgggcaccctgtcctccactgaatggatgaaagtgtgcatccacttctgtatttgccaggtactggcagagtctttcaggagatcactatgttatatcaggctccgcaaaatcttattggcatgtgcaatagtgtctgcgtttggtggtggtttatggaatggatcaccagttgggacagtctctggatcgccattccttcagtctctgctctgaactttatct

SEQ ID NO: 3174 - DNA, 1600 bp, mus musculus
ctatcccccctttccctctcccctttgcctctatgtgggtgctcccccactctcctacctagtagcatcattgctctagcatacccctactctttggcatcaagcctccagaaaaccaaggaatatttgccttttattctactaatttgaatatgaaagtaatacatatatatatatatgtatatatatgtatatatatatatgtgtgtgtgtgtgtatatatatatatacatatatacaacctgaatatcacttacaatttgaagattatgaagaaaatactatatatttttattagtagatttttgcactccatttctgttttaaatagttattatgctctagctcatcaatgtagttgagacatggttacctggtatttcacaaagcaattgtgatagattatttttattaaattatttgatttatttacatttcaaaagttgtccccttcctgtcccccccccctgagttcttcatatcattccccatagcaattgcctctgagagagtgctcctcaactctctcacgtacccccatctttcatacaccagcatccttcttgcctggtgcatcaagtttccacaggattaagtgcatcctcttaattgaaggcagacaatgcagtcttctgctatacatgtgcacaggactagagcagagtatgtatgctccttggcttttggcttagtctctgagagctctgaggggcccaggttagttgatactgttgttcttcttatgtggttgcaatccctttcagctccttcaatccctcctctgtcttttccatatgggcccacaatctcaatctaatggttggctgtaagtttctgcatttgtctcaatcagctgcctctgagagggcagcaggctctcagaggacagccatgctaggctcctgtctgtaagcacaatatgacatcagtagtggtgtcagggtgtgtgcataggatatatcccaagttaggtaggtcactgcgtggcttttcagtctctgatacaattttgtccctgcatttccttcagacaggaacaattctagaagatgggtgggtgcccccctgcctcgactgggacccatgtctatctactggaagtgatttcttctagttccacgccccccccattattggacattttggctaacgtcatccccattgagtcttggtagcctctcacatcccaggtctctgggaccttctagaggttcccctgccccctaattgactcatatttcaattctgccttcttcatctttttcctgttgaattgtcttgaatatgcttctattcttaagtaagaaaaataattagaactttctaaaattcatgaccttccttcctttaatgattcaatcatgctttctagatcttcctcattcctttttttgaccattattctttgtattacactttcttttgacatatacatgacagttttctcttaaattctgtaatcctctgcattacctacctggagaacttcacattctgtaatgcatatatcatttctaaatgtttgtatttatttatgcatgtgaatgctctgcctacatgtacataagtgctatttacagttaaccatctaattgtccta

SEQ ID NO: 3175 - DNA, 1400 bp, mus musculus
tgaataccacccatctgagtacacagttaggaagagatgctgactgatacgcctatctaaaatgtgtatttgtatgatccacttgtagatctgctcctaagacatattcttttgctttattctcattcatgcttgcagtgttacaaagtagttaaggagaaaatgattggcatccaatcggaatctgaactatggttccattatttattggttgtgatctttcacaaatcactgtacctccttaaaacttagtgccatgtgaggatttgtggagaaggagtaggtgtaggtatgtgcatggtcctgtgtttctgattatttttgtgggggttgaatgtgaaggtgaggtaatgcgtggatttgtgtgttcatgcacttgaaggccagagatcaatctcacatgttgctccgtgtgagtcttgttttttgacatagagtctcaatagagtctcagtagctctgtggctcccacctgtcccagaagctgtcagcttctgtagtccacactctcacctgtgcagactagtctaggtaggatccgggaaccaagatggctctcccaggtgctacagcatagctgtctcttgtgagtctatgccggggcctagcaaacacagaaatggatgctcacagtcagctattggatggaccacaggatccccaatggaggagctagagaaagtacccaaggagctaaagggatctgcaaccctataggaggaacaacaatatgaactaactagtaccccggagctcatgtctctagctgcatatgtatcagaagatggcctagttggtcatcattggaaagagaggcccattggacacacaaactttatatgccccagtacaggggaacgccagggccaagaagtgggagtgggtgggtaggggagtagggtggagggtataggggacttttgggatagcattggaaatgtaaatgaagaaaatatctaattaaaaaattaaagaaaaagaaatagagtctctcagtaagatctggggctcgtgtgtttagctaggctgatggacaagagaataacagcaatccatctggctctgcctttccagtgctttgagtacatgagcttaccaccattcttagctttctcaggagggttctagggctgaagctcatgtcctcttgcttataaggtcaagacattaactacaaagctgtcttcttaagatctaattactccatcttcagacatagtaagaacatctactccataagttcacccttccttcaaatgaagcacagtgtgtagagtacttatgtaacatttgacatattgtaactgaaaagtgatccttatcaggaaccatataaggtttaagtcatcaataacttcacacacacacacacacacacacacacacacacacacacaatc

SEQ ID NO: 3176 - DNA, 1200 bp, mus musculus
cagaagtgacagaaaaatcattgcagcgatagggaagttatgcacctttttgtcgagttctcaagaaaacaatacgttgccatctgggaaagcgttccattttaggtccaagcgtttgcatactggtgggctttggggaaaggcatattaatttgtatctgtttcctgcagctggatccagaaacaggcacagaggggtcaaagaccttccttctaaaagctgggagttaggaggagaaggcagaatgtcttgtaacacagaagacagcagctgtgctgagcttggctggtctctttcagcaaagaccacgaaatgtagcgacttgagtaccaaacaatatctactcagagatggcaacctaggcagcagtgatcatattaagtcttgtgcaaaatgatgggttggtaagagaactaatgatcatagaggggagtgggctcagcttgaggcctgtgtaactctctaagttctctgccctgggaaactgtggaatggaacatcagaaatccttgctgtctgggctgtgcagtttcatttggggaacaggcaatcagttctggaaggctggccgaatagagtggacagaatgatagctcaaaatgagatccatcaatgacttctttgcagccctagccaaacaatcaaaagcaaatagtcagcttcaaaaatcaatgtttcgtgagatgatgagccaaccagtggagttctcgtgaggtgggatggaaaggagaactaagagggaaaacagaaacatttttttcatactacccaccaaagccagcagctgcagttccttgaaacagcagatttggttcctagcaaaatcagacctgcagcctcctagcagaacaaaacaaaggagcagggggcaagacatttttgaaaacgggaaggcgttttggcaacaatcacaggagggctggtaagccattgtgctctagggatctatctgctgagctccagaacaccctcttctctctccacccccatctagctctcagattgcaaacacagggtcaagagctgggtcacttgtgaagaaacagtaaagtggaaaagacggactcagccagaagttgaggagaagagcccggatccaatttgttccactcatgaaggatgtggtataagagacaggaaagcccttctttttctgccatggcaagataataagagtgggcttaaataagttaatggga

SEQ ID NO: 3177 - DNA, 1000 bp, mus musculus
caccccccatcccactgtgagggagaaggctctgtttgtccctgaaaacccaaacagcagccttgaaaatcagggccagattaagatgtccattgatgaagtgtgtcgagagacactgttgtgttgctgcaagtcttttctgcagcaggcaggattaagtctgctaataagcatgacagtcattaataacatgcttgccaagtctgtttcagacctgaagtttcctttgctatccaaggggagtggatgtgcagaggtgcggggcttggaagagctgatgagtttgtctgaaaagccagtgctggtgggggaagcactggctgcccaaatgctctcctccttcatgtgcctctttaccagaagtgggagcagagagatgcttgtggaagccatctccccttaagtggctgtctcagaaagaatgagactgaagccacccagagcctgagcactttcctgagggcaaagaggctgcagtgagtgccactaaggatgcagctttagccagtcagctcctccctgggtgagagttccttccactgtctaaatggagggctacactctgactggccaggcaaggctcttccagagctgtgggcaacttctgggttttgtagtttgcaggtaaagtgcattgtaaattgctgccctgcagccttcttcatgtggtaaagggtaaggggctccccgtggccactagctggggatgactaacagcaaatcacagcatagaggtgaagggtaaggggatgcccgcggccactagctggggaaactaacagcaagtcacagcatcagagtgaatgttgctgttgcctgtggtgatctccctgtctaagcgctgaaccacttagcagaaatgacacccatatgagagcttgtgccaaatacccttctgctgctgctgctgctgctgctgctgctgctgctgcttagatagaagtagttcccttctcctctgtcctacactagctgatggatggctagcatgttaatcaag

SEQ ID NO: 3178 - DNA, 1000 bp, mus musculus
agaagcaggcctcctaggaagatgaactgaacattgcataacaagttacaataagaataggcacaagccctcatttcaagactggatgaggcaatgtggtaggagcaagaatctcaaaagcaggcaaaagagtcagagacagtctctgctcccactgttgggagtctcacaggagcatccagctccctatccataagtatgtatgcagaggacccagctcagacacatacagggtcaagatcgctgcttcagtctctgtgatcccctatgagccctgcttagttgattttatggagcatgttctcctagtgttcttgacccctgtggctcctacaatccttccctcccctttcctgtagggttcctagcacttgcttgcctgtctctgcatctgctcccatcagttgctggatcgtgactctgatgacaattggcttaggcactgatctatgagtaaagcacaataccattaggaatcatttcattgactttttttttttttgccagtcatgtttaattctatcctgggtctctgggctgccctgtctctggttcctggctatccaggcagtgtcaggggtgggctccctctcatgacatgggcctcaagttagactggtcattagttggccacatcttgaaggcagggtagattgtaggctgaaggttttgtgcctgggttggtgttcacagaaatcttgcctggttacaggagaaggctggatcaggctccaactccatcccccattactggaagtcttcgctagggttaccctggtagattcctgggagtttccattgcactaggcttctacctccacctccaaatacctacctagtgccagtcgtctctcccagtactccctcgctccacccctgacaggttccctcctgttcccatctgtccctgtcttctcacaaaatatggtatagttttaaatgtctccaatttaagcacaaaacagacatccaaaaactaacctataaattctaaaaatcc

SEQ ID NO: 3179 - DNA, 1200 bp, mus musculus
cactctgagtaagttgatgtataaatttaatgaaatttcaaaaatacctacaaaattttatggcgttagacagcctgattgcaaagtcataagagtagctaagaagatgagccgtatggaagaagctaagaagataagccaccctgagcaactgccagcctaggggtaccaccaatctcccttctctccctgactctcttccacctttaccagactcctgaaccatactggtaagcttcccttcccccacccatcttctctgctggctgagccctctaggtaaagctaagctgccctgagcagcctgccatcccagagtgggggacctctgttctctagctgccctccccctacctcatcagacttaagactcctaaaccatacagtttagcttctctttccccactcagctatcctgctctgcctgagacccatcatccttcctgtctgcatcttcatctttcagatggaacccctggcagatcaatatgcttgctcctggacaccaaagtcagcctgtctcactggaggtctgccctagccaaggacacgggattgcaggaagattgcttgaacaaggaacacaagaggtctgccctaaccagagaaagaatctgactgacacagatacagatacttacggccaatcattggaatgagattggggacccttatggaaaagttaggggaaggattgaagtgacaaccccataagaagaccaacagaatcaattaacctgaccccagggagctcccagagactaagccaccaaccaaagagctggttggtggccctcagcatgtatacaacagaggatgagcttgtctggcctcagtggaagaggatgtgcctaattctgtagagacttgatgtccgagggcagggtgatgcaaggggtgggggcgtgtaagttggttgtgaggtgggtgggtggcatgggtaggggaactccctctcagaggtaaaaggtaggggagatggggtaaaaactctgggaggagggacgtggaaggtgggcaacatttgaaatgtaaataaataaaaacattttttttaaaacaaaagaatagctaagaagaaagaagacaccagagtagggacttctgataccataataagaaaacataaactttgtggacaactgtaattacagcatcatgtcactgctacgagaatagacaaatagtttaataaagtag

SEQ ID NO: 3180 - DNA, 1600 bp, mus musculus
cactaagatcaaacccccaacacaaatctcagtgcctgctccttcccaactcatctcttaaaaacacatgtatgatcctcatccacgtgcatggagagtctctggagagagtgagaacctgccacccctacaggtataaaagctatgaatacataccagagattcatgggacacatacacacacatacagacaaaacacgtgtacacacacacacacacacacacaaacacacacactcacacacacacacacacacacagagagagagagagagagagagagagagagagagagagagagagagaaagggagggagggagggagacagagacagatagacaactgatctttgagtgatcagggatcagcgcacatacacaagttaataaagatgagaaaatccaatgtaaatattcagttggaatactccaacgtagaaataagcatctctaagagagagacgctttaaaagatattttgcccattgtattttattcttgttttctgctatgcctatgaatcatttaaaatttacatttttcttttttcaaatttatttttttaaatttgttttctgtgccccatattacattctctgcctctcatccaccctccgggctgctctacatcccataccccctccccatcccaccacgactctacgtggatgcccctacaaccatcccacctgacctctaaactccctgggacctccagtctcttgagggttaggtgcatcatttctgaattaacacagacccagaagtcctctactgtatatgtgttgggggcctcatattagctgtgtgtttggtggtccactgtttgagaggtctcaggggtccagattcattgagactgagggtcctcctgtaggatgtcccttctgcttaacttcttttagtcttctctaattcaaccacagggttcggctgctctgtccattggttgggtgcaaataactgcacctatcactttcagctgcttgttgggtcttctgaatggcagtcatgataggtgcctttttgttagcactccatagcctcagtaagagtgtctggcattttaaaccttctattttttattcctgtctttacatttacctagttttgttcacacatatcttctgattaatgcactcttttcctccttcccctcctctttctaacaggcttccatttttcttctccactttcctttcctttattcagcattgcttcttcttcttaggttcctccaccacctaattaacttcatgcatttactatttctactctgacccacattcagttttaactttacggctcactgcacactagttttgtactttctgctctattctcatttgagctgaggtagttgaatttaatcaacttcctttttattacagacatggtctgtattggtgtttcagctgttatagtggttatttctgtcctctggacagtactgaagatttagcctggaagaggaagctgttcactaacatttccaaataaaactagaagaaataccaatagcgagtgatatagaaatgagagcacagaagcacaattactgtgaaaacctggaaatgaccataacccctcaaatgtaact

SEQ ID NO: 3181 - DNA, 1600 bp, mus musculus; identical to SEQ ID NO: 3180

SEQ ID NO: 3182 - DNA, 1200 bp, mus musculus
tgttcttgtacatagttgtaaaactcctcaagaaagcattagcaaattgaatctatcaacacgtggtataataaaacaccccaagttttgttcgagtatattaacaaatttaagataaataaaatgactgtgttaccagccatgaaaaaatgctgtaaataaaaaccatttgccaaaattttagaattaaggataacttttattttctgtgttttaaaactttttagacatatttattttacatatatgagcgtattgcctggtgtgcatggaggtcagaagaattcactgagttctcaggaactagagttctgaaccatctctcctgcaatggcctggcttttaagttaaaaacgtattctctctctctctctttttaaaattttatatttttgatttttgagacagggtttctctgtgtagccctggctgtcctggagctcactctgtagaccaggctggccttgaactcagaaatcctccagcctctgcctcccaagtgctgggattaaaggcgtgcgccaccactgcccagctaaacatttctgctctttggtccactagatgtgaccttagttctgagtttgaagtctcactgggagaaagtcaggcagtgcttaagtcatactcatattttccatgtaacttttcttgaaaaaagatgtaggcagatgcgtaggtacctaaatgtgatttgccagtcaggacagggcctcgtagcctcgagaacagcagtgagctgaggtgagagaggtcagctgacccaagctaagccaataggaatcgcccaggctgagcactaagtttgaaaaggaaccgttgacctcagcctcatctgggttccgggactccgcgggacctaggaaattagtctgaacaggtgagagggtgcgccagagaaccggacagcttctgggacgggcagaagcacagagccgctgaggcagcagcctgggcgggccgcagacaaccggccaccatccggaccagaggacaggtgtccgcctggcttgggaggcgacctcagcctcagcagcagcggtcgccatcttggttccgggactcagcagaacttaggaaattagtctgaacaggtgagagggtgcgccagagaaccggacagcttctgggacgggcggaagcacagagccgctgaggcagcagcctgggcgggccgcagataaccggccaccatccgga

SEQ ID NO: 3183 - DNA, 1000 bp, mus musculus
atgtaaagacaggaataaaaaatagaaggtttaaaatgccagacactcttactgaggctatggagtgctaacaaaaaggcacctatcatgactgccattcagaagacccaacaagcagctgaaagtgataggtgcagttatttgcacccaaccaatggacagagcagccgaaccctgtggttgaattagagaagactaaaagaagttaagcagaagggacatcctacaggaggaccctcagtctcaatgaatctggacccctgagacctctcaaacagtggaccaccaaacacacagctaatatgaggcccccaacacatatacagtagaggacttctgggtctgtgttaattcagaaatgatgcacctaaccctcaagagactggaggtcccagggagtttagaggtcaggtgggatggttgtaggggcatccacgtagagtcgtggtgggatggggagggggtatgggatgtagagcagcccggagggtggatgagaggcagagaatgtaatatggggcacagaaaacaaatttaaaaaaataaatttgaaaaaagaaaaatgtaaattttaaatgattcataggcatagcagaaaacaagaataaaatacaatgggcaaaatatcttttaaagcgtctctctcttagagatgcttatttctacgttggagtattccaactgaatatttacattggattttctcatctttattaacttgtgtatgtgcgctgatccctgatcactcaaagatcagttgtctatctgtctctgtctccctccctccctccctttctctctctctctctctctctctctctctctctctctgtgtgtgtgtgtgtgtgtgtgtgtgtgagtgtgtgtgtttgtgtgtgtgtgtgtgtgtgtgtacacgtgttttgtctgtatgtgtgtgtatgtatcccatgaatctctggtatgtattcatagatttatacctgtaggggtggcaggttctcactctctccagagactc

SEQ ID NO: 3184 - DNA, 1000 bp, mus musculus; identical to SEQ ID NO: 3183

SEQ ID NO: 3185 - DNA, 1200 bp, mus musculus
cttcagcccactgcttttattaagcaataatgtccattggtgtgatgacttctatttctaggatttctatcctactttattaaactatttgtctattctcgtagcagtgacatgatgctgtaattacagttgtccacaaagtttatgttttcttattatggtatcagaagtccctactctggtgtcttctttcttcttagctattcttttgttttaaaaaaaatgtttttatttatttacatttcaaatgttgcccaccttccacgtccctcctcccagagtttttaccccatctcccctaccttttacctctgagagggagttcccctacccatgccacccacccacctcacaaccaacttacacgcccccaccccttgcatcaccctgccctcggacatcaagtctctacagaattaggcacatcctcttccactgaggccagacaagctcatcctctgttgtatacatgctgagggccaccaaccagctctttggttggtggcttagtctctgggagctccctggggtcaggttaattgattctgttggtcttcttatggggttgtcacttcaatccttcccctaacttttccataagggtccccaatctcattccaatgattggccgtaagtatctgtatctgtgtcagtcagattctttctctggttagggcagacctcttgtgttccttgttcaagcaatcttcctgcaatcccgtgtccttggctagggcagacctccagtgagacaggctgactttggtgtccaggagcaagcatattgatctgccaggggttccatctgaaagatgaagatgcagacaggaaggatgatgggtctcaggcagagcaggatagctgagtggggaaagagaagctaaactgtatggtttaggagtcttaagtctgatgaggtagggggagggcagctagagaacagaggtcccccactctgggatggcaggctgctcagggcagcttagctttacctagagggctcagccagcagagaagatgggtgggggaagggaagcttaccagtatggttcaggagtctggtaaaggtggaagagagtcagggagagaagggagattggtggtacccctaggctggcagttgctcagggtggcttatcttcttagcttcttccatacggctcatcttcttagctactcttatgactttgcaatcaggct

SEQ ID NO: 3186 - DNA, 1800 bp, mus musculus
attaagatgttaggtatggaagcatatatctgaaatttcagtatcaataaggcagaaagagaaagttcactaaatttgaagtcaatgagcagttacacagtgacagtgaaaacaaccatctgccttaaagagcccattacaagaaatgaaatcaccctgatttacagcaggtatgtgatcatgtatttgctcttctggcgtgaaaaacatttttgtttgtttgtttattttacagtattgaatacagtagaagtggaaaaggtatctatacatttcagtctttgctgtttttaaaagactagcacataaaaattaatggcatatgaaactatgatgtaaatacggaatatgattctttggagttgacgtctcaccactttcgttatcccagttgacgcagacctcgaaattcctctcacagcccaggaattgccaccacgaatggttcaggaatataaatcttggaagagggagtgaaaggatgtaatgaagaactttaaagagaaaataggaaatggttagttacatacttgaagctacctccacctcggaagaaatttatgcatcgcccaacatggaaccattgagtccagatcacagattaattcctctaccctggtcatttagtcccaaacaagtttagtagattattatgggtcacctacgtgggcggacttggagattttcttttcgttttttttcttttctttcttttttttcctttcttcttattttttttaacttttccactccctcagcagtgttagtcgttcatttctggagaggagttcgaggtggtgggcgtgccatagtctttggtggaagctgcccctcaacggtccctgcccaatttaaagcagccgctggtaattctgattggctttgaagagtcagctgacttgtctcggacccacccacgttctactctacctcgagacccgtaacttccattgtacctcgagaccaatgacctgttggcgcaatatcagtaggtttagattatgtgcctaaccacctctacctttgggttaggaattggtgattaggggttagagataaggttaggattacttaccaattaatggaaaaataaactcatataagtgagatatagccattatctggctatagatttaccaagccagtccataacttattgtcggatttagctgacaaagccctaattatttgttcaactttaatcccactatacttttttattcttttctacactaccatccaatcaaatataactttcattatcgtcatcaacaacaacaaaaactaaactaaaattccaggagaataaaagtctgtgcctacctcttatttcaaatttgtagcaaatgtgcacacttagtcttcatgtgggtcccctaagaattggagtcaggggttgtccttgactctgttccctgcgtttagatctctttccccctacttggacagcgtagttgggcctcagtgggagagaatatacctagtcctttggactagatgtcccagggtagggtggggtggtacccaaaaggggcttccccttctctgaggagaaggggaggggccaaaggggagatggatttgcaagggcgggattgggaagagaggagggagggcctgcaattgggatgtaatgtgagtgaacaagtaaattatggaaaaaatataaactagacatataaatacattcaacccacaagactgtggacacatttagataatgaaaacataaggctcagcacaaccacttgacagtgttgaaatgttgctaattataataattatcactgggtacgtgtt

SEQ ID NO: 3187 - DNA, 1000 bp, mus musculus
ttctcatactgtaggagggtttctgggctctagtggagacatattgtcctggctgttatatgtgttttcatgctagcatctaggcatctgggtttgggatgattctaactctaggtgctgatatctggccttgtccttttgggtggtgggtgttttgtttcttggtttctgttaacttcactggcttttaggagtgtgggcactgtgttttgcctggtagggagttcttctgggatcctgataggtgtggccactgggatttctggtaaaatgtgtttccagatgttgggacctaacacgtaggaatggggatgggctaggtgggggagtctgagaggtctacctgaggaagacaacagggcgtgccaccagaatctgtttcgttccctgggaattgggacaaagagtgcagagaccacaacagggctgaggatgagaattggggcttgaatttggaggagaatagagagagtgaagacttgaagctcacctttctgcttcattggcctacttgcttctctggcaggctcgcctggtaggttccagggttatttctgccagaattgggggttgggataacaggatgagaggagaagaaggttgcaggatctgtcagatgggagcaaagacgaggggctggctacagcaggcagtgcttcagagttgggagtgagactgggggattggattggaaggagaggagatgtgaagatatgcagttaggctgcctgcttccatgcccaaagtccagatactttcatacattattaatcgtgctatagacaaatacaatcattttaaagttcaaatgagcaacagtaactaacatctaataatttatttatagggtcatatataggttaagctggaggttgggcaaagtcccttacagtcagaatgcatgtgttgggtggtagatgtgagccacaaactagacactggttccccttaagcttcgctaagatccaatatccaatttgtgtcacatcaaacttcttac

SEQ ID NO: 3188 - DNA, 1600 bp, mus musculus
agaaatgacacagcaaagcctttgttttgatacaggtaatggctcttaatcagggagggattccattatcattttaaatagacacaaattatggacccagtcctcatctcatctactataatggctggggataatgggggtgtttaagaatccccaagttgaagactagcaatgagtatgctggagcccaggaagataggacagcccaagtgactttttatgttccagacttaacgagcatccaggaaggtctccaactgtttcagtccagagaatatcccaatttgggcgacttttactccaaagagaactctggtttactgtggtggtatgtgaaggaacagcagtctagacttgcttttacctcccttctcgagagacagagagcataaacagcagcaaagggggttattggaggcccccagtgtgtctgcagaacctccagttagtgtctaataccatgaattctgcccagcccctcagtttgctactggcttcctttagccaatatatggacctgtggacgaaccttctctggcctcatgtgtttccaaaggctcgagtagctacagaccttcttcagaggccttgttcctctggaaacaggcaggcacgcatgtgggcatgtgcctgtgtgtggtgtgtgtgtttccacacctcagctaacaccagaagcaaaaaaaagagagacccaggtcattgcattcctatttggacatcactcccctaacccaggggacatgggatcaggaaggctgagatagaaggaaaacaggaaagccagaggctgggcagggcctgcttcagtgaacagatccttagtctgacagcaagaactggcaccataatgtgtctttaggaaagaatgcagaagaatgcagcaacagagcacccttggctggaggaacccaggcagacaggtcctgctgtgtgaaaacaaggggggtaattagagggaggacaggctcctctgttcctgccactggggcaggaaaccctgggccagaaattctccctggactccctcagattccaacagagaaagtcaggggcctagagactgttgccatggcagcagatatccagggctgacagcctcttctctttctgcatggctgctcagtctgtattctgatacctttagtttcttctgccagaaaaggcattttaccctgcccttgctgtgtattaacatggcttgaaccattcaggaaccgtttttttagaaaagtattcaaatgcaaaattattcctgccacaatgcctaggtgttgtgttttacatcgtttttgttttcagtgatttgtatctaactcttcacagatactacatatatattcaaccattgaactatgttctcagcctctgtccagtctctctctatatctctgtgtctttgtctctctgtctctatcgctctatgtatgtgagtgtgcatgtgtgtttacacatgtgcatgtatgtacacatgtatacatgtgtatacgttgctttttcctgtgtcggtgttcagctacagcaagcacttcatcctctgagccaactcccccaaaccccatacccaggtttgacaacacattgtgggggacagtattaaatt

SEQ ID NO: 3189 - DNA, 1000 bp, mus musculus
actatcaagaggctggggagatagctcatcatagggtgcatgacatggaagcacgagggcctggactcagattcccagcatccgtgtacaatgcagggcacagaccatggcagtgtgcatatgtaaccctagtagtggaggtcagaaacaagcacttcgctggaattcattgaccagtgagcccagtcagtctattaactccaggtttagcaagagatcctgtttcaaaaaataacatgtaaagcaaccaagaaatcacttcaagtcaacctctgtccttaacatacatgtgttgtgaacacactcacatgaacaaatgcctgcatgacatacacacacactgcaatgatgataatgataatgataatgataatgataatgataatgataatgataataataataataataataataataataataataaatggaatctgctaagcatggtagcccatgtctttaatcctagcatttgggaggcaggagcagatggacctctatgagctataagtcagcctggcagatgtacataacgatttccaggccagataaggttatatagggagatctgtctcaaaacagacacctcgaaattttcaaaaataaatgaataaaaacgagcaggtaatctgagtattcttttaccaaaaagatatataaatatagtgaatatatatagaaaattcttggcattatggatcatcaagggagtgcaaattgaattcaccataaaatattataacacacctactacaacagctataataaaaactcatgtcacggacttggagagatgctttagtagtcaggacatttgttgctcttccagaggacctgggtctggttcccagcacccacaggtggttcacaactgtctgtaactactgttccagggtaatgaatgtcttacaaaatgcaatatatctccacaacagaatattattaagtcacaaaagaataaagtgctaatacatattataaatgtatgaacttgcaa

SEQ ID NO: 3190 - DNA, 1000 bp, mus musculus
gaaaaatcaaatcaaatcaaattcacacagcgcagtgcaggaagaggcacagagagacctgcgccctgccacgctgctcggtgtgggcggggcgaagggaagacacccacagaccttccctaccccacagcacaggtgggccacagatacacagagttccgcctatctccacacagctcagcgagggaggaggaagacatacagagacctgcggacttccataccacccagagacctgcctgccctctagagcacagcttgcacttcaacaggagcaccatagataagcatttgccatcatgtcatgcagctcttactgaggatggccaccctcgggtctgggagctatgtggccagtctgcagtgggaactaccataatgtgcaggtagacatctttctgaagagggatggaaatggagactctgggatggtactagagaggtgtaaacctgttgtgtgtggccaccccttctggagccatagtgaggtccgagcccaagctgttgttgtgggccatgtctgggtccatagctacttagtagcaggcaggggtcagtgtcaaagcccatgaatcatattaacactatagaaaatgaggatattctgggtcagggccgtctgccgtcactggctgcagtgctctggcgaattggtcccctcacttgggagagcaatactttgcccagatagtacagtagaggccctggtggtgggagtgtgggaaagccggcctccagggtgtgagctagggagagctggccccaccattcctctgccacgaggtggcctaggcaaagggagaagccttgccccctgcaccttaaattgttatgcagtcaggagagctcatcctggggtgaagagtgagggagagctggctccagcacccatctgttgtgaggtgcaataggtgcagggtgattcccttctcctttcccctcttgtcacctgggataattgggagagttggctctgagatagggagagctagccatgctg

SEQ ID NO: 3191 - DNA, 1000 bp, mus musculus
agtctccggacacccgcaaggacccacaaaggatcccccacaggatcctaagacctctggtgagtggaacacagcgtctgctccaatccaatcgcacgggacctgagactgcattaactaggaaagcagataacctggcctgatcaggggcacaagtctcttccggtcccctccagcaccggggttccttccctgtggagtttctggacacccccaaggtcctcacaggaccctccacgggatcttaagacctctggtgagtggaacacaacttctgccaggaggcagatttgaacaccagatatctgggcaccttccctgcaagaagagagcttgacatcagagaatactctgactacagaaattaaggagagagctagtctcctaggtctgctgatagaggctaacataatcacctgaggagcaagctctaatcagagacaactataacaactagcttcagagattaccagatggcgaaaggcaaatgtaagaatcctactaacagaaatcaagactcgacatcattagaacgcagcactcccaccccaacttgtcatgggcacccgaacacacccgaaaagcaagaccctgatttaaaagcatatctcatgatgatggtagaggacatcaagaaggactttaataactcacttaaagaaatacaggagaacacagctaaaaaggtagaagaccttaaagaggaaacacaaaaattcctttaaaaattgcaggaaaacacgaccaaacaggtgatggaattgaataaaaccatccaagacctaaaaagggaagtagacacaataaagaaaacccaaagtgaggcaatgatggagatagaaaccctaggtaagaaatctggaaccatagatgggaacatcagcaacagaatacaagagatggaagagagaatctcaggtgcagaagattccatagagaacatcggcacaacaatcaaagaaaaaacaaaacggaaaaaagatcctaactcaaaacatcc

SEQ ID NO: 3192 - DNA, 1600 bp, mus musculus
ctgatgttctctatggaatcttctgcacctgagattctctcttccatctcttgtattctgttgctgatgctcagatctatgattccatatttctttcctagcttttctatctccagcgttgcctcactttgggttttctttattgtgtctacttccctttttaggtcttagatggttttattcaattccatcacctgtttggttgtgttttcctgcaattctttaagggatttttgtgcttcctctttaatgtcttccacctgtttagcagtgttctcctgtatttctttaagtgagttattaatgtccttcttgatgtcctctaccatcatcatgagatatgcttttaaatccaggtctagctttttgggtgtgttggggtgccctgggctgggcgaagtgggagtgctgggttctgatggtgagtggtcttggtttctgttagtaagattcttacgtttacctttcgccatctggtaatctctggagttagttgttatatttatctctgtgtagagattgttcctctggtgattctgttaccgtctatcagcagacctgggagactagctctctcctctgagcttcagtggtcagagcactctctgcaggcaatgtctcctcttacaaggaaggtgcacagatatctggcatttagacctcctcctggctgaagatgaaggcccaaaacaagacctttcccagaagctgtgttgctttgtcctgtcctagaagctgttagcttctgtggtgcacactctcacctgtgcagactactttgggcggagtcccggaaccaagatggctcccattgatcctgaggcaaagggctcccgggccaggaggacacctgtcctctggccaggagggtggccagatgtctggggcctgaaaaggggactgtctcagaagctctgtggctccggtctgtcccagaagctgtcagcttctgtggtgcacactctcacctgtgcaaactaagttcggtggagtcctggaaccaagatggctcccgccaatcttgaggctggaaatcatcctttttgttgtctataatttaaaactgtataaaatgtaaattatacctttctcttgaaatctcattagaactaaactttgagctagtctttccaggaagactttcaatgctcaaatttaaaaattaagtagtattatggtagttaattcctatacattatgatttcctagacatgttcccagttttcagctttcagaaacattggtcttcagttaaatgatattattttattactgttactcgtccttatgtccacttttcatccattcatatgatttgtgttcttactgttttctttaaccatactcactagaaatttactcatttttattatatttttcctcctgatgaaagacattctggttttcttcttttactcataattaattagctttagtctttaatttattatctaccccctttttcttttggctttgtcctcttgatatatatatgtagcttgtcataggctttttgggttgtcactctttattatggctattcaatgctatattttctcctcagaatcttgcttttgtttcatccaagaagttttgctct

SEQ ID NO: 3193 - DNA, 1000 bp, mus musculus
ttcaactataagagtaaacctgtgtgaaatttctattattatagtcattttccagataaaccaagtctaagaaaggttgaagaattaattcaaagtcttataactttgagaacatattgagaagtggactttattgagccaataattctgagttcttaatagcagcaccagtcaacctgacgggtgcttatatatcatgagaaaacaattaaagagtgaagccaaactgaaccctctggaaattctagttcagttgatctgcggtgtggaatcagcactgtcagcttttaaaagcttcctggttgacttgagtgtgtgaatatgtttgggaactactgcgttagagtctacagtgtttgaagcttcatctgggccttgtgaagcggtaagctttacatggggaagagaatggagaacattccagataggaattgcttaaataacaaaggtgatgtattattttctgatttttttactgcttgagtacctcatacagtgtctttggatcaaagccatcccatactcccttgctttcaagtctttcgattccctcctatcgcttttcccttgcaactccacatacactgactggaacccactcaattcttttggtgctgctagtatgtgtgtgggtccatggccttctactggaacatgagaagcttctcaggggctatattcccaaaaacaaaacaaaataaaacaaaacaaccaatacaaaacaaacaaacaaacaacagattctccttcacttagcagccagtagccctctcaactagctcctcagctctgggtgggactttgtgaatctcttccccattcatgtggaattctgattggctttatcccatgcaggttttgtacagccacaggcactgcaattcttacatgaatgagccccaacacatcagtctgttgcagcagtgacacacaacctctggctcttagcatgtgtcttttctgcagtgatccctccactgtggcaaatacacactatacg

SEQ ID NO: 3194 - DNA, 1000 bp, mus musculus
ggcatgcatgtgtaacactatgctgcacagacataagaaagttttcttttactaataaattttgaggaatgaaaaatcagcaaaggacatgggaatttgctacagcaatatttttcccccctttggaggaggacagtctcctttaacaatagtagattggtttgtgtgtgtgggggggggattttcagtttttacaagttttgttttttgtgcatttatgcctgaatgcctatctgtgcatcacatacatgtgcagtgcctgtggaatccaaaggacagtgttacattctctggaactgtagttatatatggtggcaagcagctatatgggtgctagaattcaacctgggtcctttagaagctgtgaatgtgcttaactgaaaagctgtccttgtagctccaatttacatttttatatgtgtgtatttatttttttaattagatattttctttatttacatctcaaatgttatcccctttcctagtttcccctccaaaaatcccctattctttctcccctccccctgctccacaacccatccactcccacttcctggctctggcattcccctacactgggacatagaacctttacaggaccaagggtctctcctcccattgatgaccaactaggctatcctctgctacatatgcagctggagccatgagtcccaccatgtgttttctttgattggtggtttagtcccagggagctctgacattactggttagttcatattgttgttcctcctagggggcttcaaaccccttcagctccttgggtactttatctagctccttcattggggaccttgtgctctgtccaatggatggctgtgagcatctacttctgtattagtcaggcattggcagagcctctcaggaggcagctatatcaggctcctgtcagcaattacatttttaaagtgccaaaatgaagggttttttaggttgttgatcactagatatttttggaatttacaaccaaaaaaaatttttt

SEQ ID NO: 3195 - DNA, 1000 bp, mus musculus
tttggctaatagtttgaggatatagaaggcacgacagtaggagattaaaggaactggtcgcactaaatctaatcaagaagcacagagtaaaagatattgttactcggtggtctttctctttttttccatggagtctgatgccgtgcatgtttttatcgggcggttcaataaaattaactaaatctagtgtctttcattgacattcccagagagttgtacctgtggtgattacaggtcagagtaaattgtcaatcaagattagccatcacttggcagagcctctcaagagatagctatatcaggctcctgtcagcaagcacttgttggcatccacaatagtgtctgggtttggagattgtatatgagatggatcaacaggtggggcagtctctggatggcctttccttcagtcactgctccacactttgtctctgtatttcctcccatgagtatttggttcccccttctaagaagcagtgaagcatccacactttggtcttccttcctcttgagcttcatgtgatctgtgaattgtatcttgagtattccgaacttttgggctaatatctacttatcagtgaatgcataccatgtgtgttcttctgtgacagggttaccttacttaggatgacattttctagttttatacatttgccttcatgaattcattttttaaaatagctgagcaatatttcattgtgtaaatgtaccacgttccgtatccacttctctgttgaggggcatctgggttctttccagattctggcttttataaataaggctgctatgaatgtagtggagcatgtgtccttattacatgttcttacccgcgttctcgcgaccggccaggaagaacgcaacaaaccagaatcttctgcggcaaaactttattgcttacatcttcaggagcaagagtgcaagagagagaaaaagaaagcaagaaaaagaacaagaacaagaaagcaagagaagagagagaaaaagcaagaacaagagagag

SEQ ID NO: 3196 - DNA, 1200 bp, mus musculus
tcttaaagtgatcactataagatagtgtggcaggcattgttattcttcgttaacagaaagctgaaaccaaggctttgagaacctgtgtcatttattagaatgcagtattctttgtagtacatcagtaacttctagcctgaacgatttctgcccacgccctctccctgaggggatctgaggagataataatgagaatctatgagtcattttcaatatttgaaaggagcctaacagagagtgttcatttactttcgataaattacacaacctgactaaaatgtcaagtttctttgcttttgcctgaaattatatccactcattttgataatactggatatcccatgctgatgggaaactgattggcagttttatatgtctctgatgaatagaaatggagaaactaaatttgaaatcataaatgttgttgatctaggtttttttcttaagttttagaaactggaggaaaagtaaaattcccctttgatgctaaaatgattgaagagagctacattacaccatgcttcccattctgactcatgatgattgcaagatgggagatgtataggaagtcatggtcagagggattttcaaagtttggcagcctaaggataaattgtttttatataataagcactcttgaaatgatggtgcatataacatattctttctgcctatgagataaggaaactgaagctcaaagcagagttgtaagggattgatcaaccttggcgatcaatagggtgacagatgttgcagcagagtatagggagggatccatggctccagttacatatgtagcagaggttgtcctggtctgacatcaatgggaggggaggcccttggtcctgtggaagtttcatgccctagcgtaggcagatgctgaagcagtgaggcaggagtgagtgagtgagtgagtgagtgagtgagagtagaagtaccctcacagaggcaaaggtaaggggggaggggtggatgggatggggatgctgtagaggggtaactgtgcagggggatatcatttgagatgtaaacgaatggaatgattaataataataaaaaaggaactcatcaaactaccagaatactagatagtggaacagatgaggattttattctagtgttgtggatcaatatttcatagcctcttgatctctatcacagagaaataaagccagttcatctttaggtcttcataatgtc

SEQ ID NO: 3197 - DNA, 1400 bp, mus musculus
tgagatttggtattataatttagttcaaaacccagcttggagaaagttatgaacctttacttctgcttttcccccatccatcatttgcatataaactttcatcccatatgtataaggagagtatttgcttcaaaaacaaagtctctcttttattgaggaaattaacaaaaacatgagatatgggcctatcgacagtaagttatcggttagggaggaggttatgtgtcctaagcccttctgctaaactattaaatatttgagggggttgaaaggaggaatacgttttccattgctgtaaagagataccttgaccaatgaaacataaaagggtagcatttatttggggctgggttactgattctgaggtgaagtccattctcataatgccaggaagcatggcagtatccagacatacatagcactggaggacccgagagttctatatcctctatatcctgttctttttttttattagattttgttttcatttacatttcaaatgctatcccgaaagtccactataccctcccctcaccctgctccccaacccacccactcctacttcctggccctggcgttcccctgtactagggcatatgatcttcgcaagaccaaggggcctctcctcccattgatggcctgatggccaactaggtcatcttctgctacatatgcagctagagacacaagctctggggggtactggttagttcatattgttgttcctcctatagggttgcagaccccttttagctctttaggtactatctctagttccttcactgggggccctgttttccatccactgtgagcatccacttctatatttgccaggcactggcatagcctcacaagaaatagctatatcagggtcctttcaacaaaatcttgctggcatattcaatagtgtctgggtttggtggttgtttatgggatggattctctgggtggggcagtctctggatgatccttccttctgtctctgctccaaactttgtctctgtaactccttccatgggtattttgttccccattctaagaaggaacgaagtatccatactttggtaaagacaaagagaagactggtttccaggcagctaggaggagggtctctcaaagcctactccccatagtgataaactttctccaaaaagaccacacctcctaatggtgctattccttggtccaagcatattcaaaacaccagaaagtgctactactatcttctgtggtatactctcttaccaactcccagtacattgttctaaacccactctcacatatttgatcctagttaaaaatcccccaaaataaagtgacagtaacagcaacatttattaatgtggtatgggtatatgcaatgaggatgagaagaccatagaaataggaagggcactgtg

SEQ ID NO: 3198 - DNA, 1200 bp, mus musculus
tctccattgtgcttcactttggtttttctttattgtgtctacttccctttttaggtcttggatggttttattcatttccatcacctgtttggatgtattttcctgtttttctttaaggaattctacctgtttggttgtgttttcctgtttttctttaaggacttgtaactctttagcattgttctcctgtatttctttaagtgagttattaaagtttttcttgatgtcctctaccatcatcatgagatatgcctttaaatccgggtctagcttttctggtgtgttggggtacccaggactggctgaggtgggagtgctggattctgatgatgctgagtggtcttggtttctgttagtaagattcttaagtctgcatttcgccatctggtaatctctggtgttcgttgttatagttgcctctggttggagcttgttcctttcatgattctgttagcctctaagagcagacctgggagactagatctcttctgagtttcagtggttagagcactctctccaggcaagctctcctcctgcagggaaggtgcacagatatctggcgttcggacttgcctcctggcagaagatgaaggcccgaaacagggcctgtcccagtgctgttagcttctgtagtccacactctcactgtgcagactagtctcggcaggatccaggaaccaatatggctccctcaagtgctctggtaaaactcttctgggcaggccggacacctctcctctggcagggaaggtgcccggatgtctggatcccgaaatggagcctgcctcagaagctctgtggctcctgcctctcccagaagctgttagcttctgtagtccacactcttacccatgcagactagtctcgatggggtctgggaaccaagatgtctcctgcagatgctctggcaatggcctgctaatcgcttttagaaacgctcctttgtgggttggattagagcaattttcttatcactataatcatcatctcctgggctgggcagacacctctcctctggcagggaaggtctccagatgtctggagcctgaaacggggtctgcctctgaagctctgtagctcccgcctctcccagaagctgtgagcttccgtctctttttttttaaaatcataccttgatgacagcaaattagataagagtttaacagtcaaatgttttataaaattcattagaaactgaca

SEQ ID NO: 3199 - DNA, 1000 bp, mus musculus
ctgctttcataaatgtgtaatggagaaatagcttaattgagaatagaagctgtcccatccttctagagtctaataatggtgtcttaatgctgttgccttaagcattaagttgtgggacaatagacctggtctggaaacttgcttggtaaggtagagaaggcctttgcttcaggagctgtggtctaaatctcccatagaaggcttctctgcacttccagacaaccaccaccaagctaagacagtcatggatgagctaaactggagctcccagccccagccccaggctagatgctgtccttagcccgcagaaccccaaaagtctaagcctcgttgtggcctgctgacccccaaccctttgttactgactcctctgtgtggttcccagtggttactgggtgctccagaggtcagggaataccagctttgactttcccacatctcaaacatcactttcccaccactggggccttgctcagcatgtccctgaagcccagcaccagacaagcagctgtgtggcatttttcttccccaatggccatgcccagcagcagggcagaatgcagtcccacattaagtttcaaccttaatactcaaattgtagcaccaaaccttagttgcagtcagacaagtcagtattcttagacgaggttgtggctctatagaagaccaagtgaatctgtggtggcttcataggtggttagcattatccacctatgtagggtaccaatattcaacctccttacaaaaacttatataaaggggctggagagatggctcagtggttaagagcattgactgctcttgcataggtcctgggtgcagttcccagcaacaacatggtggtggctcacaaccatctgtgatgggatctgatgccctcttctggtgtgtctaaaggcagctacaatatacttatatatacacaataataagaagaatcttttaaaaaatgaaacattaaaaaaataaaaacaaaaacatatatataatgatatatcat

SEQ ID NO: 3200 - DNA, 1000 bp, mus musculus
aaaacctggggacctgagttcaatcctgtggcccacatgtggaaggagagaactaattcctccaaagacgccctctgacttccacacatacgctgtggcacaaggcatccaataagcaaaagaatcatgagtagatagaaaaaccatgggataagatggttactacacagataattagagagtgcatctactggatgtatgaaattgcatatatccttaagaaacagaggtaggcaaccaaggggaaattgagcaaaagactgatgagtcttccctaaaaagagggaaaatatgtaactaatagatatattaaaagtgtttaatcacattagagtttgaaatgagcttgcattagaggtgaaatccaagtcagatgaggagggcaatccataggatttaaaaatcctgatgtttgaaaatatgtaactgcatgaccattctaaagtatataatcagagacttataccatgaccactataagccaggcactattctgggttctcaggtgatatcaatgagcaaagaccctaggaacttagagatggctggaaccaatagagggacacggatctctgtgagtttgaggcctgatttatacagtgagtttcagactagccgaagcttcagaataagaccatgtctgaaacaaaaccaaccaacaaacaaccccaaccaaacaaataagcaaaaccggtggcgcttccttggtgcttaacaccacacaaattggatcctgccaacctcatctccaagtctgtgtgctgccgtctgcaaaaacttaagagaagagaaagagactgaagtgaaaaggtgaaggcatgagccctcgtggaaatcagagggatgactccataggaacacggtggagaacttccagtcagcgagcgagcgaggaaatctatgttgagtgacaactttataaacataacaattagcaacacaatcccaaaagacaatgacttactaaacggtaacaagaggcggaattagtaatcagcta

SEQ ID NO: 3201 - DNA, 1000 bp, mus musculus; identical to SEQ ID NO: 3200

SEQ ID NO: 3202 - DNA, 1000 bp, mus musculus
cacctgggcacatctaaaagggtatttctagaaaggcttaactgagggaaaaacataccccaatggatgccaccatcccataggctgtgatggttagctttttttccactttacacaaataaattcagatgggaagaggagacctcatttgcggaattctatcagctggcctatgggcctgtctatggggcattttcttcattgctgagcatgaggaggtggtcctggattgcataagaaagcaagctgagcatggtatatggagcaagccagtaagcagcaccctttatggcctctgcaacagttcctgcctccaggatcctgtcctgcctgagttcctgccctgaattctctcagtgataggaggctaaaataaactcctttctcccaaagttgcttttggtaatggtatttatcatagcaacagagaagcaaactaatacatctgggtcttgaagtgaatggaaaggagaaagcaagctaagaaacattgcttacagcttttttttttctgactgtagccacagtgtcaccagctagcacatgtctctctaccataccatgacttccctgtcatggtaaactgtacccttaaactgtgaaccaaaagtaaccctagctgctcccttaagttgcttcctttcaagcatttggtcacaacaagaagaagaaactaataaggaagcattggaatgtaaaactcaggaggatagcaaccataagtagagtacaggcaacataagggtcaaaataattttactgaggaaaagaagttgggaaagaaagcatgtgcattttgagttcccacacatttgattctaaaaccctgaaaagagaaaatatatatatatttttaattatcccaggattgagggacgtgtagaggtttgagggaaggatcaacaagaaatgttgggagtgtgaaagctaagtccgtttccctgactatgatggttcgttcatggttgtatgcatgggtctaaacttgggaaatgtattt

SEQ ID NO: 3203 - DNA, 1400 bp, mus musculus
gtactgaccagtttcaacactctaaatagtcagactcgcagttttgcaaatcaaactctatctgtacactgggaaaatgttgaactgctttgtcactatgaagatctacgtacaagccactttggacatgtgattttcatttctcttgtatgaatgcaaaagaataaatttgctgggtcatataagaatatatttaaccttataagtaacactagaagcatttgctgaagtgattgtattatattacatttccaccaacagtttatacatttttttaacttactgacttactgggtatgtaatgcaggacttacatagcatcaggatttttcctttttctttcttttctctctctttttccaactggatattttttatttacattccaaatgttatcctctttccaggtttcccctccacaaaccccctatcccatgccccctgcccctgcttctatgagggtgctcacccacacactcctacctccccgccctggcttttccctacactggggcatcaagccttcacagaaccaagggcctctcttcccattgatgcgctacaatgccatgctctgttacatatgcagctggagccacgggtccctctttagttggtggttgagtccctgggaactctgggggttctggttggttgatattgttcttcctatggggttccaataaccttcagctccttcagtctttcccctaactcttccattgaggtccttgtgctcagtctgatggttgactgcaagtatctgcttctgtatttgttaggctctggcagagcctctcaggagacagttttatcatgctcctgtcagcacgcacatcttggcatccacaatagtgtctggttttgatgtctgcatatgggatggatccccaggtggggcagtctctggatggtcttttcatcagtctctgctccacactttgtctctattttgttcccccttctaagaaggatggaagtatccacactttggtcttccttcttcttgagcttcatgtggtttgtgaaccgtatcttgggtattctgagcttctaggctaatatccacttatcagtgagtgcataccatgtgtgttcttttgtgattgggttacctcactcggcatgacattttctatttccatccatttgccaaaaattccataaatacatcgtttttaatagctgtactaatagtttttaatagtagtactccattgtgtaaatttaccacattttctgtatccattcctctgttgaaggacatctgggttctttccagcttctggctattataaataagatcagagtcacatcatgtagccccgcctggactagaacttgctgcataggctaagttggccttgaactcacagagatccacttgactctgcctctct

SEQ ID NO: 3204 - DNA, 1200 bp, mus musculus
tggataccctgatgcacaggtagagtttcgaggtcaacttaacaggagttcattttcttcttccaccatgtgggtgatagagattaaattctagtcattagggttagaggaaagcgcccttacctgctgagccacttctctggcccttacactgatatttctaagtgttttcttttagtgtggtggttctcaaccttcccaatgctgtgacctttaatacatatccccatgttgtggtgacccgtaaccatacaattattttgttactacttcttaactgtacctttgatactgttatgaatcaaatataaatattgtgttttcccatggacttgggagactcccgtgtaaaggttgtttaaattcccaaaagagtcatgacccacaggctgagaaacacggtcctagaagtttccttctttaaacacatttatattattttctcaagaacttcatacatggtattttgagcatttttcaccttcatctcctcccatatgtacctttactccataaacacccaactttatgttaaaaaattttaaaacacattagtgctatctatatacttttaggtggatggtcatccaataaaatacattagacttgtcagggtctgcacccttgaagaaaactcactctttcttttctcccctggcatctatcaactaccaaaaattctttagctagggatgcagctttacagtcaagtcctccttccatgctgagattttctcttgctgcatgctgtcacacctgctgggaatttggatgcacaaatgtcctattgtgtcaggaaaacactgtttccttgtactcacccagggcccctggctcttattctcctacctcttctgcaataaaccttgatctttgggaggaagaggtgtgatacagatgtcccacttagggctgagcactctgcagtctccctattctctttactttgactagttatgggtctctgtgttaatttccatctattgcctaaaagagaagcttttctgatgaggtttcatatatatgcctagctatgggtacagcaaccagtcattattagttggtttattactatgtctcattaccagagtactagttgtaggtgctgcttcagggcttatgatttgtcaaactataggttcttgactctgataactatatctgtgactctgataactatatctgttatggcctctatct

SEQ ID NO: 3205 - DNA, 1200 bp, mus musculus
tcccacactcctttccctttcttctctgaacatgtggtagctcccttgaatattcctccccaccctggcacaacaagtctctgcaaggctaggtgcttcctctcccactgaggccagagaaatcagccgagctagaagaacatatcttacatacaggccacagcttttgggaaagccccgttccagttgttcaggacccactgcagatctgctacatatgtgcaggaggcctagttccagcctgtgtatgtcctttggttggtgattcagtctctgagagccccaggggtacaagatagttgattctgttggtcttcccgtggagttcctatccctttaggagctgcaatccttcctcctatttttccataagagtccacaagctttatccgctgtttggctgtgggtttatgtctgtctgtgtcacttgacaggtcaggcctctcagaggacaataacgttggtgcttgcccatgggttggtgcttgcccataggttggtgcttgcccatggggtggttctcagatgaggtggttattgattggctgcaaccccagtctctgttccatactcaatccctaaatttcttgtagacaggttaaattttgggtcgaaagttttgtgggtggtttggtaactatctcgtcaccagggttcccacctggccacgggaggcaggctcttccggttccatattcctaattctatgaggcacagctaagggctcctctattgattcttggatgcctcccaatcccaggtctccgtctcttcctagagatgtaccccacctctatcccagcctcttggagatttccattcattctcatagccacacagccatgttccttgccacctcccattctcctcccaaccacctccctacccacttccctccctacatctgccttccacatccattccattcccccttccaagtgaggctcaagcatcctttcttgtgccctccctcctgtccagcttctttgggtctgtggagtatagtatgggtatcctgtattttatgactaatatcaatttataagtgagtacatatggtgtgtgtcctttagggactgggttacctcacttaagatgatattttcaagttccataaattaacctgcaaaattcatgatctttgtagttgaataatataacattgtataaatgtaccacgttttctttatctattattga

SEQ ID NO: 3206 - DNA, 1200 bp, mus musculus
aggactttttaatctataaattataggaagatgttatgaaacctatcatttgtgggaagtgacattttccactctattcgaaggatttctaattttttattatttatttattcactttatatcctgcccactgcccccttccagtctactcctcccacaattcccccttctcctctgagcaggtgggaccccctgggtattcctctgtctctgcaaggctaggcacttcctctcccactgaggccaaacaaggtagcccagctagaagaacatatcccaaagactggcaacagcttttggaatagcaccgccccctccagttgttggggaccaacatgaaggtcaatctgctacatatgtatgggatacctaggtctatcccatatatgttctttggttggtggttcagtctctgagagccccaagggtccaggttagttgactctgttggtcttcctgtggagttcctttttaaaatttcttagagtactcattctgcttggggaataatgtaatttgggggtgggtgggtgttagcattctgtctaaactccaccccacagttacctggcaacagccaggtatgctcctccccacagttacctggcaacagctaggtaggcctgattcattataaaaggggttgtttgacccttcctccctctcttgccctcttgtttctctcttgctcttctcttcttgctccttccctgtcccctagccccttcccccttcttccccattcccttcccctctctctccatgtgctcatggccagcctctaccctctagttctctactctctctgtgtctctgtctctctctctctctgtctctctctctgtctctctgtctctctctgtctcactctctgcctttctctgcctctactaccctcttaactccccttccatggcctgaataaactctattctatatgataccattgtgtgactggtccctcagaggtaagggatgccttggcatgggcctgttgagacatgcccttcccccatacctcaccacacccccatagacaatattcttctctctttatctttatataaacacatcagtgagaatatttgtttgtttgtttgtttgttgtttgtttcttatattaaactatttcggtataaatatttcacttagaggtctttctattttttttttccattttttattaggtatttagctcat

SEQ ID NO: 3207 - DNA, 1200 bp, mus musculus
gactcttgatgtcattcttctataccaggggctcgctcacaagggcatttgaccacagagttcttgaaatctctattaagttcttaaccttggctctgttgaagccacattcttggggtctgatttgggatgacagaaggtatgtgcacaaagaacgagggaatgacgtgttagcctaaggtatggaggcagaaaaccttttagcgattgtcatgcttttcaccaaaaccacatttaaaccttagccaggagcaagcactcactgcgaattctgtctgcctggcgaatctgctggagagctttctgaatgctctggctgtctcgtcccgaggtcaggacgacccctacaggtaggccctggctccgaagagcacttgagactcgattggctgtatgcatccaaatgtcttcatctgaggaaatgaccccagcatgtgcccactggaaatacttcatgacggttacaagcacccgtatcggagaagggagtgtccgagagaaggttgggaagctatgtttgttatctaattcatgattcacacaagcccaagagaaaatccctttgtcccagctggttcccaggagtgaggctgcctcgcagaagccagggttggcaggcccaacaaatcctgaggccatctgctggtgggaaatgaaactggcgagggcctttgaagtctgacagtcttcgttaagaatcacgtattcgaaggagtaactcctgtcaaatgtcttgtcccggctgattcgctcaattgctaaagcagcagcaacctcaggcagggccttggaaaagaacggatcacatgtccagggacctatgaccccgatcttgtaggggagtgcttgcccccaccgaaggagaggcaaaagggccaagaggcacaaacatctcaggaacttggaggaagggaggccatgctgtcctgacagtctgctggaaatggcaaaccaggacagaaggcgagaaaaaggccagggtccgaggaacatagcctcgctgccttccagcaaactagtgatgaaatactggagaattactctgcactctgaagacggacagtggtgtttccgagttcctgtcaagcagagggaatcatatgttacactgtttctggagtttctaggggaaaaaaaacacatcgcttttgaaacaatgcagtctcccaaggtgaaactttccgttgcccaccccaacca

SEQ ID NO: 3208 - DNA, 1200 bp, mus musculus
agaacttgtaaagctcatctcttttcattatggtagaccccaaattacattttcaatgtcttttataggaaccaaatctagtcaaatctttttgctttaattgtggtcatttgtgttggttagggaaccatctgcctgttctttatcttcatatttgttgccataagtttcagtatgtagtactcatgatcatttgaagaatgtgtctttatgtcgtcatgctttgttggttgaacttaatcttgtatgttttctgtgagctcggctgtatttaaatttgttcagcaagtacattatcattttttttttattgctatgtagaataaagtcttggatttttctcatccttcctatcttcctttaactaccactatgttattccacaggtcaaacacctcagtgtacacagataggctctgctgtaggctcactaacaagccctctctacttatttcttatttctccgctggtgctttgctctagcagtcgtttgtaagtctgctaccttctcagctaaacagagcatggcctgttctttgcagagatatgcctggtcactgcttcaaaagggttatgatgtgtacagcaagctgcatagttccacgctgggctggggctgacagttcttttggtgatggagagaggacaggattctccatgggggtttcacggtctatttcacaggggagaacgaaagcttgccagtgtcccagctgggttctgaccatgtcatttatgtgcacctttgctgacatgtgacttgctaagtgctgctactggagcctgctgctagaaaggctgcctcagcagaaaccctgtgtctgagatgtcgtgctagaattagcagggtttctacgtggctcaccacacagcaaccttgggcacggtggtcttatgaactccagtctcaccaacttctggaattccatcctggtagctttctgcttctgaaagcccccaatctccatattcctacgcacccttctctatggatgctcaactagcaacccagcattgtttgttttattgtatttatacatgcaaggctgttctttatctctttgaatctgagacacattcctttgccaatttagaatggctttttccttaggagcagtctactagtactttctctggccaccctatagaatacattttctcatacaggtttgactaaaatcaatacattctgccctatgt

SEQ ID NO: 3209 - DNA, 1000 bp, mus musculus
cctctcttaaggaaatgcttttatgagatccagctgtaaggcattttttcaattagtgatcaagggtgggagaacccattgtgggtgggttctataagaaagcaagctgagcaaggcaggggaagcaagccagtaaagaacatccctccatggcctctgcatcagctcctatttcctgacctgcttgagttccagtcctgacttccttggtgatgaacagcagcatggaagtgtaagccaaataaaccctttcctccccaacttgcttcttggtcatgatgtttgtgcaggaatagaaatcttgactaagacagttatgttacttggggagattatactccccccaagagccaaagattaccaacaggcaggcaacagaatcagagtaacccctgataagttgatgggggacccacaggaagattgagctgcttatctgctatatatgtgtggggatggggactaggtccagccagtatatgttatttggttggtgggtcagtctctaagaggttagttgtctttgttggttttcttgtggagtccctatctattccatctgggttcctcaatcctttgcccaactcttccacaagacttcctgagctccttctaatgtttggctgtgggtctctgcatttggttcagtcagctgctgggtggattctctcagaggacagttatgctaggttcctctctgcaagcatagcagagtatcaatagtgtcaggggattgcctcttgctcatgggatggatctcaagttgagccatcattggttggccattccctcagcctttgctccgtatcttctatatatgatgtggaactccacccatataatcgtagcaatgttgttacctattgggcctgcacaatgatgacactagttgatataccaatgtgtgtgtagggggaaatcacaagttcccatctctagatgaaaagctgagaggggggatgagtattcccttgaccggttatacagttccgagccgtca

SEQ ID NO: 3210 - DNA, 1000 bp, mus musculus
tgccaaggcagtttaccccacctttcttgaaactggtgtgtgtataaaaagccttcatgattttgtaatgtaaaaacagcagaaatcacttcacaaatcaggtacacagaagtaaggaggagacatcaaagcatgccagtgttaaaacagctaagaaattgtagctgagggccactaacaatcaacatctaagcttgaatcaactcaaagttgtaaaaagtttatgccaatggctggactgaaaaaaaaagtaattggaaaaaaggaaaatgaaaaaaaaaagcttgtgtcacttgaccattttgatcatcagcataggattttaagggactgtgaattgctcactcagagactgtgcatggacagcagaaagtagagttccactgtgggaatatcaagggagcttacacattcacatacgtatattgaaagtcattaatgtcttcgtttacttgaattttggtaaattgtcttattagcctttagagaggctttctctttgcttggtaaatttgagtgaatacatgagaggggaagactgtgtctgagatgatagactcctggtgtgtaccagactggcattagacatgtcctcccttacctcctgtttatcgctgctttctccataggagctgtgaaatcagctgcaactgaaaatgtctgacagcttggataacgaagaaaaacccccagctcccccactgaggatgaacagtaacaaccgagactcttcagcactcaaccacagctccaaaccactgcccatggccccggaagagaagaataagaaagccaggcttcgctctatcttcccaggaggaggggataaaagtaaagtatcaggggccgggagttcaaagggggacagtttattctttgattagcactttcttgctttcatagtctattctggagcccgggatgctccaggcttgcttgacctttcaccttgagatgttgccatttgttagaggatcatgtgtgattgacttcctgtgtg

SEQ ID NO: 3211 - DNA, 1000 bp, mus musculus
ctatgttcatagcagccttatttataatagccagaagctggaaagaacccagatgcccctcaacagtgcaatggatgcagtttctttcttatgcgtgttcgcaaccggccaggaaagatgcaacaagccagaatcttctgcggcaaagctttattgcttactcaggagcaagagaggaagagcgcggcagagagaggcagagaggaagagagagagagaagcacagagaagcacagagaagcagagagagaggcagagagggagagaggcagagagcagaggaagagagcagaggaaaagacgaagagaaagagacgaagagagggagtgccagaaccccgtcccttttaaggagaattatcctccgcctaggacgtgtcactccctgattggctgcagcccattggcccagttgtcatcacgagaaaagcagagcacatggcgggaaaactgcccctgcacatgtgcagattatttactacttagaacacagctgtcagcgccatcttgtaatggcaaatgtgagtgcggctccccacatttcttgtcgattctgtggacttaggctgagtggctgcgtgatttcagctgctaaggcaagatatgtgctgacccatggatgacacatgaagattggagggaatataaataggactagatggccaatgaaggaggctaagctgggcttgcatacagagctagctatgcaatgcttgttggtctagactcttcactgatctttgctttgctgagagagacatagccaagaacttttcctgttttccctggtccctcctgctgacttgtgctgaggcctggctgtctctgctaggtatccaccactgctgattcttgtttctcttccaactctactgaattggactgctggtgtatctgtgaagtgtttgcaagaagactgagctgcccctgctaaacagtgaaatgaactgctgatttccagacagcacagatgggagttgctccaaagaatctttataaa

SEQ ID NO: 3212 - DNA, 1200 bp, mus musculus
agatattttcttcatttaaatttcaaattctattcccaaagtcccctgtacactccccctgccctgctcccaaatccacccactcccacttactggccctgccattcttctgtactggggcatatgatcttcccaagaccaagggcctctcctcccaatgatggccgactaggccatattctgctacacatgcagttagagacacaaggtctgggtatactggttagttcatattgttgttcctcctatagggttgcagaccccttcatttccttgggtactttctctagctcctccattgggagccctgtgttccatctaataaatgactgtgagtattcacttctgtatttgtcaggcgctggcatagcctcagaatagatagctatattagggtcctgtcagcaaaatcttgctggcatatgcaataatgtttgggtttggtggctgattatgggatggatccccggggggggggtactctctggatggtccttccttccacctcagctccaaactttgtctctgtaactccttccttgggtattatgttccccattctaaggaagaatgaagtctccacactttggtctcattcatcttgagtttcgtgtgttttgcaaattgtatcttgcatattataagtttctgggctaatatccaattatcagtgagtacatactatgcgttttcttttgtgactgggttaccttactcagaatgatatcctccaggtctatccatttgactaagaatttcatgaattcattgtttttaatagctgagtagtactccattgtgtaaatgtatcacattttctgtatccattcctctgttgagggacatctgagttctttccagcttctggctattataaattaggctgctatgaatatagtggagcatgtgtccttattaccagttaaaacatcttctgagtataggtccaggagaggtattgctgaatcttctggtagggagaacgaagattttcaacttaaacggccaggaaatatcttcaacaaaattagagaagaacctaacctaaagaaaaggatgcccaagaacatacaagaagcctacagaactccaaataggctagaccagaaaagaaattcctcctgactcataataatcaaaacaacaaatgcactaaatagagatagaatattaaaagcagtaagggaaaaaggtcaagta

SEQ ID NO: 3213 - DNA, 1000 bp, mus musculus
tcagctaagacatctctctttatcagagacctaagggcacataaatctccattatgacctcctttctaagtcctcacttgagagagctgatcctgtgacacagcactccatacccaaatacagccaggagggagctgatttcctaggagtgaggacacgcctgttggcacagataagaccaccacttctgttgaaattcctggcccaagagggaccctcccagagccatcaggacacaggaaccaaggaacagcccaagacaggatccttctggtttctgtcttcactctggagcagaccctgtgccatagctctccatacccaaattcctcccggagagaactagtctcccaggagtactgatatacaggcttgcatgagggacaagtcacagtcagagacaacaagaacggctaacatcagagataactggatagcaagaggcaagggcaagaacataaacaacccaaagcaatgatacttggcatcatcagaacccagttccgctgagccctggataccccaacacaacaggaaagcaagattctgatttaaaatcacatctcacaattatgatagatgattttaagtaggacataaataattcccttaaagaaacacagaagaacacaggtaaacaggcagaagcccttaaagaagaaacccaaagttctcacttgaatgagaagaacttggacagggaaaggtataatgagatgttcctgatatactcatgctggataaatgataaacaaaatgaatgagtaggctaatgtggaatattaaagtggttagtggggtgaggggacggcagtgtggctagaaacttttcatgaactctctgtctcatggataaggattggtgatggtgacatggggtagtatgatgatcagagctgaaagaccaggcacacattcatagctatgctccagctctccttaactctgagcttggtgttttgtccaaatggacatgtgaagacatttgtgaaggctgagc

SEQ ID NO: 3214 - DNA, 1000 bp, mus musculus
tggcacctttcctgtactttgaagtatcaatgatctttgcctctgcttgttctccttccactgtttcccactgatctctctgtctctttcttcccttatgtttgttgctactgagactaccctattagatattttttcttcctaagagagagggaagagtatgtcaaatttagctcctattctatgggtagtgaaacaagcataaacagagagtcttatagaatctatattactagctcttagtactttcatgttgtttacttatttggaggttcttggtggagttgctgagcctattacccattaggatacagtcaatcacagctctatttttttttaaaatataaggctttttcaaataattaatttttaaggcctggagacatggttcaacaggtaagaacacttactgttcttgtacaggacccaggtttaattctttatagtcacaccaagtaactcccatccacctgggcatctgatattctctggcgtttttgctgcacttccatacacgtagtgcatgtagacttatgcagctttataaacataagcaaaaaataagttaatacatatgagtctgtgcatacacacatacacacacatatatacacacatacacacacacatatatacatacatatacatacacaatacatacacacacacaaacacacacacaccacacacacacacacacacacacacacacacacacacacacacacacacatatcagaaacaggacctagagatcttgagctggatttgatgaggactagcttccttggttagcagaaggtgcaatgcaagctttcaaaggagggaaacaaccaacagtctttctcagctacaatgactatggatcacaaatagcaacagccaggatggcatgataacctcaagttaatgtacaagtgcagtagtgacacacataccttggtgatagttaatagttctctaattggatttaaggcctactcaaggaaagtggaatcat

SEQ ID NO: 3215 - DNA, 1000 bp, mus musculus
aaaagaattgcaacaacagcaatgggaaaataactcagcagcaaaagataagtcacaaagcagtagataagataaatagctctctggaactgactggcgtgacagtttagatgaaataaactccagaatcaatgaaagactctgtggacattatcagaggaagacatgccacatagatcccatttttcgatatgcatgcatatagtcatgcacacacccatgaacacgtaaatatacatacaccccacatacacaagtatgcagtaatttggcattgaaatgtaaatagaatattgaatggactaatttacagagggtgaaaatttgaactaagttttcatgattagtttaatgttctaggtaatatggcatgatgtgcatgttaaattattcccaggatcatccaattctctattaaaaaaaaatcagtaatacagcaatgagacattttcatacctaaataacccattccttttacagtatctaaattccaatgtgataaaatgtggacatctttttttttttaatctgctagtttttctttttaaaattaagacaatcatttcacatcccaggctttctctttcctcactcaaatctcctccatgcctttcttaacatctcacccattgatagccttttttttttcttccttattattgttaatcgcacagaagcttctgttgttatgagagatttacaacaggaagctttcatcccattaccagactaaattgatttgtttttgtattgtgattagagcatacaataattccatcaataggatcttaacatctagttctggttgggcagcaaaaccagtattgtctctactgacctgatgacctcagggaacttctaggccatccagccctaggaaggttgcccaagcctggaactgggattcatatttaataacctaatacttctggaagcagtattatctgtctatacagagtacctcctctcaaactgtaaattagtttactaatcatcatat

SEQ ID NO: 3216 - DNA, 1200 bp, mus musculus
gatgatgttcttaagtaaattataataatttgttaaatattatcgaagttacataacaaattgtgaggctgtgaactgtgcacagatagtccggcctccagttgagcacaggcctgaaacccttgagacctggtgagtggtgacttctgccttcatgggacagtaggagtttggccatacctcctgggaccctggatcctgtccctgctacagccctccacaaccccctgcaaagaggtgtgtggccatcagtcacataggcaatacccgaagctcctggtattctgtctgaatcccaaccccacagttacctggcaacaacaaggtagcccagccacagcctgctataaaaggagctgcttgtaccccctcactcccttacctcttattctcttgctcattactccccctcactctgccttccctttccccctcttttcaagtagccatggccagcctctacttctgtacacttctacctctctctgtctttctataataaacaccttaaaaccatggaccttctcttctcatcagatccactcggctggagcaatggagcaggtttccctctaaggaacctcacctctaacctccagtcaggaagcctccctgtgctccagccaaggccaccaccaaccctagtcgccagctgagcaagcagcctgagctagccagacgcttgatcccactgtaaccagctggagttcttcttcaaaccttttcccttctgcccctgggccagagtccacctaagggtccccactttgttctcagctcttctgtgacataaagaggcacctgggatatctgagagtgagaacctgatgttcctggtctccgtgtgtctcagggaccccagaaccagctcttctgtggtgcccagcagtctgtggtgcccaagagtggctcttgcagttccgcgggggtcccagactgtgccctttcctcacccccagagcaggatcccaaggcttccaacagtccaacgcccacctgatggttctgtgggggttacttgcagtcagactccctgcgtccgcccagtggccctgccccaatcagacacaggactccattttttgccccataacaaatatgttgataaacaataatgatcagcactttgattactattggagaagcagaacacaggccatcaacttgaaccaagaatttgacttttagtcttttgtttta

SEQ ID NO: 3217 - DNA, 1000 bp, mus musculus
agttattaatacctttcttaaaatcctctaccagcatcatgagatatgattttaaatctgaatcttgcttttttggtgttttgaggtatccaggtcccgctgtggtgggcgtactaggttctgatgatgctgagtggtcttggtttctgttagtaatattccactgtttgccttttgctatctggtaatctctggtgttagatgttctagctgtctctggctggatcttgttcctcctgtgattctgttagcctctgtcagcagtcctgggagaccaactctcttctgactcccagtggtcaattcagtctctgcaggcaagctctcctcttatagggaaggtccccatatgtctgggtctcagctctgcctcctggctgaggatggaggccagaagagaccctgtccaagaagctctgttgcttctgaggcctcagtgctttcctgcgtggactggtctctgagagactcaggatacaagatggtgctcttacctgattcctggggtcagagccctttctgggggccgactttcctcagtgatcctaagatcttgagtgtgctatggaagctgcagagtagagtcctctggggaccatgggatcaactgctgtgttcatgcccaaggttgtgtgggtctggccctgaccagaatgaaccccagccactggtcttgtgtgttttctgtgtccctgttcctactggcagtagttttggaacagatgttgagttccactcaccagtgatcctaaggtcttgggtttgctagggtgcttatggtgtggagagtcctctggggagtgtgcaactgtctgccaagtttgtgtccaaggtggcgtggggatggcactgacaggaacctgtactgtatttttaacgtgaaatattctggcaattacgtttttctcatagtttggaaaagaattattgaactttcataatcatacattcatttggcatttacacttacctttatggactcaaacatcaatacaatact

SEQ ID NO: 3218 - DNA, 1200 bp, mus musculus
ccaccaggaagtgcaactccaatgaaagctcatgagggtctttattcaagctggagcttgggccatcaaccttcctaatgcaacaggataggaaaatcgatggtgtggtctaggggaagaggtttttaaaggaaaaaaaaaagcagctgggcatggtagtgcatgcctttaatcccagcactcgggaggcagaggcaggtggatttctgagttcgaagccagcctggtctacagagtgagtttcaggatagccacagtcaggaaaaattcccacatactctctgggtagaaataaaccagtgataacattatgcagaatagttcgatttcaatagcaaagtaaaataggaaaattttcagaataaatcagaaaagattagagtccactccggaaacattgacatggtttggaaacttttgtctgttcaatgagagagttcaacagacagatggattcacagctaactccagagaattggtattttacattcagtgatgaacactttaaacaacagaaatagaagaggcaggcaaaagttgtgcacaacagcagcaggatagacactcttcttggaaactagaataaaggaaagaaaccatctttaaaaagacctctacctgctttatcaggctcctgtcagcaagctcttgttagcatccacaatagcttgttgacaggagcctgataaagctgtctcttgagaggctctgccagtgtctgacaaatacagaagtggatgctcatagccatccattggacggggcacagggtccccaatgaaggagttaaagaaagtacccaggaagctgaaggagtttgcagccctatagcaggaacaacaatatgaaccaaccagtaacccccgagctccctgggactaaaccaccaaagaaaacacatggtgggacacatggctctagctgcatatgtatcagaggatggcctagtcggtcatcaatgggaggagaggtccttggtcatatgaagatgctatgccctagtataggggaatgccaggggcaggaagccaagtgggtgggttggggagcaggggggagggaaggggatgggggattttcggagggaaaactaagaaagaggataacatttcaaatgtaaataaagaaaatgtctaataaaaaagaggggacctctacaggaagggagggtgatattgagacataaagctaataaataaa

SEQ ID NO: 3219 - DNA, 1200 bp, mus musculus
tgttggtgatactgacatctgtaattcctgacctttttttaggttctacatttccaggtttgcctccatttgtgttttcattattgtttctatttccacttttaggtcttggactgctttattcaattccttcaccttttttattgtgttttcctgcatttatttacaggatttatttgtttcctattttagagcttcaatctatctactagtgtttttctgtatttctcttagtgagatatttatatcctccttaaagggtactattatcttcatgagataggatttaagtcagcttcttgattttcaggtgtgctggtgttttaccagctttctgtggtgggagaactgagttctgaaggttcccatctatattggcttctcttgcttatggttttgcgcttgtctctcaccatgttgttatctctggtgtttgctggtctgggtgactctgcctggagtctgcctctcttcagaggggcagagaagctgctgatttgttgccctggctgcagtagatctcctggcaggcattcaaattgttgggtcttctgttgtcccgagtgaagatgttctccaggggccctacagactgtggtttctgtttccctgggtgaagtagaacttcggggaggctttcattctgtcggacaagttgccctgaattccacagagcccaagggaagtctccaaaccatggttgcctattttccctgtgtacagagaagctcctgggatgcctcaggctgtggtgtcagattcccaactgctctgagtgcagaggatcttctgggatggctcatgatatggtgtcaactgatctgagtacaacgggttatctagaatagctcaggatatgatgtcttcataggagcagaccagctagcagtctgccccagcagaaaggacagggttgaaggggtggaaagggagtggtattcagtggacagggattttgttgggggatgtatccctagtccaccaggctcccagtaggctgctctgggacttggggggaggggttcatacaaactgctctgagtgcagagcatccactaggatagatcaggatatgctgtcttcacagaagcagaccaggtaggagtctgtcccagaagaaaggagatttctttctcttttaaagctaaaaaaatatactactgtatatttatattaaatttaacacacatttagctataa

SEQ ID NO: 3220 - DNA, 1600 bp, mus musculus
gagttcttaccagtgaggcatcacacaatagactcataaatactgtagggaattgccagtattcttagatgtacttggtaagaccccattgctcagtacaccacatatgaagcttcatcttcacttgctgaaagctattatggtatcagaagagaaaagtaatcttcagtcttactcagctgtgaatcctgggacctacagtaataacttgccttccaacatatgtccattagtgcaatagtggcacaaatatcatgggagcaaaacaagcatttcctgaatacatggaagcagtatttcataggtcaaagaatgtatggctagacaggtagtggctcttagaaagaatctattataaatattttgctaagtatacatttgcctctgtgtgtgtgtgtgtgtctctgtgtgtgtgtaatatagattctcctcgatgttatgtggatatcatcatctcatgtaacaacaaaggaacttatttggtggatctaatgtggaagattcagatgctggcctggaaatctctctgtgtgcatgtcactatcttccatgagcacccatggaagctatgctttatgtctattactgcagaggctcccaggtgattctactgagaaggctgtgaccaaggaagaatttcagggcaaatggactaggccagctcctgcattttcactgctgtttaagcagaggtggcaggctggtcagaaggtatgtagatgccctctgtatccatctagcagttctctgctgaagactggagtgcccaagcagccaccaaggactggtcagcatctcccacagcacaggtcaccaaataggttggaattaccacttagtggtcctaagttgctctgcagacacctgaacaaagacagaatagtgtatacaataaataatttctgaaaatcctggggaaaattatctggtaaatctcatctggagagtttagaattagcttttactgtctgccctccccccccgcctgacacatacacatacacaattgttgtatactaattgttcagggcactttatattattctatttatttttcttcatttgttatggagactatacttttatattactctgaaaagtatttatttactttgaaacagataagtttctgattaccaggactttggataactgtggtgtcttatattttgttaaggtgcaattctgaaaatctcagtatgttttcaaatctcccacaaacatgaaaaaaatgacaatacatcttctaaaagcttctcatgagaattaaaatttttctttctatgtttcataatgagattttaccttaggctttatcctatgtcagtccttcttaaataatttcaatagactacttctttttactcaacacattttttgtaacctttgacatatagatatgtaaaataggtaagcagattcaacatctacttagaagatataaaaactaactttatttatttatagccttgaatttgtccctgaagctcacctcaaaaatcacacagatttatctccttctgcctcccaacttcaggaatcaaaagtatgaggcaccatacttggcatgaaatttgtttaaaacaattgcttactatac

SEQ ID NO: 3221 - DNA, 1400 bp, mus musculus
gccagtagcccagcacagacttgggagttgatactgtaaccttgactcttctcgttgagcaggttttaagctcaaaaaccataatcaatatgtggaagatagcatcacaagatcaaaacccataagcaggtgggcaacttaagattccataagagggaatatcaggttaatgataggcttctgagtcttgggatggttttgtaattcaatcctagaagagggagggagggagggagggagggagggagggagggagggagggagggagggagagaaggagagagagagggagagaaggagagagagggagagaggggagagagagagagagagagagagagagagagagagagagagagagagagagagagagaacgaacctgctgtaccttaaatgatgctcaagcaccagcaaatggatgactggcttaagatggcagtgctctccatgtatactctttggttggcagtttagtccctatgaactctaggtggtccagttaattgatattgttgttcttcctatggggttgcaaaccccttcagcagcttcagtccttcccctactcttccattagggtccctgggctcaatccaatgcttgcctgggagtatctgcatctatattagtcaggttctggcaaagcctttgagaacagctatatcaggctcctgtcagcaagagcttcatggcatcagcgatagtgtcagggtttagtatctgaagattggatggatccctaggttggtgagtctctggaaggccttcagtctctgctccatttttttgtgccctcacttcctttagacaggaacaatcctggattaaaaattgtgagataggtgggtggccctatctctcatttgggtcctgtgcctctctactggaggtggtttctacacgttctaactccccactgttgggtatttcagctaatgtcatccccactgggtcttgggatactcacaaattccagggatctaggactttccagtggcttccctctggctccctcgttccccaaaccccactgctcatatttctattcatttccctgactttctagacttctctagtgtctcttcccatacatgatcctgcctcccccctttccctgcccctcttccctcccgccctccatctgcctcccataattatgttttatcacccttctatatgggattgaagcatccactttggccttccttcttgtttacagcttcatatggtctctatgttatatcgtaggtattctgagcttttggtgtaatatccacttatcagtgagtacataccatgtgtatccttttgtgtctgggttacctcactgaggatgatatcctccagatccatccatttgcctgcaaatttcatgaagtcgtcatttttaacagctgag

SEQ ID NO: 3222 - DNA, 1000 bp, mus musculus
agccatgattgaaaaaataattattcttaatctaaagacacaaaaacatcaaaataaattctggaagttttcctttaacttttctatagctaaatctgcacgtaataaaacataagggcatttagctacctttctgatttggtagatatggaaatttctgtatgcacagtatacaaagttataattatgctgttggattattactttcccttttctctcttttttaaattagttttatttttttacagtccatccattatcccctctcagtctgctctcccacagtttcacatcccattcctcctccccatcttgcttcttggtcatgatgtttgtgcaggaatagaaaccctgactaagacaggggccaaaccaggcagtgctctgccatatatgtgtcagtgacctcaaaccagctaatgtatgctacccagttgatggctcagtgtctgagagatctcaggggtccaggttagttgaaactgctggtcatcctatggggtcacccttgtcctcaacttcttccagcctttccctaattcaaacacatggtcccagaattcagtccattggtcccttctcttttgtatctaattttgtcctaagaaatagaatgtagcaaacacaccactatagttaataaagaactttatctttctaatgaagagtccggaaccttagtgatgcatcatcgaagagagagtaacaggttggacattgcagcgaaaagtcaagtaaaacactgactatacaacagagatggagatgaaagcataaatatactgcaatctctgccactaggggaagagaatttgtgaacctctctatccaaagaagacagctttttccagaaaattctccttaaacatcagctaccctcctcctcttcctcttcccctcctcctcctcctcctcttcctcctcctcctcctcctcctcctccttctctttttcttcttctttaccattgtcagaactgggaataatttttttaatctct

SEQ ID NO: 3223 - DNA, 1000 bp, mus musculus
cccacaagaagtttccaaggccccagcctgttaatactccctcatataaggaagggataagaagggtcatcagaatctcacctgaggttcctactgctctttcttgtgtcccagtcctagttatatgaattctcccccaaactgtacgtggtctcggggaggggctagccaactatgtaaagaagattgaaggttaattgaaggagggaacatcatatgcatagctgtgggggaagtatcaactatgctgtggtgaaatatttagtgaagtggctatttgggggtatgccccacactcctgcaagtaactgctcactcatgctgtgtgaggaagtccaataaacttatttgttcaccaagagacacttggatagaaacctttggtttgtcattagtgccatctctaagattctggtttacattcttccaaggaaaataattaagacaacagccaggaactgcaaaagtatcatatgttcttcctataaagcccataaaccggtaatataactcagattttacaggttacataaaatagtttatgctttgcttcatgttgttatcagaaggtcacataggtaaaaagtggaaaaacaacaccaagcattcacttacccatgcaataagtatatattgaaggattattctgtgtgaagagtattctccacatatactatatgtagcaagttactctcttaactacaaccaggaccctcaaaagagattaaataaccaacaatatacaaaatgtaagaatctaagagtaatgttagttaattcgtggataatcatgagtaaagattgcatcttttacttaagtctgtaacaggatatattgtaatgtttaacattttgattttattcgtgaaatgacatactggtgctggataattaagaccaatatgcaaaataagtcaatctagacttatgaaatgaatgataataaatcacaaagaataaatgacacattccaaagattatacaaggaaaacaatgaggg

SEQ ID NO: 3224 - DNA, 1200 bp, mus musculus
gcctaacacagataaatacctgcattcaatataatggtacatgcttataatccccttccagtaatggaacttagttggtgtaggtctgaatgttgtattcacaagaccctcagtttcctactccaggtccacagagagattgttttcaggctcttcataaaagactggacgtggaggctcaccctgtacccagaagactggggcaggtgaaacaggtttatataattttgagtaaaatctgagctgcaaagtgatacctggtctcaatgatgtgcaaaacatacacttttaaaaacagggttctttggttttgcttttcttttctttttaaatgaccatagtatggcttgtaaaacaacatcttgccaatccaaatctgtgctcctttggatgctgtggctacggtgatttggggacagcgtttgtaggatccatggctctaggtacatatgtagcatagggtgggcttatctgatatcaatgggaagggaagccattggtcctgtggaggtttggtgccccagtgtagggggaagctagatctgtgaggtgggagtgggtgagtagctggaggagcacctcatcaagtcaaaggagagtggggagaggggggaggtggagtttgtggaggggtaacagggaaggaagatgcatgaaagggacaataaaaataaaatgaaatgaataaaataaaataaaaacaggagaactgtcaaaggcctttatttgtaaactgtgtttgttcagaagtagggtgcagcttagttggcagagtgcttgaccagcatgcacaaagtactgagtttgatcctcagcacaaccaaccaccatgaaaagcagcttgcatccaagacagcttggatgttgggaagtgcttgctgatgttaacttgatatggctgtctccagaaagactgtgccagagcctgacagatacagaggtagatgctcacagccagccattggactgagtttggggtttcctgatggaggaattggagaagtgattcaaggagctgaggggttttcagcaccatagagggaataacagtgtgaacagaccagactacctccccccccccgaagctcccaggaagtagaccaccaagcaaagaatacacatggaggaacccatgttgctggtcacatatgaggcagagtaggatgagaggtctttgggcctgaggctgttcattgccct

SEQ ID NO: 3225 - DNA, 1200 bp, mus musculus
aagttagttttgtactaacaggcccataacactaaagcaggactcccagtctcacgttcaaaagggatccatttcctcaagtaaattccatctcttctccctgatcatttctcaccactttcagttttttcaatttttccagtttgtttttactttttttactttttttttttttgacagggtcatactatctatctgcaactgacctggaatttgctatgtgaccttgaactcaggtgtcccctttcctctgccacctgagtgctgctggcattgaagacgaatgttcccatgtcttttttttctcactgttattttcatcttgtaaaactggcaatgttttcattacattcatacagatgcaggaaggtgaatccagtgccacatctgcctgcctccctccctgcctgcctgctaccactctccagtggaatggccttggactaaccctctaaacctgtaagctagccccaattgagtgatttctaagtttcactagttatgttgtcttttcacagcaatacaacagtaactaagagaggaagggggaacaggaagagtaggagcataactgatttctttccccaatggggagaattctaccttgtgctttattctctacaactgtccctccatgaatcagagaagcctagatattcctaaatggcacattttccttattcatttgatttctatttctctaacctccataggcaaccaaatacctgtctctgactctacttctatagaatctgatacaagataacaaatatgcttctcagtatcaactcacctggacccccagcatctctcagacactgagccaccaaccaggaagcatacacaggctggtccaaggcccctgacacacataacagaagaggactgccccatctggactcagtgagagaagatgcatctgaccctcaagagactggaggccccagggagtggggaggtctggtagaatagtggtgggggagtggggacatcctcttggagacagggagaagtggggtgggggaggaggaatgggaggtgggatagtcagagggtggaccagaagggggataatgactgaactgtaaaaaaataaaaagaataataattttttaaaaaacaaagatgcttctgtgtagcaagcaattgtgacagaatgttattcttatcaggcagtatctcagagaatactgaaagtgt

SEQ ID NO: 3226 - DNA, 1200 bp, mus musculus
ttaattaccctttccaattataaaaccatagtctgaattctatactcctttatgaagccctgggtcatatcctgttttttttcacctctgacaccatatagttaagaacattgggtgggctgtttcctcaaacaacaaggattgattcccagcacatggctcacaaccatcgattccaggagaatcgagtgctcttctggactgcacaggcatcaggcacacacttgagtcacaggcaacacagagataaaataaccaaaaagatgaactgagaattcaaaatgaacataaataaaacaaattggggttagtgtgaacagaattatttagagcccagtagtaatgatcaggatttccctactatacaacagagaatacatttaaggaggtggtagaaaagcgtgtggcatgatgaagttcttcgaagttatccaggccagcagtggaactgtgtgaaaatgcccccctcccgggagcagagtagcaggaatttgaaaatagatgatttccccgcccctcacttgggattggaggcgtggtgtggcctggcataggctgaaatctgaccaatgagcctctgcaacagtgcaggaagcacagtgattggaggacgcctttagggaagtgttgagagcctctggctggtccggggaagacacacctcagcaagtggatctctgtgctttgaggttgctgggactcccacaggaggtggcaaactgatggcgaaccgtgaagctaaccagttctctctaatttgagagtagcagtgtgtcccctctccctgctcaggattcccactggtccaaaaagaatgttgactgggagatctccaaataacccaggccactaaaaatggtgccttgtggtgtggagctttccagagagggctctggctctgtctctcctcttttcctcatttgaggaggggcttttagcctttctggcacagtgcccctatacccccattaacctctctattctagaagggaaactttaaacttcctggcaattaatgttttatttggatggcgtgtcagtaaaatgaccataatttttgagtgaggagagggggcttgcagagttcccaggttgaggatcaaatagctggagcctagggttagccttctaggaatctgggaattagaatgccagaaaggtatagcacacaatttttttaagtttgggaggggtgtctgg

SEQ ID NO: 3227 - DNA, 1000 bp, mus musculus
ccagaggtgggaaaggtgccctctgaggtccccacagacataccagagttggtctctgactcttggccacaacagacaccgctgggtaccagggagtgccacttctggggtttgcaaggagaccagaggtgtcaggttctcagtcttgaacatcatagacaccctggatgttgaggaagccctgaaaatgaagtgggggagggcagcgctggcgggccctgaacagggccctaaggaaaagggatagggaagagagagctccagttaggtcctgtggcgaggagacttggttggcggtggtttggtttggtggcagctgtggctggagggcaggaaggccaccggacaggaggttagatgaggctcattaaggaaagaccagcagggcaggtccttatgagaagagatggtccatggttttaaggcattcattgtagaaaggcaaagagacagagagagtagaaaagcagaggctggccatggccacatggagaggggaggaaggaaaagcagagaaatggggagaaagggaccaagggatcaagagtaagagcaagagaataagagagggagccaggggcaaacagcccctttcatagtgggtcaggcctacctaggtgactagggagttggtgtaactgtgggtgtggagttcagaaggaatgctaggagcttggatcattgcctacatgactgatggccacacacctctctgcttggtttggaggaactgtgggaggctgtagctgcaacagaagccagggttccaggaggcataactggacacctgccatcacttagggtcaccagggttcaaggccttttctcaaacagggactgggctgtctatgcgcagctcactgtagacaccagccagatgtggagacaccagggtaaaaacaaaatgaacaacatcgagcatggtatgtctacatttgagcccagctatcctactacagcaggccctgatatctcaaagccccaaagcacaagaaaatac

SEQ ID NO: 3228 - DNA, 1000 bp, mus musculus
agggaaacacaatgaccaggcctttcaggagaagaaacctaatgcctagaataccctaaggagaaatagcaatttaaaaagtaaaacattctaagtccacagaccctgaattataaggcaggaacctctagaatgcagcaatcaatggcatcatcccagcaggcaaaaacttcaacccctcctttttttcaaacacaaagggtgggtgaagcgatgcatggggtcacatcctagggcaatattactacctaatgatcacagaaaccgacccacataaatcagaagaatggcttatggaaatgacatgcccaagaaaatggttgattggccaaaacctttacaaaatgtgtttaaattatgccaagtggacccagaaaatgatcctcaccatatataaacttcccctgctgtggcccttggaaccaggaaatttctgattcacctcatcagaactcagctgttcctatccaagaattagcaggccttgagcctatgcagaaatagctagtgaggtcccttcaactctctttctcggggctcaccaagacataccttcccaatgtgcagttgctggtaggctgatggatgagactgctgatcttcaggaacagctgacccacccaccatcatataccagtcctttggacaggcctcccactcaagccagccttggaatgcattcttcaggaggagactcagaatctttcaatactaaccctaactagccaacatagagccaaggacacagagcagaaggccactggaccctcctagtcaagaaccttctggcttctggttggtatatctgccctttgtcataccccaggcagcaggaaagactgtctttctgtcacagtcagtaataacaggtgtcctgaatgtatcggagtccttagacaaagacaagaaaactataagcttttaaaattatttaggtttatttccacataactgaaaaagaaatcatatacactataccagagcaagctttcattttaaa

SEQ ID NO: 3229 - DNA, 1000 bp, mus musculus
cactttttattttccattcatttattaattcattcaccttacatcctgatcatagtcccctgtccccatttcccctctcatagtcctgcctcacacatacctcattccccttcacctctgagaagggggaggtccccctctgggtactaacccaccctggcacctcaagtcactgcaggactaggtgcatcctcttcgactgaggccagataagacaggggaataggatccccaagcaggcagcaggcagggttacccacatcaagtgttgggggaccctatgaagactaagctatacatctgctaaatatgggggggggacttaggtccagcctttgtatgctttttgtttggtggttcagtctctgggagcccccaagggcccaagttagttgactctgttggtcttcctatggaatttctatcccttctgggtcctttagcccttcccacaactcttctacaagactcccctagtttcatccagtgtttggctctgggtctgcatctttttctgttagctaggtggagcctctcagaagacagttatgataggctcctgtctgcaagcataacagagtattaatagtgacagggattgttgcttgcccgtggcatgagtctcaagttgacccagtcattggctggccattccctgcattacttgtaggcaggataaattttgggttgaaagttttgtgggtggtttagtgactctattgctccactgagagtcttgcctggctacaggaggtggccacttcaggctccatattccccactgctctccttcactggatctccctccacccccacatctctcactttctaatatgagtactataaattttcctcttaggactgcctaggttgtgtctcagaagggaggttctagtaggttgttctcattttgttggtgtctaggaattttaaatttccctttgaatttcctggatagcacactgttacttcaaaatgtatcacttagtccccaaatatt

SEQ ID NO: 3230 - DNA, 1000 bp, mus musculus
ggtagcagctttgaactgacagatggcttgccttttcctgtgagtcgggacagtcccacttggtttgcatttatgtacagagaaataggaaaaatactgtaaagagaagtaaaccttataattagaaaacacgagcaccttagatttaaatgtgtgtaatagatgaaccctgtgaaaagttgggttggaggtgggcctataccaaatcccatgagatggttcaccaggtaaaagtcttcttacaatttaatctcaatgagctcagcccctagaacataaggtgaagaaaaccaactctgcatgattgtccctgtcttatgacatctgcacatatttactctctctcccttctttcctccttccctatttcctcctccctgtcccctaatccttccctctttcccctctcagcaataacaagtctctcactcacaagtttaaaggatttctttgaaaataagagagacaagaaaggttgggtatgatggtgcaaactttttaaatcctagcaccggggatgcagaggcaggtagatatctgagttccaagaccaacgagggatacatagggagaccctgtctcaaaacaagaaagaatttaagcaagaaagagaaggagacaattgtttataattttttcatataccacaaagatagagaaatttaatacttgagtttgggaagtagcatttaagtatcctattttggtctagtccttggtaacctctaaagcattcagtggccattagtgaggttgagttctaggaaagatggtaaaaggtccaggcaagctgcctttgtgccttgtatggcttgtccagttagactcagatatctcataactgttcatgatgccaagcagagtctttggcaaggccatagtatcctttgctaacaatattgcattcaagcaagatctggcttgggtaccaggtttgtgagatattaaatgccacgtaatggtagacataccaagtttttacaggactcagatgttaaca

SEQ ID NO: 3231 - DNA, 1000 bp, mus musculus
tgaaatgcaaatcaaaactgccgtgacctcacaccagtcagaatggctgatgctgccaaggatgtctgaaaaagaggaacactcctccattgctggtaggattgcaagctggtacaaccactctggaaaccagcttggtggttcctcaaaaaattgggcatagtactacctgaggatcccgcaataccactcctgggcatatacacagaagatgctccatcatgtaataaggacacatgctccactatgttcatagcagccttatttataatagccagaagctggaaagaacccagatgtccctcaacagaggaatggatacagaaaatgtggcacatttacacaatggagtactgttaaaaataatgaatttatgaaattcttaggcaaatagatggaactagaaaatatcatcctgagtgtggtaacccaatcacaaaataacacacatggtatgcactcactgataagtagatattagcctagaagcttggagtacccaagatacaattcacagaccacacaaagctcaagaagaaggaagaccaaaatgaggatgcttcagtgcttcttagaatggagaacaaaataccctcaggaggaagcatggagtcaaagtgtggcgcagagactgaaggaaaggacatccagagactgcacctcctggagatccatcccatatactgtccccaaacccagacactattgtggatgtcaacaagtgcttgctgacaggagcctgatatagctatctcctgagaagctctgccagtacctgacaaatacaggggtgggtgctctcagcccgccattggactgagcactgggaccccaatggaggagctagagaaaggacccaaggagctgaaggagtttgcagtcccataggaggaacaacaatatgaaccaaccaatatccccagagcttccagggactaagccaccaaccaaagagtacacatggagggacccatggctccagcctcatatgtagcagagg

SEQ ID NO: 3232 - DNA, 1600 bp, mus musculus
gctatttgatgttttctctgacttttctgtaattctccattgaatgttctctctgtgtaactcagactcttcggagcaaactttgtcacaggccattacgttccctgtgcctgtcagccttaagcagctctgatctggaagtataccgaaatgccctgggttgtagccaggtgacttaggtcactgcacagacaccttgaacaggctgcactgctaagccatatgtgtgtctattccagttgttgaagatgccctacctgccagggtgttttcaagtagctttaagagctttctgtttgggttagcattttggcatctcataggcctggatgtattccttagaaggccgtacagctatttccacccaggccagagggcaatacaccccctggtagcccagcaggatggctgccattggtccagttcataaagttccattggcatgaaagattgtgctgttactggtgcaaacatatttgccacacccctattcttactgtgtgagctggcagttgcgtttactttttggatcaacttgccctctgctgctgtaatgttaggtccactagaagaatggcaactgtggtcttgtctgaccacttttagggtgtgaggttttgtttttcatgacacacaggcctaagctggtagcctgaagaggagacagaaggcaggtgaagcagcagcctcctagaaacagcatctgctatctgctgtccctgcagaggcagcagctcttgcagtagcaccagtggccacaagagggcagtgggagagttcttgagagagagaggctggggcagaaaggatgtggagcaggagaggatgcagcaagggacaacagaaagacagaggagccaccagagccttaatgctgaagaaagacagaaggccgtgaggaatcatggatgagaaagggtggggtctacctccctgaaagtgctcaaggagcctggaagggccagaggtcttcaaaatctagatcctgggtctttgacagtaatccctgtcaggggccaagtatcccaacactgtagaccctagatgtaggaacagagcatcctaagaaagaaatgtcaaacttgtgagtgctacctagtctgcttttgtaatgatccgagtcacagacagtgggggtttaaatccttgaagaataaggctcaaactaaagaagtggaatccaaaggtctctggattctttagtgtggagtaatatcctccaccccgcaacacctgggggctgtaggactctgggtccgccattcctgaccataggctttcatcagacagaatcccagcagcgctaattccagaggatatctttcccacctactcacgatttctccaggtagagttaaaagcatcttgtgtttttgaaaacctttctcattgttgttgttgttggtggtggtggtggtggtggtatgttttacttgatattctaccactttgattttttttattatcatcctgagagtcatttggtcaaaccaagctttcaaaacacacgtgttgctgtatgttttgaaaaactttctcatttgtgtgtgtgttccccttgatattctacactttgattttttttttttattatcctgat

SEQ ID NO: 3233 - DNA, 1000 bp, mus musculus
ctactgctttggggattagtttgttcttgtttgtatagtgtcttaaggctcacgagcaggttgtttacttgagatcgttctgattttttaaattgaaaacatatttttcatgaaatatattctgattttgacttccctatccccaactcctcccagatcctccccaaccccatgctactccacctaattccacaccctctctctctctctctctgtttctctctcattagaatactagcaagcatttaaaaaataaaataatatccacttatcagtgagtacatatcatgtgagttcttttgtgactgggttacctcactcaggatgatgccctcgaggtccatccatttgcctatggcctagttggccatcattgggaagagaggccccttggacttgcaaactttatatgcctcagtacaggggaacgccagggccaagaagtgggagtaggtgggtaagggagttgggggagggtctaggggccttttgggatagcatttgaaatgtaaatgaagaaaatacctaattaaaaaaataaataaaataagataaaataaaaacaaataaacaagaataggatgaagcagggaggcagaaacaaaggaaaaacacaggaatgtatatagatgcagggatacatattttcacacacagagagatcctgtaaaaacacaacaccagaaatcataacatatatgcaaaagacctgatctgtaaggaaaaagaaaaataacccccagacaaagcattatgagaaaaagaacttagtgttggccatcttctactgggcctggagcctgcccttaatggtggatttgtatgcctgtgagaagtgtttgtcagtcagagatagcttttgggttagggataggagctcgtgtccacttcccttctcagcactgaaccccatgtgggtgtgcaggccttgtgtatactgccacagtctctgtgtgtcttgtgtgtctgaggctaatgccattctctgtgatctgaccct

SEQ ID NO: 3234 - DNA, 1000 bp, mus musculus
aaatgcacagggccctaatcatagggagtagtgaaaacggctagctggcaggtgctgaaattgcaaccttctcctttaactctgagcagcgagtgggcggggccgcgtccatcagtgtctaggtgcccgcaggccgccctaagggccaatggcgcggaaatgagagcccgggccacgtgatggcgggtggcactctggctttcctaaagcagtctctatggtattcttccaagcaaacccagggcccccccaaaagggtagcggcacgtgacaggccctgggactacggcaggttcccacgtgatcctggcctgcagtagcgtggttgcggtgaggttcttgcgctcctgaagggcgggcgcggaagtaagagcatcctcaggcggaccgtgactggcagcgaggtcgggaggagccaccaggcagtgaccgctttgcttctgcagctccgctccgctcattccgttatctcagcctttgcagtctgtacagaagctgaccaagttacctttgggtcttgagaccttggcgagtgaggcccaaactcgggaccaactcctcatccaccttgccctccctctcctccatctcttcctttgcacgcaccgaatcgaatcgcttgctcctttgggctggcctgctcggctgtgcctggagactaagttcgggtcggtaaaggtaactgtgggaaaagcggccccccagtggacaaaggcggaggcagggatagatcaggccccgcgggccctgggtgctgagcgtaggcaggtgagccagaagaacggtactgcggatttagaaggcactgtgaaggacttgttgcacgatggaagaatctgactccgagaaaaagacagagaaagagaatgtgggcccaaaagtggagcctcctctaggggagccggaaggatcgcttgggtgggtaaaggggattatgttgcacctgggagggagggcatgctaattgtaaagagtattgtgagatgcaacaacctctaac

SEQ ID NO: 3235 - DNA, 1000 bp, mus musculus
ggaaacatccctctaaagacaatgctgcccactaaattataaataaaatacgacataaataaataaaaagaatccatttgattaactaaaagcttgatccacagacagcattacacttctggctatggtgtttgtaggatggaaattgtccttctggtctgggcctgtgccctaggcagaccttgggagcgaactctgcagccagtcccacaataccaggaggaagatctactcccaaacactctaacacttccaggatcacagaataacagattccctgagcagaccttggatgctaactctgcagccagttctacaacaccagaaaatgctccactcccaggcactttaacatgcccaggatcacaggatcacaggatcacaggatcacaggaacatggtcacaccagaatctcagggtcccaggagccctgacacacccaggatcacagaatcagaggtgccctgagcagaacttggatgctaacactgcacctagttctacaacacccaggaaaagctctactcccaggcacgctaacatgcccagaaccacaggatcccaggaacttgttcacaccaggatctcagggtctcagaggcagcttgactcccaggggctctgacacacacaggaactcaagatcacaggatcacaggatcacacagacagctgaactctgtcaagttctgacacaaccagattcacaggaaggacagactccagtcagatatagcgagggcaggtagcactagatggtaggagtcaagtttaagaacataagcaacagaaaccaaggttacttggcattatcagaacccaattctcccaccatagcaagtcctggatacaccatcacaccagaaaaaaaaagatctggatctacaatcacttctcatgatggtgatagatgactctaagaaggacataaataacacccttaaagaaatacaggagaacacaggtaaacaggtagaagcccataaagaggaaacacaa

SEQ ID NO: 3236 - DNA, 1600 bp, mus musculus
cctccctcccccctctctctctctctctctatatatatatatatataatataatatatatataatctgtgtgtttatacatttatctatgtatatctatacatagatataagtatatatatacatatatatgtatatatgtacacacatatacatacataaacacacacatatatatgtgtgtatatatatgtatatatatatatatatatatatatacacatatatataagtacatgtgcatgcatggttgtacatacacacaaacacaccctcccccccccacactttcatctttgtttgttttttttctctctggttattgttgttactccctgaggtccaatttaattcctatcccttagttctatgatatgtcaaagaactcaatctacgaataagtacaacgtcaacatattttgctttacttcctcagacatttcaacatttgtaagatttaaaaatcactctagtaaatggctgtgttaatttgaacttatttccaattcctcaggctttagctatttggttaaaatggccagggcacaagtcccttctgaggcattttgggtgcaaactggcgggaggtcccacagtccccagaggactcttcactcaatcttaggatcactggtgagtgaaacacaacatctgtttcaaaccacttgtgccaggcctgtgacagcaggagcaaggacacgggagccctgactgattagaggcttgggttccttctgatcgctactggtataccctggtttcgaacacaccagacagctccacagtcctcagaggagacaccatttccaggtgctataaaacgcccaggatcttaggattccaggatcccaggataacagaagctttgtcacatcaggatttcagggtctcagaggaagcttgactgccaagaactctgacacaccaagaatctcaggttcacaggagtctggaatcacaggagcacagagaaagctggactctgaggagtcctgaatcaaccgggattataggaaaaacaggctgaaatcatatactgagggaagcaagcacttgagataatcagatggcaggaggcaagcataagaccagaagcaacagaaaccaaggttacttggcatcataagaaccaaactctcccaccacagcaagtcctggatataccatcacaccagaaaagcaagacatagatttaaagtcacttctcatgacaatgatggaagactttaagaaggaaatacataaaatacaggtaaacatctagaagcccttaaagaggaaacaaaaaaattccttagaaagttacagaaaaacactaccaaacaggagaaagaattgaacaaaatcatcaaggatctaaaaatggacgtagaacaacaaagaaatcacaaagggagacaactctggagatagaaacccaaagaactaaatcaggaattatagaatcagcaatagaatacaagatagaatacaagatagaatacaagatatatatataatacaagatagaatatatatatacatacaagagcaatacacatatatatacaagagcaatagaatacaagagatggaagagagaatctcaggtacagacgatt

SEQ ID NO: 3237 - DNA, 1000 bp, mus musculus
ttagcctttaggacacatgtagaattatagcttatatttaatgccatatccttcctcttggttgtctctttgcagaagcttttagcgttaaaaggggttctcatatttattctgccttcatgttttcctccttcaaattgtatatttaaattgactggctgtcaggagttgctttttgttttcttttgtctgttttttaagcagccccatgcacagtctcttaaacacacttttcaaggaggttagtcattttttcactttttggataaacatttttcccctctgaaaactcctattcccctccccctgctcatcaacctacccattcccccttcctggccctggtattcccccatacaggtgcatagagccttcacagaaccaaggccctctcttcccattgatgaccaacaaggacatatgcggctggagccatgggtccctccaagtgtactctttggttggtggtttagaccctgggagcctgggggatactggttagttcatattgttgttcctcctatgtggctgcaaacccattcagctccttcagtcctttctctaattccttcattggggaccctgtgctcagttcaattgatggctgtgagaattgacttctgtatttgtcaggcactggtagagcccctcaggcgacagctatatcaggctcctgtcagcaagcacttgttggcatccacaatagtgtctggaattggtaactgtgtatgggatggatcctcaggtggaatagtctctggatggcctttccttcagtccctgtgccacactttgtctctgtaatgcctcccatggatattttgttcccccttttaggaaggactggagtatccacactttgctctttctccttcctgagcttcatgtggtctgtgaattgtatcttgggtattccaagctaatatccacttatcagtgagtgcataccatatgtgttcttttgtgattgggttacctccctcaggatgatattttctag

SEQ ID NO: 3238 - DNA, 1000 bp, mus musculus
aacttaagttttagaggaaaaagccaaactttacactgaacacttctcaaagtctgatgtgactgactggaatttcagtgactggggaggttggaatgttgcaggtccagggtctaattgcaagttatcttggattgctgcgcccacctcggctggcaaggaagacacaacacggtcggattcctctcaacagcctttattgcaggaacgcctcaatgctgctacccagggaggtctacttatatactctcagcccccatctactcaggcacacagcttcagctaatcagggtggcaggggcatgtctccaccaaatatggacttgtttacaccgccagcatcatggtgcacctgcgcagctctcacgatggtcgtggctgttttcaggtgtatgagaaagtcaggtgcaagtcatataagacttagctgcagtcccgggcgccattttgggactgctgccacacctgctcctcacattggattatctgtagagccctaaatatccatttattgtctacctttgtatatgacacaaattcttatcactatgacttgaaacctttggaatgtattagttttaggaaccattagcttctaccaactcaaaagctaagaatgttatcatattgcatctgagacctatagcagaggtttccctgctttgcctacctactgtttctatcaatgtatttaattgattgactgatttgtttacttttgagacaaggtcttattctgtagccctggctacactggaattcatatgaccaggttgacctgaaactcaccctgcctatgtcttctgcatgctgaaattaaaggtgtacaccaccttatgtggtgaacatgtgaaatatatgaaatatgtggcaccagcaacacatttcaaaagcatttgacttatgtttttctttattctgttcccattaaaaacttcattaacatgttattatgttgaaacttagatttataataaggaaaattcatgttcctgggaca

SEQ ID NO: 3239 - DNA, 1200 bp, mus musculus
atttacaatttctactaatattactacttcaattggacactgagtttagtaaaaattttgcatgttaatcccataacatttgtgaaacttacacgggtgtatcatccaaacaggtcactgtagttctaagaacttgcatctctgtgtttttgctgcttataattattctgtattaaatactccagaatcttaaagtgtgggaagcggtttccgctgtgcctgggtggcgtagttggtaaacaagcaatgtgagcatgcacgagagtgttttcgtgccaagtcacggcccatcccggggcgtggtgatgaggctctcggagagcagctaatctggtttggacacgccacaccaaggtgtatataagcagtgcctttttgtgcttggggtcttcctcttcatgttgaaactggtgtaataaagttgctgcagaaggatctggtttctcatgcatgtgttcttgctggcgagacaatagcgtgtgtgagaattagtgctgaaacccgggaactgccttaccatcaccggcactgaggagaccctctgttcgcggggcggattcagaactgcagtcaggttggttttttaaggttctgagaggcatgtttggttctggtctttctctacaattggaaggggcaatggaagcctttgtaattgtttttgcagcacttagccttttccttatagtggaagcaggacagggagtgctggaggaggttcaagacagcatgtcagaaacagagcagggtaaaagattgggagctcaaagaaaaaaaggtatccctacgaaacaaggcccttccaaggattctggatctgaggaagagagagaaaagggaaaggacgccctggtagagaaaaaggagaagggagagagaaagaggaggaaagataaaggggagaagagaaaaaagaaggggaagaagttcccccaagaggaagaacctttattcgttaaaagaacttgagggtttaggacttgatagctcaagttcaagtgaagaacttagtccctcggaagaagaagacttagaggaagaagcagcccactatggggaagaaagataccaccctgatgagggtagaaatagtgagccaaggaggaagttaaaaggaaatggtggtttaagtcagggcatggttcggtctccgggccctagcgcccctccaccttatgcagaaaatttctgctcagattc

SEQ ID NO: 3240 - DNA, 1200 bp, mus musculus
catctttagtattcccaaaacaagcctaacaatgctgtatgcacacctccagatcatgtttctctagactcatttgtttgactaccagtaatgaaacatattgtctagctttgagattctcagaatctttgtctggattctatatacctagtaatcttgcataatttttcatcagatttcatatcatgtggaacagtttgccaaattcttctattagatgtgatggagtctcaccatgacagtttgttctgtattaccttgacacaatgtagaatcatatgagaacattcttccatgaaacattcactaaaaagcattttgagagctatctggagtaacgatactcatggaagtgtggaacacactatgggtgttaccaagatttgcaaggtagattgtgctgtaggagaatgaaagacaaggaatttcgtaattacaaagcattgtgtagtgtttcttagtggtatctgttcttgtttcttacttgtcttacttgattcctgatcagtgttcttacagtaactgtggagagccgtgtagcgagcaatcgcgtgtgtgccgtgagcaatcgccattataagatggtgctggcttccactgcacctaactagtaaacaagccttatgctcaagtgcaagagtgaactcacgcctagtcactgcccatctcacggcttagtaatggggtgatgggcgagcaacgaatcaggagctgtcacgccacatcaggggctgaaacgtcatgctgcgggctatataagcagcgccattttcccggttcagggtcttccctcctgataagtaagcaataaaagctttgctgcagaagatcccagttgtcctgagtgtgttcttgccggcggggacaaaatctcgggcaataagtagcgctgagaaacccgggaactaccatcacactggcgcaagggagatccctcattcgtgaggcagaaccagaactgcgggacacattacaggtttacgacgtatgtctggccttgaactttctccagtgttagaagcctttttgttccttttcacatgtcaacaagtggttaaggcaggacagagaattctggacgaaattcaagacagtctatcagaggtaaagcggggagagagagtaggagcaaagaggaaacatggtgcaccaattaagcatacaggcctttccacgggtcttgaacccgaggaaaagtta

SEQ ID NO: 3241 - DNA, 1200 bp, mus musculus
tgtctaaaaaggtaaccttataattgtttaggagatggagtaaaattagggaatagatgcaactgatttgtaacctgaaaatctagtggtccagttccaatgctgttcagtagaagagatcaatggctggactaaatttcagatactaccctcacaataatttaggagctgataaggttgaactgaggaacagcttgggacaggatccttccagtttccttctgtgcccaaagctgatcctgtgtcacagcgctccatacccaaacaatgttgggagaaagcaggtctcacaggagtatggacatgcctgtgagcacaggtaaaaccaccacttctgctcagagtgacctgaccagagcactcaggacacaggaactgaggagcagcctgagacaggatccttccagtattcatcagcacagggagctgatcctgtgctgcaggactccagtctcccaggagtgctgacgcacctgtgaacacaagttagaccacaacttctgctcaaattcctggcccaatagtggccagtccagagccacaggacacatgaaccaaggaacagctggggacaggatccttccagtttctgtctgcaccctagagctgacactgcgccacagctctccataactgaatttctttcagagagaactggtctcccaagagtagtgacccacaggcttgcagaagggacaagccatactcagagacagcaagaccagctaaccaaaagatacccagttgtcgaggggcaagggcaagaacataagcaacagaaaccatggttacttggcatcatcagaacccagttctctcaccttgttaccccaccataccaggaaagtaaatctctgatttaaagtcacatctcatgatgataatagagtactttaagtaggacataaataactcgcttaaagaaatacaagagaacacgggtaaacaggtagaagcccttaaagaggaaacacaaaaatgccttaaagaattacaggaaaacacaaccaaacaggcaaagggactaaacaaaaccatccaagacataaaaatgaaaacagaagcaataaaaaccacaaagggagacaactatggagataaaaaacttaggaaagaggtcaggactcgtagacacaagcataacggaaagaatacatgagatagaagagagactctcaggatcagaagattccatagaaa

SEQ ID NO: 3242 - DNA, 1400 bp, mus musculus
ttctctatatctggaatgaattcctttcttcaaatcttcttgagaaaacacatatgacacaagaggcatagtgagtagcacaaaaaaaaaagatgacagaaagaaatagccattccctcttctgtggtgaggataggtgtgcctctagtaattgtaataattatgtgtgctctgttagggatacaggatatccactttactttgagacatctccctaaggttgaacggacccaaggcagaattacaatagtaacagacatgaggaagcaaacatctttgtttacatgagacacagcatcaaaaatgcataaagacagaggatgatccaaaagttaaaaacgtttctttttgaattttaaggtgagggaaataagagaaaacagggaaaaagaagcccattaggtcagcaaactgtactatgttgcaaaatttacatgatgtacaagatgctgttgtgagttttcgcatgaacaaaacagccagcaatagaggtgctgaggaaaccatctgtgcagcctctgggatggcaggtggagaagagagccctagaagggtaaattgatcaggaggtgggagttgaggaccatagccaaaaccaaactgtggtggagagcctaagtcctgtggggagaatcctccaactagttaggatactatataggtggtaaagtttgggcgttgggcagggtatgggctcctttgccagacggtcatgggacatagctaacaatgccctatcctgctgacacctcattcattgtgggccctatccttgttaccatgtaaacagtgtttgttcagcccggccagtatagttccccgatcgccaataatgttactggcaggactaggaaagtttctgctagggttgtttggatgcctggaaccagatgctctcctacagtggcccctctgagctctgccgctgatggtgacagtgtcttcagatgcatgaagaaccacacagtgtactgctccattcctacctgcactatccagggtgatggatccaggggaagctttggaaatactgaactcctgataaatacacagtccagacaaaattaatgagccctggacagaatattaggggaaggtggatcagctgcaaagtcaatatctggacagaagtcttaaatacgtatatttctgacccattggcacaatggaattaagtcactggttcaacatcagggtttaaaaatgccatcaagtttaattcagaatttgcaatttcattgtcttcttcctttttccatattgtatgataatgtcatacctagccttttgttttcccatgtattgaaatattgaagttaacggaaaatatatttacactattgtgatttttgacagaaaatttctgcatcatgtcttagactatactttatatgaagcag

SEQ ID NO: 3243 - DNA, 1200 bp, mus musculus
tgcaataataattttaatttatattattataaatgattttgattttgattattactaatggaagtcatattcattatggaagtttctgattaaagagaagaggattttaaaagtcacctgctatcttaatactcaggaaaaacagttgttggatattttattgcaaattcctccaggggctatagaacatatagattctcaattcctatatattaagctttcttctatcctctagttagtcttgatcatctctaggagaataattcatctctgaaccttagatttgagagattgcaacatgagcaagggaacttgagccatgtgctcactctgcatttatgaacagaacccattgcggaataaatacccatcttctttcctaacttgtgaaatcatactttacagaaactacatatagtcattttaattttttctgtcttcttactttctcatgagaatcaagacagctgcaacctccagataatccactttcttgggaactcttccttggttggctatacaaatgtaaccatccaatagtttgcatctcttcctactaatctcatccaggggagaatctggagatagggataaatattacctgggttatactctcatggaaatctttaacttctaagaatgggctattgcagtctcaacatgagcaatctcgtgttctccttgaggttagagggaacaaaaaatggttgatggaccacttgtgtgtctgcttttacctcaccctaccatgctccagctatgtgctgaagggcaagtgatcagtatcaggtaaaccatttatcccttgtgtaactacacagagctccaggagcaaaaggatgacacataattcccatcctgcctctcccttgggatcaaatgccttgctcagaggaggacatattgaaatgtaccactaacatggttccaaagcacctttaagctatctctaattcttaacatcaatgaaattgatcaccagcccttgctgatattgctaataatttctgatagccattgatctagatgtgttggtatatctcaaatgttacatcacaagccttgctatcatttagagctgtacatacattctgcatttccaacatgtgatgtctatcacctcatttgggaccatctttgcttagtgatcttgcctacctctttctatctctctcttaatttttttccatacgactgggt

SEQ ID NO: 3244 - DNA, 1200 bp, mus musculus
atggatactttattagcctccatttcttagcaattgaggatattgttgcaacaaactttcagattcaaattctcctacatacactaatttcatttcctttggttatatattctcaggtggaattcctgcatagtgtaacaaggctattttaactttttgaggaaactttacactgtttaccacaatgcctgtaccagtttacattcatttttttcttttttaaaattaatttatttttttacactgcatgttccattccttgccctccatccaccctccaacttcttcacattcctcaccttctctgcacacccctgtctctacatggatgaccccaacccccaccccacctgatctctaaactccctggggcctccagtctcttgagggttaggtgcatcatctctgaatgaacacagacccggaagtcctttactgtatgtgtgttgggggcctcatatcagctggtgcccactatctgtttggtggtccagtgtttgagagatcttgggagtccagattaattcagactgctggtcctcctacagtatcacccttctcctcagcttctttcagccttccctaattcaacaacaggggtcagcttcttctgtccattggttgagtgcaaatatctgcatctgacactttcagttgcttgttgggtcattgagagggcattaatgaaaggtccctttttgtaaatgctccatagcctcagtaatagtgtcaggccttgggacctccccttgagctgtatcccattttggccctgtcactggaccttcttttccacaggctcctctgcatttccatccctgtaatctttttagacagggacaattatgggtcagagatgtgactgtgggatggcaaccccatcccttacttgatgtcctgtcttcctgctagaggttggctctataagttccctctccctactcagacatttcatctaaggtccctccctttgcttcctgagagtctcttacttccctagtctctggtgcattctgtagcgtccccctaacttcctatttccggaggttgcctgtttccattcttttcatcctcatgaacaatgtacatgtatcgtctttgcattctcaccaagatttaatattttttgtatttgttaataatcattctaatataagtgaaaagatttttttccttgtttgttgaagtactttccaaaag

SEQ ID NO: 3245 - DNA, 1000 bp, mus musculus
tatccatcccttataagttattcataactacctatggctatttaaaaccacatggaatctggattgtcttcctctccctccaccatccttccttctctttaactcctctttccctgtctcctccttctcccccaaacttttcagctctacctccccttccactgcccaatcaccagctctagcctttattttacaagttaaggcaaggttgaagtttctcaatgagtcacctgagtatgtgattcactccttgttagcaaccactcctggtaaaagcagaattagcatcaaaatacaaacagcaccaggactatgcacaacatatatgtatgtattttttatgtatatgtgaagtagaaacttaagggttctttggaaagttggttggatggtgttttgcttgggcaaatatgtgaagaaatattttgttacagtggacacaggtgtgcaaggctaaagcagagtcatgaaggagtgtttcactgaagcagacacaggagagaggatgttcagctaaagcagcacgtgaaaggacatgtgatgatgcactttcttgctacttcctctgattcaggctgatttgtagagtgatgtcagctgaaacaagtgcacatgctgaggcaagacccttggagaacaaatgatatttggatagagtatcaaaggactcaacagagagtgacaggggtggagttaggcttgctggtagggctagctcagcagtgcttgtgggtcttgcatcttcactgatcctcactttcctgagagaggcacagccaagaaagtctggtgttcctctgggtccctcctgctgactagagctggaggctgaggccttgctgtctctgctagggagtgccagcagtgctgatccctatctacagtcctgagtgagtctgctgaacaggactgctggtgtatgcaggaagtgtttgtgagtggatcacatgctgctaccctgtgaaatgaactgctgatttccagacaacacagaagggag

SEQ ID NO: 3246 - DNA, 1000 bp, mus musculus
tacattttaaatgttcaacatcttcccaatacccttgtaatcaagcctttaccacatgggcttttgaggggtatgccacatctatttaacagtactatgaagtctggcctttgccaatgggtaaactcagttgcaggaaaattaatttatttacccagtcattatgtggctgagccatgatttcaaaccccaggaatctgtcacagaattcatattcataattacatctaaatgattatgtagaagagtttaaaaacacaataagatggactgtgaagtagaaaatctgggttttatttgttttgtaaagtcaattgagttggatggtgttttgctggggcaagcaaatgaaggaacattttgtcagagtggacatagctgaatggctaaggcagactcgtgaaggaacattctgatgatgtagacacaggagaaaggatgttctaaagcaagcacatgaaagagcatgcatgtattggtcctccttacgttgcttagttaagctccatttgtcatggctacatagaaagaaaagcaccaaaaatcttctgttgatgtgctgcagtttcttgctgcttccatggactcagactcataagctgaatgatgtcagctgagacaaactgatgtgctgaggtaagacatgtgcttaggtaagacccatggacacattacaaccttggcttgcttagagagctagctgtgtaacacttgttgatcttcacttttgctgagagggaacttttctttgcattccttttagccctggtccctactgatgatttgtgccaaggatgaggcctgactgtctcttctaggtggtggtaccactcatgatttatatttgctatcccaatactaccgaactgactgatggtatatccatgaaatattcaagagtgaattgagctgccactgctgacctgtgaactaaactgctgatttccagacaagatagatggaagttgctcaaaaatatttctaaacaggtccacttctc

SEQ ID NO: 3247 - DNA, 1400 bp, mus musculus
aaggaaggaaggaaggaaggaaggaaggaaggaaggaaggaaggaaggaagacatcttagtgacttaacagcacaattggaagctctaggagaaaaatagaagaaatttcacccaaaaggactagacagcaagaaacatttaaacttgggcctgaaattaataaaatagaaacaaatactaacaataacaattacataaaaatcaataaaacaaaaggtgtgttctttgaaaaattcattatgattgacaaaacttttgacaaattaactacaaggcagagagtgaaattcaaagtaacaaaattaggaataaaatggggacagtaagaacagattctgaggatcataaaggcaaattgtattctgagaggctctacccaacagtcaacagaaagagatgcagagattcacactcaaacagatggagagcagggagccttattgggagagcaactgagggacccaaagaggatgaggactctacaggaagaccaacaaaatcaactaacctgggctgggcctaggcatattgcacatatgtagcagatgagcagctcggtcttcattcgagtttcccaacaactggagcagggaatgtccctgagtctgttgcctgccagcttatggaccctgtacccctaaatggactgtcctgtctggcctcagtgggagatgatgttgggagatgatgtacctagtccttcagcaacctgatatatggtgggggagggggaattgttagtgtggaggtgacactgggataggcttctccatttcaaaacagaagggtaaggaagaatagggggaagacttgcatgagcgggtactgggagatgaggaagggctgttgttggctagtaaagtgaataaatcttaaaaagaaactatcaatttgagagtaggaggctgaaggaagttgtaaggaggggactttggaggggcttgagggagaaaaagaaagagaaagtgaagtttattttaataaaaatgtataaaaataaaaaataaaaatctttgtattaggaaaaaagaacctataatatataccaggtactaaaacaaaaacataaaatatttgtcttttggggtctgagttattctggtgaggatttgttctaactccatcctttcacctgaaaattttatgtttttatttttgtaacagttgagtaatattccattgcataagaataccacattttctttattcatctgttgatggatatttgggctgtttgcaatttctggctattatgaatacagcaacaataaacatgtttgaataagtgtctctgtactaagaaagagcattctttgtcctttggatatttgtacaggagtggaatagccagaatagcactcttactaataatgggtgagtgtgtagtttatttatatcc

SEQ ID NO: 3248 - DNA, 1000 bp, mus musculus
gtccctaactatgatcctaataatcttttttatattttattttaagataggatcttgatgtgtagcccaagctgcctttgaactctcaccttaggacagcatatctagaactcaagatccttgctgggattgcagggctgtgctaccaagcctggttttcattttaattcatgtttacttctcttccttcaacttcctgcttctgttcctgccttgagagatcttcctgacacatgccagacttggataatttacaaggtgattcatgactctggggggaaagaacacatgtgttgtgatgagatcagcttaacaagggagaacggaaagaatgatgcagcatacctgagatgaaacaggggattttgttgacacatacttggaaaactagtacgttatgtatgagaagccatctctagttatttttcaggtattttgttatttcggttttgactttaaaagtaaaaatccgggaatacagaggccagcagtttctgggataggcaagagccacagagcttctgaggcggtgccattttcggctccagacaactggccatcttcctggtcagagcacaggtgtccgcccggcccgggaggcttctgcctcaggttccaagggagcaaccttggttccgggactctgagggaagtagtctacacaggtgagagtgtggactactgaaacaacgacttttgtgacaggcaaaagcaacacagcttctgggaaagatcctgttttgggccttcatcttcggccaggagaaggtccaaacaccagataactgtgcaccttcactgaaagaggagagcttgcctgcagagactgctctgaccactgaaacacagggaagagagctggtctcctaggtcgctgatagagggtaacaaaaacaccagaggaacaatctctaaacagagacaactataactactaactccagagattgccagatggcgaaaggtaaacataagaatcttactaacagaaaccaggacc

SEQ ID NO: 3249 - DNA, 1200 bp, mus musculus
tatactcactcataagtgaatattagccataaaatacaggatactcatgttacactccacagaccctacaaaactaaacaagaaggaaggcctaagaaagaatgcttgaatctcacttagaaagggaaataaaatagttataagagatagatggaagaaaggaactgcggtgggaccaggaatggagaaagaaacgggggacgtttgaggatcaggtgtgagaagagactgaggagatagccagatggccatgagactgaatggaaaactgtagttgttgggggatgtcccagagacctgggatagcgaaacctcccaagatcaatgggcatgactttagttgaaagtcacagtagtggggatatggaagctgaagaggccacctcctgtagccagacaggaatcccagtgaagtgatcatgattgggacaccaacctacccacaaaactattgacccaaaatttatcttgacaacaagaaatgcatggactgggatggagcagagactgagggaatggccaagtaataaccagcccaactagagagtcatccaattgggcaagcaccaatctctgacactattaatgatactctgttttgcttttagacaggaagttagcatggttctcctctgagaggctccactcagcagctgactcacagccaaatattggatggaggttgtgaactctttggaaagttgggggaaagattaagggccaagaatgaggtagaagtacacaggaagatcaacagagtcaactaacctggaccctttggagctcttagagtctgaaccaccaaccaaaatgcatatatcggctagacctacacctcaccacacatatgtagcaggtgtgcatctcagtcttcacgtggatcagaactgtagcaggtgctatccataaaaatggtgcctatctagtggacaaactagggtgtcttgtctagcctcagtgagggaagaagtacctagccctgtagagacttgatgtgtcagggtcaaggaatacaggggagggggaaggtccactgtctcagaggaaaagaagagaagggtgggtggacgaactgtcggaggggaaccaaggggactgcaatggggattcaaagtaaataaataaataaataaataaataaataaattactttaaaaaagaacagagccactagaagtttggataatgtttttataagca

SEQ ID NO: 3250 - DNA, 1200 bp, mus musculus
cacagagtttgtctcctttaatgtccttgcttaaggatgttctgacccaaaggagttgtaacacccacttttgtctattgtggaacagtgaaccatgccgggaaacttggtaaggtagagtgggtctgagacccagcactcgggtacacacctgagacagcaggtgcctccctgctccctactagattcctggccaggaacatgtgtccataatcctcacagcaatcacaaagcccagaacagagttctccatactaataagcttcccttcccagacattccttcctcctaaaggtatttaacctctggtacaccctgaggaattggtatgcatccattttccacgatgaacactcaataaatggtatggataaatgtggactatcttttccatcgaaacctccatggggagcatggagaagaccttcgtctgtagagccacagcctaagtctcctgtagaaggcctctttgcacttccagaaagccattgccaagctaaggacaatcattgatgagctaagccagagttgcatttcccatcctggccttgtcgaaggccatggaaccttggtccttcattctaactcttctgtgcgacactctagcagtgactagatgtctgggaatcagggaaacctaactttggcctcccccatcttagactgcattcttccaccccttgagcagtatctcgatgcttccctaaagccgagcacccgactacatcatcatggggtatgtgtcatctccccagtggcatgtcaccacatgctaacagtggagcagaatttggacccaatgtctataatgtattttcagtggaagaaaatgtcttagttagggttatattgtggtgaagagataccatgaccatgacaacttgtatagagccaatatttaattgaggctagcttactgtttctgacgtttagtccattatcatcaaggcaggaaacatggtgttgtctaggtagatatggtgttggagaagaaattaagagttctacctcttcattcacaagcatcagaaggagattgtgtgccacactgggtgtatctcaagcatatttaagacatcaaaacttatccccacagtgaaacacttattccaacaaagccatacctactcctataagaccacacctcctaacagtgccactccctatggccaagcattcaaacctatgaatctatggggc

SEQ ID NO: 3251 - DNA, 1000 bp, mus musculus
cccacaactgaacatgcaccatgtattctttcaggccatattcagaatctgtctaattctcccagtctctctatccaggccatacagacaaggacatccatagtattttgtgagcacccgactcgccagcaagaacgaagccacaataggatccttctgcacacatttattgggagagctcaatcacagaggcaaaaagatcctgagccaagaaatggtgctgcttatataggcctaggagtgtcgtgtccatacctgattggttatgctaccagtacctcattaatatgtgttgggccaggcagtgactcggcaaaaaactcttatgcacatgtgcacattggttgtttacccgtaatcatgggtggtggccagtggtagccagcgccatcttgtaatggtgtttgcggcttcccacatctccccctttttattttaataaaatgatgctggactaggcctatgcaattatgtccatctgccacagctcctgttttaggtcgttcctctatgttacagccttacccgtcatagggtaaccctattgccaccaggccccatgtcttaggttggtctgtgcatgaggaaagttgcccgtctctggacaccgcaatgctgtgtgacagtaattgctaaatgacctagggcgagctctacaaaagaggccagccaaattttttaaggaatgaattagtggagaaatcatgatcactctatcgcgtgcaatgaggaaacgtcagcgatgtgcaagggctgatcaatgatcgttgaatctctcttatcccagtgcaatggatccacaaatccgtggggtgcaagagcagagaactcagatgccaaataattcttgagcatagataaccaaacttcaggggaggtgccattttcaatggctaaaagtgcctgagttataatcaccttgtcaggtttttgttgagttctgaatttgcaaaccaaccaaagcatgaacatcagtccacagcatatagcagcacaaaac

SEQ ID NO: 3252 - DNA, 1400 bp, mus musculus
agtctatccttcctcctggccccttattaagatatgcaacctctgtggttagtttgactgtaatacacataacaaaagcttaacagctgatatcacgtacaagagaaaacatacaatatttttcctttagagtctgagttaccttactcaggatgatttattttcatggtccattcatttatctgtgaatttcatagttcatttttttcttaataccttgacattattccattatgtaaaggtacaacactttcactatccatttaccagttgattgacatctagactgtttataatttctggatgttatgaatatagcagaactcctctcctcaaggctcaggaacctatgtagaagaaaagacagaaagagtgtaagagctggacaaaatagatgattccaaggaaacaatgctttccagacaaaacaggattgatgcacatgtgaactcacagcaactgtggcagcatgcacaaagctttcactggttcaagccagactgtatcccagtaatgttgaaagggaagtggatatcaggctagcacccctgaccaagaagctctgtgtaattgatacccactggaaaagtaatatcaatttcctccaatggagtttcaccaggtttatcaatccaatcacagagcacagcagttcccacgcccaggagtagttgaccaacacaaaatgaactcagtggtaattttgtggacttgttttcttttgctttgtctaggcatttttttgtcttattgatctttttattgttttgatttttatttttgtttctttctttgtattttttaagagagaagagaaaacaagcataaagttgggtgggtaggaagatgtagatgatctggattgaacatagaacagagagaggaaaaatttcatgataacgatatcttgtataagccaggcacggtggtgcacacctttaatcccagtacttgggaggcagaggcaggcagatttctgagttcgaggccagcctggtctacaatgtgagctccaggacagctagggctatactttctcgaaaaacaaaacaaaacaaaacaaaaaaaaaacaaaaacaaaaacaatatcttgtataaaaatagtttttcaataaaaaatatctgtcagttgtaaaggtgctgtttttcttttacttaaagtatctcttgaaataattatacttttaaaagaaacattataagaatttgtgaatatttaccaaaggtcatcatctagatttcctgattgttggtattttttatatatgttactcagaagtctccttaatagatacagagacagaggacagacagacagaagatagtgatgatttgaatctgttaagagcaaacctcaggaataatgcccctttatttctaatacttcagaatatattgca

SEQ ID NO: 3253 - DNA, 1400 bp, mus musculus
aaaaaaaaggaaatgtcattctgtgccaatgagtccaaggcgctttctcactttctcttctattagattcagtgtatctggttttatgttgaggtccttgatccacttggacttgagcattgtgcaaagtgacaaatatgtgtctattttcatttttttttttacatacagactgtggggccatgataggcaacctattttggttgaatgaggcttgctcctgcgacccgatagaaaactctacaagggacagaaaagtgagccacattcccagagtcgagtgcctgacaccacagaacccccaactccatgattctatgactataagtcatgaaaacaatgtcccaagcttctggcgttctggctagactccacccccacagttacctgactgtagccaggtatgctccttcccagttacatgatagcccagcccactataaaaggtactacttgctccctccttgctctttaagctcccacctttcttactcgcatctctagccctccttctctctctccttttccccttctctccacgtggccatggccagcctctctctgtcttctctccttatccctacctttctataataaatctctaaaaccatagactgtctctgctcatgccgtgcttgaatgatgggataggctttcccctaactagccttgtctaacctcccgcctgaaggccttcttgcactccagccacagatcagacaaaggactcttgcccacatgggaaccacccagtgccctctccccctgccctctcctccctttggcctttggggctgattgagcagccccagggcccccattctgttctcagctcttccccagtgtccaccagtggggactattggatgcccgaggataagaacctggtgtctaggacttccccttgtccaccactcatcaagctggagtttgtggcttcatatagccagacacccacctgggaccacatggaaagtgtgcagcagtcagttttcccccacccactttatcccctaggtgcccactgccccacaacagacagccagttagaccagtactatttattgaagatgctttcttttttccattgtatatttttggtgcctttgtcaaagatcaagtgactgtaagtgtatggttttatttctgggtcttcaattctattccattgatcaaagtgtctgtgcaaataccatgcagtttttatcactattgctctgtaataaagtttgaggtcagggatggtgattcccccagctgttctcttattgttaaaaattgtttttgctattctgggtttttttgcctttccagatgaatttgagaattgctctttccatttctttgaagaattgtgttgggatttagaatggggattgcattgaatctatagattacca

SEQ ID NO: 3254 - DNA, 1400 bp, mus musculus
aaaaaaaaaaaaacaagttttaatgaaatagataatgaggtagtctgaggttggatgaagcaggatgctataataaatatgtctcagcatctcagcatccttgaggacaaatcttgtcagggacttcattgttgtttgtaaacataaacgtccacaggtattacacagtttggctttagaatatatatggaatgtgtggtatgcacaattggctaaaaatgattctatgctctgtgttaaagcagataaaacatgtttttctttttttcttttaaaaaattttagattttattgttattattttttaattggatattttatttgtttacatttcaaatgttatcccctttcctagttttccttctgcaaatctcctatcccaccgcccccccccttaccctgcttctatgagggtactcctccacacacacacccacctactgctctaacattcctctacactgggggaccaagggcctcccctcccattgatgccagataaggcccctttagctccttttgtccttcccccaactcctccattggggtccctgtgctcaatctgaaggttggctgtgagtatccacatccgtattggttaggatgcagcagagcctctcaggagacagctgtatcaggcttctgtcagcaagcacttcttggcgtcagtaatagtgtctgggtttggtgtctgcatgtgggatggatcttcaggtggggcagtctctgtttttctttataagttactttggattttataatcaaatttcgtttgtatccatgctatttgaaaggaaagcatgataagtcctgaggattctgtagccaacaatagttactggccatgcttagcttaagtcctgactgaagacatttcatgtctcagccagtctcagagctcttcccatgtagaggaatcagcaatacatgttacctgacccatccagcaggtccagttattcgagggtctcgaggggaccttcccctaagaaccaaatgtgtggtgggggggggggggagaaaagacggacaccaagtgcaaggacaccaagtgcgaggacaaggaaccattctgaatagcatcaaggtgtcactgtattagcaaggcttaaatgcacaagcaaaaggggaagtacacagcaggaggaatggggcagtggaaatgcacaagcaaaggaggaagcacttctcagcaggaggaatggggcagtggaaatgcacaagcaaaggaggaagcacttctcagcaggagggatggggcagcggaaatttttcttttggtgactatacggggaagcaggaacttggtggtatcagggtacatcttgtggtcaggacatccggcgctgacttagggctggagcaatctgtggttgttctcagagcggtgcgttggtggc

SEQ ID NO: 3255 - DNA, 1200 bp, mus musculus
gaattaggagctttttgcattttctttgactgttgtgtcaatgttttctatgatattttctgcacctgagattctctcttctatctcttgtattctgttggtgatgcttgtatctatgactcctgatctctttcctaggttttctaattctagggttgtctccctttgtgacttctttattgtccctagttccatttgtagatcacggatggttttattcatttccttctcctgtttgattgtgttttcctggaattctttaatggatttttgtgtttcctctttaagggcttctagctgtttacctgtgttttcctatatttctttaagtgagttatttgcatccttcttaaagtcctctatcatcatcatgagaagtgatttttagacccgaatcttgtttttccggtgtgatggtgtatccaggatttcctatggtgggagaattgggttctgatgatgccaagtaaccttggtttctgttgcttatgttcttatacttgcctcctgccatctgattatctctagtgctaccttccctcactatatctgactgtagctttttcttcctgtgatcatggttgtgtcagaactcctcagagttcagctgtctctgtgatcctgtgattctgggattctgggatcctgagatcttgggtgtttcagagctcctgggagtcaagctgcatctgggaccttgagatcctggtatgaccaagctcctgcgatcctgtgatcctgtgcatgttagagcacctaggagaagagcttcctctgggtgttgtgggaatggctgcaaagttagtgcagttccttcccagactggtcaggtggagttccttggtgcctatgtcccactggtcccagttactccctggtgttggggcaggtgttgtgtcctcttcacatctgatcctatgatcctgggattattagagagcctgggagtggagcacctctggctgctctgatcctatggttggcttttcaagataggatttctttgtgtaactcttgtctattctggaattcattctgtagaccagaatggcctcgaacacagagatttgcctacctctatctcctgggtgttgggattaaaggcatgtgccaccattgccatgtgttcaattcctattctttaaaacactgaaaaataaaacatcctaggctagtcatggaaaaacaaacttaactgaa

SEQ ID NO: 3256 - DNA, 1200 bp, mus musculus
cacatggctacccccacactatcttcagggtaatctcggtggagggccccaaggtccccagaggactctccacgctgcaggctccctagcacacaaggatcttgagatcactggtgagtggaactcaacatcacttccaaaaaaacctggtcttgtgctagcagcaacaggtcaaaggacaaaggcagaccctagcacacccagaatcattcgatcactgagaccagtctatgcaggagagcacgtgggcagcagaagcaacagagcttcttggacagggtcccttccggccttcatacccagccaggagacagagctgagacccagacccctggacaccttcccggccagaggagagtcggcctccagggagggctctgatcccaggaatcaagaggtgaatcttagctccacacttttgtgcaccttccctgcaagaggagagcttgcctgcagagagtgttctgaccactgggacacaggagagagttggtctcccaggagttctgacagaggctaaagaatcacaggaggaataagctccagccagagacagctagaacatctaacaccagagattaccagatggcaaaaggcaaaataaagaatcttactaatagaaaccaagaccactgggcatcttcagaaaccagtacacccaccacagcgagtcctggataccccaacacacccgaaaagcaagattcggatctaaaatcatacctcatgatgctggtagaggattttaagaaggacattaataactcacttaaagaaatgcaggagagccggtcatggtggcacacgcctttaatccaggtactcaggaggcagaggcaggcggatttctgagttcgaggccagcctggtctacaaagtgagttccaagacagccaggactatacagagaaacccagtctcgaaaaaacaaaagaacaaaagaaagaaagaaagagagagagagagagagagagagagagagagagaaagcaagcaagcaagcaggagaacactgctaaacaggtagaagcccttaaagaggaagcaaaaaaaatccctcaaggaattacaggaaaacactccaacactcctaaacatatagaagatcttaaagaggaaacaaaaaaaatcctttaaagaattacaggaaaacacaaccaaacaggtgaggaaattgaacaaaaccatccaagatctaaa

SEQ ID NO: 3257 - DNA, 1000 bp, mus musculus
gaagctctgtattgagtgaagtcctgggtgaatgagtactgttgacatgggcatgccttgctcccatgggaatggaaaagccttccccaggcgagattcacagagatggaaacatctccttcaggggtctgagtgctagtgactgatccatgtatacaaaattagcaacaacttcttcctcccagatgtctgcaacctaccaagcagaaacctccttcctatgtagtctagctaacttctccccgctctgctgcacataataaagcacggtgaggttccacattaagtgaactttgccagaatgccctcagccagtcctggcaaggctctatttggttgtagagcctcatatgcttcctcaattaaactgcatgagactttcttttagttgtggaaattgaggggaacttctacagtaagtatgctccccaaagcccaagtcattgaatctgcactgccttgtttgagcaggttccaccatcaatatcctatataaaacagaggcctgtaacctcctctgtagtgggccagacagaccacattttagacagcacagacggtgaggcctcctcagcaatcctcactgctgctggagcacaaaacaaacaggctgtttattaagaagtgacaaacagaacaggcacgcacacttggaactgtgtgtataccctgccttaagctagcaagcatgcacaggctttgctcccagtgggaagaggaggaaaacaggacaagctaggcctttcagtgtctcggtattctaacttctctccagcagcattattctcagatcccatgaaatagccagaataaactagagtgtgcagataaacacttcctccggaaaaaaccgaccgctacctcatctagatatttaaatagaccaataatcaatagaagttcatcgataggttctaagtaacagttcaataggaaatttctgccacgaaattacacagtatagggttgactatgctaatgattgtacagtgtatatttc

SEQ ID NO: 3258 - DNA, 1200 bp, mus musculus
caatgccaggtattccttcaggaggaaatttctttcctgtcatatactcagaataatcggggggtgactcaccagcctgttcttcagctatgggatcttctttttcattaacatcgtcccacatggtgaagggaaattcgccatcaagaccatcgatctgcttctgctcccactgtttgtcacccaggtcagcgttcacgctttcttctgcaccggcctctataaaggtcgtcaaaccacagagattcccttcataggggctgagctcaccttgaccattctctgccgccagaaagcccgtaaaagaggcagtggtcggctggagatagtcgtcttcattaactggcaaaaccatctggcttccaaattcaggactgaatagtaggttgtctgagtcttggtagcccaccacctcctcctctcgtgtctgaacgacaaacatttccttatcatgatctctactactcaggctgctgcccacaagcggctgcagagcaataacaggagagtggtattggctaccatgcgcccaatcgacacctacatctccatatacttcgatggtttggcctacgctggtttccagagaaaccgcctcgatatcaccgatattatccggtggcagcagctccacaaaatcagcaggaatctctgcgctttctgtgttaagacacagaagtttctctgtctcagaggccatggcggagacccgcggaccggtcctgggtagcaagcaggtgggagagagctgtggagtagagaaaaaatcagggaagaaaagcacgcgctggcgtgctggataaaaccaaaacaaaacgagaaaaaaaaaaaacccaaacgacaaaactacaacaaaaaaacaaacccgagagagcctgacgaaagccgtgcgcttcggagaaaagccgccgtcgtctgaggcactacggtgtttccggaggagcttataggtgtttccggaggacaagacgcatgcgttgaacgtgtcactggatacgtcactgggcgcgccactggaaacgtcactaaactgcgacagaccggcaagaaagcttcttttgcgcatgcctttttgattgcacaccttccttcaggagttgcagaaccttccctgggtttcctgctattttagtttctaactgaacatagatttcctttctgagcttttctatattttatttcattagatttcttacctac

SEQ ID NO: 3259 - DNA, 1200 bp, mus musculus; identical to SEQ ID NO: 3258

SEQ ID NO: 3260 - DNA, 1000 bp, mus musculus
atattttaagtatgcctaagatatgttgctacattagaaaaatggagcaaccgttctttccagaactctgaagatagattctgcattggcatgagggtgatatgatttataagaaatggctcaggtgttgagacttttgttagagatggatgagagcaccaattgctctgtcttacctcttcattaatataccagtatagggatgcatcctttaggacaaaccagtacttcttccatttctgtgaaaaatagctctttgcatctttctttttccaaagccatccttcacagtcaccacggccaagatccttgcaagaaattcttcttttgctcttgcctgatatagctcctaaagagagtgagtggtaatactttatacattttggaaaatgcaaagaattaaagaataatctgtagattctgaaagcaagtcagatacttattattcataaaagtatcatttctgattatgtaatcctcatctcaagactttttgagaccatctgttatcaaagatatatgcatggcaactgatctaaaaccacgttgacttcaagacaatgagaggattaatgaaatgtgctggggaatatcactgtacaaaagcaagtttaaaggttcattttcttttattacctttgtttttcttctttgatttgtgctgcagagaggactgttgaaatgtctgaaatgaaagacaggggaggttagtatgctcagagtgtgatacagaaaactcatagggttacaacaatgactctcagtccaggttagagaagtcattttcccattaatatttcaaacattactttattttcccatctcccttgaagcaggagaaggcctatgtgtcctaattttgttggcagattctagaataagacacattgtgaaactaagtgttcttaacccctccccctgacacacatacacaactgttcaatttgagagatttattgtgtttccaatacatctcgtcgtattctcacataatctgatg

SEQ ID NO: 3261 - DNA, 1000 bp, mus musculus
gaaaatatacgatttttttttgactgtggtagagggatagggttgccatcccacagtcaaaaattctgacccagaattgttcctgtctaaaagaagttcagggacaaaaatggggaagagactgagggaaagaaggtccagtgacaggctgaaattgggatccagctcaaggggaggctccaaggcctgacactactactgatgctatggtgtgtttacagatgggagtctagtatggctgccctggcccaacaagcagctaaaagagtcagctgcagatacttacacccaatcaatggacagaagccagggactcctgtggttgaattagggaaaagctggaagaaactgaggaagagggtgaccccatattaagaccagcagtctcaactaaatgcgaccctcgagatgtctcagacactgagccaccaaccaggcaacatacaccagatgatatgaggccctcaacacatatacagcagagagaggactgccaggtctggcctcagtgagagaaccctaaccctcaagagacttgaagccccaggaaatgggaggtctggtggggtgggggtgggggatggggacatccttttgaagatgagaggggaggggcggaggagggaggaggaggtatgggatgagaaacagtcagaaggccgactgggagaggataatgacgggactgtaaaagaagattaaagaatattaaataaaaagtgtttaacaatcaaaatagaaaacatctgaatttctctaaataactatttaaataactattctaaactaaagagcaaaattgtaatgcatccagaatctacttagtatgtatttttatatacagtgatcatatgctattgtagtcaacattttacttcaatcatgtgaaatgcacacaaatgccaacttaattgttttcatacttacattttctgtggtcccggtaattacatggaggccatcatatgtggatttaatatacataccctaagaaaaagac

SEQ ID NO: 3262 - DNA, 1000 bp, mus musculus
actgtcatagtgagcttctggtgtcaacttcacacaaatgtaaaatcaccctgggaagacgaaacctcaattaaggacatgccttcatcatcttggcttgtgggcatgtctgggggtgggggtcttaattgctcattaatgtaagagggcatagcccactgtgggtgctgccatcccaaaacagatgggtttgaaccaaataagcaaggtagctgagcaggccaaaaggaataagcctccgggcaacagagagcaactaaggaaggcactggcagggtatcctcatatttagcctactttatttacttaattttgtcatttattttattaatttgttcatttatttggcaagaaaacatttatagaagattaaccagtgaaatagtctttgtgatttgcaggaattgttgtggtttaaatactgggccagtattgagaatagagaatctaaattaattctagtcagatttaaatttagccaaatctcagacagagtatttctttagaggtataaccaagtataaaatgtatctagggaaacacctgatttgggcctattattcaaatgtgtggtttagatttattttatactgtcaatctaaattttgatttgtttattacacattgctgtagaaatattgtactcatctttcaaggctgtagtctgtcttttcttattccaactgggttagaacttttgttttattataaatttggtactatggcaatgttcaggccttctgtgttgttattttgaagttgctctcataaagaagcagggcacatatccttaccctatgaatatcatttgtcttgtgacttgctcttgtcaataggtgtcactgggagtgttagtgagccagcttaaagcttagagtttaagaaaccttgtggatttcatatccttttattttcttggctcctgaggaaagtcagagcagaggaaaaagtgctttccattaggccttcacacactgatcaccttgccaggttgattgta

SEQ ID NO: 3263 - DNA, 1000 bp, mus musculus
gttgctctggtgcctgcatacccctacatgtactagcatctttggtactagaaggtactctgaatactacgaaaggagaaatgtaaacaccaacccaatctcaaaccctttgatctacaggggtatactacctgcaagatatgttgctgcaatggttacacaaacctgttgtgggttgccttggtgctgtttgtattttgatgttaatcctgtccctgatcaggaccagatcatgtaatcaggggattccatgtgaacctgctccccattttaactggtcaaataaaggttaaagcctgtgattgggcagtggaagggaaaggtggagctggaagttttagagaaggagagagaaaaagaagaggaggtagaagatgaaacagaaccatgtggcctggagaagctgcaagcagcaagggatctcctggctgggaaacagagtagtgtagtaggaaatctgcccaatttaggtacacagtttataaatattatgtgttgtgtgtttttttgcatgggcatattggggtaggatattctttgcccagcaattgtgctatctggctgattttaaagtgttagaaatgtctgatgtttttgtcagagactcaggtgggcaggagagaaagaacacagccaaggccgaaatcgcccaggctttagaatgagaggattgggcaaaggactgcgctctaggagagaggtaactacagtggattgtggattggtgagacagtgatctcagaaccctggagaggcaaagccagtgtttgtgggagaggcattggctagcaggtgggtggatgctggtcctatagcctacccagaccaggcatgggtttttaaaaattacacacaacataaaccttgtaggagtaactaacaagtatctaatttgatttaaggctcagtccacaagatggaagccatacctgacactgcatcagcgaacaagaacctgacactagatatcccagagacttagtgtaaaagcaaatactac

SEQ ID NO: 3264 - DNA, 1800 bp, mus musculus
tttactgaccctttaagttgaaagtcttcattctcatctataccgattatccttaggtttggtcttctcattgtatcctagatttcctcgatgttttgagttagaatctttttgcattttgcattttctgtgattgttgtgcccatgttctctatggaatcttctgcacctgagattctctcttctgtctcttgtattctgttgctgatgctcaaatctatggctcctgatttctttcctaggatttctatctccagagttgtctccctttgggttttctttattgtttctacttccatttttagattctggatggttttgttcaattctttcacctgttcggtagtattttcctgtaactctttaagggatttttgtgttttctctttaaggacttctagctgtttacctgtgttctcctgtatttcttaaaggagttattgatttccttcttaaagtcttccatcatcatcatgagaagtgactttagatccatatcttgcttttctggtgtgatggtatatccaggacttactatggtgggagtgtttggttctgatgataccaagtaaccttggtttctgttgattctgtttttatgcttgccttctgccatctgattatctcaagtgcttgttgccctcaatatatctgattggaacctgtccttcctgtaatcctggttgattcaggactcctcagagtccagctttctctgtgatcctatgattctggtatcctgtgaacctgagattctgggtgtgtcagagttcttggcagtcaagcttactctgagaccctgaggtccttgtttgaccaagctcctgggattctgggatcctgaaatcctaagatcttgggcatgttacatcgcctggaattggtgtctcctctgtgtaccatggggcggtctgatgtgttcaaaatcaaggtataccagcactaatcagaaggaaaccaatctgctggtcaggcagagttcctgtgtccttgctcctgctgtcatagacttatcacgatgggtttagaacagatgttgtgttccactcaccagtgaacctaaggtcctggatgttgtagggcacctgtgccatggagaatcctctggggaagtgggaccatccgctgagtttgtgcccaaggtctacactttgtcttgaatattaatgtatcatggtacacttcccacattgatggttatttttctctcagtacttggaaaacatataatgattctgttgccattgcaaagaaatatattcactttcagtttattcttcatgcctcagcactttgtattccccttgtctatatcgaggtggtgagacctcaataatttttcatcatgtctcccttcacctgaatctgttttcttgccttaaccacccattgaactttgttccctttagtaattatatttctatttctagaaatactatctagttgtattaatctgtctgggaatatttggtactgggccttctgttacttctgtaataactttaaacattcttattttgttgtaaatagttgttcttttatctgaattttaggtggtgtaattctgctgattcttcttcacagtactccctaccccctacataccataagcatcatctagcttgggattgtgagtgcctacttgatttgcctttatcgatgaaagccttgtgatgagtagaacatggtttttggaaaggtttgtgttttctttgattgggcaaactcaaaatgactttaatttcttctattgattgagtttctcctaagagatataattgacataaatttgaacatttc

SEQ ID NO: 3265 - DNA, 1000 bp, mus musculus
tgggtgcagagtcggcggacacccccaaggtctctagaggacagcttctgaggaagaccctatttcaagctccagacatcccggcactttccctgccagaggagaggtatccgccccacgcgggagggctttgcctgagctcctaggggagccatcttggttcccggatccctctgagacagatctgtgaaggtgagagtgtgcactacagaagctaacaggttctgggacaggccaaagcaacacagcttctgggacaggcccagtttcaggccttcatcttctgccaggaggcagatccaaatgccagatatctgtacaccttccctgtaagaggagagcttgccttcagagagtgctctgaccactgaaactcaggagagagctagtctcacaggtctgctaatagaggctaacagaatcacaagaggaacaagctctaaccagagacaactataacaactaactccagagattaccagatggtgaaaggcaacttaggaatcttactaacataaaccaagaccactcaccataatcaggacacagcactcccacctcacccagtctggggcaccccaacacacctgaaaagctagactcggatttaaaagcatatctcatgatgatggtagacgacatcaagaaggactttaataagtcacttaaagaaatacaggagaacactgagaaagagttacaagtccttaaagaaaaacaggaaaacacaaccaaacaggtagaagtccttaaagaaaaaacaggaaaaaaacatccaaacaggtgatggaaatgaacaaaaccatactagacctaaaaaggaaagtagacacaataaagaaaacccaaagtgaggcaacgctgcagatagaaaccctaggaaagaaacctagaaccatagatgcgagcatcagcaacagaatataagagatggaagagagaatctcaggtgcagaagattccatagaaaacatcggcacaacaatcaaagaaattgcaa

SEQ ID NO: 3266 - DNA, 1200 bp, mus musculus
actctaaatgaacgtttctcaagaataaaaaacagacaggatgcagatttcaatcaaacgaaatcaaattcagatccagaatttcacaggtaatgattaattactgtcttttcacttacctcagaagaatagtccagctttctgagctcgctttccttctgagcttggtatagaacctagaagtgcactttgtacgtaccaaaagcagtctgagcagctgctggacccatacacagtgctaacttaccactgtttgaaaagaaagattcacttgctctcattctgctatgtctgtagtagctgtctactgaagggaatgctggaaaaggtcagccattgaaatcagggcttactttaagtggtcacaaatgattgttctgaggtctgatgaaaacatgcatgccttctgtcggtacttgtctgagcagagggtgcaccctgtatgcagtactgagatgaatcaatgttataattttatccatcaccaaaattgagtttgaggtcacactagtgattggagaaccaccaagacttccctacaatacacccatagggtatgtatggcttagtagactgccatgtaggtgaaagcctatcatggcgtggtggcacacggcattagtcccagcacttgggaaacaggcaggcagatacctgaatttaagggagtgagtttcaaaacagccagggctacattagaaagaccctatcttaaaagacaaaagaaatgaaaagctacctgacagcaggttgttttggctttttctaagacctactggtttatttctaattctatcctgtagtaaaagaatcagtgtataacacaattagcataattatttaattatgtgcctttattattttaggcgaatagatatgtctttggatgattttcagaataaatatacgatggtatatgaaccagataaggtaagtgagtacaattattattgctatagtagtgggaaaggagttaaaggtctataaagaaaggatgacattcaggaatataaattgaaaaagttctccaagtgactgatggcagtccaggatggagtgagatgctgaaaaggacaaactttttctttgggaggcatggttagtaagcataacaactttgaaaagttgatttaaaattacattgaatactcatccccaaacttctcagagtaaagcttatagaaaatatggttgatagcc

SEQ ID NO: 3267 - DNA, 1200 bp, mus musculus
cgtgttcacccacttattgaataatgctcctattctcatgcccttggttttctttttatgctttacttagatataatgtacacagcataaattccacttgtcctaaacatcactgtctttcttagtgatttttaataaattatagagttgttcagccattgcactgatccaatattggactatttacatcacttcccaagctgcccacttgcagacagtccctattctttgttttgttttgttttgtttttctcgagacagggtttctctgtatagccctgactatcctggaactcactttgtacaccaggctggccttgaactcagaaatccgcctgcctctgcctcccaagtgctgagattaaaggcgtgtgccaccatgcctggctgacaatccctattctttccctcagcctcaagcaactgctaatctttacatattttatgccttttcatgtagataaactgtatattatgtattattttgtgcctttctttcacttagcatgattatttaaaaattcatctatgatgtaactgcactcgcagtttaattctttttttttttttttttttatgtatagcattccattgtgtggatattccacatctttctcgctattcctcagtaatacacacttatgttgtttctactttttggctttgaacaatactactgtgaacattccagtacaagtatttatgtagacatgtattcattttcttggagcttcctggttctttgtcactagtgtgcatactctaaaggtattctggagagactggtctgcacaggtgagagtgcagactacagaagctacacagcttctgggacaggcagaagcgacacagcttctgaggcagaccccatttcgggctccagacatccaggcaccatcctcgccagaggagaggtgtccaccccacccaggagggctctgccagagcacctgggggagccatcttgggtcctggatccctcagagactagtctgcacaggtgagagtgtggactacagaagctacacagcttctgggacaggccctgttttgggccttcatcttcagccaagaggcagatccgaaggccagatatctgcaccttccctgtaagaggagagcttgcctgcagagagtactctgaccactgaaactcaagagagatctagacacccaggtctgctgacagaggctaataga

SEQ ID NO: 3268 - DNA, 1200 bp, mus musculus
cttggatggttttattcaattccatcacctgtttgtttgtgttttcctgcaattctttaagggattttgtacttcctctttaatgtcttcaacctgtttagcagtgttctcctgtatttctttaagtgagttattaaagtccttcttgttgtcctctaccatcatcatgagctatgcttttaaatccaggtctagctttttgggtgtgtaccctggactgggcgaagtaggagtgctgtgttctgatgatggtgagtggtcttggtttctgttattaagattcttacgtttacctttccctgtctcgtaatctctggagttagttgttatagttgtctctgtttagagattgttcctctggtgattctcttaccctctttcagcagacctgggagactagctctctcctctgagtttcagtggtcagagcactatctgcaggcaagctctcctgttacagggaaggtgcacagatatctggcgttcggacctccctcctggccgaagatgaaggcccaaaacaggacctttcccagaagccgtgttgctttggcctgtcacagaagctgttagactgttccacactctcacctatgcagattactttcggtggagtctcagaaccaagatatcttcctctgatcctcaggcaaagtcctcccgggccagatggaccgctgtattctggccaggaaggtggccggatgtctggagctcgaaaaaggcgctcaggcattttcttaattggtgattgatggtggatcacccagcccattgtgtgtggtgccaccctgggttggtggtcttgggttctataagaaaccaggctaatcaagtcatgagggagcaagccagtaagtagcacccctccataggctccatatgtgctcctgtctccaggttactgtcctgacttccttttatgatgaactgtgatgtggaagagtaagtgaaataaaccctttccttcataagttgctttgataatgatgtttttatcatagcagtagacaccctatctaagataacttctttttcagtttttagatgtaagctttatatatcaaaacatttaaactagcagtattataatagccagaagctggaaagaacccagatgcccctcaacagaggaatggatacagaaaatgtggtacatctacacaatggagtactactcagctattaaaaagaatgaat

SEQ ID NO: 3269 - DNA, 1200 bp, mus musculus
acaagaatgacaaggaccccaaagtgggttaacacagcagcttcttgtagctttttctctttcagctctcttccccagcagtttcttcttcccctgtccttcttgcagcaagggctatactcctattctctttgcaactgacctcatctcgcttcacaccacctcatccaatcagaaccacacacactccatgtatgagctcaggtcggtcacagataggctgacaggtccagatcatgagggatagtctagcttggcaggcagcttcactatgcatgtctggcaaggcagtagacatgtggggttcacggggcctggcaatgagccagggcgccatcttggtccatgagaccgcacccacctcctgcagtatctatggttccagatttctttcctagggtttctatctccagcattttctcactttgggttttctttattgtttctacttccctttttaggtcttggatggttttgttcaattctatcacctgtttgcttgtgttttcctgtatttctttaaggacttctacctctttagcagtgttctcctctatttctttaagtgagttattaaagcccttcttgatgtcctctaccagcatcatgagatatgattttaaatccgagtcttgcttttcgggtgtgttggggtatccaggactggctgaggtgggagtactgtgttctgatgatggtgcatggtcttggtttcttttagtaacatcttatatctgcctttcgccatctggtaatctctggagttagttgttatagttgtctctggttgaagcttgttcctcctgtgattctgttagtctttgtcagcagacctgggagtctagctctctcctgagtctcagtagtcagagtactctctttaggcaagctctcctcttgcagggaaggtgtacagttatctggtgttcagacctgcctcctggctgaagatgaaggcccgaaacaggcctatcccagaagctatattgcttctgcctgtcccagaagctttgtagcttctttacagagccctcccaggagaacacctcttctctggcggggaaggtgcctggatgtctggagcctgaaatggggtctgtcctagaagctgtgtagcttctgcctgtcccagaatctgtgtttcttcctgtagtccacaatctcacctgtgcagactagtctctgagggatctgggacct

SEQ ID NO: 3270 - DNA, 1600 bp, mus musculus
ttttttgaaaatctaatgtaatttggctatttcattactatcttattatttcagtctttgcaacttaaaccctttaattattcatattagttttgattggcaaatcacaattctatacacttataggtacagtgtagtgttttgaccaattatgcacatacaactttggaagaataaattcaaataattatcatatccatttccttgctcacaaatacttttgtgagttatttgaaatttagtatcgtagtttttatagaaaccagatagcatagcttaagttgtagttcatcaaatttcatactgaatgaagataaatattttttatttatatacagtattttagatgtttttaaaaacctagaaagatctaagggaatgatacttaattcaatgactctcagttggtgcctcaactcttcttatatccacactttctgccccttaaacaactagcatgatgagcagtatgactgacaatagcattaatttttcatatattatatatatatatataatccatatatttttaaaaattttatgtgtttaaattaatttatttattcattttacatcccaatatcaacccccctccttccagtcccagttttcacagttcctcccattcctaccttctcttctcttctgaaacagggaaccttccctgggtgtcagtgcccctcccacctccactttccaggcacatcagtcactttaggactaggcatatcctctctcactgataccagacaaggtggtccagttaacagaatgggatccacaggcaggcaacaaattcagtgacaacctgcctctagttgttagagaaccttcatgaagaccaagctgcacatctgctacatatgtgcagttggtgggggtgggggtagggcagctaggaccatcccacactttctcttcggttggtggttcagtctctgtgagcccccaaaggtccaggttagttgactcttttggtcttcctgtggagttcctatctcctttgggtttctcaatccttctcccaactcttccacccctggactccatctaaggtttgtctgtgggtctctatatctgtttcatttagctgctgggtggagcctctcagaggatcttgtctgcaagcataacagaataccacttacagtgtcaggggtagtattgtagatatatatagtcatgctgctatgcaaaaatctcaaaattcagttttcctttctatctgaaatatttataccctttgatcaattacttcccattggctccccccatgtcttcattaaatgcttaatattttactctctacttttatgatttcaattttctagggttttacatagaagtgatattagattatgcagcactctctttctatgtctagtttattttacctaacacagtttattccaggatgatccatgtcatttcaatttacaaggtttcttccttttaaaggctgacattgtatatacatattacattttctttatccattcatctgttgataggcacttggtttgtttatatattttggctgttgtaaataatgaaatacaaatattgccttaaaatattgatctaatttactttctatata

SEQ ID NO: 3271 - DNA, 1200 bp, mus musculus
taaagactttttagaatttaattaaaatgaaggtacaacatatccaaccttatgggacacaatgaaaggagtggtaagaggaaaactcatagctctgactgctgccaaaagaaactggagagagcatacactagcagtttaacagcacacctgaaatctctagaacaaacaaaagcaaatacacccaagaggagtagacagcaggaaccaatcaaacttagggctgaaaccaaccaagtagaaacaaaaagaactatacaaagaatcaacaaaaccaggagctggttctttgagaaaatctacaagatagataaacccttagccagactagcaaacaggcacagagacagtatccaaattaacaaaatcagaaatgaaaagagagatataacaacagaagctgaggaaattaaaaaatcatcagctcctactacaaaagcccgtactcaacacaagtggaaaatctgcgtgatatggaaaattttatagagagattccaaatgccgaagttaaatcaggatcagataaaccatctaaacagtctcataccacataaaggaataaaagcagtcatgaaaagtctcccaacctgggtggggctgtctctgtatgtctttccttccgtcttaggtctgaaccttgtctctgtaacagggcccctaataaaggagctagagaaactatccaaggagctaaaggggtctgcaaccctgtaggaggaactaaccagtacccccagagctgtgtctctagttgcatatgtagcagaggatggccttgtcagaggagaggcccttggtattgcaaagatcatatttcccagtacaggggaatgccagggctaggaagcgggagtgggtgggagtgggtgggctggggagcagggcaggggggagggtatagggggctttgggatagcatttgaaatgtaaatgaagaaaatatctaaaaaaaaaaaaaagaaaagaaaaaagtctcccaacccctccccaaaaaattaaaaatcctaagaccagatggttttagtgcagaattctatccgactttcaaagaaaaactaataccaatactcttcaccctattccacaaaaaataaacagaaggaacactacccaaatctttctacgaagccacaattatactgataccaaaaccacacaaagacacaacaaggagaacatcagaacaatttcccttagg

SEQ ID NO: 3272 - DNA, 1600 bp, mus musculus
atgctcctcaacagaggaatggatacataaaatttggtaaatttacacaatggagtactactcagctattaaaaacaatgattttctgaattttgcaggcgaatggatggaactaaaaaccatcaccctgagtgaggttacccagtcagaaaagaacacacatcatatgtactcaatgataagtggatattagcccaaaagctcagaatacctatgatacaactcacagaccatgtgaagctcaagaagaaggaagaccaaagtggggatgctgcagttccacttagaagggggaacaaaataatcatgggaagtagagggaggtatagacctgggaggaagagtggaggggaagggaaaagggggccaggttcaggtatgggagaagacaagggagaaatacagagggtcaggaaattgaacagaggtgtgtagcagtgggggatagggaactggggggtagccactagaaagtcccagatgccaggaaatcaagagactctcaggactcaatggggatgacattagcttaaatgtcaacaaaggggagatagaacctgtagagaccttatttagaggctaggcatagcctacagttgagggatgggggcacccacccatctttaaaatattaacccagaattgttcccatctaaaggaaatgcaggggccaagactgaagattgaaggaaaggccacatagagactgttccatctaggaatccatcccatctgcatataccaaacccagacactattgctgatgccaggaagtacttgctgacaggagcctggtatagctctcccctgagaggctctgcaagagctgaaccaatgcatatgtgggtgcttgcagccaacaatcagactgagcatggggaccccaatggagtagttaggggaaggattgaaggaactgaagggatttgcaatcccataggaagaacaacaatatcaaccaaagaactttcctatccctcagagttcccagggactaaaccactaaccaaacagtacacatggagggacccatggctccagctgtatattagcagaggatggccttatctggcatcaatgggaggggagcccattggtgctgtggaggttctatgccccagtgtaggggaatgttaaggtggtgacagcaggagtgggtgggtgggtgggggatcaccctcatagaagcatggggggggggaatggaatagggagtttgtggaggggaaaccaggaaggggaataacatttgaaatgtaaataaataaaataaccgggtcgccatcttggttccgggactcagcagaacttaggaaattagtctgaacaggttagagggtgcgccagagaaccggacagcttctgggacgggcagaagcacagagccgctgaggcagcacccttggcgggccgcagacagccggccaccgtccggaccagaggacaggtgtccgcctggcttgggaggcggcctcagccacagcagcagcggtcgccatcttggttccgggactcaccagaacttaggaaattagtctgaacaggttagagggtgcgccagagaaccggacagcttctgggacgggcagaagcacagagc

SEQ ID NO: 3273 - DNA, 1000 bp, mus musculus
acagtctatgtgtatccatataaatatataagttagatgaagttacataacttaggctggcaatgctccctgaaacagccatagactatatcttagactcatgtagtcaaatgcttggcccatagggagtggcacaactaggaggtctggcattgttagaggaagtatgtgactgtggaggtgagattttgaggtcttaaattcccaagcttgcctgtgtgaaaaagccagtctcctcttggttgcctttggatcaagatgttaaattagtggctcctccagcagcatgtctgcctgcaaattgctatgattccagcaatgatggtaatggaccaaacttctgaaactctaggctagccccaattaaacgttaggctttttaaattttgtcttggtcatggtgtctcttcacagcaatggaaatcctaactaagacagactatcaacaaaaccccaaatactaggcttgagatatcctcattcatgttgtttttcagaggagtccaattgattctcaaaataatgtgcgctgttgctgttgctcttggtggtctcccagagacacaatgcacctcagacacaagacccagaggacataacatataacttgcatggctgtcctttaagaggcccaacaagcagctggcttaggcagatgcaaatacttacacccaaacattggactgaagttggggaccatggtggttgagttagagaaaggctagaagaagctgaggaggagggcaccctcataggaagactagcagtctcaactaacctgtacacctgagatctctcactcactgagccaccaaccaggcagtatacatgagctggtctgaggctcccaacacatatatagtagaggacttcctggtctagattcagtgggagaagatgctcctaaccctctagagacttgaggccccagggagtggggaggcctagtgggcatgggtagacatcctcttggagacagagggaggaggaattggatgag

SEQ ID NO: 3274 - DNA, 1000 bp, mus musculus
gcaatatgccatccaacataaaacacccatacacacacacacacacacacacacaaacacagagagagagagagagagagagagagagagagagagagagagagagagagagaagcaagaaaacaggcaaaaaacccaaagcatagaaaatgtggaggttgtagtgtgttacagtgtgttccatagtaaattcttcagtccatacatcttcacttacaaatgttcattataatgaggccttaatctagttcaagatctctggcttctgtgacaccatcaatattggatccacactgagtctccttccagttatcctgttattgctctgtatcatggaattcctatagctttggaatagcagcactgggccttttacatgccccagtctttcacaaataatatagattttgggatgggtcaattcagagccctggatctgggtctgggtggtagctgagctgctcacatcacctacctgcagactctcccttatccatactaccatagcaagctctccagcactgctccagcttggccacccatgggcaggaggcaggctcagctatcctgttttcatgtccttggagccagctcacctgtgtcttagccatcacaccactgccactgggccgcctctactgcattgcccaggcaaggtgtaggggcggctaatcagtaaagtacaactagtgagctgtcatgatcccagggtgtgctctcctggctactgcaggtattggaaggaggacacgggcatcaccccctcacccataccaccttttgctagatgagtggtgggactcctatgttcttgccctcattttagctaacctgtgacccttccctcagggccaagtctcctatgctccccagataaaatacaggatcccactttcctgaatgctgcagcaggtgagggaaaagaccaggccacttgctctcatgaactcagggccagttctccagactggacttacagaagtggtgatgggtgaggcag

SEQ ID NO: 3275 - DNA, 1400 bp, mus musculus
attttctatggtaacttccatacctgagattctctctatctcttgtattgtgttggtgatgcttgcatctgtagctcctgatctctttcctaaggtgtccatcaccagggttgcctccatttgtgttttctttattgtttctatttccatttttagttcttggaccgttttgttcaattccttcatgtgcttgatttcttaaatcctgtatttcttaagggatttgtttcttccttcagggcttataactgttttcctttgtttttctgtatttcttcaagggtgttctttatatcctccttaaagtcctgtatcatctttgtgagacaggattttaggtcattatcttgcttttcatgtgtgttagggtagccagggcttgctgtgtgtggttgagttctgatggtgccaaattgcatagagttctgtcatttaggttcttacacttgcctctgaccatctggttctctctgttgttaactgccctgggtgtctctgactgaatcggtctccttggaggcaggttgactctgggaactgagttagggctagtttccttggaggcaggcagtgttgtctctggttagggtgggcctcccatgtctctggttaaagcaggcctcttgtgcccctggttacagtagaccagctgtgcccttgattactatggagctcctggaaggctctcaggctgtagctcaggctgtaatgtttgagcaggtatagggtcactgatctgaccccaggtggagaaatgggccagaggaaggtagagctctgtgtcctttgtcattatagacctcctgggaagcatgcagcatgcagtattgccaggttgctgatctgggctggtggagaagtgcctaggaaggaaagaagtgcttgggggttggggagagaagggagtgtagttcctgagtcagctgggctgtgtgggtatcctagctgatgtgggtatttgggtgaaattctcacccgtggccttggtcactgtgcatctccttggaagcatgtgggcttcagtgtttgggtatgcatctgtcaggccactgatctggtccggtggggggtaaatctgcatttttttaatgattatgggttcattgttttcttggtattcagggttttttgtttgtttgtttgtttgtttgagttctttatatattctagacattaatctattggatcctctatagcttctcaaatgcctttacacttttctttggtctgaagtatttcagtaaactctgtagagctgacctagtgatcataaattgctttagtttgtcaggaactttttatttcgcttttaattagaatagataattttgttgggtataatagctaaggttgatagttctgttctttcacaaactgtacattatctttataagcctttt

SEQ ID NO: 3276 - DNA, 1200 bp, mus musculus
gttgcctccatttgtgttttctttattgcttctattttcatttttaggtcttggaccattttgttcattttctttacctgtttggttgtattttcctgcctttatttaagggatttgtttccactttaagtgcttttacctgtttggctgtgatttcctgtacttctttatgggaattatttatatcctctttaaaggtttctatcttcataagatggaatttgaggtcagaatcttgttccttgggtgtgttgggataatcagggcatgctgttgtagaaagagctgtgtcctgatgttgactaattgcattggtttctgttgattatgttcttgtgtgtacctttcactatcttgatatccctggtgttagccggcctggatatcctagattggagaagtcctctcaggatgcaggtggagctgtatgtcctgggttagatcaggcctccttgttggaggcagtgctgtgtctctggttagagcaagcctccttgaaggaggcagtgctttgtctctggctatcataggcctcctgtggctctggttacagcaggcttcctggcagacagcaggcctgtagggtttgggtgtaggcacactgatcccctggcagagcaggtagagatgtagactggaaagagatagggttatgacagggagggacagagcccctgtaactgctgggctctgtggggtcccagctggcttggagtttgtggtggggatctcacatgtgtccctgattagagcagtaatcctgggagacaggtaggcctgggaccagggggtgaggaaactattttctaaagagaaacaatgttgatttatttggagggaaggctgttcacttaaaaaataaaaaaaccttcctttctggaccctatttctttatagaaggaataggaaataaagaattataagattgttcctataaaaggataatacagctacagtcactgttcttgtccttcatgaaaggtcagatagcaaatacttctggctagctcttcaaatctaccattgtataataacatccatgtataatgcaaaagttaaaaggcacagttgtattcccagatacttttaaacaaacagctgccagatttggactattggatgttgaattctgatccctgatctatggtattagctaaacatataaccagatgattacatgctttagaaagaaaagagtct

SEQ ID NO: 3277 - DNA, 1400 bp, mus musculus
atgtttgtgtgtgaatctgtataagcacataacttcttctgctttaccaataacatgctaaaaccccaaataaaaatcttgtctccatgaagaatttactcagaatctattgtcttctttcagttttagaaatatttgaaaggacttccacatcatgtatgagtcttctctgatccagttacagatttttacatgttttaaaagtctgtcttttctatgttcaatagctgtatttctctataataaaatccacatatatgtatattttggttagtttaattttatttcagatgttcagtagaaattctaaaagcataaccaaattcaattgagtacttttaagtgaaataataattattattctaaatttctatactatagagcaccataaattgtaaaattgtagataatggggaaactagtctgaacaggtgagagggtgcaccacagaacaggacagcttctgggacaagcagagccacagagccactgaggcagcacccttttcgggccacagacagccggccaccatcctgaccagaggacaggtatccgcctggctcggaaggcctcagcctcaggagcagcaggtgccaccttggttctgggactccaccgaacttagaaaactagtctgaacaggtgagagggtgcaccacagaacatgacagcttctgggacaggtggagccacagagcaactgaggcagcacccttttcgggctgcagacagccggccaccctccctaccagaggataggtgtccgcctggcatggaagacctcagcctgaggagcaggggacgccaccttggttccaggaatccgctgaacttaggaacttagtctgcataggtgagagtgtgcaccacagaagctgacagcttctgggacctgccaaagcaacacagcttctgggaaaggttctgttttgggccttcttcttcagccaggaggaggtccaaatgaagaataaagataaaaaattactgaactcttcctcaccccagagcctgacccctcccatctagagattgttcccagaacactcctgaactcttcaccccagaatgcattcctgaactcctcaccctagagttcgaaccctcccaactaaagacttttccaagaacatttttgagataagggcctcctggaacaacctcagaatgaaccgggtacattgccaaataataggacatgaccccttagttacatagaattcccttggcagaaccccttgtcccttggcagaaccccttagttatgcaaacttgtactttccctgccccgctctccccccttgagtttttcctatataagcctgtgaaaaatttggctcgaggtcgattctcctctacaccatactaggtgcatgagtttcgaacccagagctctggtc

SEQ ID NO: 3278 - DNA, 1200 bp, mus musculus
gtcctctagggaccgtgggggtgtccgctgactctgcgcacaaggtgatccggtgctggccccgacctgaagggacttgtgatcctggtcaggccaggttttctgcttccctaatgctgtctcaggtcccacacgattggtttggaacagaagttgagttccacacaccagtggtcctaagattgcatggagagtcctctagggaccttgggggtgtccgccaactccgcactcctgttagtaagattcttatgtttgcctttcaccatctggtaatcactggtgttagatgatctagctgtatctggctggagatttttcctcctgtgattctgttagtctctgttggagctcctgggagtccaactctcccctgagtcccagtggtcagagcactctctgcaggcaagctctcctcttgcaggtaaggtgcacagaggtctggcactcagatatgcttcttggctgaagatgaagaccctttgggcccctgttcaagaaactctgttgcttctctggcccatgagctctcctgtgtgaactggtttctgagagacccaggatacaagatggtgctctcacctgagtcctggggtcagagccctctctggaggccaactctcctcagtgatcttaagatcctgggtgtgctagggcacctgaggtgtgcagagtcctttggggacagtggaactgtccgctgagttcacacccaaggtggccaggggctggcgccagattcagctactggtcaggtgggtttcctgtgtccctgttcctgctggcacaggcccctcttggttgttttggagcagttgttgtgttacactcaccagtgatcctaagatcctgtgtgtgctagggcacctgtggtgtggagagtcctctgagaactatgggactgtctgccgatttcacgcacaaggtggcccagggctggcactcaccagaatgaaccccagctgctggtcccattccaattattttttgcaagcaactatttgtagtaaatttacatctgctcaaaatacctagagagcttcctttcaaggaacttattagaaattatatctgtaatttcacctctaatttctatcagcaaaaatgaaacataagcaaccagaccacagagctctcaatctgtggctatgtatcctccccagttttctgttgttttatttagctaacaatgaaataagt

SEQ ID NO: 3279 - DNA, 1000 bp, mus musculus
gaagcacctgaaaaaatattcaacatccttaatcatcagggaaatgcaaatcaaaacaacccagaaacttagactacccaagatataagatacaatttgcaaaacacgtgaaactgaaaaagaatgaagaccaaagtgtggaccctgccccttcttagaattgggaacaaaggatggaccatctagagactgccatacccggggatccatcccataatcagcctctaaaggctgacaccattgcacacactagcaaggttttgctgaaacgaccctgatatggtgaaaagtctcttgtgatgttatgccagggcctagcaaacacagaaatcgatgctcacagtcagctactgggtggatcacagggcccctaatggtgcagctagagaaagcacccaatgagctaaaggggtctgcaaccctataggtagaacaacaatatgaactacccagtacccaccaatgctcctttctctagttgcatacgtagcagaatatggcctagtcgtccatcagtggaaagaaaggccctttgggtttgcaaaatttatatgcctcagtataggggaacgccagggccaagaagggggagtgggtaggtaggggactgagggcaggagggtatgggggacttttgtgatagcattggaaatgtaaatgaagaaaatacctaattaaaattaaaaaacaaaataacaaaaaaaatagaaaataaataaaaagttgccatcgaagaaggcagaaatgaaaaaaaaaatgtatgcactgaagccattcattatctctcctgagtcagttagttgataaagcaaggtatgaaattcttctgttccatgtgcttacttaccagttgggctgcagttgtttggaagatatactggaaatgaagcattgaagattgtgcactgagtattgctcgcagttgagactgagcacaggctcccctagagcttctgaataagatgtgctggtgctcctccacagagctactcactgagat

SEQ ID NO: 3280 - DNA, 1000 bp, mus musculus
gagggggaggggagggggaggaggagaaggaataacaacaaagtaataataatccttttagatagagaaatgccataaaaacaacacaaacttgctgccaacccttcaccaagcttcccctaacattcgtttgcataatcatagctcagtgattaaaaccagcaaactggcaccagaacagtgctgttaactaagctaagctgtttgttcaaacctcactagcttttcttccaagggcctttcttttattttattaggtattttcctcatttacatttcccaatgctatcccaaaagtcccccataccctccccccactcctctacccacccactccccctttttggccctggcgttcccctgtactggggcatataaagtttgcaagtccaatgggcctctctttccagtgatggccgactaggccatcttttgatacatatgcagctagagacaagagctccggggtactggttagttcatatttttgtttcacctatagggttgcagttccctttagttccttgggtgctttctctagttcctccattgggggccctgtgatccatccaatagctgactgtgaacatccacttctttgtttgctaggccccagcctttgtgtagcagaacgctgtgcagtaacccacatgacatttacttgtcgtagtcccttagcctccctccccatcatagttccttactctttctatggctttcaacttcaactcaaatacaacaacaacaacaataaaacaacaaaacaaagtgcaagaaagaaaaaaatggacaggatctggcatagtcatgctggcctcagactcagtagataaccaaagctcaccttgaacttctgatcctctttcctctaccttcttcagtgctggggttacaggtgtgcaaatactctgctcagttttatgccatgctgaggacagaactcagggtctcacacatggtaggcaagcatgctaccaaatgtgctacatccctagccctt

SEQ ID NO: 3281 - DNA, 1400 bp, mus musculus
aggagttgaggcataaaattcacacattaaaggcctgtctatatcaccaagagataccaaagccaccttgggtaacctagccagaaaatggaaacaacctaaatgtcccgcaactgaagaatggatgcagaaaacgtggtatacaacggaatactattcagctattaaaacaaggatatcatgaagtttgtctgaaaatagatagaaatagaacacctgtgataaccaagaccccacagagacaaacatggtatgtactcacttacaagtagatgttagctgtaaagtaaaggttaatcatggtacaatccacagacccagagaggctaagaaacaaggaggatattaaagggagacacaaggatcttcccttgaagggaaaatagaatagcttttgtgggtgggcatggggtgggtgaggatgaaaataggggtaatcaggtactgggggaagaatactgggagagacaactggaattgaggagcatttctggagtgagggagaaacctagtgcaatagaaacttcatggaatctatgggggtgacagtagcgaagagacccagtaatgggggacatggagactgaactggctatcatttgtaaccaggcaagtcctcaagtggagggactgggacactactacagcaacaaaatctccaacctagtttgtcatacctggagaatgtgctgggaccagagcctagaataatcattatcagatagaccagagagacttcattcagcaaacagtgggaccagatgcagagtcccacagtcaaattttaggcagagcttggggagtcctgagaaggagggtagaaatgattggaggagccaaaggtatcaaggataccacaagaatcaactgacaaagactcaagtgggctcacagagatcaggaagcctgtacagggttgacctaggtcctctgcatgtatgttatgcgcgtgtaagtctgtgttcttatgagattcctaacagtgggagcagtggctgtttctgactctttttcatgcctttgggagccatttcctcctattgggctgcctcatccagtcttgatatgagaatatgtgtttggtcttaagttatgccatatttggttgatgtccatggaaggcttggtcttttctaaggggaggcaaatggggtaattctggaagaaagaggagttagggagagagacggggaagaggagagaaggaaaactgcagttgggatgtaatatacgaaaaaggaataaataaacagtaaaaaaataaaaacatcataggcttagttctaggctaaagatcaataacaaaaaagcatgtaaacaatcattcagcataaattgtaaatcatatactgtctgtattctattgaccatagaaatttatcttgataaggattgttaaa

SEQ ID NO: 3282 - DNA, 1000 bp, mus musculus
atcagcacttctcaatttcatcttgtccccctcccattatgaagtacatgaggtcttgggttgtagaaaacacactaaatttagattttcttattgtcagaaaaaatggaatgcactttaaattttttattgtgtatgcatgtacatgctgtgtgtatgtgtcaaggtatttggcagcaaaggtaccagttcttcaggtgtcagttctccttccaccctgttgaggtagggattctcttgttgtgaatgctagccatgtactccaggctatatgacccctaaatctgcttcccctctctctgcaagaatgcgatggttatctaaccacagtcgcatatgatttcaaccccagcacttcagaaatagagacaaatgatgttgaggccaacctagtctacataccaagttccaggccagctgtggctacatagtgagaccctatctcaaacaaacaaacaacaacaaaaagaatgctgggatgatagatgtatgccactacagctagattttactgatgtctttacatacattccagggattgaacttaatatgttaagcttaaatggcaagtgcttttacccactgggccattttgccgaccatgctttttttgataccttgcttgcttgcttgcttgcttgcttgcttgcatgtagtgctgaagattaaacacagggcaagtgctctaccactgtgttacacctccaatccaaaaggcagaattttaattatttctgttttgggttacctcaaaatggtactaacaatagttacttaatgatagctgagtctcagccttaaacaagatatatacgctatcccctcacagaagagtgagttggaaagaatgtgaaagccagattctaggaggaaagctgacaaaatgtcatgttctggcaagacagggccattgtaattatgaattcacagttgctagggttacctgcagtgggcatgcacaagaatgcccagataaccatcagtcatggatggtgaagga

SEQ ID NO: 3283 - DNA, 1200 bp, mus musculus
tcaatgtatattttttcctaagtgaaaaatgttttattaactaatgcttctcaagggaagtttaccttaaatccttgccctcacccaaaagattcagagacaatatcttttaattagttaggattttagtttattacaaaaggtttagcaaaaactaaaaaagcttttataattgttattaattatattcattggtaattaaaaatattagctgtgcccaagacaattccttggccagaaaaaaacattgtaaagtcatttttctcatcctcccagtggatcgttggcccacgtgggtccaactagctgctggctgctgctggtcagggccttgagacacacagtttcccagagctatagtactgcgagaggccaccataggcgggcagccttacagcgaattcaggagagggccgcgttcacatttgccccgagcctccacgtgtcctgaccagagtagccatattttcagagtagccatattttcagagtagtcatatttttccccgctaaggcccggggtgttctgtcacccttgtttgagttttctagcctgagaaaaaggccgaggtgcggcggcagtaacaagagcggctgtggcagcagggccggccccgccccagtgccaggaccagagctgccccttgacatagtggcgcatcaggcgcacactgctttctccgcttcaaaattacaggtctcaacagcgagttaaaatccagagtcattttcaaagtgactccacatgccagggcgtcaggcggccagggctaaagacttagggcaaacgccccccaccccccaagtaccctgtgggtgtcaggccctagaccacagagccaagactaggcaggtgggcagggccgaggtagcactcccctcaaaacagtttcatcatcctattaaaaccactgtgatactaataaaaaattgtaaagtgtattcgtgtattttagaaaacctataacaaaaattatgtcttaaaaacctgacttagtgtctgtcccttgttccaaacagcaattaatttggttattacaaaatattaatgattgacctattatgcaccatcatttttaatagattaacaatcaatatcccaaagatgagttgattgtttttatacgtgctttttatatcttctataaattcatgcatgcatacatcccaattattgtgtttaataacaacccctatatg

SEQ ID NO: 3284 - DNA, 1000 bp, mus musculus
tttttttagtaagcattatgttgctgttgctggattgctattgaccattctctcagcagcacagattaaatgagaacttgcattcccacctccaatctagagaatagggaacatgggagcaggatcttcaaactgctttcttacaaactctctagtgactccgatgctcaaagtttcagaataggtggagaggtcttcggtgcttttccatagatcctactctctacctatcccctacagagcacttacaagcagaatttggaccagatgcaacccaggatatcctctcactgggcccatgagcagaaggtaaacatggaacagcgaagacacccaagacttcattctctttctaagagtggcctatggctagagctaaagtttctttttttagaagttctctgccagagtgtccttctttactgccatggtgaaagaagttaagatatcgaagcttaggatgtttcatgctgacaaatataagagtagtttcaaggtcactgattcaacgttcactcttctagtttttacgtgatttatgtgtgtgcacgtgtgcgtgtgtatacatgcatgttgagggcagaggtgagcctcgggtgatatttctcagatgccatccaccttcttatttgagactgagtctgatgctgacttgcagttcaccaagtagtctagtggacggccatcaagtcccatgaattctgtttcaattactttagcactggtatttcaagtgtgtgttatcactcctagctttctgtgtggattccaggtagtgaactctggtctgcatgcttctatcgaacgtacgttacatgctgatttatttcccctatttcttaatatgattcttacagcagaaaggaaagagacgccttcacctgcacacttctgcagagtttgaggtgtatccatgggatcatgcaacaagtgcgctgttgttaatgaatcttgggtaccccaactcaaaaggagttgggagcccctgatccaaactggt

SEQ ID NO: 3285 - DNA, 1000 bp, mus musculus
ctgtagtagggtacctgtgctctaaaagtatcatattaccctggcttttgttgattgtgttgttttgaaggccttttgctatctggattgctttgatcacggtatgttcctgttgtagtagatattaagaggggagttaaccttgatgctcctggtgtggcaggtctctgatgggtatccttgggctatatggttccagatctactgggctgtatgtttcagtatcctcaggtgtatggttcaggattaacatatctgaagaaggtggagggagagctggcagaagattggacgtctgcctgggctaggaggctactcagggcagcttggcatgtcccagaggactcagtgagcagggaagatgggtgggggaagggaagctaacctgtatggttcaggagtctccagtctgatgaaatgaggaggagaggtggcaggaggatgcaggtccaggggacatagtaggctgctcagcacctcttggtgtgcttagaggactcagagagcaggaaagatgggtgggggaagggaagctaacctgtgtggttcaaggtcagcagctctgatgaaggtgagaggagaggtggcaggagagtggaggttccccagggataacagctgctcacagaagctttgtttgcccagaggactcagtgagcagggaagtaggttgcggaagggaaactaacctgtacggttcaggctcagcatgtctgatgagtgtgggagagcacgtggtgagagaatggaggtctcctgggaacaatacattttttaaaaaaaatatgttcattgctgtatttgtttattctcacatattatatcccaactgcaatttttcctccctttctttccaatcattttaggaggaaaaaaaaagaagatgaaaatgattatttttaaatgacaatactaacattgtaaaattttgtaagtgcttgaatttcagcttaacatttggaagtatagatatttctaaaatgccctctttctttcagtt

SEQ ID NO: 3286 - DNA, 1600 bp, mus musculus
gaccagaaggtcggtcgacacaccggccgccgtccacctctaatgtgtttaggaaggacagacagacatatttagacgtaaagacttaaagggagtgtgatcgccaataaaggatcactttaaaaagaaaacacctgtggaccacgagcaaatctcaccgacaggcgatgtgattttcttttttttctcggcaggtacgccatcggcctggcgtacagatcggcgccgaaacacgagtggatcgggaagaacgcggcgtcctgggccctctgccgctgccacaaccactgggcggtgcgacacgacggcaaggagacccccatcgcgccggcccctcacctcaggcgcgtcggcgtcctgctggactacgacaacggctccatcgccttctacgacgctctgagctccgtccacctccacaccttccacgcggcgctcgcgcagcccgtgtgccccaccttcaccgtgtggaacaagtgtctgaccatcgtcacgggtctgcccatcccggaccatctggactgtacggagcagcgaccttgagggacccggccccacagcggccccggggagggacacaggtggaggccgctgtttatggggtcgagaaactcaggcttccagagcgtcgtgacatcttccccaatctgtccagaaaatcactcacagtcatccccctgcctcacacggtcactcagggtcatccccctgcctcagaaaatcactcacaatcatccccctgcctcagaaaatcattcacagtgatcacccccgcttcagaaaatcactcacagtcatccttctgcctcagaaaatcactcacagtcatcccactgcctcagaaaatcactcatactcatcccccagcatcataaaatcactcacagtcaccccctgcctcagaaaatcactcacagtcatccccctgtctcacacggtcactcagggtcatccccctgcctcacacggtcactcagggtcatccccctgcctcagaaaatcattcacagtcatccccccgcctcagaaaatcactcacagtcatccccctgcctcagaaaatcactcacagtcatccccctgcctcacacggtcactcagggtcatccccctgcctcagaaaatcactcacagtcatccccctgtctcacacggtcactcagggtcatccccctgcttcagaaaattctattccatactgaggccaggctgggcacgaccgcttagaagaaccggatagacggctaaagcagaagccgtcttgagcctaataaggaagcccgcgggcttcctcactccgatgtgagtggagacatttcagctgtgactgtatcattgatacccagatgaatattttgatagcgacttaaaacgacttcacatcttaaacacggacacctcggtggaaaatgtttcattttcctctgaaaatttgtgagaacgtctcgacgacgacgacgccagcaagagaaacgtttggaaaacagcgcttctcgtcacgttctcgattctgccaccccggaagacatctggcctcatctggagtcgatctcgggcgtctgtcccctcctcgtcgctttcccctcgcagactccgaccc

SEQ ID NO: 3287 - DNA, 1600 bp, mus musculus; identical to SEQ ID NO: 3286

SEQ ID NO: 3288 - DNA, 3800 bp, mus musculus
cccccgcctcagaaattcactcacagtcagccccctgcctcagaaaatcacccacagtcacccccctgcctcagaaaatcactcacagtcatccccctgcctcacacagtcactcaaagtcatccccctgcctcaaaaattcaatcatagtcatagcctggcctcacacacacaatcagtgccatccacctgcctcacacagtcactcacagtcatccccctgcctcagaaaatcactcactgtcatccccctgcctcagaaattcaatcacagtcatccccctgcctcagtcacttcacttcattcccctgcctcacagttaatcgcggtcatatccctgccatggcgacagggaggagacacagagccgctcccgccagggggtcatggaggcgtccagcggcctggggggaggggagcctcagacgttcactcgcagtcatgccccagccttatacattcacccacagtgatccccccgcctcagaaactcactcacagtcattccactgcctcagaaaatcactcacattcatccccctgcctcagaaaatcactcacagtcatccccctgcctcacagtcacacatcaacatccccctgccccacagttactcagcttcatctccctgtgtcagaaaatcactcacagtcattcccctgcgtcagaaaatcactcacagtcatccccctgacttagaaaatcactcacagtcatccccctgcttcacacagaaactctctaccatgcccctgcctcagaaaatcacacacaggcatccccctgcctcagaaaatcactcacagtcatccccctgcctcacacagtcacacagctgtgacacccacaggcatccagcggcctggggggaggggagcctcagacattcacccacagtgatccccccgcctcagaaattcactcacagtgatccccccgcctcagaaattcactcacagtgatccccccgcctcagaaaatcactcacagtcagccccctgcctcagaaaatcactcatactcatcccccagcatcataaaatcactcacagtcatcaccctgcctcagaaaatcactcacagtcatgcccctgcctcagaaacacactcacagtcatccccctgtgtcagaaaatcactcactgccattcccctgtgtcagaaaatcactcacagtcatccccctgcctcagaaacacactcacagtcatccccctgcctcagaaagttttttggtttttcgagacagggtttctctgtgtagccctggctgtcctggagctcaggctgtagaccaggctggcctccaactcagccatccccctgcctctgactcccgagtgctgggattaatgacgtccgggtaccaagatgccctgccctgcctcagaaacttacaggcaaccccctgcctcacacagcgtcatgcccctgcctcacaccctcactcaacctcagaaacacactcacagtcatccccctgcctctgactccagagtgcagggattaatgatgtccgggcaccacgatgccctgccctgcctcagaaactcactcacagtcaaccccctgcctcagaaaatcactcacagcgatcaccctgcctcagaaaatcactccttgtcattcccctgcctcagaaaatcactcacagtcatccccctgcctcacacagtcactcaaagtcatccccctgcctcagaaattcactgacagtcatccccttgcctcacacacacaatcagtgccatccacctgcctcacacagtcactcacagtcatccccctgcctcagaaaatcactcactgtcatccccctgtctcagaaattcactcacagtcatccccctgcctcacacagcctctcagggtcaatctcctgtgtcacacagccactcagcatcaaacccctacgtcagaaacacactaacagtcatccccctgcctcgggaactcactcacagtcatccccctgcctcagaaacacactcacagtcatccccctgcctcagaaacacactcacagtcatccccctgcctcagaaacacactcacagtcatccccctgcctcagaaacacactcacagtcatccccctgcctcagagaatcacttacagtcaccccctggccccccgcaacctgaccaggcgcggcggagggagagactggggagcgcggggtgctgaggagacgtctccgtggccgccgcccgtcctcctctcgaggctcagagaaccgtgcggaagggggggcagagacgggacgagccggggagggggacggacatggaggacgcgcttccagacaccgggggacggactcgctcacgcgggggctcccggagacggtggcggcacgcagcggccactcacagtcatccccctgcctcagacagtcactcagcgtcatccccctgcctcagacagtcactcagcttcatccccctgcctcagacactcactcagcgtcatccccctgcctcagacagtcactcagcttcatccccctgcctcacacagcctctcagggtcaatctcctgtgtcacacagccactcacagtcatccccctacgtcagaaacacactcacagtcatccccctgcctgagaaattcactcacagtcagccccctgcctcagaaattcactcacagtcagcccctgcgtcagaaaatcacttacagtcaaccccctgcctcagaaaatcactcaacatcattcccctgccttacatactcactcagcatcatgctcctgcctcagaaaataactcacagggatccccctgcctcagaaaatcactcaaagtcattcccctgcctcagaaacacactcacattcatccccctgccccagaaaatcacacacagtcattcccctgcatcccacagtcacacagccacatccccctgccccacagttactcagcttcatttccctgtgtcagaaaatcactcactgtcatccccctgcctcagaaaatcactcacagtcatccccctgcctcagaaaatcactctctgtcatccccctgcctcagaaaatccctcacagtcatgcccctgcctcagaaaatcactcacagtcatctccctgcttcaaaaaatcacttacagtcacccccctgcctcagaaaatcactcagcatcattcccccgcctcacacactcactcagcatcatccccccgactcacacagtcactcacagccatccccctgccttagaaaatgactcacagtcattcctctgcctcagaaaatcactcacagtcatcctcctgccttagaaactcactcacagttaaacccctgcttcagaaaatcactcactgttatccccctgcctcatacagcctctcagggtccatctcctgtgtcacacagtcaatcaggatcaaagccctacctcagaaacacactaacagtcatccccctgcctcagaaactcactcacagttaaatccctgcttcatacattcactcagcttcatctcctgcctcattttcatgcccctgcctcacacattcaatcagcacaaatcacttacagtcatcccctgccttagaaaatcactcacagtcatccccctgcttcacacagaaactctctaccatccccctgcctcagaaaatcactcacagccatctcactgcctcagaaaatcactcacaaccatccccctgcctcagaaaatcacttacagtcatcccctgccttagaaaatgactcacagtcattcctctgcctcagaaaatcactcacagttatcctcctgccttagaaacacactcacag

SEQ ID NO: 3289 - DNA, 1200 bp, mus musculus
tcacacacagtcatccccctgcctcagaaaatcacttacagtcagcccctgcctcatacattcactcacagtcatccccctgcctcagaaaatcactcacagacatccccctgcctcagaaaatcacttacagtcagccccctccctcagaaaatcactcactgtcagtcctctgcctcagaaaatcacacacagtcattcccctgcatcccacagtcacacagccacatccccctgccccacagttactctgcttcatccccctgtgtcagaaaatcactcactgtcatccccctgcctcagaaaatcactcacagtcatccccctgcctcacagagaaactcactaacatccccctgcctcacacagcctctcagggtcaatctcctgtgtcacacagtcactcagcatcaaacccctacgtcaaacactaacagtcactcacataaaatcactcacagtcatgcccctgcctcagaaaatcactcacagacatccccctgcctcacacagtcacacagctgtgacacacacactgggccgcctgccctggcgctgtgtttgcattttatttattttattattttattcacacacactcactcatggtcatccccccgcctcacacagttacgagtttggggggtgtttggctttgtttggatgcagggattcagctctggggttcatgagcctcagggccccaggcagggacccgcccaggcctgtaatcccaggggcagagctgaggcagggggatgactgagatggcaggccggcctgtgctggcagggcgggaaccaagcccttccccagcccgggggctgcctggccgcctgcgtcgccatggcgacagggaggagacacagagccgctcccgccagggggtcatggaggcggccagcggcctggggggaggggagcctcagaaactcactcgcagtcaacccccagcctcatatattcacccacagtcatccccctgcctcagaaaatcactcgcagtcatccccctgcctcagaaattcactcacagtcatccccctgcctcagaaattcactcacagtcagccccctgcctcagaaaatcactcacagtcatccccctgtgtcagaaaatcactcactgtcatccctctgcctcagaaaatcacacacagtcatccccctgtgtcagaaaatcactcactgtcatccctc

SEQ ID NO: 3290 - DNA, 1000 bp, mus musculus
ctgcttcaccccctgtgtcagaaaatcactcactgtcatctccctgcttcaaaaaatcacttacagtcatccccctgcctcagaaaatcactcacagtcatccccctgcctcagaaattcactcactgtcatctccctgcttcaaaaaatcacttacagtcatccccctgcctcagaaaatcactcacagtcatccccctgcctcagaaattcactcactgtcatccccccgcctcagaaactcactcacagttaaacccctgcctcatacattcactcagcttcatcccctgtctcattttcatgcccctgcctcacacattcaatcagcatcatcaccctgcctcagaaaatcactcacagacatccccctgcctcacacagtcacacagctgtgacacacacactgggccgcctgccctggcgctgtgtttgcattttatttattttattattttattcacacacactcactcatggtcatccccccgcctcacacagttccgagtttgggggtgtttggctttgtttggatgcagggattcagctctggggttcatgagcctcagggccccaggcagggacccgcccaggcctgtaatcccagaggtagagctgaggcagggggatgactgagatggcaggccagcctgtgctggcagggcgggaaccaagcccttccccagcccgggggctgcctggccgcctgcgtcgccatggcgacagggaggagacacagagccgctcccgccagggggtcatggaggcgtccagcggcctggggggaggggagcctcagaaactcactcgcagtcaacccccagcctcatatattcacccacagtgatccacctgcctcagaaaatcactcgcagtcatccccctgcctcagaaattcacttacagtcatccccctgcctcagaaaatcactcacagtcatccccctgcctcagaaaatcactcacagtgagccccctgcttcagaaaatcacttacagt

SEQ ID NO: 3291 - DNA, 1000 bp, mus musculus
ctcatacattcactcacagtgatccccccgccccagaaaatcactcacagtgagcaacctgcttcagaaattcactcacagtcagccctctgcctcagaaaatcactcactgtcatccctctgcctcagaaaatcacacagtcattcccctgcataccacagtcacacagccacatccccctgccccacagttactctgcttcatccccctgcctcagaaaatcactcacagtcatccccctgcctcagaaaatcactcactgtcatctccatgattcagaaaatcactcactgtcaaccctctgcctcagaaaatcacacacattcatccccctgcctcacacagtcacacagccacatccccctgcctcacagttactctgcttcatccccctgtgtcagaaaatcactcactgtcatccctatgcctcagacactcactcagcatcatgctcctgcctcagaaaatcactcacagcgatccccctgcctcagaaattcactcacagtcatccccctgcctcagaaaatcacttacagtcagccctctgcctcagaaaatcacacacagtcattcccctgcatcccacagtcacacagccacatccccctgccccacagttactctgcttcatccccctgcctcagaaaatcactcactgtcatccccctgcctcacagagaaactcactaacatccccctgcctcatacagcctctcagggtcaatctcctgtgtcacacagtcactcagcatcaaacccctacctcagaaacacactaaaagtcatccccctgcctcagaaactcactcagttaacccctgcttcatacattcactcagcttcatctcctgcctcattttcatgcccctgcctcacacattcaatcagcagaaatcactcacagtcatccccctgcctcagaaaatcactcacagtcatctccctgcttcaaaaaatcacttacagtcatccccctgcctcagaaaatcactcaca

SEQ ID NO: 3292 - DNA, 1200 bp, mus musculus
ttcagggcctcacatcctctgctgtgtgagtgtcagggcatcacatcctctgctgtgtgtgtgtcagggactcacattttctgctgtgtgtgtgtcagggcctcacaaaatctgctgtgtgtgtgtcaaggcctcacatcctttgctgtgtgtgtgtcagggcctcacatcctctgctgtgtgtgtgtcaggacctcacatcagctgctgtgagttttcagggcctcaaatctgctgtgtgtgtgtcaggcactcacatcctctgcagtgtgtgtcagggcctcacatctgctgctgtgtttgtgtagggcctcacagcctctgctgtctgtgtgtcagtgcctcacattagctgctgtgtgtgtgtcagtgcctcaaatcttctgctgtgtttttcagggactcaaatctgctgtgtgtgtgtgtcagggccacacataatctgctgtgtgtgtgttagggcctcacatcctgtgctgtttttgtgtcagggcctcacatcctttgctgtatgtgtgtcagggcctcacatcctctgctgtgtgtgtgtcagtgcctcacatcagctgctgcttgtgtgtcagggcctcacatcctctgctgtgtgtgtgtcagggcctcacatattctgcagtgtgtgtgtaagggcctgacatctgctgctgtgtgtgtgttagagcctcacaaaaaatgctgtgtgtttgtcagtgcctcacatcctctgctgtgtgtgtgtgtcaggacctcacatcctttgctctgtgtgtgtcatggcctcaaattagctgctgtgtgtgtgtcagtgcctcaaatcaactgctgtgtgtgtttcatggactcaaatctgttttgtgtgtttgtcagggccacacataatctgctgtgtgtgtgtcagggcctcacatcctttgctgtttgtgtgtcagggcctcactcacctgctgtgtttgtgtcagggcctcacatcctttgctgtatgtgtgtcagggcctcacacctctgctgtgtgtgtgtcatgacatcacatcctctcctgtgtgtgtgtcagggcctcacatcatctgctgtgtgtatgtcattacctcacatcctctactgtgtgtgtgtcagggcctcacatcagctgctctgtgtgtgtcagtgcctcaaatcttctgctgtgtgtgtgtcagagactcacaacctctgctgtgtgtgtgt

SEQ ID NO: 3293 - DNA, 1800 bp, mus musculus
gtcagggcctcacatcttctgctatgtgtgtgtcaggacctcacatccgctgctgtgtgtgtcattgcatcacatcagctgctgtgtgtgtatcagggcctcacatccgctgctgtgtgtgtgtcagggcctcacaacctatgatgtgtttttgtcaaggcctcacatcttctgctgtgtgtgtgtcagagcctcacatcttttgctgtgtgtgtgtcagggcctcaaatctgctgtgtgtgtgtcagggcctcccatcttctgctgtgtgtgtgtcaggaactcatttcctctgctgtgtgtgtcatggcctcacacccacagctgtgtgtgtgtcagcgcctcacattttctgctgtgtgtgtgtcaggccctcacatccgctgctgtgtgtgtgtcagcgcctcacattttctgctgtgtgtgtcagttcctcacatcctttgctgtgtgtgtgtcagggcctcacaacctctgctgtgtttgtgtcagggcctcacattctctgctttgtgtgtgtcagggcctcacattctctgctgtgtgtgtcagggcctcacatcctctgccgtgtgtgtgtcagggcctcacatttttgctgtgtgttgtcagcgccttacattttcagctgtgtgtgtgtcagggcctcacaaattctgctgtgtgtgtgtcagggcctcacatccgctgctgtgtgtgtgtcagagcttcacatcctctgctgtgtgtgtgtcagggcctacatcagcttctttgtgtgtgtgagtgcctcacatcttctgctgtttgtgtgtcagtgcctgaaatcagctgctgtgtttgtttcagggcctcacatccactgctgtgtgtgcgtcagcgcctcacattttctgctctgtgtgtgtcagggcctcacatcttctgccgtgtgtgtcaaggccgcacaacctctgctgtgtgagtggcacggcatcacatcttcagctgtgtgtgtcaggacctcatatccgctgctgtgtgtgtgtcagggcctcacttcctctgtgtgtgtgtcagggcctcacatcctcttctatgtgtgtgtcagggcctcacatcctctgctgtgtgtgtgtcagggcctcacaaaatctgctgtgtgtgtgtcagggcctcacatcctctgctgtgtttgtgtcagggcctcacatctgctgctgtgtgtgtatcaggtcctcacatccgctgctgtgtgtgtgtcagggcctcacaacctctgatgtgtttgtgtcagggcctcacatcttctgctgtgtgtgtgttagggcctcacaacctctgctgtgtgtgtatcaggtcctcatatccgctgctgtgtgtgtgtcggcgcctcacattttctgctgtgtgtgtgtcagggactcacatcctcggctgtgtttgtgtcagggcctcacatccgttgctgtatgtgtgtgtgagtgcctcacatcctctgctgtgtgagtggcccggcctcacatcttctgctatgtgtgtgtcaggacctcacatcttcatatgtgtgtgtgtcagggcctcacatcagctgctgtgtgtgtatcagggcctcacatcctctgctgtgtgtgtgtcagggcctcacttcctctgctatgtgggtgtcagggcctaacatccgctgctgtgtgtgtatcagggcctcacatcctctgctgtgtgtgtatcagggcctcacatcctctgctatgtgggtgtcagggcctcacttcctctcctgtgtgtgtcagggcctcacatcctctgccgtgtgtgtgtcagggcctcacatccgctgct

SEQ ID NO: 3294 - DNA, 1800 bp, mus musculus
tcacatcctctgctgtgtgtgtgtcagggcctcacatcctctgctgtgtgtgtgtcagggcctcacatccactgctgtgtgtgtgtcagtgcctcacatcttgtgctgtgtgtgttcaggacctcacatccgctgttgtgtgcgtgtcaggacctcccatcttctgctgtgtgtgtgtcagggcctcacatcttctgtggtgtgtgagtcacggcctcaattctgctatatgtttgtcagggcctcacatcatctgctgtgatgtgtcaggacttcatatgcgctgctatgtgtgtgtcagggcctcaaattctctgctgtgtctgtgtcagggcctcacatcagctgctgtgtgtgtgtcagggcctcacatcctctgctgtgtgtgtgtcagggcctcacatcctctgctgtgtgtgtatcaggacctcacatcctttgatgtgtttgtgtcagggcctcacatcctctgctgtgtgtgtgtcagggcctcacatcctcttctgtgtgtgtgtcagtgcctcacatccgctgttgtgtgtgtgtcaggacctcacatccgcgtctctgtgtgtgtgtgtcactgcctcacatcttctgatgtgtgtgtttgtcaggacctcacatcagctgctgtgtgtgtgtcagggcttaaaatctgctgtgtgtgtgtcacggcctcacataatctgctgtgtgtgtgtcagggcctcacatcctctgccttgtgtgtgtcagggcctcacatcctctgttgtgtgtgtcagggcctctcatcagctgctgcgtgtgtgtcagggcctcacatctactgccctgtgtgtcagggcttcacatcctctgctgtgtgtgtgtcagggcctcacatcctctgctgtgtgtgtcaggaccacacatcctctgatttgtgtgtgtcaggacctcacattcgctgctgtgtatgtgtcagagcctcacatcctctgctctgtttgtgtcagggcctcacatgagctgctttgtgtgtgtgagtgcctcacatcttctgctgtgtgtgtgtcacggcctcacatcttctgccgtatgtgtcagggcctcacatcttctgctgtgtgaatttcagggccgctcatcctctgctgtgtgtgtgtcagggcctcaaatcctctgctgtttgtgtgtcagtgcctcacatccgctgttgtgtgtgtgtcaggacctcacaaccgcctctgtgtgtgtgtgtcactgcctcacatcttctgatgtgtgtgtttgtcaggacctcacatcagctgctgtgtgtgtgtcagggcttaaaatctgctgtgtgtgtgtcacggcctcacataatctgctgtgtgtgtgtcagggcctcacatcctctgctgtgtgtgtgtcagggcctcacatcctcgactgtgtgtgtgtcagggcctcacatccgcagctgtgtgtgtgtcagggccgcacatccactgctgtgtgtgtgtcagggcctcacatcctctgctgtgtgtgtgtcagggcctcacatccgctgctgtgtgtttgtcagggcctcacgtcctctgctgtgtgtgtttcaggacctcacatcctctgctgtgtgtgtcaggacctcacatcctctgctgtgtgtgtgtcagggcctcacatccgctgctgtgtgtgtgtcagggcctcacatactctgctgtgtgtgtatcaggacctcacatcctttgatgtgtttgtgtcagggcctctcatcctctgctgtgtgcgtgtcagggcctcacatcctctgctgtgtgtgtgtcagggcctcacatccgctgc

SEQ ID NO: 3295 - DNA, 1000 bp, mus musculus
gctgtgtgtgtgtcaaggcctcacatcctttgctgtgtgtgtgtcagggcctcacatcctctgctgtgtgtgtgtcaggacctcacatcagctgctgtgagttttcagggcctcaaatctgctgtgtgtgtgtcaggcactcacatcctctgcagtgtgtgtcagggcctcacatctgctgctgtgtttgtgtagggcctcacagcctctgctgtctgtgtgtcagtgcctcacattagctgctgtgtgtgtgtcagtgcctcaaatcttctgctgtgtttttcagggactcaaatctgctgtgtgtgtgtcagggccacacataatctgctgtgtgtgtgttagggcctcacatcctgtgctgtttttgtgtcagggcctcacatcctttgctgtatgtgtgtcagggcctcacatcctctgctgtgtgtgtgtcagtgcctcacatcagctgctgcttgtgtgtcagggcctcacatcctctgctgtgtgtgtgtcagggcctcacatattctgcagtgtgtgtgtaagggcctgacatctgctgctgtgtgtgtgttagagcctcacaaaaaatgctgtgtgtttgtcagtgcctcacatcctctgctgtgtgtgtgtgtcaggacctcacatcctttgctctgtgtgtgtcatggcctcaaattagctgctgtgtgtgtgtcagtgcctcaaatcaactgctgtgtgtgtttcatggactcaaatctgttttgtgtgtttgtcagggccacacataatctgctgtgtgtgtgtcagggcctcacatcctttgctgtttgtgtgtcagggcctcactcacctgctgtgtttgtgtcagggcctcacatcctttgctgtatgtgtgtcagggcctcacacctctgctgtgtgtgtgtcatgacatcacatcctctcctgtgtgtgtgtcagggcctcacatcatctgctgtgtgtatgtcattacctcacatcctctactgtgtgtgtgtcagggcct

SEQ ID NO: 3296 - DNA, 1000 bp, mus musculus
cagggcctcacatcctctgctgtgtgtgtcaggaccacacatcctctgatttgtgtgtgtcaggacctcacattcgctgctgtgtatgtgtcagagcctcacatcctctgctctgtttgtgtcagggcctcacatgagctgctttgtgtgtgtgagtgcctcacatcttctgctgtgtgtgtgtcacggcctcacatcttctgccgtatgtgtcagggcctcacatcttctgctgtgtgaatttcagggccgctcatcctctgctgtgtgtgtgtcagggcctcaaatcctctgctgtttgtgtgtcagtgcctcacatccgctgttgtgtgtgtgtcaggacctcacaaccgcctctgtgtgtgtgtgtcactgcctcacatcttctgatgtgtgtgtttgtcaggacctcacatcagctgctgtgtgtgtgtcagggcttaaaatctgctgtgtgtgtgtcacggcctcacataatctgctgtgtgtgtgtcagggcctcacatcctctgctgtgtgtgtgtcagggcctcacatcctcgactgtgtgtgtgtcagggcctcacatccgcagctgtgtgtgtgtcagggccgcacatccactgctgtgtgtgtgtcagggcctcacatcctctgctgtgtgtgtgtcagggcctcacatccgctgctgtgtgtttgtcagggcctcacgtcctctgctgtgtgtgtttcaggacctcacatcctctgctgtgtgtgtcaggacctcacatcctctgctgtgtgtgtgtcagggcctcacatccgctgctgtgtgtgtgtcagggcctcacatactctgctgtgtgtgtatcaggacctcacatcctttgatgtgtttgtgtcagggcctctcatcctctgctgtgtgcgtgtcagggcctcacatcctctgctgtgtgtgtgtcagggcctcacatccgctgctgtgtgtgtgtcaggacctcacatcctctgctgtgtgtgtcaggacctcacatcc

SEQ ID NO: 3297 - DNA, 1000 bp, mus musculus
catcctttgctgtgtttgtgtcaggacttcatatgtgctgctgtgtctgtgtcaggacctcacatcttctgccatgtgtgtttcagggcctcccatcttctactgtgtgtgtgtcagggcctcacatcttctgtggtgtgtgtgtcacggcctcaattctgctatgtgtttttcagggtctcacatcctctgctgtgtgagtgtcaggacctcacatccgctgctgtgtctgtgtcaggacctcacatccgctgttgtgtgtgtgtcaggacctcacatcttctgccatgtgtgtttcagggcctcccatcttctgctatgtgtgtgtcagggcctcacatcttctgctgtgtgtgtgtcaggacttcatatgcgctgctgtgtgtgtgtgagggcctcacatcctctgcagtgtgtgtgtcagggcctcacatcctctgccatgtgtgtgtcagggcctcacatcctctgcagtgtgtgtgtcagggcctcacatcagctgctgtgtgtgtcagggcctcacatcctcttctgtgtgtgtcagggcctcacatcctctccgagttgtgtcagggccttacatcctctcaggtgtgtgtttcagggcctcacatcctctgctgtgtgtgtgtcagggcctcacatcttctaccgtgtgtgtaatggcctcacatcttctgctgtgtgtgtgtcaggacctcacatctgctgatgtgtgtgtgtcagggcgtcacatcctctgctgtgtgtgtgtcggtgcctcacatcagatgctgtgtgtgtgtcagggcctcacatcctctgctgtgtgtgtgtgtcaggacctcacatcctctgcttgtgtgtgtcagtgcctcacatcatctgctgtgtgtgtgtcagggtctcacatcctctgctgtgtgtgtgtcagggcctcacaaaatctgctgtttgtgtgtcagggcctcacatcctctgctgtgtgtgtgtcttgacctcacatcctctgttgtgtgtg

SEQ ID NO: 3298 - DNA, 3600 bp, mus musculus
ggcctcacatcctctgctgtgtgtgtgtcagggcctcacatcctctgctctgtgtgtgtcagggcctcacatcttctgctgtgtgtttcatggcctcacaacctctcctgcttgtgtgtcagggcctcacatcctctgctgtgtgtgtgtcagggcctcacttcctctgctgtgtgtgtcagggcctccaatcatcagctatttgtgtgtcagggcctcacatccgctgctgtgtgtgtgtcagggcctcacaaaatctgctgtgtgtgtgtcagggcctcacttcctctgctgtgtgtgtgtcagcgtctcacattttcagctgtgtgtgtgtcaggaccttacattttcagctgtgtgtgtgtcagggcctcacaaaatctgctgtgtgtgtgtcatggcctcacttcctctgtgtgtgtgtcagggcctcacatcctctgcaatgtgtgtgtcagggcctcacatcctctgctgtgtgtgtgtcagggcctcacaaaatctgctgtgtgtgtgtctaggccacacatcctctgctgtgtgtgtgtcagggcctcacaaaatctgctgtgtgtgtgtcatggcctcaattcctctgtgtttgtgtcagggcctcacatccgctgctgtgtgtgtgtgagtgccacacatcctctgctgtgtgtgtgtcagcgcctcacattttctgctgtgtgtttttcagggcctccgatcctctattgtgtgtgtgtcagggcctcacgtcttctactgtgtgtgtgtcagggcctcatctcctctgctgtgtgtgtgtcagggcctcacatccgctcctgtgtgtgtggcagcacctcacattttctgctgtgtgtgtgtcaggtcctcacatcctctgctgtgtgtgtgtgagagcctataatctctgctgtgtgtgtgtcagagcctcacatcctctgctgtgtatgtgtcagggcctcacatcctctgctgtgtgtgtgtcagggcctcacatcctctgctctgtgtgtgtcagggcctcacatcttctgccgtgtgtttcatggcctcacatcctctgctgcttgtgtgtcagggcctccaatcatcagctatttgtgtgtcagggcctcacatccgctgctgtgtgtgtgtcagggcctcacaaaatctgctgtgtgtgtgtcagggcctcacttcctctgctatgtgtgtgtcagcgtctcacattttcagctgtgtgtgtgtcagggccttacattttcagctgtgtgtgtgtcagggcctcacaaaatctgctgtgtgtgtgtcagggcctcacttcctctgtgtgtgtgtcagggcctcatatcctctactgtgtgtgtgtcatggcctcacatcctctgctgtgtgagtgtcagggcctcacatccgcttctgtgtgtgtgtgagtgccacacatcctctgctgtgtgtgtgtcagggcctcacatcttctgctatgtgtatgtcaggacctcacatccgctgctgtgtgtgtgtcagggcctcacaacctatgatgtgtttgtgtcaggtcctcacatcttctgctgtgtgtgtgtcaggtcctcacatctgctgctgtgtgtgcgtcggcgcctcacattttctgctgtgtgtgtgtcaggccctcacatccgcatctgtgtgtgtttcagggcctcacctcctctgctgtgtgtgtcagggcctcacaaatctgctgtgtgtgtcaggcctcacatcctctgctgtgtatgtgtcagggcctcacatccgctgcagtgtgtgtgtcagggcctcacatcttctgccgtgtgtgtcaaggcctgacatcccctgctctgtgcgtgtcagggcatcacaaaatctgctgtgtgtttgtcagggcctcacatcctctgctgtgtttgtgtaaggacctcacatccgctgctgtgtgtgtgtgagtgccacacatcctatgctgtgtgtgtgtcagggcctcacatcttctgctatgtgtgtgtcaggacctcacatccgctgctgtgtgtgtcattgcatcacatcagctgctgtgtgtgtatcagggcctcacatccgctgctgtgtgtgtgtcagggcctcacaacctatgatgtgtttttgtcaaggcctcacatcttctgctgtgtgtgtgtcagagcctcacatcttttgctgtgtgtgtgtcagggcctcaaatctgctgtgtgtgtgtcagggcctcccatcttctgctgtgtgtgtgtcaggaactcatttcctctgctgtgtgtgtcatggcctcacacccacagctgtgtgtgtgtcagcgcctcacattttctgctgtgtgtgtgtcaggccctcacatccgctgctgtgtgtgtgtcagcgcctcacattttctgctgtgtgtgtcagttcctcacatcctttgctgtgtgtgtgtcagggcctcacaacctctgctgtgtttgtgtcagggcctcacattctctgctttgtgtgtgtcagggcctcacattctctgctgtgtgtgtcagggcctcacatcctctgccgtgtgtgtgtcagggcctcacatttttgctgtgtgttgtcagcgccttacattttcagctgtgtgtgtgtcagggcctcacaaattctgctgtgtgtgtgtcagggcctcacatccgctgctgtgtgtgtgtcagagcttcacatcctctgctgtgtgtgtgtcagggcctacatcagcttctttgtgtgtgtgagtgcctcacatcttctgctgtttgtgtgtcagtgcctgaaatcagctgctgtgtttgtttcagggcctcacatccactgctgtgtgtgcgtcagcgcctcacattttctgctctgtgtgtgtcagggcctcacatcttctgccgtgtgtgtcaaggccgcacaacctctgctgtgtgagtggcacggcatcacatcttcagctgtgtgtgtcaggacctcatatccgctgctgtgtgtgtgtcagggcctcacttcctctgtgtgtgtgtcagggcctcacatcctcttctatgtgtgtgtcagggcctcacatcctctgctgtgtgtgtgtcagggcctcacaaaatctgctgtgtgtgtgtcagggcctcacatcctctgctgtgtttgtgtcagggcctcacatctgctgctgtgtgtgtatcaggtcctcacatccgctgctgtgtgtgtgtcagggcctcacaacctctgatgtgtttgtgtcagggcctcacatcttctgctgtgtgtgtgttagggcctcacaacctctgctgtgtgtgtatcaggtcctcatatccgctgctgtgtgtgtgtcggcgcctcacattttctgctgtgtgtgtgtcagggactcacatcctcggctgtgtttgtgtcagggcctcacatccgttgctgtatgtgtgtgtgagtgcctcacatcctctgctgtgtgagtggcccggcctcacatcttctgctatgtgtgtgtcaggacctcacatcttcatatgtgtgtgtgtcagggcctcacatcagctgctgtgtgtgtatcagggcctcacatcctctgctgtgtgtgtgtcagggcctcacttcctctgctatgtgggtgtcagggcctaacatccgctg

SEQ ID NO: 3299 - DNA, 1200 bp, mus musculus
ccccaaaattaaagggaaattaggcaaagggcaacctggcaagattttaaggcacagggaagagagtggataggaaatgagctgaactgaaggtcatttcctgaaggaatgcatgggagaaaagtcagcccctaacatcacaacaaggaaagtgagacattacaggagatgcaggcttctaacagagtaacaagagactgtggaaatccagagtgtatgtgcagcaagatataatcattgtcagactagaagaaccaggggacaatgtcggaatctgtggagggatggcagaagggtgctgtagaacactaagaaggctctggaaattgatgtgaaagatgaggatgccctagaggcaacagaggaaggaaaaataatatcattaaatcatgatttcaagatgggcaacagaatgacgaggctactggtgctaaggtcaaggaaagaacacatgtcttcggtatccctgggtcttgttatggagtgaatgagctctacaggtacaagcttaatctgtgggctcaacagctaagaacaggagaccccatctttatattggcttcagtccagggacctttagggagatgagtccaaacaccagaatgcagttaccatcctgaagtcagatgttagtgtttacttttccaggaggtcattttggtcccgttatgtaggaagggcatattcaccaatacttatgaggactaatgatgccaacttcctgttcattatagagggaagagggatgatgagcccttccagtcggcgccagcaccaggtcaccaagggctcagagtctggagacaaacccacagtccctagaggattctccacatgatcttatgatcactggcgagtggaacacatctgtgccaatccaattgtgatggacctgtgacagcaggaacaaggacaccagagcccttcctaaccagaaactcaggttccttgtgatcagttctggtttaccttggttttgaacagaccagacagctccacggtcctcaaaggagacaccatttctaggcactgtaacacacccaggatcgtaggacaacaggatcccagtataacaggggctgggtcataccagtatttcagggtctcagaggaagcttgactgccaaaaactctgacacatccagaatcttaggtttgcaggagtccacaaccaaaggatcacagagaaagctggactct

SEQ ID NO: 3300 - DNA, 1000 bp, mus musculus
tcttctctgactgagcccagacccggcagttgtatatgtgttgggggcctcatatcagctggtgtgtgctggaccttcttttcctcaggctcctctccatttccattcttgcagttcttgtgattgctttcttctccctccaaagtgggactgaggcatcctcacttgggcacctcagcttgttgacctttttgagttctgtggactctatcttgggtattctgcactttatttatttatttatttatttatttatttattttgctaatatccacttgttagtgagtatataccacacatgtcctttggggtctgagttacctcactcaggtaatcccatctatttgcctgcaaaactcaggatgtcctcgtctttaatggctgagcagcattccattgtgtaaatgaaccacattttctgtatccattcttctgtcgtgggacatctaggttgtttctagcttctggatatcacaaataaggctgctatgaacatagtggaacacatgtccctgaggcatggtgggccatcttttgggtatattaccaagagtggtatatctgggtgttcaggtagatctatttccaattttctgaggaacctccagattgattttcagagtggctgtatcagtttgcaataacaccagcaatggaggagtgttcctctttctctacatcctctccaacaagtgttgtcacctgaggttttgatcttagccattctgatgggtgtaaggtggaatctcagggtcattttgatttgcatttctctgatcactaaggactttgaacatttctttaggtgcttctcagccattctagattcctctgttgtgaattctgtttagttctatacatcattttttttaattaggtattttcttcatttacatttccagtgctattccaaaagtcccccataccctccccccccacacactcccttacccacccactcccacttcttgtccctggcattctcctgtactgaagcata

SEQ ID NO: 3301 - DNA, 1200 bp, mus musculus
atatcaaaagatggcctagtcggccatcactggaaagagaggctcattgaacttgcaaactttatatgccccagtacaggggaacaccagggccaaaaagggggagtgggtgggcaggggagtgggggtgggtggatatgggggacttttggtatagcattggaaatgtaaatgagttaaatacctaataaaaaatagaaaaaaaaaaggaaaaaaaaatgagttccttgtggcaaatgtagcgaacaaagatgaagtcatcacatagcactgaacggtttctgcatttacccggacatcgtggcagaaaacatggacaggcaaaacttcaccgcaggtttctacccctcaacttacatatcaaatcatatcgcattatcccagcaatgaaatccaagcattaaggcctaagcaagtagctggtaggcaatggatacatgactgttctgtgacatccatttccactcaaaagtacagtgctcacccttaaaactaccgtgtgtcctattttaataaaaagtctgctaataaaaccttgtttccagaggcagctgtgacaggctgttctataagaatctgatttattaataacaaaatttatggggcgaggaggagaaaagcaatacatggtcttcttgcctggcttcatttccctgtaatatcttagtgatgagcctcctgctggcaagcattctggagccaagaggaaaaaataagacactcaggttcagcctgtgaagttctctctctttgcccgttcctgaacagtcctgagactcaattgtgccatttctccttctgtaacttggaaaagaaacagttggtctccctcagcgtcccatgtgtctcatttgcctcatgctgatgagggaagagctgggtacacataaagtcccccgttgtctttaatttggtcatggatgactgttcccagcctcagatgagtcatcaccagtcaattacattctctcagtcaagagcctgcccattgggccatcccagagtaacagccgtacacttcatcacagttcatcctaactaatggtttcctgggtgaagcaaatgcacatctagctcttaaggcttaccaacagcatattcctttgagtgacttctcacggatgaactctgacacttcaaatcgatttatatactctacattactgaagaaaaagagcgatgcaataaagagtcgttaag

SEQ ID NO: 3302 - DNA, 1000 bp, mus musculus
accagtcaccgtcctctcccttggacatagcatgctgaatggacaggaaggtctcctctgtttctgggcagaacgtgggatttccctgaacggaggcacgctgccatgcaggcagaggaccccctgtcagtacaccacgtcaagaggaagctgctgatgtaagggccatgtctgagggaaagcaggaaactctgatgttagatagggaagcaaaacgtcacaaggtagggaagaggagggaactgccaagggctcagccaggggccacaggccacacggagctgcatcattcccaactcagggtgttacagatgccaggagctaggggcaccacagaggggaacgtgttttgttgaaacttttgtgaagcaggctgggagtttctccactgaactatggggcaggagagcaagggagaggggtgtaggtgattttgcaggaagtacattgtgtgtgagctcccccgatggacaacctgggctggtggagttcaccgctttactatggtttgtacgtctcacttagagcacggcttggggagtgtttgcttttctcactgtgtaaataaaagtctatctctggaaaatggcacaaactgtccctccgattgaaatctacaaggtctgaatgacttcaccttcgccggtgggcagtggaatttagaaagcgcttggctaaccatgcatcctgaagtggagggggtggcgggtggggatgcatcccagcaagctgacctgaatcagcgcagcaggcagctctacattcagtacatacttagagagcaaggagggaaaacagaaggagttcaacggaacgtgagaaagaacaaaccggcaatgcctctggagggtgaggccggggcttgctgtgtttaccccgcaacccctgtaccgggtccagtaaatctccacccagcgtcatctgggtatgacgtcactgattcccccattggctctggcagcttcctgctttctgggggccagctagggcaatgatgtca

SEQ ID NO: 3303 - DNA, 1000 bp, mus musculus; identical to SEQ ID NO: 3302

SEQ ID NO: 3304 - DNA, 1200 bp, mus musculus
actaattgagaaaatgccttacagttggatctcatggaggcatttcctcaactgaagctcctttctctgtgataactccagctgtgtcaagtttacacaaaactagccagtacaagcagtttactcaggcagctacttacttcaaatctcccagcctctctagttacaagtgtttttctccactccagccacaaccacgcccccaccaatcaccacaggtcacatcacctcaccaggcaggcttgctcagccaatcagggattaggggcgggccatccaccaaacattggcttgtttactacctggaacagacgtctatcctgctgaccaggaagaccgggatggctccctacaattcccccttttatatatttttttgaataagccccgtgggtgaagatagaggtctgatccccagtgtgcagaaataggggccatgtacaggattgactcttaggctcacaggtttttacccagagcaaccctgacctgctcccgtgctgttttttccttggggaaggacactaggacactcaaccctcatgcaatcagacatacctcccagagattgtcaaacagcttccagactaacctctgtgcagtatttagccgtacaaccctacggagtgatggcttcattgttcactcttcatggcagcaagccaaatctgaggtgactcccctgcttccactgtggcaaaagcttgcaccaccatggcggcagtgtggacctgggcattccgcaaccgacacatacaccatacacacaacatgcatgccaaaacaagggccatagtgaaggcacctatcccagtccattctttgcctatgccaagccaggatccactcgggcagaatttacggtgacaatcgaccgaagctcattcatcttgccatcaaaattttacaccgacagtattccccatctgggttctgcacccatcaggggcagacacgtgctcatcaccagcaagatcagcttcttcattttgacagcgttgcactagccactctggaacccacactggctcttcgcgattctgtggaaacatgcaaacagaccctctcccccaggctaacacagggtccggaccatttcatgatcctgtaagcacatccttccatttagcataccccagtttactggggctggtattagcatgttgttcagcagcagagtgaccttccttatccaattgc

SEQ ID NO: 3305 - DNA, 1600 bp, mus musculus
tccaggcaacccaggacaaattcttaactgtccaaaaacagtcttctaaaagaacagcattttttcttatgagttgcataagcaattgcaaactagagaattaatagcatctggggggtgaacaattttaagcaattgtaagctctgatatatatatatatattaatatatacatgtatatattaataaagatacaaattaaagcttgattattcaacattttaaaacaccatctacagcacacaatttaattatctgtgttgaagcaggagaaaactcaaaagaataagcgtgtgatccaattcacatatacttttctcccatagaagggctgtttttaaacacagtaattgggatgcatgcatgcatgaatttatagatgatacagaaacatgcataagaacaattttctaacttgtcttagggataatgattgccaattttatttaaaatgatgttatgcaatagatcaaatattaatattctgtaataaccaatttaattgctgttttgaacaaggaacagacagtcaggttcttaagacacgatttttgttataggttttctaaaatatacgaatttatcttacaattctttattagcaccacagcagccttaataggatggtaaaactgtgctttgtggtgaacgccacctcggccttgcccgcctccagcccttctcccaggttgaagaggctgaaacggcccaatcttttgtaggccaggaaacccaagcgagggcagcagtgcaccctgagtcctagcaggaaaaataagatcacccccggcagggacaggcggaggctcatgggggcaatggcaagcacagccctcccctgagtttgctacaaaggcacccgctttctggtggcctcccgcgccaccactgctcagggaaagctgcatatcccaaggccctgccctacagcagccagcagccagcagccggcaggctccacataggccgggaggaaaagaaaaatgactttacagtcatgttttctcttgccaaagaattgctgtgggcacagctaatatttaattaccgttgattattattgataacaattataaaagctttcttcattttctgcaaagccttttgttctttgccagttaatttgtgtctcaataataatagcacctaacaaaagcttaagttctcctgtggtgagtttaaggtgaggtcttagccagttaacatctcctggaagcttttgaaaataaatttttgaagcaaatcaattttttgttctagattttctgtaccacaattttatagtataactaaacccctaagtattcaaaagatattgcctctgaatattttctggagcaacagctactctccagaacttaaaagctccttgtgtgagagcaaggatttaaagtaaacttcccttaagaggcattagttaataaaatactttccacttagaaaacaatatacactgaaagattcaaactcttagcttcttgtattgaagcagagacactaagaatttttattacatgaggttaggctatataagccatacctagaggcaaaattttccagtgattacaagctcactagaagcaagctctttacaattttc

SEQ ID NO: 3306 - DNA, 1400 bp, mus musculus
tactgatctagaacttcagtgaggatggaaatatatatgtatttcatacatctatgaaatttattgacaagtacattgaaaataaattagttgcttgaacagaaagttgaatattctattttgtggatatagatgcatcctatttcaccttggacaatgtcaaagccaggctacttgtgagtcattcaaaatatgtgtcatttaatagtaaagtgttcattggcatgctgaatgagaagtaaacatttgtttaatcctgtttttcattgcatttattatttgattaaagaatattattttatttttgtttcatcaattcatattgcaacaaaagatgccttccatcaaagtcgtgaaaacagtcaaggatagtaatggatcctaggctttaagaagagctgtttagtgccaggtccccctgaggcatagtcaatagaggtgagctgagtgtcacagctctgcctgtcttcatgaggaggcctgatgggccccagaaacatccaggttgcacacctctggggcattactctgactgcaaagtctcctgggggcatagccagtagcaatgggctgctttgtccagcacacaactttgtctgccttctcaaggaatcctccaggggttccaggaacattcatgtccacctagggaatgtccaccagaagtgagcagtatactggtcccaagctccattgtcaggcccacagttctgcctgtcttcctaaggagtcctcccgacatcaggaacatccagtcaatactaggaatggctaaagaacaacaaccatatggctaaaggcagtataaaaacaccattgacaagagccagggatatatgatatcacaagagtgaagctaccctactacaatcccagaatatcctaacacagcataagcacgaagagatgaccttaaatccaacctcataaaaataacagaagcctttaaagaggaaatgagtaaataccttaaagaatacaggaatatgtaactaagcaggtgaaggaaatgaatgaatctattcaagatctgaaaatgataatagaggcaataaaaaacacaaactgagggaatcctggagatggaaaacctagggaagagaactggaactacagatgcaagcatcaccaacagaatacagaagatgaaagagagtgtctctggtgtagaagatatgactgaagaaatcgatacactggtcaaagaaagtgttaaatccaaaaggttcctggtaccaaatatccaaagaattccagaacactatgaaaataccaaacctaagaataataggaatagaagaaggagaaaattcccagctccaagggccagaaaatattttcataaaattcatagaagaaaatttccccaagctaaagaaaacaatgcctataagcataca

SEQ ID NO: 3307 - DNA, 1200 bp, mus musculus
tttcggttgtgttggggtgcccaggactaggtggggtgggagtgctgcgttctgatgatggtgagtggtcttgatttctgttagtaggattcttatgtttgcctttcgcgatctggtaatctctgaagctagctgttatagttgtctctgttaagagcttgttcttcaggtgactctgttagcctctataagcagacctgggagggaagcactctccttagtttcagtgggcagagtattctctgcaggcaagctctcttcttgcagggaaggtacccagatatctggtgttcgaaccggactcctggcagaagttgtgttccactcaccagaggtcttaggatcctgtggggaatcctgtgtgggcccttgcgggtgtcaggcgactccgctggcaaggtaccccagtactccagtggagcgaatgggcttgtgccccaggtcaggccagggtagtctgcttccctatttaccgcagtctcaggttccgcgagattgggttggggcagacgctgtgttccactcaccaggggtcttagaattccgtgtggaatcctgtgtgggccctcgcgggtgttgggcgactctgctggcaaggtaccccgcggttcgagtggggcggaagggctgtgcagaggtcttaagctcagctcttccttctggctgaagaagaaggcctgaaaggcaccttgtcccagaagctgtgttgcttctgccacctgtgcactctgctgtgcagactggtctcttttggacctgggatacaagatggcattctcacctggtcctgaggacagagagtcctccctgggggccacctctcctctggcagggaaagtgtgcagaggtctggttctcagctctgctttttggctgaaaatgaaggcctgaaatggaacctgtcccagaatctatgttgcttcttctgcccacgctctctcctgtgcagactcactttggaatttttatataagttaaggcacactggttccagttgttttgatgtctgcatgaaaattattttgcacctaaatctcattaactgattaatgtaacccagagaaggcacagtgccacagagggcagcactcaccagaaatccttgatcaccacaggcaacattttctttcctgtcttctgtgccctgttttaaaaggtagtctggtttctttgctttgtgtgtgtgtgcatattatttat

SEQ ID NO: 3308 - DNA, 1400 bp, mus musculus
taagatgaccctgcctttcctcagattgaggggagattccggccagatggtgttagcttagataatgtagccccatttgtccttgaataccttttcatctttatggccaagatgttcttaggaatgccttatcaacagccctgccttggcatgcctgggggcttgttctgctttgttctcagtcccagatcggggcagtgggctcctaaacaagttacaatatttcatcttccttcaagacaacttatcaatgttgcatgacccaggagggcagaccacaccggagacaacctctacacatactgtggccacatagcacaagtggcgtatagcattcatgagcccatgactgaggtgaccctagacacccactcagatgtgtcagaactcaggcatcactaagacaaatgagtaattggtggataaatagaagaggaagagaaagaaaggcagaagaaagtatgcacaatgaacagaggcagaactggagacttgggggtagtaagaaacagcctgatgtgatacctggtgatgcctcctaaggccatggtgtgatcctggcctgtgctgccactgtaggccacttcagcagcagtcatctgttatcaccaaagggaaggcagatgtccctagtccagactgatgcctggggcatgttgatgtctgaagactgagaagaacaggtcccatccttcatcttggcatcatgggagagctgactccaaaggtgtgagggcacaagagccatccataccgctcagtggccataccactcaggaaagcaggccctgaaccttgcctgggcagcagtagaggtgaccctagtggtgagagtgcagaggagttggcccctatggaatgagcatgaggtatctggctccacaacttgtctgttgtggtagcagggaggagggacagatgccctcctcccctacttttttcactcaccacctatggcaggctggaaaactgggccttgtacctcacaggctgcagcgcttaggagggaaggtcctgtatcttgcctaggcaacacagtagagcttgccctgttttgggggttgtgggtgagacagccccaagagtttaagagcagaagagctggctctgcccttgagagctgtgtcattgataatctatctgggtcagtggtggagagcttgccttcatagtgtaagtgcaggagagctaatggggtcactagctcagataatctctcaggcccagatccagagctttgagttggcccatcctaatatctaccccatctctgaactgctgaagcatgtgaaggatccagtcctgcaaattcaaagctacagtatttccatgatgaagggcaacaacaggatatcttagaggagtcccaataaggattcaggattgatagtgtagcagaa

SEQ ID NO: 3309 - DNA, 1400 bp, mus musculus
ctttaggcttcttgtatgttcatgggattctctttctttaggtcaggaaagttttcttctataattttgttgaaggtatttactggccctttaagttgagaatctttgatctcttctatacctattttccttaggtttggtcttctcattgtgtcctgaatttcctggatgttttgggtcagggcattttttgcattttgcatttttttttttttttactgttgtgttgatgttttctatggtatctcctgcacctgagattctctcttctgtctcttgtatctgttggtgattcttgcatctatgacttctgatctctttcctaggttttctatctccattgttgactccctttgtgatttctttattgtttctatttccatttttagatcctggatggctttgttcaatttcttcacctgtttggctgtgttttcccataattgtttaagatattttcatgtttcctctttaagggcttctacctgtttatctgtgttctcctgtatttctttaagcgagttatttatgtccttcttaaagccctgtatcatcatcatgagacgtgattttttttaatccaagtcttgcttttccggtgtggtggggtatctgggacttgctgtgttgggagaactaggttctgatgatgccaagtatccttgttttctgttgcttatgttcttgtgcttgcctctcaccatctggttatctatagtgcaacctcatcttgctgtctctgactggagcctgtccctcctgtgatcctggttgtgttagaactcagagtccagtggtctctgtgatcctgtaattctgggatcctgtgatcctgagatcctgggtgtgtcagatcgcctgggagtcagtctttttctgtgtgttgtgggacagcacccaaggtctgctcatggcacaagttcagactggaaggaacccatgccagtgtcagggcatccctggaccctggggaacccagttgctccaggtgttggtgcagatgttgtggcctctcctgtgatcctgggtgtttcctataacaatattaagaggatgctattgttggtacactggaagctcacttagttgccactggtcttttaatgaagtctttattattgtcaaccctacttgtgagacagcttttagatataaaagccatgcagaatgctgctgcttttgcatggctctcatatcttgcatgatggtagtagtatactttaaaacaagtcattatattgaatctaatactaaatccatgccatctctcacataccactaatggcattgctttttgcaaacagaagggataaacccatgagaattctaattatgcctttctaaagaagtggcattagtatgagtttactggccccttgctatcccaaaatcccacccct

SEQ ID NO: 3310 - DNA, 1000 bp, mus musculus
agacaacacagtaagagcaaaagagttacaagagcaaacaaaacagccagagatgcctccattcccactgttaggagtcccacaaaaacagcaagctaaaaaccataacatatatgcaaaggacctagtggagacctatatagtatataggctccatgattgccatttcagtctatgttccctgtgaggtctgcttagtatgtctattagccatgtttttctcctgtccttgacacctctggctcctgtaattcttcttccccttcttcccctgggttctgggagctccaaggggagagaaccaatggagatctccaatttgggctctctgcctaatgtttggttgtggatctctgcatttgctcctctcagtagcctctttgatgaagataggactggtcaccaatctgtgagtatataagactatcattagaaatcatcctattgggagctgaccctgtgccacatctatctggacccaagtcccgcctcacaccccagtactgcccagagagagcaggtctcccaggagtgttaacataccaaagatcacaggtgagatctccactgctgtgcaaatattgggcaaaagtgggaccgcctggagcccacaggaccaaggaactgtggagcagccagggacaggactcttccagtttccatctgtgcccaggcctgaccctgtgccacactatctggatcccagtcctgccccacatgccagtccctctcagatagtgaaggtctcccaggagtgctaacacaccaaagatcacaagagtgctgacacatttaagaccacaggctgacaggctcacaggagggacaagctccagtcagagacagaaaaactaggtgataaccagatggcaagaagcaagcacaagaacataagcaacagaaactaaggctacttggcatcatcacaacccagttctcccaccacagtgagccctggatactccaatacagcagaaaaacaagactctgattttaaaat

SEQ ID NO: 3311 - DNA, 1000 bp, mus musculus
ggtcccacatgaggaccaagctatatatctctttcatatgtgtagggggactagttctgtcctatgcatgctctctggttggtggttcagtcactgtgagccctctgggcccaggttagttaattctataggtttgcccataatgacctttctggatctttcaattcttcctcaccattttccacaacattccccaaattacacctaatgcttggctgtgggactcttcacctgtctccatcatttgcctgataaagcccctcagatgattgcaagcttcctgtcgcaagtatagcatcgactttttgggttggttttgatctatgcttttaattattttatttatttacatttcaaatgttgtccccttttccgattccccctccacaaactccctactccactctcctcccctttgccgctaagagtgtgcttccccacccacctacccactcctacctcacccctctaacattccccttctctggggtatcaagcctccacaggaccaagtgcattccctcacactcaggccagacaaggcagtcctctgcttcatatgtagcaggggccaaggaccagtccatgcatgctctttggtaggtagatggcttagtccatgggagctctgaggcggtttagttaatttatattgttattctttctaaggggttgcactctccttcagctccttccgtccttcccttaactcttccattagagcccctgggctcagtccagtgattggctgcaagtatctccatcttgaagaaacaaaacactgaatgaaaatcacatataatggctggaatgaaaatgtactgatgacaagtttcctggtaggaaaatgtgcattgaaacacacatgaaccaattgtttatgttcaagagcatatgggatagaaagatggaaacatgtgcaggagagaaggaaaaggacaatgactcatctctaatagcagataccaaaaaagattagtgcagatgggcgcaaaggaaa

SEQ ID NO: 3312 - DNA, 1400 bp, mus musculus
aattctactttctatcaatttgtgtatataacaatctttcattcctataatctttcattttactaagtgctatttagaggaattcatttcaaagaaccaagggaagtgataatatttcataaataaattaaagataaacctttgagtctcttaaaatttatatagaaaatattgttgacctcaaaataaaattaaattgtttatagtcctgtgtgacatgttacagtttcaatttatgaatcttaagaatatagagaataaaattggaagcatcctttaggagagattagttattatgttcattcaacaatggtatatattaaatgttgtagttggttcttatgatgcatatctcagggctatggagataactcagtgggtaaactcttttgttttggtcagttgaggacctgggtttgcatcatcagcatcctctgtcagagctgtgtacagtaatgggtccctccatgtgtactctttggttgatgatttagttcttgggtgctcaggggcactggttggttcatattgctgtttcttaaatggggctgcaagcttcttcagctccttcagctccttcagctccttcttctgtcctttctcttgctcttccattggggaccttgttctcagtccaatgatgtttgactgagagcatccacctctgtctttgtcaggcactggcagagcctcttaggacacagctatatcaggctcttgtcagcaagcacttcttggcatccacaatagttcatggatttggtgattgtatatgggatggatcccttagaagactcgatgccccagtgtaggggaatggcaggacagggaagtgggagtgggtgagttggtaagccggaggaggtgagatagattaggggatttttcggtggggaaaccaggaaaatggatatcatttgaaatgtaaagtaaagaaaatatctaattatttaaaaaaaaagagctgtgaatatcagtgtttaaatgatattcacgtgtgctgagataggaggatgctgggtagtgctctccttccaccctagcactttgatgagtaccaggctcaggttcagttagaaacgctctctcaaaaaataaagtccgcatttggaagctcattatgggatggatccctgcatatggcaatcactagatggtccatcctttcatcacagccccaaattttgtctctgtaactccttccatgggtgttttgttcccatttctaagaaagggtaaagtgtcaacactttggtcttcgttcttcttgaattttatgcgtttggcaagttgtatcttatatcttgggtatcctaagtttctgggctaatatccacttatcagtgagtacatattgtgcgagttcctttgtgattgggttacctcactcaggatgatac

SEQ ID NO: 3313 - DNA, 1400 bp, mus musculus
taagttggaaatcttcattctcatcaattcctattatccgtaggtatggtcttctcattgtgtcctggatttcctggatgttttgagttaggatccttttgcattttgtattttctttgactgttgtgtcgatgttctctatggaatcttctgcacctgagattctctcttccatttcttatattctgttgctgatgctcgcatctatggttccagatctctttcctagggtttctatctccagcattgctttgctttgggttttctttattgtgtctacttccctttttagttctagtatggttttgttcatttccatcacctgtttggatgtgttttcctgtttttctttaaggacttctacctgtttggttgtgttttcctgcttttctttaagggcctgtaactctttagcagtgctctcctgtaattctttaagtgacttatgaaagtccttcttgatgtcctctatcatcatcatgagaaatgtttttaaatctgtgtctagattttcggttgtgttggggtgcccaggactaggtgggatgggagtgctgcgttctgatgatggtgagtggtcttgatttctgttagtaggatttttacgtttgcctttcgccatctggtaatctctgaagctagctgttatagttgtctctgttaagagcttgttcttcaggtgactcttttagcctctataagcagaccagaggtcttaggatccgtggggaatcctgtgtgggcccttgcgcgtgtcgggcgactctgctggcaaggtagcccagggctagagtggagcggaaggggcttgtgccccaggtcaggcccgggtagattgcttccctatttaccgcagtctcaggttccgcgcgattggtttggggcaggtgctgtgttccactcaccagaggtcttaggatcccgtggggaatcctgtgtgggcccttgcgggtgttgggtgactctgctggcaaggtagccctggggctcgagtggagcagaaggggcttgtgccacatcatttccaataggagagtaaaatatgaagacaaatgaagtaataagtaaatttattttattctttcacacatttctcaaggattaattttatatgttttacacttagaaaagtgttatggtatacctgatagtttatgcttgtaaaagttcaaaactgtacaaatgttgttaatgttaattgggcaaaatgatgataaaatataatggactgtattttttatatgttttgagcatatattgcctgctaagatgtttatacactattttaattaattataaattattttacaaagagcttggtgtgttcaaactgtacatattttgtgtttgagaattttaaaagagacaatatgacatatagaattatggtttttattatt

SEQ ID NO: 3314 - DNA, 1400 bp, mus musculus
ctctgccctctagttagtctgactaagggtttatctatcttgttgcttttctcaaagaaccagctcctggtttggttgattctttgtatagttctttttgtttccacttggttgatttctgccctaactttgattatttcctgctgtctactcctctttggtgaatttgcttccttttgttctagagcttctaggtgtgctgtcagactgttagtgtatgctctctctagttactttttggaggcactaagggctatgagttttcctcttaggactgcttttttgtgtcccataagtttgggtatgttgtggcttcattttcattaaactctaaaaagtcgttaatttcttcctttatttcttccttgacaaaggtatcattgagaagagtgttgttcagtttccatgtgaatgttggctttctattatttatgctgttattgaagatcagccttattccatggtgatcaaatatgatgcatgggataatttcaatatttttgtatctgttgaggcctgagttctggggtcagaaccttccctgtaggccatctctcctctggcaaggaatgtgcccagcaatctgggtcttagctctgcctcctggctaaggatgaaggctggaggggaccttgaccaagaagctctgttgcttctatagcccacatgctctcagatgtgtgtgctaggggtcctgtggtgtcgagagtcctctggtgccctagatgccctcggctaggttcacgcagaagatggcagggctagccccaacctgaatggatcccaacctcttgttgtctctgttcctgctggcataaaacccttgaagctgatgttgcattccactcaccagtgatccagaggtcctgaggcatggagagcactctggaggccttagtggcctctgctggactcagaaggaagatgatggggatggccacgagtggtattttcattgttatttaatttccatagtattttaaacacattccttatttgttgttatttttggtggggttgtgtttttgttgtttttattttgctttgttttaattcacactctagttatgatgatcccctgggattcattgtcatctgaatgcagaagaacatttatttagctataacatgttgaatgagacaatatggtgggtcactgtacttgagaaccaaactgaaaaagtacctttcttccaggaggaactatctactaattgacctgagaactgtacataggaaagaaaaggtacaataacagaagggataaaataaacaatgcctctcttgattctccactagatgctatcacagcaagaaacttcagagcaaagggatcagttgaactatggaggtagacaggcattgctgtgaatgcaatacagctgtagcacctctttgaa

SEQ ID NO: 3315 - DNA, 1200 bp, mus musculus
actctgtaggaggttttagtaggctctcctccactcccatagattgagttcatatacaaaggaattaattatctgaactcacatcccaatcttatgagctttaggcttataaagtgaactgagttcattgatacaattttagatgtccacacataaatgaaaaccaagagtttacaagtggaatatctctttctcacaaccccctccatgcccaactctctgatttggttaccactgcatttactctgccctaatttttctgtcctaggcaaattaaaccacagttttccatgccagaccttggtataatctttgattcttacactcctgcttaatttggcctaacagtaggttcttcaatatatctactttgttttgcagtgtgagtgttttcgactatattttatgacatcttgaaaatgtccacattgctttccttccctcctgttttcttttcacaaattcttcttcacgcaaggacacaacaaataaacaatcacatataataacttaaattttatttttgttttatttttgttttgtttttgtttgtttgtttgttttggggggggttgagacagggtttctctgtataaccctggctgtcctggaactcactttgtagaccaggctggccttgaactcagaaatctgtttgcctctgcctccccaaatgttgggattaaaagcgtgcatcaccactgcctggcaacttaaaatttttaatcctacttagcaaaaataatgcttaagtaagaaaagaaactacaaaaaaaaaaaaaaaaggaggaaatggttcattttcctaaggatgtagacaggtattcaagaacatccgcacatttggaagtcacattcagttaaaagccactttctcatttgcttataggaaatatatactattctttgagtacgtgcaggtcagcccattcactttcagtttcttgggttatcatcttggctgttgagctgagggaccccatgtctactttcaagtttctaacagacagttggtagaagccatttttaatgaatctattacatgagtgccttccttctatttgtctaactttcaagatctagctgagtgtctgaatataattagttattgtatttacatgttattctaaattttaaacatgagatttaagttaagtttattcaaatatgaaaattaagtgacaaaatttgtatatttta

SEQ ID NO: 3316 - DNA, 1400 bp, mus musculus
tagaatttctcttaaaattaaaaatataatacaatagaagttgaatatcaacacttaaaatattctttagtatttatagcattggtataaggaacaacaaaatgaccaacactagtgagtagatatactatttgtagcatgattgatgtacatttgtatattagaggagactatgtaaataatccataaataaaacttgggccactggaggttcacaaaagtatacaaagaaattcaagtttatgatctatccacatcttatatgctacccaaaatattaaatatctatgaaattgtctaaattaaaaatagaatttatagcccttttgcctggtcctttctgctggtacagactgctagctggtctactcccatgaagataccatcctgacccatccaagaggatccacagcattcagagcagtagttaagaacccctgtaccccaaactccctgagctttcccctgagaatccagtggacttgggacccaatcactcaccaaaacccctgctccccgattaccattccactccttccatctgcagctagccatctgctctttttctgctggggcagatggctagctagtctgctgccatgaagacaccataccctgccccatcctagaggatctcctgctctcagagcagctgacaccatgtcctgagccaccccagaagatcctctgcactcagagcaatccagcaccacagcctgaggcagttcaggagatgtgctgcacccaaggcaactgagcaacagacatcacaagcttgtatgctcccttgaagacaccacaacttgaaggcatcccaggagctcctctgtacatagagcaactgggtaacagacatcaaccctacaaactgaaagcctccatggagttctgctgcacacaggaaaacagaaaccagagtctgtagtcccccctggagaacatcttcacacaggctccttgaagacccaacaagctgaaggcctcccaggatatctattgcagccagggcaactgataagcagcttctctgcacctgtgaagacatctaactgaagggctccacagataatctggtacaaccagggtgtcaggcctacctggagacctgaaacaactcagggacaaaagaggcagactccagatagagtcacccagaccagcaaatagcaggaataaccagatggtgagaagcaagtgcaagaccataagcaacagatgcaaatatacgtgggtatcatcagaacccagttctcccaccacagcaaacactgagtacaccaacggaactaaatatctggaaactgacctaaaattatatctcatgtagataatagaatagtttaaggaggatataaataacttactgaaagaaatgtaaggaaatgtggtaaacaggtaga

SEQ ID NO: 3317 - DNA, 1400 bp, mus musculus
tatttccattgataatgtaaaggaaatattctggcattcagtagcatgacaaaacctgtaaggtttttttttagtgtttgagtaacccattttgtagatgtttttattaaaatttaaaataacaatttacacaaaggactatgtcaacaattactaattaatgtcattaatacttaagcaatgattctttctccatataagtcatatcaataaagtgacaagcaaaaatgaaaaaaaataattgtgtatgtactatggactaaacagcatactttcatattgtacatggttatggtttagttacatggaagaacttaaatccaatcctcagacaaaccagaagaggtcatcagatcccattacagatggttgtgaactaccatgtggttggtgggaattgaactaagaacctctggaagagcagtcagtgctcttctcggctatgccatctctcctgtccttgataccaggaaagcaagaccctcccaggaccccaaggggatggcattagctaaaatattccacaaaatggaggaagaccatatccagatgtttggccttgccccacagatgaggggtggggccacccacccatctctaaacttttaacacagaattgttcctgcctaagaaaatacatggtcaaagagtggagcagagactgaagaaaagtccatccagagtctgccccacctgggaatccatcccatttgcagacaccaaacccacacactattgctgatgtcaagaagtacttgcaaacagccgcttgatacaactgtctcctgagaggctctgctagttcctgatcaatacagatgtggatgctcacagccaatcatcggaggactgagcacaaggaccccaagggaggagttaggggaaggactaaaggagctgacgggccttatctgtcatcaatgtgaaaggcggcccttggtcctgtgaaggcttgatgccccagtgtagaggaatgctagggcagtgatgtgggagtgtgtaagtggattggggagcaccctcatagaagcagggtaagtggggatgggataggggtttgcataggggaaacaggaaaaggggataacacttgaaatgtaaataaataaaatatccatttaaaaaaagtgaaaaaaaacaaaaaagcaaataagcaactgtaagaaacactgggttttaattcaaaacaatgctatcaacaaagtatgtaggaaccatacagagtcatatgaaagtctataaaagactgaggggcaggggcaggtaattaaagtgtgcactgttattactgagagtaatgactcattgtctctagatggagaactttgtgttgttcacaagagttctgaatgaagaacttacatttcacccaatgatttgtatattcacaatcatttcat

SEQ ID NO: 3318 - DNA, 1000 bp, mus musculus
tctttacatcatttacctctctcctcctatctccaactcctaccatgtgactcagtgtttttcactctcaagttcatgacctcctctttattattacacacacaaaacacagacatacagacacacagtcacacagacacacaagctaatgagcacattaagacgttcagtgtttaggactaatcacttggatgagtgataacctaactggaagctcatttctggagagctccactctgtactacagcaaccattgactgtctaatcccctccatataagggtagggccttgtgaggtttttttttttttttattgaagttgatatgtcgcccttctggtcggcaccagaacgaggtcacctaggtaaaggagtcagcagacacacccagggtccccagaggactctccactcaaacttaggatcactggtgagtggaacacaacatgtgttccaatccaattgtgatgggcctgtgactgcaggaacaaggacaacagagcccttcctaaccagagacttgagttccttttgatcagttctggtttaccttggttttgaacagaccaggcagctccacggtccacaaaggagacaccacttccaggatcttaggacaacaggatcccaggataacaggagctgggtcacaccagtatctcagaggaggcttgactgccaaaaactctgacacacccagaatcttgggttcacaggagccaacaatcaaaggatcacagagaaagctgaactctgaggactcctgaatcaagtgggattataagaaatacaggctccaatcagacatattgagggcagcaagcacttgaggtagtcagatggcaggaggcaagcataagaaaagaagcaacagaaatgaagggtacttggcatcatcagaaccaaactcttccaccgtagcaagtcctagaaagaccatcacaccagagaagcaagacatggatctaaagtcacttctcatgatgatgatggaggacttt

SEQ ID NO: 3319 - DNA, 1000 bp, mus musculus
ctgtgtttgcttggccccggcatagtctcacaagagagagctatatcagggtcctttcagcaaaatcttgctagtgtatgcaatggtgtcagcatttggcagctgattatgggatggatcccaggtatggcagtctctagatggcccatccttttgtctcagctccaaactttgtctctgtaactccttccatgggtgttttgttccaaattctaagaaggggcaaagtgtccacactttggtcttcatccttcttgagtttcatgtgttttgcaaattgtatcttgtatcttgggtattctgtttctgggctaatatccacttatcagtgagtacatatcatgtgagttcttttgtgattgggttacctcactcaggatgatgccctccaggtcccttcattttttaacattgcataatactggaattaaatatgcaaaaaccatccataattaccaggaatctatgtgacagagatactgtatagaatatacaaaaaaccaacaacagtaacaaacaacaatttcaaaaaagccaatcccattaaaaactggggcatgggttagcacattacaactggtcttgttggaggaagctcaggtgagctggcccagagggtatgagagcagggcagctggtcctgatggcttgggctctgcaaagctgtcctgtttctagacagctgctgcagctagaagggttcacactgttgctcacattggcaaagtgggagatctggctctggtggtatggatgcaggaaagcttgtgagcagggcaactcagctaccccccaacctacccagaaccaggattttgagttagtttactccatcatccaccccatctatgaccttctggaacatgtgaagggactgctcttgcataactaaagctgcaggaccctcatggaacaaggcaacaagaggatatatgagacaagtctgggtgaggattccacattgaaagggtgacagaaggcagcagcatcacaccagacc

SEQ ID NO: 3320 - DNA, 1400 bp, mus musculus
ttgtatctgccaatccctgccatctatcaactgtctattgctattacctgtttaccaatcatctacctatttttttaaaagtctgtgaacttttattataaatagatttttttaaaaaagttcctccccactttcctatgtacaggaacccacacactttctctctctctctcttgctctgtctctctctctctcattagaatacaaacaaacatcataagaaaataaaatagaaataagaatctattgtttaagtaaatctgaatagaactacctttactgataatttctggaaagttaaagtagtttagagtacccccctaccccagcctgaaacaggctgatccagactttgaccttgctgccactaagaattagaccacctggggtggagccttcctgcctagattgctctattgttcacccaatgccactattctcctttaagaccttgctacctgctgagaggcccctgagatattctggagtgaacaccctatcctgcactgtcatcacctgcagctggttccaggctctaagaatggattagtcagggatgggcctccccccctttataagcacagttttctattaaacatttgagctttgatcaggaaccttgacttagctccatttttctctcaaccatctagttctttctctttcagctccagtctgcctcccaggtctaccctgtttcttgtgagccgcaggatggctcccaacagtctggcacctggtccaggggcctgaggaatggcagaaaaatgctggaggaacactgcttggtgtggagctccatgggaaggaaagaatcagagaaaaaaatcggggcatggtaagcaacaggtaatgtgttgctggaggtgcggaaggatacgggctaagcttgattgagtgctaacccagcgctggagtcacttaagtcagcaacaaattattcaggactagaaactggaatcaggtggttgaccgcagcttttcaaaactgctctaggcgagaggaatagggtttaaaaataatgaaacaggtggctgtccacagtcaagaactgcatcagacaggaggaatagggcttaaaatgatggagtaaaatatttagaggaaaatggattttgaaattctcccagaggcagagaaaaaattgggggacaccctgcctttttctctctggcccttacagcagaagttctctgcccttgttgtgttgtctaatgtctagtctaatgtctggtgtaccacatgtcaatccatttggtttgtgtctagttgtctgaatgactgaatgttctgtgtttcatgttggaaaataaagatggctaaaactttatctgctggttcagcaaagctgagagtggccacatgctttagccaaggatcaggcacagcaggggagccg

SEQ ID NO: 3321 - DNA, 1000 bp, mus musculus
gcttacaaaatctttaggaagatctataatctccattattttgccacttgttaacaattcagactgatatttttcattcattgtctcaaaaacgcttgttgaatgaccttaccttttcccattttgggggggggggtagggtgaggagttgtctgcatgtggacactttcccacaatcttctttttactatttactgccacagaccctcttggtcccttgtctgcatggaacgagtctctggtgcaggtgggcaaggagtcggcaggaattgacagacagactagacagaagggagtgtagatccgaatgtaatttgtcaaatagagcatcagactttttatacagaaaaaaaatagggaagttgggtgacacaccggcaaggtacaaagaggttactggatttacacaaaacagaggaatacaaacatggaataactggcaggaaccaactgggggtaaaactcaatgtttctgtgtagggcagtgacttagctatccgtgtccaaggttggatcaagggctgcctagaatctaacttagctatatgtcaaaatatcagtccttaggagcacttgtaataaagcaatattaagggaaagcgcacagatctggttaccaactaaagcaatgacattggagcattctttatacaggatgccacgttctagaggagactaagtttctgtgaactttttgccttggaacagtgcccaggttttcggggcctgtcgcgcttgtcacttctggagtggatgtagcaatttaccttatttctctgacactaaggctacgctgctgtcaccaatgttgtttctgggactgggtcacatgttctcatatcttcaaattattattattttctttctagacttaaatgctgtgacacagtggttctcaacatatgggtcacaaatccattgggggctgcatagcaaatatttatattataattcataacagtagcaaaattatagtcattaagttacaaaaagtaatttt

SEQ ID NO: 3322 - DNA, 1400 bp, mus musculus
attgcaatatgatctgtctggagtaaatccatgcccttactatacacacctttagttccaaacaatgtaggtaagtttagtttgtataaggaagctgccatatttgaaagtgatgtctaattgaagggcagacaaagtgactaatcagaaaaagatttgacacaataagacagaagttggatgtgtccaactttcatgagagtaggaaagaactacttaagagaacagctcagagtgagtcagagaaagggaagtttagtaaatatatttcagttgaattcaggcagtacagtggaatccggttgatttcaattcaatatagttcaatgcaattcagtagaatgcagttaagttcatttgagtttgtgcaattctgttcatatacattcagtcagtgcagtttatggaatttaaagccagttttcccaagcaaagcaattcactcagaagctaagagaaacaaatttgaatcagtcagcttgaggagaagtttgggtcagaacagctgagtgaaccaatcagccaaagttctgaaagaactacaaatattggttcctgtcagcttcagcccctggccaccttgggctcaaccttggcagatggtcccactgtacccagaggactctccctgcagcaggcaccctagcacacccaggatcttgggatcactggtgagtgaaatacaacatctgtctcaaaacaacccggaggggcttgtaacagcaagaacagggacaaaggaaaaccacctgactagcagctggggttcattctggtaggtgccagccccatgccaccttgggctcaacctctgcagaagatcccacatttcccagaggactctccatgttccctagcacaaagagggctctgaccccaggactcagctgagaacacccgggtctcacagaaaccagtccacacaagagagatcatgggacacagaagcaacagagcttcttggacagggtcccttttggccttcatcttcagccaggaggtggatctgatctccagcctctgtgcaacttccctgcaagaggagagcttgcctgcagagagtgctctgaccactgagactcaggaaagagttggactcccaggagtgctgacagagggtaaagattcacggtagaaacaagctccagccagagacagctagaacatctaacaccagagattgccagatcaggaaaggcaaacataagaatcttactaacagaaaccaagaccactctgcatcatcagaacccagtatgcctaccagagcaagtcctggattacccaacatacctgaaaaacaagattcagttttaaaataatatctcatggtgctggtagtggattttaagaagggcattaataactcacttaaatataggagaatactgctaaacagg

SEQ ID NO: 3323 - DNA, 1000 bp, mus musculus
tcatcttttcacacatattcccatccccacacataaaataaataactacatgtcactaaaatgttaacgaagagaagaacagatggatgacctgctgatcagctaaaccacttcactgcctagacttggtttctgatgacaattccacgaccctccctccataccttactgccttccctacatccaggcctctgcctccatttcagacagacgcctgatgctcaggtgcaggtcatgctggtcagaagaacaggtaagtgacttgtctgtcagttgaactgccccactatctagaccccattctactgaccaccctgccacctcatcacctaatctgcagctgggcccctgcattgattcaggcagactcttctttctcagatgcagaccacaccaaacaaaagaaaggagattcacttctgcatcaaaagtctaagctagttaccagatgtccaaccctccaacctgatctgagactccctattggatcagagcggagctgctcatctgaaattcagacaacaaacaacagaacaccaaagagaaaacagtaactgaggaacaaaacactaatccaacaaaaacctataatcattcaaaatgtagatgaataaactccagtgtaaggattcaataaaaagagcaaggccaatatggcaccaccagaggcatgcaatatgaagatagcaaaattggaatatttcaatgcacctggagggcaagaaaattaccattaaattaactttatcaacatgataccttctgttctccatctgtgccctggagctaaggctgtcccacagccctccacatacaaatcctaccgggaaaaagctggcctcccaggagtgctctcactcctaaggccaccggtgaaatcactactttcattccaaaaactgtccaaagagggaccaaaccaggagtgcacaaggcacagtaatagaccatttgtgcccaggagctaaggctatcccatagatctctggactcaaatcct

SEQ ID NO: 3324 - DNA, 1400 bp, mus musculus
tgtttcagaaacaacttttagattttacattttctttgatttacgtattgatttcatcagtcatatcttctacatctgagattctctcttccacctcatgtattttgctggtgatgctcacatctttagttcctgttctcttccctgggttttccatctccatgattgtggttttgttgttgatgttgttattgttgttttggtttgggtttgcttgtttgttatttcttctgcttttatttctatttttatgttttgaacagttgtactcatttcttcatatgtttgactgtattttcctgtatttcttcaagtaattcattcatttcatccttaaaggcctctataatctttttaagattggatttagggtgatcttctagtgctttggctgggttagaatatccagggcttactgtggtaggatagttggtctcttggaggtgccatagtgccccagctcttgttgtttgtggttttatgatatcctttagccatctgattgaccctggtgctggctggatcttcctggtaacagcagaactcctagtggagagagcagaagtttaggactgtcaaggatgttcaaggaatagcatgttcctcatgtctgttggctgtgccccagatggatcctgtctgaagggaattggcacagaatggtctaatcaggatggccccggggcccagcaagcttgatagtggatcagtgggcactgacagaggacagctctcctctgctaactgtgtcctaggtggacctggctagcagggaatagttgggatgggatctaatatgggtgttcctagggccagacaaccctggatattcctgggacccaaaaggtttcctatggaggaaaatcaatggagttggggatagaagcagagtgccgatcacctctgctgactctataccatatgtgtcaggaaggcatgctctacataattattactactttttggatactaaacatcttcccaatcatacctgttcccagagatagcatgctctcatcactttatatcattactcacagtaatagatcctattttacttacatagttaaacagtttctgctttttcacatttaaatttcaacacccatctatcataagtactccaagtaatctcaatttcatttgaacacagtaatagatattcatacgaattttcagcttttttgcaactattatttagccatgatttcaactaagatcaccttaatcacaaagaacaagaggagagtttttcttagtaatatcaccatcagcatatttgattatgaataacaatatatttaaagatagagctgacttcctgatttaatgcttgattcaatttcccctgtagacccaggagggagttatttaagagatcccaattaggaatgatttga

SEQ ID NO: 3325 - DNA, 1400 bp, mus musculus
tttatgaagcaattaaaataagtgtcatgtttgcacatttataggtgtgtataaagtagggttgcattatttatctttttggtcacacaacatataaaggatatgatatgtggtgtggtgaactctgcagcctggtctctagtcaagcacagacctggaaccccagagacctggttggcagtgacttcatgggagggtaggagttcagccacgcctactgggcccctgactcctgttgcagctaaagccccccacagcagagaggtgtgtggcagtgtaggcaatgccttaagctcctggtattctgtctggactccagccccacagttacctggcaacagccaggtatgctcctccacacagttgccttgctggcaacatcaaggtagtccagcccactataaaaggagctgcttgcccctcctcactctcttgttctcttactctcttgcttctctcttgccctcttgctccgcatcttccccttccttcccccactctccacatggctgccctctgcttctctactttctccctttctctgcctttctacaataaatgccttaataccatggactgcctcttctaatcaggatccacggtgctggagcaatggagcatgtttccctctaacaagtggcgcctctaacctcccaccaggaagcctccctgtgctccagccacagccacaaccaatccaatccagctgcagagcaagtcacttaagctgagcatactcaatcctccttgctcataacctgccagagctctcctttctaccctgagtgtcctggtatgtccacgtctgtgacatacagcaggcatctgagatgtcccagagtgagaacctgatgtccctggcttctgtgctgcccagagattccagaaccagctcttctgcggtgcccagtagtgtctgtgatgtctgagagtaggagcccgactttggcatgtctgaggggacttcaaacttcgtcttccctcctccagggggatcccgcagctccccacagtccaacgcctgtctggctgttccatcaggttcctcaaagtcagacttcccgcaacccacctcacaaagcagccctagccccaagaggacatgggtccccacttgttttgacccacatctgcagaccaacgtgggccgaaggtccctctcgcctctgtttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagacttgaagtttttat

SEQ ID NO: 3326 - DNA, 1000 bp, mus musculus
atttgaaaatatggttttatttaaaatgtgtttgatagagtttttgagctacaaaatcttaatatctgatttgaggtacatgtagttagattttgttgtaaaaactaatgacataaataaaaattatttgatttctttgagctgaaatgagtccataaattaattaagttgaagtactattttgaaagatagttatacttttgtttgctttcaaatttaccactgtattttaacattttatgaagccttttttcttggtgttgctttcatttttcatattcaacatgtgtaaattaccataaaataatagtgaaatcttttttggatacatatacacggtcattaaaaattatcagtacatcatactttcttttcaaaatgcctgagtatgtccaggtaagaggatatgtggtttacatatgaaacaagcacattagttgtctataggacattgacagaactacagaaaaacattcatctcctgtgggaactgggtgaggctgcagaggccaagatgtttactgccttgcccaagcatgcttggtgaggctccatgcgtgggctgcctaccagactggactgttccttgtgatctggaactgtcagcctatcagtgaccaacctgagctcttgcctggagagtgtgtgaattctgattggatgaggtggggtggagctagatgaggtcagtcaggtgagtttaggagttgtttttgttgtttagcccttgccctgagtagaagctagttgtagtaagagaaactgttgtaaggggagttctaagaaaagttgcaggaaggagaacaagtaaagaagctgttgcatgaaccggacttggtgtccctgtcgttcgtgtctcctctggctcgaaggacctgtgacaatctcccacttgcaaaatacatatgatcccggaaatgaaacaactggaacttgctgtgccttgcctgggaatgttatatgaggtctgattgactacagttcagcaaggcttctgcta

SEQ ID NO: 3327 - DNA, 1200 bp, mus musculus
ttggtataaaagaactttatatgagtaaagttagaattacttaacaaatcctgaagtcgccaacctcatgagacatactaaaaagtaaatatctcagtactaactctgtcatattaaactattggttcactcacaatggccattttggccacagagtaaacttatatagtcagaactggtgaaatgtagatgatgtaaataattactcatgtaaaatcaagttctcagacacttgcccaacatcagaggaccacagagtgtgcagagaaatatcctatgttccctgaacaaatttttttttgttattaggggagcccagttgttattcccctctgcttctcccccctgacagttcctcatcccattactcctccccaatctccaagaggatgtcccacaccctagaccccctagacctcagcaggactccccattccctggggcctcaagtctctgaaagaatatgtgcatcttctctcactgaagccagatcaggcagtcctctgctgtacatatgtaagaagtttcagatcagctagcatatgctgcaaggttggtggctcagtgtctgagagatcccaagggtccggattgccctccttctcaacttcttccagcctttccctaattcaaccacaagggtccctgacttcagttcattgctcagctgtttaagtatctgcttctgacacagtcagctgtttgttgggcctctcaaaggaatgccatactaggcacaccataacatcagtagtagtgtcaggccttagagcaccagttgaaccagtcactgaacctcctttccctcagtctcttctcagattttgtcctgaagttctaaaagaacttcagagaactagagaggaacaattctgggtcagagtttttttgactgtggtatgcaaaccctatcccttcacttgaagccctgtctttttgctggagatggactctacaagtcacctctccccactgttgagcatttcatctaaggaccttttgagtccttttaacatgaagcagttttgtattttgtcaaatgttttttcagcatctaataagatgatcatatgattttttctttgagtttgtttatatagtggatcatgttaatggattttcatatattgagacaaccttacatatccaggataaagcctacttgatcatggtgaataatcgttttgttgtgctcttgaa

SEQ ID NO: 3328 - DNA, 1200 bp, mus musculus
agtactggtatgcttttctatatctggcattcagaatctgataaggactatttgctaagtttagtaaaaccatggcttcaattttattttctaaaagtttaaatttttcatttccactgctgttatctttgatttttttcttctgattacatacttgtcactcttgtttcttctatatcaacatttctcttaaagttagtgagagagtagttctttgcagctacacaggcatagccaaaatatccaacataggagcgatacaacctgtagagaccacctgcagtagaaaggcatggcccctgctgaggcctggccagatagtttcagcacagaattctactagacttttaaaaagagctaatatcaaaactcacttaagtcaaaatttttaacccagaaatgtttccaaaggaaagacagggacaaaggacaacagagaccaccccacctagagatccaacccatctgcggacaccaaatcccacactgttgctaatgccaagaagcacttactgacagaagcctgacatagctgttccctgggaggttctaggagcacctgaccaatacagatacctatactcaaagccaaccatcagactgagcccaccgaccccaatgggaaagctaggggaaggactgaaggagctaaaggggatttcatctccatatgaagaacaatatcaactaattggaccacccagagcttctggggactaaaccatcaacctaagagtgtacaaggagggagccaggactccagacacatatgtagcagaagaagaccttatcttgacatcaatgggaggggagggaagcttgatacactagcgtagggggatgctagacagatgaggtgggagtggggggatgggtggaatacaccagcgtagggggatgctagacagatgaggtgggagtggggggatgggtggaggagcatcctcacagaggcaaagaagagggggaagagagggttggaatggtgggaggttgtggaggggtaaccaggaagggggatatcattttaaatgtaagcaaataaaattattaataaaaatcaaacaataaaaaacaactccccatatttagaaaatctgaatgaaaaggatgattttcttgagagatatcacttaataaagtgaaatcaagatcaggcaaacaatgtaaacagacccataactcctaaagatacagata

SEQ ID NO: 3329 - DNA, 1400 bp, mus musculus
acaggaagcagaaaaaaaaaacaaattttatattatatagagagagactaactgtcattaacaaaaagttattatgtcattgctgaagatgtcacatacttgaatcagagaacttggagaaatcatgctggtactgaactgaaagcattatccttgccagctagctttcattgcttgaacggtctatgcatactaccagagaaggaaaggaataataagtcttacccaaaaacaaccactgagcagtaaaataataacaggcctggaaaggtgtctactgattccatactaacattgctatctgggagtaacaaacaactatctgatttggtgtactgtttataccacaagatgaaacacatatttggaaccattatagggctaagaaactgtagacaaaagacccaagaataaaagacactactgttcttctaaatgggcaaagaattaatcaaactcctaattacttatcttcattcccatagatcagtaaatatttcaacccccaaaagagaggctcctactttcagcaaatagtgataaactgaaacaaacaactggtcaaagttcagagagtaagaggcagaagaatgcttagtggtaagtggaaaatatataccacatcccctctgccaaaacctcagcaaataggaggtagaaagagtgaaagaaaccagaactggttgatgactatgagaaaatagtgtcctctggaaacagcagggaaactgtataagtgatttcatagttcttgtgacagcaggcacaagacctgtgcaaaccaagtcagaactcatcactaatcccaacatggagaagggagttgagaattaagtcctaccccttgtaaaggagctgtggtcaattgtcagctactgagaggggaagggtcaattttctttaagaatgtagcacctaataaattgccaatactggagtcaaacccctcacatccaaaattatttgaacatcacaagagaaagatgaagagaggagacatgttgagtggttagcgaggcaaaggatggtaaatctatgaggacttggagaagaggtgaaaataatcaaagtgcatcccatgaaattcttgcagaatttaaaaaaataattggctgattttatatgaaaaaggtagatccaacatttacttccactcactgagactgaaagataactcctgtattctccatattcaccttaattctcaaggtaatattcaatctgtctgctgtcacgttggaagtcttcattaatattattgagcatgtaatttacttattaatgtcacaagttccattctaaaattttgactgagaagggaaatcagatggaaaagaaatcaaaaagtcttctcaaggataaaagaacttctggcggaatcaccatgccagacctaaagc

SEQ ID NO: 3330 - DNA, 1200 bp, mus musculus
acaaaatctgaaatgataaaagagaaataacaagagaaactggagaaattaagaaaaacaaaaacaaacaaacaaataaataacaacaacaacaaacccttaggcttactttaaaagcctaaagtggacaaaactggaaaatctaaacataatagttgactttctagacagatacattgtacccaaagttaaagcaagatcgggtaaaccatcctagcagtctcataaccctaagaaaatatgagtggtcaccagcttgtctgctcctctaaagaccccacattctgaaggcctcccaggagctctgctacatgaagaacaacaaggaagaggccctctcaaacaaccgcaaaatctgggaaccccaaggagcccagcctacttgggacccagcatttcccttctagcctgagccttcagtccagcagatcatcagctttactgtaccccacagattgaagactacacaggagaacagttacatgcagggcaacagcttgactgctccttggaagacacaacagcctgaaggcctcccaagagatatactatacacagtgcaacagatcatcagcctgtctgtcctctgaagacttcacaatatgaaggtctcccaggagatctgttccacccagggaaatagatcagctgttgtctgcccctctgaagactctacagtctgaaggcctcacatgaaatctgctacaaccagggccacaggtatcccaggagacctgcagcatcccagggaaacaagacaaaggctccagacagagacacccaggccagcttagagtagagatagctagatggcaagaggcaaatgcaagaccataagcaaaagaagctgatacacttcagcatcatcagaacctagttctcccaccacagcaagccctggacacatcaacacacttaaaattcaggatgctgatctaaaatcctatctcatgaagattatagagtcctttaaggaggatataaataactcactgaaataaatataggaaaacacacataaaccagtagaagcccctaaaaaggaagcaaataaatcccttaaagaaatacaggaaagcataaacaggttaaggaattgaacaaagcagtctaagacctaaaagtagaagtagaaacaataaagaaaacacaatctgaggaaaccttagaaatggaaaacctaggaaagggaccaggaat

SEQ ID NO: 3331 - DNA, 1000 bp, mus musculus
tcctcatcctaccttcagacagtcccttcccccagctgttttccccttttcctctgagaatcagaagccctcccgctgtgtaccaaaccacccttttacatcaagtcactgcaggactaggtgtattctctccagtgaagccagacaaaggagatcagttaagggacagggatccacaggaaggcaacagatttagggacaggcccactctagtttggaggatctgtatgaagattgagtttcacagctgctgtatatgtgcagggggcatagacctattaattttcattttaagctatataatatataaataatcttctactttagacagcaaaaatccataccttaaacccttatataaatactttctcaaatacaaatgcttttggtatgtttctagtataagagcaatggatgtgcaacaccttttcattttataacaaagagattccaccctgtacacaatattcttcatttacattttctgatacgttttaaatgtcttagagatcttcctccattaatatataatttctctttctctccctccttggtccctctcttcttacttttctgttcacagttatatgtcattaatatgaattttaatttattcagtctcataagcaaatattaatttgtttttacaagctactgtacaaaatatgtaacttcttaatcatatggacacatgtatttgttcaataaattattaatataattgcattaaataatatattatatatatatatatagttgctagcattggactatttctagagaagtctgaaactaaacttattgattttcttcttgaatattaaactctctgtatgttatttttgcctgtctggagaagcacagaagtgttctgatatggttatattcaataacttttctcaggaactatgtattataatagatttgtattagtaactgccaggttgtgaacaataaaaactatctaccagcaacataacagtttccttacatcagtact

SEQ ID NO: 3332 - DNA, 1000 bp, mus musculus
tcctcttcacggacgtcctggtgctaaaggcaaagtcgaggattccatttcagccctcctccaagttcagccagcccaagatttatctgctgcgcatggacaagagcacagaggggaagagtgtggccccgcccatcagatggcggtgctgcacagaatctaaccttgctgtaaggaaagccatgcagagctgggatggtgccacagcgtgcgttgctggacacaagaaagtcagtctccagagcagtttggaaagagaagggatgggtgaggtgtcagaagggcaaagtctactctaaatcctgcaaagggttcagacagaacttggggtatgggactcgtgcactgagtattccaaaccactatgaaggactttatgctttgcaaagccttcaggcctgaggttaaacctcttactagcacgtgcaggccttgtatttgatcccagcaaccaaatagaaaggaactagctgttaaaagtctcagaggttaagagcactggctgctctcatgggggatttggttgcccacacccacacggtggctcacagccgcctggaacttcagttctagggcatccgatgcctcttctgcaagtaccagaaatgcgcgtggtacacatgcacacaggcaggcaagacactgccgcacttaaaagtaagtaaaccttaaaaatagtagagtgtgtctgtccatccatccgtctgtgtgtacatcatacatgtgtatgtggtctgaggacctgggtgtgtgtcctcaacttccactttgagtcagtctttgttttcttcttctatgtatactgggctcgctggcttataaacttccagagattctcctgtctccatctcccctccccacgtaggtgtgctgggcttgaagacatctctgccatggacatggcctttacgtggattttgggaattcagtctcatgccctcatacttgcatgacaggtgctatattgagccacctatgtcctcagtacccaagtcacctt

SEQ ID NO: 3333 - DNA, 1200 bp, mus musculus
actactatggctctgtactacaatttgaggttgggggtggttatatatctagcagttcttttgttattcaagatctttccactatcttgtttttgcatatgtttccatatgaagctgaaaattgcccttccaagttcttgttgggagctattaagacaacacaattgtcctgatctctgaattgggcctctcccccctcccccgagaagaaaagggggtcaaaggcgggccacctacgcacctgctccgagaacaaccacagattgttctagccctaagtcagggctggatgtcctgactacaagatgtacccagataccaccaagttcctgcttccttgtgtagtcgccaaaagaaaaatttccgctgccccatccttcctgctgagaagtacttcctctttttctgatgtcccattcctcctgctgagaagtacttccccttttgcttgtgcatttaagccttgaattaatacaagtgaatacttgctgaatacagtgacaccttgatgctaatcagactgcttccgtgtgttcttgcacttggtgtctgtctctccctccccccatttggttcttaggagaaggtcccctcgagaccctcgaataactggacctgctggacgggtcaagttctgtgaagaattggggggaaattttaatggggattgaattgactttatagattgattatggtagaatggccatttttaacacattcatccggtcaagccaagagcacaggggcagggggagattgttttccgtcctctgaagtcttcttcattgtctcaaatttttatcatgcaatctttcacttgcttggttagagttacctcaagctattttaataaaaagttttgaggctattgtgaaaggtatgtttccctgatttctttctcagctcctccgtcatttgtgtataggaaggctactgattttttgtgtgttctgtttgaatcctggtactctactgaaagtgtttattagctgtacaagtttcctggtggagattttagaataatttgtatatacactcctgtcatctactaacagggatacattgacttcttccttttctgtttgtatccccttaaactcctttggttgttgtattgttgtaactaagacttcaagtcttatattgaagaggcatggaaagagtggaaaatcttgtcttgttcctgattttgatggaaat

SEQ ID NO: 3334 - DNA, 1600 bp, mus musculus
ctgtaagccagggtgaccttggacgcagaaatctgcccaaggttaaaggtgtgtgccacaactgccccagctctactctaattctctctctctcttttttctgtctgtctgtctgtatgtatggaagtaatattaatccattaatatctctttttcctaaaattcatgtcacttctccttactttttctctctcactcactccatgtttgtgtgcatgtgtgtgtgtgtgtgtgtgttagtctagggtacacagatcaaagaaatcatatttcccagggattcttagaaataaacaaggaattctaaccatcatcaccatcaccaccaataaaaaggctgtggaaactgtttcatgtccctctcccccacaggtgaggatgtagctgcttaatactccatgtgtgtatgtgtttccatggccagctagtaccaaccccagatttgtgtttcagagatctttacttatttatttctcatgcctggtcttgagtgggtggtaggccaccacacttccagaaaaacaacataaaatcaactaacaaaccaacccgaaaatgtaaaagaatggattcatctggcatttaaaagtaatagactgccgggcagtggtggggcatgcctttagtcctactactttgtaggcagaggcagacagatttctgcgttccaggccagcctggtctacagagtaagttccaggacagccagggctacgcagagaaacattgtcttgatctcagcactggggagaggcagaggcagaacttacttgagaggccggcctggtctgtcttgtatgtttttgcaccatgtacagagactttgcatctcataaatgaatgaatacagagaaagatattcatccatctatacatgcatgtgcgatggctcagagggcaaagctgctagctgttaaggtacaggtaaactattaaggcctagatcgaatgtgaaggcctacttcagattagataaggcctaggtaacctcttacctggctagcctgccattttgtgctgttaactactattataaggacactttctcataccttgtttctgcttttactgcccgaattgattacatattcttattggttgtgtcctcggaaaccaatcatgaaagaagccaatcgaactgcttcctttgttctatagtaatctgcaataggcttggacccaaactgaccacctagcagcatttcctgtactcacccatgtatacacttttatggcatttgctcttagaagctgccctggggctggacccccccacccccaacacaagagagacacccacaccaccgattcagtgcacagactactatgattggagctttttattactgttgattgttgagtatgtctctgaataaatgaaatatagtaggttaggtcaagcaccccgagcactggctactcttccagaggacccaggtttgattacccagcacccacattaaagctaaccagcatctggaactccagatttcaataggaaactcctttacaataggaaaacactgcctattggtttatttgttcaaatgtacaataggctatttataaataaatggatctccagtgaagtatgttaaaa

SEQ ID NO: 3335 - DNA, 1400 bp, mus musculus
cccgggcagtttcactttgtgatttctttattgtttctacctacatttttagatattgaatggttttgtttaattcctttcacctgtttggttgtgttttcttgttattctttaagggatttttgtgtttcctctttaagggcttctagctgtttacctgtgttctcctgtattcctttaagggagttatttatgtccttcttaaagtcccctatcatcatcatgagaagtgattttaaacctgaatcttgcttttctgatgtgatggtgtatccaggacttgctatgatgggagaactgggttctgatgatgccaagcaaccttggtttctgttgcttatgttcttgcacttgcctcttgccatctgattatctctagtgctatctgcattcactgtctctcactggagcctgtcccttctgttaacttggttgtgtcagaactcctcagagtccagctgtctctgtgatcctgaaatcctggtgtgatcaagctcctgagatcctatgatcctatgatactgggcatgttagagttcctgggagttgagcttcctctgggtgatgtggggcttggtgcagagctggtgcccaaggttctcagggcagtggatcagaccagaaggaacccgtgcaactccccactccttcttttgatctgtttttatcttgttttaaggcttcatactatccaaacactagaatctgaaacaatcccttctctccttttctaccaagtgaagggattaaaggtgacaccaggctcagcttcaatgcttatgtggctcatcaacaaccagcctgctcaggtcccttccctgcccacctagcctttcccactttcccatccacagaatgccttttaccccatcgggggcaatatgcggtcatgtctggggagacctcatctaatcaggggatggaaagccttgttctctatggatgactctggcaatggtactgcctttggatctatgggatcttctgcccttgctttcaagaccatgtcatccacctcctggatagatggcatcagataatggtattcattaccaggaaggagtgggttcttttgttttataaaagatggccctttccccctatattttcagctagatttaagaccctaaaacacaaataatatctgatacactttatacttcagcacttgataaaagtcactaaaagtacttttgagataagtccttcaggtaacatgatgtgcatctgaggggttctactaaccagagactgtcgatgattgaacagaaaataggatgcagaactggtggacatcttttttttttttcctttcaattttttattaggtatttagctcatttacatttccaatgctataccaaaagtcccccatacccacccacccccactcccctacc

SEQ ID NO: 3336 - DNA, 1400 bp, mus musculus; identical to SEQ ID NO: 3335

SEQ ID NO: 3337 - DNA, 1400 bp, mus musculus; identical to SEQ ID NO: 3335

SEQ ID NO: 3338 - DNA, 1400 bp, mus musculus; identical to SEQ ID NO: 3335

SEQ ID NO: 3339 - DNA, 1600 bp, mus musculus
ctcatctagtgacgagtatctcctagagacctccgctaattgatcttttttcttttcttttttcttttccttccttctaatctctccccaggtattcttacctgacattaacttttcctcgggttcaagacccttggaaaggcctgtatacttagtttgtgtaccatatttcctctttgctcctactctctctccccgctttacttctgatagattgccctgaatttcatccagaattttcagccctatcttaaccacttgataacatgtgaaaaagaacaaaaaggctcctaacactaaaaaaaattcaaggccaaacataccttgtaaagctatttcccactttacttctgatagactgtcttgaatttcgttagaaagttcaagaccagacttaccttgtaaagctatttcccactttacttctgatagactgtcctgaatttcgttagaaagttcaagaccagacttaccttgtaaagctgtactcactggtacccctgttccccagctgaagagttctgaattcatgcagttgaatccttctcaacagtctgtgttgcgggaacactttattaccaccattccccagctgaagagttctgaattcatgtagttgaatccttctcaacagtctgttttacgggaacacttcattaccataacccgcagttctggttccggaatgagggatcttccttgcgccggtgatggtaaccgtcctgggttttctcgtcccaggttttctcgtcccgggttttcggcaccaactcttacacgcgttcacgaccggccaggaaagacgcagcaaaccagaatcttctgcggcaaaactttattgcttacatcttcaggagcaagagtgcaagccccaagcccaaaaacgaaagcgaaaccccgtccctcttaaggagagttatccttcgcctaggacgtatcactccctgattggctgcagcccatggccgagttgtaaggcagagcacatggggtggagaactactcttggcacatgcgcagattatttgtttaccacttagaacacagctgtcagcgccatcttgtaacggcgaatgtgggggcggcttcccacatcaggagatagtgttgtcatttccagtttaaaattcaagcttctggagggcatcatcctgagtgaggtaacacattcacaaagaaactcacacaatatgtactcactgataagtggatattagccccaaacctaggatacccaagatataagatataatttgctaaacacatgaaactcaagaagaatgaagactgaagtgtggacactatgcccctccttagatttgggaacaaaacacccatggaaggagttacagagacaaagtttggagctgagatgaaaggatggaccatgtagagactgccatatccagggatccaccccataatcagcatccaaacgctgacaccattgcatacactagcaagattttattgaaaggacccagatgtagctgtctcttgtgagactatgccggggcctagcaaacacagaagtggatgctcacagtcagctaatggatggatcatagggctcccaatggaggagctagagaaagtagcc

SEQ ID NO: 3340 - DNA, 1400 bp, mus musculus
attatttcaaagaatataaagagatgggccacagtgtgcttatatgtaaatgcaatgattctgcttttagtttaatcaagtgcatattttctagaaagaacatgaactacattattgacaattgattcaaaaatacatcctggtgttgcatctttgcatgtttaaaatgaagattctgtattatttctaacacaaataacagctgtgtcctgctctaggggtatctgtggccactctctgactccctgctgcctcaggacaaggcacctgacacttcttagaatcttctcccttagaacagaacttctgttccaaagaacacaagtaggagttcaaaaaatatgccactgaacatcatctgtcttctataattacactataaaatgaaaccaacatcaaacggagtttggctgcccgtacgtaaaagtaatgataaagcctgtgagaccatgcagcaaacagcctaaccacagacccagtcttctggttggctgaggagggcagggggtcaaagagtggaggttggggctgctgaggggagcccggagggaagacagggcttaggtctcagctctgcgtctaaggctccaactccagtcctgatactttgatcttcttccaacaccctctgttttcccaggatttaaagctgaaggaggtagaagccaatgaggaggaaggtgaatcgtcacctgggggtaataatttaatcccattattggggacttgaggtccactttcatgaggacttcagggaagcatcaggatgagaggaaagtctcaccaacccagggctatgcctacactggcaaagtagggagctttcctgggaccgggggactcacatgatggagagaatgagctaccatcttcatacgtcagtcaggaaatgcagggggcatgccttcaggtctaactgtgtcttttgctttgtaaaatattgcaaatcttcatataaactgcaattcttttaagaacttgctcattgaggattatatatggtcctgagacaagctaaatatcaattcttttaagaacttgctcattgagaattttatatggtcctgagacaagctaaatatatgtcacattcaataacactttcttaaaatagtatgttttctcattatccccttcttactgtggaactcactctaaagtttaaagcaaaattgcataaacacaatgtgtattttgtgtttaagaaacaccaatctgggtacggtggatgacacctgtaatcggagccttcaggagggagaggcagaaaagtactacatgttttatataacagaatatttaaatgttagaatatgatattttaaggtggaagaacattttaatttacctcctgataatattaatatggttctaatgcattttaaagtgtcatttagctt

SEQ ID NO: 3341 - DNA, 1200 bp, mus musculus
tatataatatactaataaaagtttttaaagtatttgttttgtggaacaaagtgaaataagaataaaaacaatcagataatttcagaagcaaaaattcaaatgaattccagttaaggataaaagcaggaagttagaaaagaatgagttaattaagagcaacatgcggatggatgtgtctcacctgacagaatgcccagcttgaacgatgtcctggctcagttcccagcacagcatgaactgggcattgtggcatatgcactggggaggtggggggcaagaggatccattccgagatgctccctgctatcaactctgataagacaacttggatttcaccaaaaataaaccccaaaaacttcaaaaactcccaggaatttatgagggtgaccctagctaagactcttagaagtgaggactatggagcctcaaccacccatctcctgtaaccagtcaaaacttccagtggagggacagtgacccagtcacaaaagcttagacccacaatttgtcctgcctacaagatgtgcaggggtaaaagaaggagcagaatttgaaggataggcaaacagatgcctggcccagcttgagacctatgccatgagagggaacccacccttgacactattcataatatgctgctatacttacagacaggagcctagcataactgtcttcagtgaggtgtcacccagcaactgatggaagcagttgcagaaacccacagccaaacattaggcagagattggaaaatcctgtggaagagggaaaagaattaaaggagccagaagtgtcaagaatacaacaagaaaacctacagagtcaactaacctggacccatagggaccaacaaagactgaactgtcagccagagagcattcatgagatgcacttaggccctctgcacatctgtaacagctgtgaagctgggtcttcatgtggtactctaaagcagaaacaggggctgtctctgactacatggcctttggtttcctctcccctaactcggttgccttgtctaatctcaatagaagaagatgcacttagtcttacaatttgataggccaaggctggttgatatccatgggaggcttccccttttctgggaagaaggagaggagtgaatgggagagaggatgaaattaattaattaattaatgaaaatcagaaagtgagagagaggaagggagggagggagggaag

SEQ ID NO: 3342 - DNA, 1000 bp, mus musculus
tgaaagaagtcaacaaagcaggggaaaaaatcaagaaaacaaagcaacaaacaaaacagagagaagactacagtgttctaaaagacagtggaaaaaagtactccactgaagtaggaacaatcaactgcccagtgcagtttctcaggagtcgagaaagttgagaagcaatgattgaccgtgcggttctgccccatataaatcaccaggggccacaggagaaggtgtaaagaatttctgagaaggcactatgctgaagtaactccaagtcgcgagaggcagaacaaaaacagagcacagggcctaggcaagagcgatctgattgtttcatattagatatgcagctgtgtggatacgggatgagccaaggagtcagaagagggaagaatgggcagaagaagtatgagactcacgaacaggacgagcctcggtgctcaaaatatgtccagatggaaagaaacatatcaactgaacactaaagaactagcaattagaaactgaatagtaaagaattatatatgttaactatttacctgtacaagggcagggatgtgcacatgccatggtgcatgtggaggtcagaggccaactcgcagaggtcagttccctccttcgagcacgtgagtcccgggcacggaactctggccattggccttagtggaatgatcgagccttcctgccagccttcattttgttttttaaatagttataaagaaaaaaaatcctacagaaataataaagcattgtgctatgtagggtctgtgtggtgttctgtataatgctgtgcagaggaccagagctcccagtggtcacagtcagctcttaacaagcatgtgagctccaggggcacaaagccatagtcgagagctgaagccacgtgtggggatctgaacaggcacaaactctcacgaggcagagcagtttcccataatcgtcctaaacagtctttagagcagattctatggacccctcaggactgggaccctaataaagtccatgccta

SEQ ID NO: 3343 - DNA, 1200 bp, mus musculus
tagaatatttacatggacataataagagattttagaaatgagctataaaatctaagtacaaaatttaattgtttcacatatacattatgcatatagcttaaaggtaattttaggaaatctttttagtaagcctgcatgtaatttttaaaatttatttatttatttagacacatgtgtgtgcgtgcgtgtgtatgcctagggcctgtgcatgccacggcacacaggtgagtcagaggacaacttgtcgttggctctccttctagagttcagttcagattgtcaggcttccccattgagccacctcagtgacaagtgtccctgtgctttcactatgtacctattcatgacatcgggcaggacatttttttacatttggcatcatgtttacaatcaaagtgtttggattttgtagtgtttggaatctggattgttccacctctaatcccctttccttttgcaactaactttcttttaaaattgatttttccattcattaatttacgtattcattttacatcctgatcgctggaccccaggggacacccccgacccccacgccagccacatcaagtctctgcagggataggcgcatcctctcccactgagtctagacagaggcagccccgttaggagaatgggttccatagacaggcaacagctttagggacagcccatgctaccattgttgggggaacccacatgaagaccgaggtgtatatctgctgcacatgtgccgggggcctcggttcagctcatgtgtgctctttggttggtggtttgtttctatttttagaaatactgggactccaaaagtggttttgccctgaaaagctccagcccagcagaccttttgtctggaaacctttgagttcttccctacattagcatttaaagccattaataaatgagactgaggtagagggagggagggaaggagagagggagagagagaaggagagggtgggggagagggagagggagagagagactgaggacttcaaccactgctagaatgtaaccagtatccagcagttttggtaacataatttatacaaaagtaacaataacaactactattggataacaagaattaacctccatagagggtggcttccaagtgccaggggaaccagaaatagccagctagcagcctcatctcagaacgtggagaaactgaggggcctgcatcatgcttctaga

SEQ ID NO: 3344 - DNA, 1000 bp, mus musculus
cctcaaaggatcaataaaaatagtttttaaactataggtcatcttgttgttctggggggaagtgcgttctggtctagtgaagagacgtccatttttgcctctgaacacatgagtgcacaaaagggaagcgagtatttggacttttctctttggcatcacagcaggcttttctgtaaaaaggactccagtccccagaagtgagcagatctgctgtcacatctgaaaatagatggctgacattatttaccccctggagtacccacagttctggtattataattttctcatgtccaactgttgacgcagtccagatacaggtaggagagagagtatttctcctgggggaatctcagtgagaagggcagttctggtttctatggtgacttgccctatggggtagagtgtctgctcttggcggtgggagtatactcttctcacttcatacaccagtcttaatcagtggccgaggtgcttcctggaactctctctcttgcctgtgtgtgaatcatctgccggctcatgccctgagcgtgaactctcttccctttggttcctgtcctgccttgtgatctgggaaactcccctgcctggatccagtcgaagtgcacagaagtgcacagcccgctggtcccttctctccttttgtggccaccgggtccacactgttcttactacttcagatgacagcagcctccacattgtcctctctgccccctttcttgccctcttatcttctccacagtgacaacaaggcagatttttaatgcatgagcacacgtcacacccagatttcaattcatctgtgactctcttggcccttgcaaggaagtgtgagccttgtgctgttcacacccgcatccaacctgcctcccccactgcccacctcaggttcttcctgaggcttcttgggctgaccctttcacacctcagggccttggaacccgcttcccacctgtgcctgcagaaaggtaacactgagttctccgtaaacaggctcagt

SEQ ID NO: 3345 - DNA, 1000 bp, mus musculus
atatctaatttgatataatgcaaacctccacggtgatttaattagaataatttcagtagaccaagtagttcaatccttgtgacccatctgctaactcacctttctcactgtgagttccagggacactgttgcataaactgttgcactgttgtctgtggtactgagttcaatttacaaacacagcagtttctttgtccagccttcatgttatcagactctggaatatgcatatcatattttgattaattggaagtttctttgcgcacacaaacaccaagttaagaagtgaaattgcaaatgtttgtcttccagaagtgcagacacacctgtaaacacaggtaagaccaccacttctactcttagaaacccactgggagacctcaagatgcaggaaccaaggagcatcctgggacaggatccttccagtttgcatctgtgccagaagctgacactgtgctacagcactccataatcaaataccaccaggagagagctggtctcccaggagtaccaacacacccgtgagcacaggtaagaccatgacttctgctcaaattcctggcccaagaaggacctacccagagccatcagaacacaggagccaaggaagagctaaggacagggtccttcctgtttatgtctgcatcctggagctgaccctgtgctacagctttccatacccaaatcctgccagaagagaactggtctcccaggagtactgacacacaggtttggagtagggacaaaccactgtcagagacagcaagaccacctaacaccagaggtaaccacatggctagaggcaagggcaggaacataagcaacaaaaaccaaggttattccacatcatcagaaaccaattctctcgccaaagtgagccctggactcaccaagactatccaggagcttaaaaatggaaatagaaacaataaagaaatcacaaaaggagacaacccttgagatagaaaacctagaaatgagatcaggagtcatcaccaac

SEQ ID NO: 3346 - DNA, 1000 bp, mus musculus
atccatggaaagattcctggacctagttttgaggttgtctgcgacctcagtgatgctgtctatactgggctcgtcaatgacacagttattaagcttgatcacaggtagcgtgaaagcactgatggatgacgacacaatcgatttggtgtcacacttcttggagctgctggccttgtcatcggtggccttggctggaggtggataaaggccaaagacagagactgcactgtcagatagcaacgggggcatgaggtgccccaggctcttactttcagtcaacatcagttcatcctcctccacagagctgtccacccgaaagctgttccgcatccctgagaaggaggccaaggtggtggcagccagcctggatgcacaggggctgccgttctgcttcacttctgtgtctcccagcaagcctgcgtataggccatttgcctgcttctgctccttgagtctcagagtgtggatgtcgatgactgtggagtagatatccctcatgtggatgattttggtttctttgtcgcggttctcatgaagaatggcattggcgcagatgaaaatgaagatgccgatgcccatggtgaacgggccaagcatcttcatcttatcggaatgtagatgctgctcaaagaagcgcaccaccacaccgccctggttccgaaccacttgggtctcattggtggacagcgtggtctctgcgtcaatgaagtgctccttctggggccaatatccaaggactgccatggcgattcctatgatggacaccagcactcccagaatgaggaaaaagccagatggagaataaagtcggattttcccacggaccaccacaacatctgctcgtgggcgccgtctgacgggtttctgatcctgggtagcaggcagtgggctgaggttaatgtgttgctgagacctggcagagtcctgccgcttcaaggccgccaggccggtgatgaccccaccagtggctatcatagtttcctcttgtgctctgaaaaga

SEQ ID NO: 3347 - DNA, 1200 bp, mus musculus
agataagtttaagacttgacaacatggactaaaaaaaaaaatattaaaactaaaggtttaagatcttttaggtcgacaaagctacatatacaaatactgccaggagagagctggtctcccaggagtgcaaacaagcctgtaagcacaggtcagaccacaactgctgctcagaagaacctgtctgttactctcaggacacaggaacaaaggggcggtctgggagaggagccttctggatttccatttactcctagagccaatcatttgccacagggctctatacacaaatatagctgggagagagctagcctcctaagagtgcagacaagcctgcgagcgcagttaagaccaccactgctgctcagaggaacctacccggaaccctcaggacacaggaaccatgatgctgcctaggacaagatacacaaatgccaacaggagagagctagtctcccaggagtacagactagtctgtgagtgcaggtaggaccaccacatgtcttcaaattcctggcccaagagggacctcacagagccatcaggacacaggaaccaaggatcagttggaaacaggatccttccggtttctctctgcactcaagagttgactgtgtaccacagctctccatatacaaattcttccctgagagaactggtctcccaggagtactgacacacaggcttgcaggaaggacaagtcacagtcagagaccagagataaccagatggtgagaggcaagggcaagaacataagcaacagaaaccaaggatacttggcatcatcagaacccagttctcccaccacaacgagccctgtttacacaccagaaaagtaagaaaagtgagactgactcaaaatcacatctgccaggcagtggtggcacacgcctttaatcccagcacttgggaggcagaggcaggcagatttctgagtttgaggccagcctggtctagagagtgagttccaggacagccaggagtacacagagaaaccatgtctcaaaaaacaaacaacaaaacaaaacaaaaacgaaaacaaaacaaaacaaaaaaccaaaatcacatcttatgatgttgatagaagaatttgagaaggacataaataacttccttttaaaaaaaaaaataccagagggcacaggtaatcaaataggagcacttaaagaggaaacacaaaaatcccttaaagaattataagaa

SEQ ID NO: 3348 - DNA, 1200 bp, mus musculus
aggttaggaaagttttcttctataattttgttgaagatatttactggctctttaagttgggaatctttactctcttctatatctattatccttagatttggtgttctcattgtgttctgcatttcctggatgttttgagttaggatctttttgcattttgagttttttttgactactgtttcaatgttatctatggtatcttctgcccctgagattctctcttttatctcttctatatatgcctcttggtctctttactaggttttctatctacagggtcattttactttgtgatttctttatttctatttcaatttttagatcctggatgcttttgttaaattcattcagctgtttgctttacctatgttctcctgtgtttctttaaggaagttatttatgtccttcttaaagttttcttttcatcatcatggcatgtgatttttgaccagaatcttgcttttctggtattttgaggtgtcatagtagtgggagaactgggttctgatgatgacaagtagccttggtttctgttgcttatgttcttgcccttgcctctctccatctggttatctctagtgctacctgcccttgctatctctgactgaagcctgtccttcctgtgatcctgattatgtgagaactcctcagagtccagctgtttctgtgatcctgtgattctggtttcctatgatcctgagatcctgagtgtgtcagattgtctgggatttaagatgcctcttggatcctgaaatcctaatgtgaccaagctcctgataacctgttgtgtcagagctcctgggagtcaatccttctttgggttttgcagggctgcatggggtgccagagtgctgggtttgctcatggcacagttacaagccagaaggaacccttgccttggcctgagtggggttcctatgtcccttgatctattccttctaatatcaagttttggtctgtatttcatctgttgccatttgcattccactgcttttctttatattcaaatatgttaatacctttgttttatctttgcttgtgatagaatcctatagcccatactgaattaaactcaaacctcctgcctcagtctcccaagaacgtagagtacaggtttaaggcttcacaatccctttattatttctactcatttgctttctgttggataggttgcttcggtactttgattgaaagccaatg

SEQ ID NO: 3349 - DNA, 1400 bp, mus musculus
aaacattgattacaattttgatttttgaattgctaaagcattaccatccacataggtatgtccctcaaccctgtcagtgtaattcctgtctcatgtgcctcttcaaccatcaataactgagtaaggtcgaggctacgtattcagctttcaaccacccagagactccattcactgaatcttactaggtttcctgcttattatctttcttcagctataaatcaccaacactctttccttaagtgacccattactctgttcctcttcaggggttgaggaagctggaattgtctggaaagaaagccaggaaggagagagttcacaaccagaggcacctggaacacatatttaaaacatgcttcccatgtccctgtcatatgtattaaataagcgagaggctatcattcccaaaaccttctttaggaagtgatttatgaggtttataagtgaatttgacttctcagtgatatctccattgacagcccctgtgaggagttctctggagcttgtagcagcacctattttctgcagatgcaacactcattgtaggagtgtgacgctctgcagcctgctggggaggcatgtctgcatatgggtgcccattagagctttctcctgtggctggactcacaacttaatgcaggctccctgtggcctgctgccttatagcctacaacttctattactgaattccagatcattctctctgactaaaggaaagcaaattcctgctgagtcctctcagcactgatgatacaaaattacctttttctaaaattaaactccaaaggctttttcctcaaagcctcccatggttttcagccgggataacaacacactggttatctccccatggtcatccctctccctccatgccaagccctaatacttgatgtgccagtgttatcacagctcacagtgagctactctgctcccttggaattcaatcccagtatgaagaactaatctctttcttggtagtagttgaaccttgttatcttgggaacttagtgcaaccctgaaattccgtcacagtgaagccacatggtaaatatttttgatctcttgaaactcatgtagagtgtgctgagaaaattcagagaaggtagtgagtgagtcggatgctgaagcaacaaagtccaagaaaacagtgggcatgatgcagccaacgggaaagatgtcagaaaaagaactctgcagtcatgatttcaacaggcagtagccagtactcattctgtgtgcatagaggccagactaaagatctagtctttacaagatcaatgtggaattgacctagttattttttaacctggtaatggtgtattatctacctgaaacaacattttagaatatcttgatgggtttggtgtgtctttaaatgtgtccaaaaagggacagggaaa

SEQ ID NO: 3350 - DNA, 1000 bp, mus musculus
ttttttacacaccatattttattcccctcacccctgttcaccctcctgttgcttcacatcccatagctcctccccatacccctgtctccacttggatgtccccatccctatgtcacctgacctctaaacgccctggggcctccaatctcttgagggttaggtgcatcatttctgaatgagcacagacctggcaatcctctgctgtatgtgtgttggtggtctcaaatcagctggtgtattctgcctgtttggtggaccagtgtttgagatggcacaggggtctagattaattgagactgctggtcctcctacaggattgcccctcttctcagattctttcagccttccctaatttaataactggggtcagctgcttctattcattggttgggtgcaatatctgcacctgactctttcagctgctccttgggtcttccagggtgcagtcatgctaggtccctttttgtgagcactccatagcctcagtaatagtggcaggctttgggacctccccttgagttggatcccactttgggcttgtcactggagcttcttttcctcaggttcctctccatttccatgcctgtaattctttagacaggaacaattatgggtcagagatgtgactgtgggatggcaaacccatccctcacttgatgccctgtcttcctgctgggggtgggcgggctctataagtttcctctccctactgtctggtatttcatctaagctcccttcctttcagtcctgagagtctcccacctcccatgtctctggtgcattctgaagggtccctgcaaactcctatttactgggttgcctgtttccattctttctgctggccctcagggcaccagtccttttccctcacacaataccagataaggttcccctctcagcccactcccttcctctgtccacttttggtctcaggtcccttccttcctccacacttggaattggtttcttctccttcccaagtggaattgaggtgtcctca

SEQ ID NO: 3351 - DNA, 1000 bp, mus musculus
tgcctggttcccattgcccagatttctgctgaccagaggcaagtatcatctgtatgtcacaaggcaatttatggtcaggggcaccaggtgttataaaaatcagagtcaggccaggcagttgtggggcagtgggcaaagttctagaaccctggggaacctgatgggtggtgatttccacttacatgggacagatcatgtctcctggaccccgggctcctgtcgaagttaccacccccacaaccctcacagaagaggtgtgtgactatcagtcacgcagacaatgtcccaaacttctggcattctgactagactccatccccacagttacctgactatagtcaggtatgatcctccccacagttacctgatagcccagcccacaataaaaggaactgcttggccccgccttgctctctttagctctcacctttcttactctcctctctagccctccttttctctctcccttccctcctctctccatgtggccatggccagcttttctctctctctttctacctcctctctttctccctgtctttctacaataaagctctaaaaccatagactgcctctgctcatcaaggcccgcaatgcttgaacgatgggacaggctttcccctaacgagccctgtttaacctcccgctggaaggcttttctgtgctccagccacggaccggaggaccggactggaccaaggactcttgcccatgtgtgaactacctagctcccccctttctccttaacctctcctccctttgacccgggctgaccaagccacccccagtgcccccattctgttctcagatcttccaccgtgtctgagatgcccaaggctgagaacccggtacctaagactgccccttgtccaccacctaccgagctggggtccagtggcttcctatggccagacaccacctgggctgcatggaaagcatgtggtagtcttccgaatctgcccacccagagcatgggatctctggcaggatgtgggttttc

SEQ ID NO: 3352 - DNA, 1200 bp, mus musculus
agttgtctctgtctgtgatttctttattgtttctacctccatttttagatcctggatggttttcttcaattccttctcctgtttggttgtgatttcctgtaattcttaacaggatttttgtgtttcttctttaagggcttctagctgtttacctgtgttctcctgtaattctttataggattcccctttaagggcttctacctgtttaactgtatttctttaaggaagttattaatgtcctctaccagcattatgagatatgattttaaatccaaatcttttatttccagtgtgttgggggtattcaggactcgctgtggtgggagtactgggttctgctgatgccaagtagtcttggtttatgttggtaagattcttgtgtttgcctttcgccatcttgcaatctctggtgttagatactcttgctgtcactgactggagcttgtttctcctgtgagtctgtaagcctctttcagcactcctaggagaccagctttctcctggcaagaccagtgcacagagggctgcggaacagccttgcctcctgagtgcagatgtaggcctgtaggacactttccccactgctctgctgcttctgcagcttttgaactcctgggtgaacctgccttagagagtcattggaaagaaatggagatctcacctgagtcccgttgtcagaggcaagctatcctctggcagggaaagtgcacagagggttgaggttcagcctcacctccttggtgcagatgtaggacgctgtcccagaagctctgctgcttctgagtcctgtgtcgtcctgagtagacaggccttagagaatcacttgagagaaaatagagatctcccctgagtcccgagggtcagagtgcttcctggagacaagctctcctctggcagggaaggtgcacagaggactgaggaccagctccatgtcctggctgcagatgtaggccagtagggccctgtcccagatgttctccatttgttctttttattgcatgatttttttcacttggtatgcgatcagcttctatgcacagatgtagaaatcatgtgtatctctcaaggcccaactcagagatatcattctacaaatatttatcttgtctgccacccctcacctctatgctacaggaacaatttctgtttccttaagtttcatctgtagtttgcttttattttcctcttgccattatcaca

SEQ ID NO: 3353 - DNA, 1800 bp, mus musculus
tctgccaggaatgaaaaattattaatcaggaaaacaccactgaactgtaatccaggacttagaaactggcttctgataccttcatggcaatagttttaaaaattcagaatgacatattgattgatatcagtggcaagcaataaaatgacattataagcagactccaatctccagcaatgaagtggaacacattcttgaaactgaatctgaagacccctgataaaatgatatgcaaatgctgcagattatcattttcagggtagtgataaaaatacactcagatccagcaatccctatgtctgcatttccaggaagcaaactgggtttactagacattaactaaaaccacttagaacaagtaactcagcctgagagataagtaacacatgacagttttcatacatcaaaatttcagttttcagacattataaatctctgggacattaagggtatattttatagtaacggaaaaatgaggcagattttccgaatggtagtttagcaagacacactacaatctttaaaaatacaagtgagctgttctggatgttccttggaggatcatcagggacactcagacctgaactagtcaagccagaaaagaactatgtagcaaaattattcagaatctttaacagtttggtaaaatagatcataaatttaatctgtatagctatttaaaatgttctagaaaacgaaattctcgtgtgagaaattgttcacaatacattatgtgataaagaaaagtttgcaaaatggtatatatataaggtgattcaaatttctagacatatctactcatagaaaagagtattaaagggctaaatctatcaacagccttttagtgactcctatatcactcaagatagtacacaccatcaaaatctcagtggcttaatacacgacagcttatttatttgctctctcatgatctgttgagggtacaggcatctttccagggcagctgtcttccatgtgggagaacagagcttcagggcaatgatcacgtgttagctcagaacaagtgctttcatgattgccaacacgagggagagagtgcatgtgaacacacacaggtaggtttcccttggattcgtatgtgacccactaacatctgtaaaaactgaaaaatctaagattctcagataagaaaccaaaattacctcacttcaaactggaatctcaaatcatttcatcatttcaaacttatattcaatagattgcattttattcacatacacatagcttatatggaatatgttatctgctaagacatagcttaatacaattgccatagctaaaatataaaatgtttatcaaagccttagaaaattctataacacctaatcaataagtaatagtgaaatgagatgtgctacaaagcttgtatttatttcagacttctttgggcatcttttgctttctccattataagtctcttaaattttaagtgcagtgaaatctaagattattttatagctggaaatcacattgtttattccaagtaatcaattctgatgtacccaagttggtgtcattacttacttatttattatttgtttatctgaattctgctaagggtgtatgtgttctttcaagcaatttatgttgtcttacatcagttgttaacaagctagctttcatccagtctttctgctcatattgaggacaaccttagctgtaggcatctatatcagaatcatggtttattctggtgtaaaaccaagctgattttcaccctgcatgaatgaacttatttctgtaataaaattggaggcctccatcttgtcccttaggaaa

SEQ ID NO: 3354 - DNA, 1000 bp, mus musculus
attcaaagtccaagatggcaaccttcaaggaccagctgattgtgaatcttcttaaggaagaacaggctccccagaacaagattacagttgttgggattggtgctgttggcatggcttgtgccatcagtatcttaacgaaggacttggcagatgagagaaagactgggggctcacccgctgagttgtcatggctgggtcctgggagaacatggcgactccagagtgcctgtgtggagtgacgtgaactttgccagcatctccccgaagtctctgaacccagaactgggcactgaagcagacaaggagcagtggaaggaggttcacaagcaagtggtggacagtgcctacgaggtgatcaagctgaaagccattagcctctctggcaaacttggccaagagcataatgaaggaccttaggagggtgcatcccatttccaccatgattaagggtctctatggaatcaatgatgatgtcttcctcagtgtcccacgtatcctgggacaaaatggaatctcggatgctgtgaaggtgacacattcctgaggaagacgcccacctgaagaagagtgcagataccctctggggaatcccgatggagctgcagttataaagtcttcccggtgccctagcacttcactgtccaggctgcaacagggtttctagggagaccacacccttctcatctgagctgtggctagtacagtggtgttgagggggtgtagggaaacatcccagctcccacagctctgccctgctgccaagtggtacttgtatagtgctaacctagttagtgtgacagtctcactgtctccaagacacactgccaactgtgcaggcttcgattaccctgtgaacctgctgcattgctgtcctgtgcaccctcaccaagcatgccaaggccaacgagttcccagttagtcataacctggctccagtgtgtaagtccattatgtataactttgcataaatattctacaggatattttatgtattatatgc

SEQ ID NO: 3355 - DNA, 1000 bp, mus musculus
gtttcccctccaaaaccaccctatcccactccctctatcccctattcctatgagggtactcccccactgacctacctactccttcctcacttagcattctcataggttggagcaccaagctttcacaggaccaaggcccttctcacccaattatgcaagataaggtcgtcttctattacatatgcaaagggaaacatgggtccctccatgtgtattctttggttggtggtttagtccctgggagctttgggggtctggttggttgatattgtggttcttcagatagggttgcaaaccccttcagctccttcagtccttcccctggaatagcctctcaggaaacatctatatcagactcctgtcagcaagcacttcttggcatcagcaataatgactggtttgggggctgcatatgggatggattcccaagtggggtagtctccgtatggactttccttcagtctctgctccactctttgtcccagtatttcctttagacaggagcaattatgggttaaaattttaagaagggtgggtgaccccatccctcaactgggaatcgtgcctaacttctggatatggtctcaacaggttctctctcctctttgttggatatttcagctaaggttgtccctattgggtcatgggagcctcttgctttgctcgcatctgggactttctgttgactactcctcccagttccctatgcccccattgctacacacctctgttcaatttcatgaccctctgtgcattaccctccatctcctcccatacctaatcctgcccccctttgtttcctctccccctcctctcttcctcctaagtacctccaaccctctaactcacatgattattttatcccccctcctaaataggactgaagcatccatactttggttttattatctcctcagtatgatattttctagttccatccatttgcctgtagatttcatgaagtcagtgtttttaatgtctgagtagtactccactgtca

SEQ ID NO: 3356 - DNA, 1000 bp, mus musculus
atgtggttgctgggatttgaactccctaccttcagaagagcagttggctgctcttacccactgagccatctcaccagccctgaatccttttcttaaaattctcttttcagagagagagatatgagagagagggggggggagagaaagagagagagagagagagaagcattgtttaaagtatttatagattcactgaactgtaaggacagtacagtagtgtactcataaatactttaattcatctaagcccacctaccacagggtcttgtttaaacattgcgtaagaatgttccaaaagtgtgaaagaaaaccagtgggaaaacctacttcagagaagaggttgagctaaagcttgagaaggctatagcatatcatgacaagtaaaaactggctggaggcaagaaaggatggcttgaatgtgatacagaaaatgctcaaaagctaacaagtggttcagtgatcctagacaatgtcaggattgctcccacagtatcctgaagtggattcacatataagaatgtaggcagtgtttataaatctttgcttccactggcctaaagcaggctgcatttcaatcttctcccgtatctagcagcttgcaaatagccacaataagaaaccaaactggtacaaacatttataatcaaatattagtggtcagctgttcagagtgatgttaactgagttgttgatggaacttctcaaccagcataatagtaagaataatgaaacaaacaaacaaacagacagactaaagcagagtgaaagctacaaactacagtattcctcattccttccccaaggaaggaaggcagtttaataagtttgagagaccagagaatggctggcagttctgaaggctttctttttcctctaaagttattagagccaaagttggaggcagtgaccggcctttctcaagctggcccaggttgtctggcaagcagagttcagatctctggatgatatttgcacacatactctgaagtacaggccctgc

SEQ ID NO: 3357 - DNA, 1400 bp, mus musculus
cacacagtgcaccacacataataatagtgggagacttcaacataccattctcaacaatggacatatcctggaaacagaaactaaacagaaacatagtgaaactaacagaagttatgaaccaaatggatctaacatatttatagaacattttaccctaaaacaaaaggatataccttcttctcagcacttcatggtaacttctccaaaactgactatataattggtcatgaaacaagcctcaacagatacaaaaatactgaaattatcccatgcatcctatcagatcaccagggactaatgctgatcttcaataacaacataaataatagaaagcccatttacttgtggaaacagaataacactctacttgtgggcctgggtaccagaggttttccacggagatctctgtccaggtctggtgcaagggttccagcaaagggaagtgagtgcaggcatggagatgaaatctctgctgtgccttacaagtcactgtgttactctgagactctctgaactgagtcaggtctggctgggcagacaagaagctgactacccagtgaggagtgtggcagaaattcaggtggcttatggggagagaagatctcttcccaagtgttatatatagctcatggaacaaaagacttagacgaaggagtagttctcgtgcacctttaattccctggatggatttattttagttttggtggttgttcatggtttgacagcaggtacctctcattagcctggaatgacagtttgaggaaaactttatttgcatgtgggaaggcttggtgctactcctatgtgactgatagccacaaacctctccagtgggggttgtggggacattaacttcaacaggaaccaggggtccaggaggtatgaccaaacacattccttcccatgtaggtggaaattaccacccaaagggccccaccagggttcaagatttatgctccactggagaccaggctgtctgtgtgcagcccattgccccacatcaactcaatgataacttggtcagggaagaaataaataaattaaagacattttagagtttaatgaaaatgaagccagaacatacccaaatgtatgaggaacaatgaaatcagtcctaagaggaaaactctcagctctgagtgcttccaaaaggaaactggagagagcatacactaacagcttgacagcacacctaaaagctctagaacaaaagaaaacaaattcacaaaagaggagtagaagtcagaaaataatcaaactcagggctgaaatcaaccaagtggaaacagaaatctacaaggaatcaaccaaaccaagagctggttctttgagaaaattaacaagatagataaacattatccagactaactagagggcacagggacagtatcctaattaac

SEQ ID NO: 3358 - DNA, 1000 bp, mus musculus
tggtggaactgggttctaataatgccaaatagccttggtttctgttgcttatgttcttgtgcttgcctcttgtcatcttgtaatctctggtgttagctgtctttgcctggagcttgttcctcctgtgagcctgtgagcctgggtgtgtcagcactctagagaaacaaactatttctgagagggataagggtacaatggttcctgggttctgtgggtcttgggcaggtcctagatgggcaaggtactggggcaatagtggtggtctcacctgtgagcttaggtatgtcaacactcctgggaggccagctgtctccaggcagggcaggattggggtggagagagctgtggtacagggtcagctccagggcccagatgagaaatttaaatattcaaaatgcagtttggtactactgtctccttaggctccacttgctcttacaatctttctggccagtcttctccaatgttccctcagctttgtgatgggaggaggtatatgatacagatatccaatttaaaggagagaattccagggtgtctgtattctgtcccttgaccagttgtgggtctctgtgttaaccaatacctactgcaaaaagaaactcctgatgagacttgggagatgttttgatctctgagtatacaagaaatcaccaggagttggcttaatactatatccttctagtagagtagtaataatatcttctcctgcccaggagatataaacagtctggttacaagtttgatgttttcttacttttgtttctcagtacatgagtatgagattaatatagcttggtttgtattttgttagatgtttgatgttaaaattgtgtattcaagcttcaatggtacaaaaacttctcaatggactttgacttgtgattatgatatgatttctgacaggaaacatacttcctagacatatgactgtgacctagccccatatatttacctgaagcagcattttcagtatctgtgactgtaaaatcaattctga

SEQ ID NO: 3359 - DNA, 1000 bp, mus musculus
caacaagaaggccttcactgaatcaccagcagacacataaaaagcactagatatggcaccttgtaccagcaaccacaatgttggaaagcagagacatcccaggaagctcactggctagctagcctcgccaaatcaatgaacttctggttcagtaaaacacacaagcaaacaaaaacaaacaaacaaaaccactgtctcaaaaaaataagatagggggatccttccgtttttcatctgtgcccagagctgacactgtgcccagagctgacattgtgccacagctctacatatccaggacccgctgggggagaactggtcccccaggagtgcagacacaactgtgagcaaaggtaggaccatcacttctcctctaacggactgacccagagccctcaggacacaggaactgagaagcagcctgggacagaatcattctagtttccatctgcacctagaactgcccctgtaccatagttctctgtacccacatcccactgggagagaggaggtctcacgggagtgctgacatacctgagagcacaggtaaaaccaccacatctgctcaattcctggcccaagaaggacccacctgggacccaactaactacgaccaccacttctgctctgagggacctgcccagaaccctcaggacacaggaaatgagaagcagcctgggacaggagttttctggtttccatctacaccccaaaccttaaactgtgccacacctctccatacccaaattactccaggagagaattgactacccaggagtgctgacacacaagccacagtcagagacagcaagactagctaacaccagagataaccaaaagtcaggaggcaaggacaaaaacataagcaacagagatcaaggctacttggcatgatcagaacccagttctcccaccacatcaagcccaggatatgccagtacactggaaaagcaagactctgatttaaaaacacatctcactcatattgatattagaggacttt

SEQ ID NO: 3360 - DNA, 1000 bp, mus musculus
gcccaaacagctttacttgcaaatgtttattgcagtgagtcattggtctggttcaaggcctctggtttctgctatactatcaatggtagatcttcaccaggactcctctcagatatcctgttcctgccctgtgtcatggagattctgcagctttggacctacaggaccagctccttcactcactccaggagttcatagatggggtagatgttagtgtgggtcaactcaaagccttgaatctgggcctgggtggttttcctttgtgccactagggtcagctgtaggtgaggggtgcgatcatttcacgagccttctgtcggtgtgtggtggagaggggagtcatctttctgcaaccatgccactgctcagcaggcaagaaagagaaccagttctcctgaactcatgtgatcaggaccagatctctcacatacatgccaccagagccatctcttccaagctgcccaggcaaggggcagagccagctcagcacagtgcttgtccatcaataaagcctcatagagcagcccagactagggacagccacatggcctttggtggtaatatgagtctcaggcatcaacacagaccttggctggaatcggacctctgattcagtggcacctatggcagcatgggccactcagatcagtttacccttccaatccccgtcctgtgttattatggccccagacaccaacatggtctcaggtagcagcccagactactgacgtccctatgacctttggtggtaacatcgggcatagacatggatcttagtagcagcccaggcccacatattaccatggccttgggtggtaccacaggctccttatatccacctgttcctcaccgttgtagcttccagctccatatttctccacagtgcacaaactactcagcttcactttctctcccatctactctatatttcccatttctccgttacgtatttactcattgtagtgacaactgccgcagggcctgggcaggtgcttgagtg

SEQ ID NO: 3361 - DNA, 1200 bp, mus musculus
ttacatcacctatttggttgtgttttcctgtaattctttaagggatttttgtgcttcctctttaaggacttctacctgtctagcagtgttctcctgtatttctttaagtgagttattaatgcccttcttaaaatcctcttctggtattatgagatatgattttaaatccaaatcttgctttttgggtgtgttggggtatccaggacttgctgtggtgtgtgtactgggttctaatgatgctgagtggtcttggtttctgttagtatgattcttacatttgcctttagccatctggtattctctggtgttagattttccagctgtctctggctagatcttattcctcatgtgattctgttagcctccggcagcacacctgggagtctaactctcttctgagtcccagcagtcagagcactctctgcaggcaagctctcctcttgtacggaaagttcacagaggtttaggtctcagctctacctcctggctgaggatgaagtccagaagggaccctgttcaagaagctctgttgcttctgcagcccacatgctctcctggaggactggtctctgagagtcctggggtacaagatggcactatttattgcctgagtcccaggatcagagccctctctggaggctgactctcctcagtgatcctaagatcctgggtgtgctagggtgcctgctgcatggagagttctctaaggaacttgggactgtctgctgagttcatatccaagatgtgggcctagcgataatgggaaagaaccccagccattggtcaggcgtgtttcctttgtccctgatcctgctggcatcagcccctcaggattgttttggaacagatgttgcattccactctccaatgatctcaagatactgggtgtgctagggcgcctgctgcatggagagtcttctggggaactcgagactgtccactgagttttcgcccaatatctttctatttttagtgctcttatgtgtgggcagtctttggaagatagtaaaaagtgacctatgacttcttttcctatctcaagagaaatatcctgaactcagggcacaatcagcagaattgctgtagggaagaatgaagcagattttactaagcttagagaaaaaaaaatgttttagccctttttttccttcttctatttgttctaaggaagcatttattgtctctgtaactaagatactc

SEQ ID NO: 3362 - DNA, 1200 bp, mus musculus; identical to SEQ ID NO: 3361

SEQ ID NO: 3363 - DNA, 1000 bp, mus musculus
ttaaattcctctaacatatccatgactgctggatttaaggagccagagaagttaacagataccacaagaaaacctacagaatcaactcatcctggaccataagggcttactgaaactgaacaccaaccagagagcatacatgggatacacctaggctccctacacatatgtagcagatgtgcaacttggtcttcttcacatggggcttctaactgcgggagcaggagatgtctctgattttgcttcctacctttggatctctttttcctatctggggtgtttagtctattctcaacaagagaagatgtatctatgacaagaaagctgcacccatgaaatgtcaacaatgtgcttacctaaacaagacctgcataatgccaatactaggtggtaggttaatatagagtgaagagaactttcactatgcctcacagctagatgaagagctataggaaattaatgattaattaatgcaacttgatataccaaggtaggttaatatccatgagaagcctccacttctctgaggagaaagggaaggggtgggaggaggggagatgagagggagagattaggaggagaggaggaagtagaagctgtgatctggattaaagccaataaatttattagttataatcttggtgtaagccctacagaactgctatcattctttgacaacattcaccttctgagtacagtttgtgttatttataaaaatgcacattttatgctattgattaatgtgttttaggaaatattagaatcattagaattattgtttccaaactgcttatttagtcccatgtgatgacttctatagtgtatgtttttctataacatcactgtgtttctgtctgttatcctgtgagcactcttaaattgtgaatatgtgtgaaaatgggaaaccagaaaaatcaagcctcattccatttagaatctgactacccttctgaggcaaaagaaatgtaccttctattaatgaatcacccagcttatacat

SEQ ID NO: 3364 - DNA, 1000 bp, mus musculus; identical to SEQ ID NO: 3363

SEQ ID NO: 3365 - DNA, 1400 bp, mus musculus
atgcactatataaaatgcaacccatttttttatttctacaaaataactaatatttatgtttcattatttcttaccaatgtttgttgtagcacaattgcctattttcataatttatagaaaaaaaaacctctcttattatgtgaacctgtcattatataaaaagaattccaccttttattctatttcctgaatttatttataacattcaagcaatggagcattcaaatggtgtgtgtacacatcttagtgtttagagtgttgaaaaagacaatggttcaggtgctatagactgcatcctataagcagttttaacagagccatttctgttttttcatgaacctgtacattttaatcttccttctcccaccatactcttcacaacatgtgaggtacttttgaaattgcccaatgagaaaagaaatcccggtcccttccagtccagccagcaccagggtagctagggcacagagtcggctgacacctgcaagctacccacaagacccgccacgggatcttaagacctctggtgagtggaacacagctgctgctccaatccaatcatgcaggtaccgagactgcatttattagggaagcagaaaacctagcctgataaggggcacaagtccctgccagtccacgccagcacaggagtaccttgggcgtggagtctgcggacacctgtaaggtatacacaggaccctccacgggatcttaagtcctctgtgagtggatcacaactggttcgaacaccagatatctgggcacattccctgcaagaggagagcctacctgcagagagtactctgaacactgaaactcaggagagagctcgtctcctaggtctgctgatagaggctaacataaacacctgaggaacaagatctaaccagagacagctacaacaactaacaccagagattaccagttggcgaaaggcaaacttaagaatcttactaacagaaaataagaccatgcaccatcatcagaacgcagcactcccaccctacaccatcctgggcaccccaacacaccaggaaaaatagacctggatttaaaagcatatctcatgatgatggtagaggaaatcaagaaggactttaataactcacataaagaaatataggagaacactgctaaacactgttaaacattgctaaggtagaagaccttaaagaggaagcacaaaaatcccttaaagtattgaaggaaaacatgaccaaacaggtgatggaattgaataaaaccatccaagacctaaaaagggaagtaaacactataaagaaaaccaaaagtgaggcaatgctggagatagaaaacctaggaaagaaatctgaaaaaatagatacaagcatcagcaacagaatacaagagatataagagagaatctcaggtgtagaaga

SEQ ID NO: 3366 - DNA, 1400 bp, mus musculus; identical to SEQ ID NO: 3365

SEQ ID NO: 3367 - DNA, 1200 bp, mus musculus
cttagaagccccacaccagagctctcagtgctgttctatgaactcatcctgaatctgtcatttctcaactcaacttgtagttactttcaaaaatgcttgacagacaaggttatacaataactgctccaggaacacttaagccaaggtcttaatgactagaacgggttttcagctgctgatactttttgagcaactttactttctctttctagggaaaatgactgaaatgttctaacaatactctgcatcctggctattttgactgtctcatcaacttttgaggtgaaatggttcatatattattgttgtcttcagaagaggaagatcgcccttcctttcggagccagctacaggccaccttggttacgaattcctgggactgccccaccccagaggacagttccagaggactctctaccccacagatgtcctagcatactcaggatcttaggatcactggtgagtggaacacaacatctgttccaaaccaatctcgacaggcatgtacaagcagcagggacacaggaatcccacccaaccaggggctcaggtaccttccagtcagattcagctctgagccaccttagtcccaaacttggcacacagtccaactgtcccccaaaaactctccatgttgcaggcgccctagcatatccaggatcttaggagcactcgagtggagcacagcatctgttccaaactaatcctgatgggcctgtgacagcaagagcaaggacacaggagccctgcctgaacagcagctcaggttccttctgatatgtgctggtataccttggttctaaacacaccagacagcctcacagtccccagaggagacaccatttccacgcactgtaccatgcccaggatcttaggatttcaggataccaggataccaggaacttggtcacaccagaatctcagggtctcagaggaagcttgactgccaagaactctgacacacccagattctcaggttcacaggagcctggaatcacaggagaaagctggaatctgaggagtcctgaatcaaccaagattataggaagggaaagctccaaccagatattttgagggcagcaagcacataagataatcatatggcaggaggcaagcataagaacagaagcaacagaaaccaaggttacttggcatcatcagaacaaaactctctcaacataataagtcctggatacacca

SEQ ID NO: 3368 - DNA, 1200 bp, mus musculus; identical to SEQ ID NO: 3367

SEQ ID NO: 3369 - DNA, 1000 bp, mus musculus
ttttgtgtttcctctttaagagctttctatctgttttcctgtgttgtcctgtaattctttaagggagttatttatgttcttcttaaagtcctctatcagtatcatgagatatgattttatatccatatcttgcttctctggtgtgctggggaatccaggacttgctgtggtgggagaacttggttctaagggtgccaagtggtcttggtttataatggtaatattattttgtttgcctttcgccatctggctatctctggtgttagttagatgttcttgctatctttccctggagcttgttcctcctgtgggtctgttagcctgtgtcagcactcctgggggaccagctctctcctggaggaagttgtgcatagagggccctggaacagcctaagctctgggtgcagatttcaaatggaaggattctggcctggctgctgcactgttcttgcaccccatgtgctccttgctgcccagatccagacagttattggagaaaaattggctatctcacctctgagcctgggagtaaaaccactccagggagaaccgttctctcctggtaggacctctgtacagcggtgtgtggcacagcttcagctcacagctgcaggtggcagactggaaggaatattgcttttctgaacatttgtcttttctaaggcattatcactttacaggtagcatattcctgtgacttttatggacttctgtgctaatgagaaaactgtttacactcaaagacatgattgtggacattttttatttcttcaaaacataggtttaaaaagtaataactctaagtgttataggaaaaatagttgaccttgacaggcattttgacccacatgcgtaatcccaataatctggaacaaaggtgaggaaaccctacaatgttaaatacagctcaatctataaagtgattgccaggccagccaatgctatgtaagcaaaaccccatctcaaataaataaacacagacataaaggtaccacacttg

SEQ ID NO: 3370 - DNA, 1400 bp, mus musculus
gaaatgaacccacacacctatggtcacttgatctttgacaagggagcaaaaaccacccagtggaaaaaaggcagcatcttcaacaaatggtgctggcacaactggtggttatcatgtagaagaatgcgaattgatccattcctatctccttgtactaaggtcaaatctaagtggatcaaggaactccacataaaaccagagacactgaaacttatagaggagaaagtggggaaaagcctcgaagatataggcacaggggaaaaatttctgaatagaacagcaatggcttgtgctataagttcgagaattgacaaatggtacctcatgaaactgcaaagcttctgtaaggcaaaagacaccaccaataagacaaaacaaactaaccagtacttccagagctcgtgtctctagctgcatatgtatcagaagatggcctagtcagccatcattgggaagagaggcccattggtcttgcaaactttatatgactcagtacaggggaacgccagggccaagaagtgggagcgggtgggtagtggagtggaggtgggagggtatgggggacttttgggatagcatttgaaatgttaatgaagaaaatacttaattttaaaaaaagaatgattttatgatatctgcttttattaaaagtgagcatcataagattatacccaactatatggaatttatccagggtagtacatgccttgttgtaagaagtctaaaaatattactcaaatatgtaagataattacactactcaaaatttgtattacacgtatttatttgtgtgagagcagagtggatactggtgtccacatgctacaggtcagaaaagaacctttggaagccagttctttccttcaatcaacagggtcctagctgtcaaattcaaatgttaggcttagtgtcaagtgctcttatcccattacccatcttaacagttcctaagattagaaaaatttttggagctctgaggcggcgccattttcggctccagacaaccggccaccttcctggtgagagcacaggggtccacccggcccgagagacttctgcctcacgttccgtgggggccaccttggttccgggactccggggcgggcggtctgagggtgagagtgtggaacacagaggccagcagcttctggaaagggcgagagccacagagcctctgaggcagctccattttcggctacagacaacctgccaccttcctggtcagagcacaggtgtccgcacagcctgcgaggcttctgcctcacgttccgcgggggccaccttgattctgggactccacagagggcagtctgcaggccaaagcaacacagcttctgggaaaaatcctgttttgggccttcatcttcggccaggaggagttccaaacaccagataactgt

SEQ ID NO: 3371 - DNA, 1000 bp, mus musculus
tcctaggttttccatctctagggttatcttcctttgtgttttctttaatatttctttttccaattttagatcctggatagttttgttccattccctcacctatttgattgcgtttttctgtttctttaaaagatttatatgtttcttcttcaaggggttctacttgtttattcttcttttcagtatttctttaagagaattatttatgtccttcttgaagtcctctatcatattcatgatatgggattttagatctggatttttttcaggtgtgttggggtatccagagattggtgtggcaagagaactaggtctaattttatcaagtagcattggtttctgttgcttatttttgttccttgtgcttgcctctcaacatctggttatctctaatgctaactggccttgcattttctgactgtgagtctgacagtctatccctgctgtgagccttgttatgtcagacctcctgagagtccagctgtttctgcagtcctgttattctgtgatcctaggatcctgggatcctgagattctggatgtgtcagaacacttgggagtcaagctgcctctgagattctgagatcctgatgtgtcagagctcctgggagtcaagctttccgtgggtgttgtaggagtttgtcagaagccagaggcttgggtccactccaggcacaggtgcaaaccagaagaatcatgtgcctctggctaggtggtggtttctgagttcctgtgtcccaagggttccagttaagctgggtattggggcagagcttggggtctcacctgagatcctgctgtttcagagctcctggagttaagcttcctctgggtgttttaggagtgggtatggagccagataccagtgactgctctggggctaggtgcaaactggaagggcagtgtttaattcttatatcagctcttgggattcttttcttcccgttgggttgccatgtccaacttcaatatgatgagttttgttttattgtattatatt

SEQ ID NO: 3372 - DNA, 1200 bp, mus musculus
tgttatttgagcaaggctttaacaactcttttttttttttttttttttttttttttttggtttttcgagacagggtttctctgtatagcgccaccacgcccggctgacaactcttgctgaatgttttgaaatagatttccaaactgtctggcagctgtcaaatcatagttcatgcacagtaagacaggttacctaactcagagaaccagaaaagaggcagaagatttatggccatctcctgagaggctctaccagagcctgacaaatacagaggtggatactcgcagccaaccattggactgagtgcagggtccctgatgaaataattggagaagggactgaagaagctgaggggggttacaaccccatgttggaagcaatagtgtcaaccaaccagaccctctggagctcccggggactggaccaccaaccaaatagtacacatggctctggccacatatgtggcacagggtggtcttgttgaacatcagtgggaggagcggcccttgggcctaagcgggctgtaaggcaggagtgggtgtgtggatggggaagcaccttcatagagtcagggagggtgtgggatagggggttttgggagcagatacctgaaaagaggataacataaaatatataaaaagaaaatatccaataaaagaaaaatgttgggaggggagagagagagagacagagagagagagagagagagagagagagagagagagagagagagagatcttcctgacagttgaaccttgtccttggttctgaaatgaatttcactatcatattgcctttctgaagaaactctcctcttcccaggaccatggaaataatgttataatttatttcccgaagttttctttcgtcattttatccttcaatgctaaagcaaagatactcctaagaacagtgatgtttgatcttggtccgggacccgccgaacttaggaaattagtctgaacaggtgagagggtgcgccagagaacctgacagcttctggaacaggcggaagcacagaggcgaagaggcgctgaggcagcaccctgcgtgggccggggacagccggccaccttccggaccagaggacaggtgcccacccggctggggaggcggcctaagccacagcagcagcggtcgccatcttggtccgggacccgccgaacttaggaaattagtctgaacaggtgaaagggtgcg

SEQ ID NO: 3373 - DNA, 1000 bp, mus musculus
tttaacccaatttagtggcgagttctttagcctttgctttttccagcttggcaatgggagccacagacttaggacccaggacgttgcctccccagtggcgactgatcttgtcataattgatcctaatagcttagccagagcaccttgtcttccgagttaacctgggtgaaggcaacagtggtgcttgtcttcctctggaccaggtgccccagcctggcctttcccttgatgatgcagtagagcacccccatctttcaacacagggcaggcaggaaaaccaccagctcaatggggtctacgtcatggtcaatcaccaccagctgagccttcttgttcgccaccaaggtggtgactgtattgactcctgctcagaggacaggtggtctcttagttgggacatcgcctttgccagcagctttcttctcagcacgggccagtagcctttgcttcttctcttgctttgtctctggtctgtacttgtgggcaagctgaagcagctgagtagctgtttgactatccagggcctgggtggactggttaatgacaggagggactttgagccgcttatagaggatggctctttgccacagcagcctgatgtagcggggccatttgacgacgtgtgttagatctcttttgggctggatgtcctgcccagtgccaaagttcttgggtcttttctcaaaggattgaccacctttttggcctcctgtttcttgacgacagagggggctggggccaccttcttcccgttggccttctatcctttgggcatcttgcttggctggtggagagagcaggattcagattcttaagtaggtaaaagtcatactgaattaggtcactcagtagagcttgaaattcttaaagcagactaacagggaaatacatgtgctatgaactgatcaagttcatatgagaagatgctgtaaaggttttataaaaaaagatatgatgagaagctgtagtttctgtaaatgagtggaactgaacaagtaga

SEQ ID NO: 3374 - DNA, 1400 bp, mus musculus
cggccatcactggaaagagaggcccattggacacgcaaactttatatgccccagtacaggggaatgccagggccaaaaagggggagtgggtgggtaggggagtgggggtgggtgggtatgggggacttttggtatagcattggaaatgtaaatgagctaaatacctaataaaaaaataaaaaaagaataataaaatctaaaggcaatcaaattaaaaaaaaaaaaaaagaaattcaccaacctagaaaactggctaatactcatgagacttagctaaatcgaacatgaatttgaagcataagcaatattgagttacaggctcacttgtttcttctgtcttaggttaaaatcatattaagatagttagataaacactggggtgaaagattttgaggatttagaagcaatcacattatttacattttttaatttaattttatttgtaattcatttttatacttcatattccaatctcctccctccccatccaccctttacatcccacacatcctccccaccctgtctccacatggatgaccccatcccccacactgcctgacctctagggatggaaatggagagaagcctgaggaaaagaaggtccagcaacaggcccaaagtgtgacccagctcaaggggaggccccaaggcctgacactattactgaggctatggaacactcacaaaaagggatctaacgtgagacccaacaagcagctgaaagagtcagatgcagatatttgcacccaaccaatgaacagaagcagctgacccctgttgttgaattaaggaaggctgaaagaagctgaggagaagggcgatcctgtaggaggaccagtagtctcaattcatctggacccccgagatctctcaaacactggaccaccaaacagacagcatacaccagctggtttgaggccaccaacacacatacagtagaggacttccaggtcagtgttcattcagagatgatgcacctaaccctcaagacacatcatttacgtattaaaaggaacacaattacttatttatcagtggaaccatccagcatccagacaagaagcagaataagatagaaactctacttttcaaagggaaaatcatgaacatgctgctgtttcccagggctacagatattttccttaaaaattaatttttttatatttagtaactatcacgtagagtggctagccattttgataagttagttggtagttaactggtaggtgatagtgatcttaacagtaatctttaccgacgatgttaaattaataaaatggtacattttatctaaaaaaaaaaaaaaaaaaaagatgtacttctctagggacataccaatttcattatttttaatttttttttcttaaaattttttattatttaaatgcattttatacatc

SEQ ID NO: 3375 - DNA, 1600 bp, mus musculus
cccactacctatacagcatcaggatttatccagttgtgtaaacttattaatttagtccctagatagaatgtattttctctgcatttaaagttttttcctcctgtttgtaaatattaatgtaaactggattgcactagtcctagttgagggaatagaagtagagagagaaagaaggaggagggaaggaaagaagagagggaaggagggagggtgggggggctgtgataggcagcctattttggttgaatgaggcctgcttctacgacccagtagaaaactctacacgggacagaaaagggagccaccttcccagagtcagatgcctgacaccacagagcccccaactccatgattctgtgagtataagtcacacagacaatgtcccaagcttctggcattctggctagactccacccccacagttacctgactatagccaggtgtgctcctcctcagctacctgataacccagcccaactataaaagggactggccccttctgctctctttagctcttacctttcttactctctagtcctccttctctctctctctctccctctctctctctctctctctctctctctctccctctctccatctctccaggtggccatggccagcctctctgtttaccttctctctttctcccttcctttctacaataaagctctaaaaccatagactgtctctgctcatcaaggccctaaagagccaagtctaacctcctgccagaaggccttcctgcactccagccacagacagaccagcttgcatgggaaccacacagtgcatccctccccccaaccacttccctctcctcccctcagccccagggaggtcctgggggcctccattctgttcttagttcttctgcggtacccaggatggaatgctggagactgagaacctgttatctctggcctccatgaggcccaaaaacctaggactgccccttgtccactgcctgctgagcggggtccagtggcttcccacaggaagagacccacctgggccaagtggaaagcatgcagcagtcctcccacatctgcctgctcagagcaactggcaagatgctggttttcaccaactctccttttatggcctccccccagaaaaaagagagaaaaagagagagagagagagagagagagagagagagagagagagagagagagagagagagagagggagagagagggagagagagagagagagaggaaggaggaggaggaagaggaggaggaggaggaagagaaaaagaaagagaaaagaaataaaagaggaaaagggaaagagaacacatgatcagattgcaaagctgactgacataagtctagtagggatccttaactttagtagttgtaagagacctgagaacatccttcatccttcacctccccatcctcctcctttccctcctctttgttttcttctattttgtccaatttattcatatgtagtggcagaattttctcttttgaagttgatttcatgaatatgtcctcagggcagaaccaagagtcaagagttctgttcctcagctagagttgccagatgaatcccgagttggccattcctgttcagagatgctctgctt

SEQ ID NO: 3376 - DNA, 1000 bp, mus musculus
gtctaagcgaggatgcctcagtcccacttgggagggagaggaaagcaaccacaagaggagggagggacctggcagggaaaggggttaggaggggctggagaagggaacatgatcaggtattgggtgggagaaaaggactgaagttcctgagggccagcagaaagaatggaaacatacaaccaatggaggtaggaggttggggggaccctccagaatatatcagagacctgggagggaagtgaatctcaggacttaaagagagagaccttaaatgaaatgaccttcattggagagatggaaattgtagagcctacctccagcagaaagacagggaatcaagtgagggatggagttgccatcccacagttaaaactctgacccataattgttcctgtctgaaagaactgcaaggatagaagtggaaaggagcctaaggaaaataaggtccagcaacaggaccaaagtggaatccagctcacggagaggtctaaaggcctgacacaattactgaagctatggagtattcacaaagcgggacctatcaagactgccctctgaaagacccaacaagcagctgtaagagtcagatgcagatatttgtaccaaaccactggacagaaactgcagatccttgtgtttaaattagggtaaagctggaagaagctgagaaggagggtgaccgtataggacaaccagcagtcttaaataacctggacccctgatatctctcagatactagaacaccaaccaggcaacatacaccagctgatatgaggcctctaacacatatacagtataggactgccaggtctgagttttgtcagagaagatgcatctaaccctcaagagaccggaggccccagggagtttagatatctgatggggtgggggtgggggttggtgacatcctcgtggagacagggtcatggagaggaagtatgggaagtgaaacagttggaaggtggaccgggaggggaataaaatctggagtcataggtgc

SEQ ID NO: 3377 - DNA, 1000 bp, mus musculus
aatataaattttctcctattgaaaaaaatacaagaacaaagagatagagtaataaaatagaacttttcaacaatccaaaagaaaattggagaatttgacttcagattaaatattctacaaatgatgaaagaaaagaacataaaaggaattctctcagaatatgcaggaaaaagatcctcatcctaaacaccaatccaaacatcaagaactgatcaagcatataatatgtttgaatgtagcatttgtattttatttatgtaagtgcattgaacataccctcatactttgactcataaaatgatttcttaaaaagagatgttagacttcagtgagagggttatgaatcagagggtttatgaggctaattaggatctttaaaatggaggtaaagaagaggagcagctgggacaggatccttctggataccatctgcacccaggggttaatgctgatgtacagccatctatacacagttcctgccaggagagagctgttttgccagaagtgctcttactcctggacttggaggtgagatagccactttctctccaataactgtccagggctggaccaacaaggagtgcactgggcatagaaacaagggagcagaaggggcatgatccttcgggtcatcatcagcacccaggagatgaggctcttctacaggccactgtgcacaagttctgccaggagagagcctgtctcccaggagtactggcacaggcttacaggtccacaggagggacaagatcctgccagtcacagaaagaccaaataacatcagagataaccagatggagaaatgcaagtgcaacaactttaccaacaaaaagcaaggctacttggcattatcagaaaacagttctcctatcacaggaagccatggaaacccaaacacaacagaaaagcaagatttggatttaaaatcaaaactcataatactgatagaagattttaagaagaaaacaaataagtcccttaaaaaaatacagtagacagg

SEQ ID NO: 3378 - DNA, 1000 bp, mus musculus
ttggttctgatgatgccaagtaaccttggtttctgttgcttctggtcttatgcttgcctcctgccatctgattatctcaagtgctccctgcctgttatatatctgattggagtctgtccttcctgcaatcccagttgagtcagaacttctcagagtccagctttctttgtgatcctgtgattctgggatcctgtgatgctgagattcttgatgtgtcagagtttttggcagtcaggcttcctttgagaacctgatatcctggcatcctgggattcttggattctgtgatcctaagatcctgggcatgttagagcatctggcagtggtacctcctctgaggactgtgtggctgaccactgagttctaaacaaatgtagaccagcacctattggaaggaacctgatccactctttggccaaggtttctgtgtctgtgttccagctgtcccctggcacccttgttcttttggaacagatgttgtgttccactcaccagtgatcctaagaacctgggtgtagtagggtacttgtgggatggagagtcctctgaagatcatggggctgtcttctgagtttcagcccacggtggcctgggctggtgccaaaaagaaggaagggcctaaagtattttaaataaactaatcatattgaattcacacatgtgtttgtaataaataatactgattctttgtttctcatttttatcccagttgaaaactgatagtacagtatcacaaccagtaaatgggcatttatacagtagacaaacagacgatttctatcaatgtactgcaatgttaagcatccttgtcaatggtgaaaatagctttacatttgtttactggccattagcatatgcactgctcttagccagctcttcaggtctgggatcagttcatagttttctggtcagttttgagttttaagaatcttttatgtagccctggtattactatgttgtacaggtatcctattgatatttccctccactgtttatcttt

SEQ ID NO: 3379 - DNA, 1400 bp, mus musculus
attggccatatactcagtcataaagcaagtctgagcagataaatgaacattgaaataaccccctgtatcctctcaaaccaccggagattaaagttgtacttccacagcaagagaaacaacaggaagcatatacactcatagaagctgaacaatattctactcagcaatcactgggtcaggacttattcaatgaaaatcaacacacaacatacccaaatggaatacaataaaagcagtgctgagatttaagttcatgacactaagtgactgcataaagaaattggaaagttctcatactaacaatttagaagtatacctgaaagttctaaaatataaaaaaaaaaaaaggagaagaagaaaagcaaagaaagagagaagaaacaaacacactggcgaggaatagatggctgtaaataatcaaattcagggctgaaatcaattagaaacaaggaaaaccatacaaagaatcaagtttctggtggctacccccagttccccactcactcatctccaaaattttaacctagatttgctcctgtccaaagaaaatacagggtcacagtgtagaaaggctatccagagactgtcctatctgtggacccatcccaaatagagacacccaacccagacactattgctgatgccaagaaatgcttgttgacaggatcctgatacagctgtctttgagaggctctgccagagcattgcaaatacagattctgattctggcagacaaccattggactgagcatgaggccccaataggggacttaaggaaaggactgaagaactgaaggggtttgcattgctccagatgcatatgtagcagaggatgaccttatctggcatcaacaggaggagaggaccttggtcctgtgaatgcccaatgccccagggtaggggaaaggcagagtggtgagtgggtgggtgggtgggggaaacaccctcatagaagcagggggaggggttatgtgataggggggttgtgatgggaaaactgggaaagaggatgtatttggaatgtgagtaaatcaaatatccagtaaagcaaaacaaaacaaacaaacaaacaaaaaaaccctggtattttgagaaaatcaaacaggtaaacaaacacctatcaaaactaaccaaaagacaaagagacagaacccaaattaagaaaatcagaaatcctaagagaggcataaccactgaaaccaagaaaataaaaaagaatcactgggccttacttcaaaagcctgtactacacaaaaatgaattaaatggatgcctttcttgatagctaccatttcccaatttaaatcaagatcaggtaaactattcaaaatattcataagccctaaggaaatagaagccatcattaaaagactccaaaccaaacaaagcctagggacaga

SEQ ID NO: 3380 - DNA, 1000 bp, mus musculus
tatattcttttgttttagagtaaaatgttctatagatatctgttaaatccctttggttcacaacttctaatagtttcactgtgtctctgtttagcttctgtttccatgatctgtccattggagagagtggggtgttgaagtctcccactattattgtggaagcaaggtaaacatgaaattggataggtagttgtcgggtggtggactgtgcacaggtagcctggtcccttgttgagcatagggctggaaccccagagccttggtgggcagaaatttctacctgcatgggactgcaggagtttgaccacacctcctaggcacctggctcctgtcacatagttacagcctcccacagctccccctgcagtgaggggtatggacatcaatcatgtaatagctgcaccaagccctctcacatgcaaataaggtttccccaaactctcagtccaagccagtgagaggtacctgctgtcaaaccctgaatcacccccaaactgtatgtaaatccaatccagggaataaaggtgtgtaagacctaatctgctgtccaagcattcgactttttttttttttttaattaggcattttcttcctttacatttcaaatgctatctcaaaagtcccctataccctgcccaagccctgctcccctacccacccactcccacttcttggccctggagttcccctgtactggagcatataaactttgcaagaccaaggagcctctcaaagcgctgcctgaggccctgcctcactcctcattggctagtcagcttctcttccacctaggctgacccaactcaattcagggaggcatagaattacagcctggcagagatggaggtggagcctacctatgtagtgcaagcaggtaagcaacttcccctccctgcccacatttgcttcccttcactggcacccttgcaccaggcctgggcagagatttccctggaaaacctctcttacccaggcccacaggcagtgagcttgggtgata

SEQ ID NO: 3381 - DNA, 1200 bp, mus musculus
ataaagtcaattcaaacaaatcagtagcgttcctctactcaaaaaatatacaggctgagaaagatattaggaaaacaacaccctttacaatagtcacaaacaatataaaatatattgctgtgactctaactaaacaagtgtgcgacaagatcttcaagtctctgaagaaagaaaaccaaaagatctcagacaatggaaagaacttccatgctcacagattggctggattaatatagtaacaatagcaatcttaccaaaaggaatctacacatttaaggcaatccccatcaaatgtccaactcaattcttcattgagttagaaagaacaatttgaaaattcatttggagtaacaaaaaatccaggataacaaaaactattctcaataataaaagaacttctgggacaatcaacatccctgacctcaagttgtactacagagaaatagtaataaaaattgcatagtattggtacagtgacagtcaggtatatcaatggcataggattgaagaccaagaaatgaacccaaacatctatggtcacttgatgtttgacaaaggagctgaaactatccagtaaggaaaaatgtaacctcccctccccagcctgaaacctgtttgctcaggtttcagtgttagagagcatcagggcgcagcttgccgccctatcgtcctgacaatcccactgccactgcctgcaaactagctgttccagatttatcccgtgttcacctgcaactttactctgagattatttggtgggaattagctccttcccctccttcataactcggtgcacgaattagtaaaattgagctttgatcagaacctggtttgtcttagctctgtctctctctcacaccgcctagtgccccctcttctcttccaggtttccaagatgcctttccagactagaacccagacatgtgagctgagcagctggctacccacaacagaaaaatacagcattttctccatatggtgctggttcagctgtcggtcaacatgtagaagaatgcaagttgatcaattcttatcttcctgtacaaatctgaagtctaagggcctccacataaaaccagacacttttaatctagtagaaaagaaattggggaaaagccttgaacatatgagtacatgggaaaagttcctgaacagaacaccagtgatttatgttctatgaccaagatttgacaaatggaa

SEQ ID NO: 3382 - DNA, 1200 bp, mus musculus
gatttgatagtatacataagcaaccccaaaagttttattagagaattgctacagcggataaacaacttcagcaagtggccagatataaaattaacacaaataaatcagtagtcttcctttatacaaaggataaacaggctgagaaagaaattagggaaacaattcccttcataatagccacaaatagtataaaatatcttgggataactctaactaaacaagtgaaagacttgtatgacaatacttgagactttgtcaagttcattttgaaccctgtaataacatacttgcaccaaattaatgtggacaaattttcagcaataatgagatatatcacttttaatgaaaataacagcttggacacagtcccagctgagacctaggtcagttactcagtatctgttttactcaccttttcagtagcaaaaaaatgtagttaatcatagcatgatcttcatttgaagtggtaggagtgttagctgtaaagtgcttgttcctgacaccaaaacagaggaaagtgggaattcttatcaagaaatgaggagaagttttaatttgctttatacatcatcatcatgtaattctacgatatatggaatagctttttaaagccagatcaagcttacaggcaagactagagaagttgtttgatagtgaaattgtggtgaacttgagagtgtttggatgattgagaaagttgtgtacaaagaaacagtaattagggacttcactggtaactaatgtgatcattttgaatcaggaacgatttcgcagtgaataaagaaaggactagagccaagcagtggtggcacacacctttaatcccagcacttgggaggcagaggcaggtggatttctgagttcaaggccagcctgatctacagagtgagttccaggacagccagggttatacagagaaaccctgtctcacaccccctcccccaaaaaacaaaaacaaaacaaaaacaaaaaacaaaacaaagaagaaaaagaaagaaaggaaaggactagaattgtacaaaggttactaattagtattatttatttgtctgtttgtctttgttcatttagttttagttagtatttatgtttttattttgctttgaaaatcattcaggtagaatttgcttaaacattcagggagttcttattaagaaattatgctttctttatagtattggcatccttatcagtctcttt

SEQ ID NO: 3383 - DNA, 1000 bp, mus musculus
tccctgtctctcgtcttgtaattcagcataatcatctcttttacaagttttaaatattttactataaaatatctacttgctctaggtattaagataatttagcaaaatacagaagctaaaaatgactgacctaaattgggtgagtgaggtcagtcatgagaatgaaatctaacctccactcagggtggcaatgagggctgtacttaggaatttcaaggatatggtagagaaacacttgagtggagagttgttttgagatttcttcatgatttgatagatttattatggtcgtgaatatgaacaatttggttggagaaaggcaagcttccaaaactgagttaagaaaacaaagacagaaaaatgaccaacgtgtggacactttgcccctgcttagaattgggaacaaaacactgaaggaaggagttactgagacacattttggtgctgagacgaaaggatggaccatctagagactgccatatccggggatccatcccataatcagcctccaaacgctgacatcattgcatacactagcaagattttgctgaaaggacccagatacagctgtctcttgtgaaactatgccggggcctagcaaacacagaagtggatgctcactgtcagctattggatggatcacagggcccacaatggaggagctagagaaagtaaccaaggatctaaaaggatctgcaaccctataggtggaacaacaatatgaactacccagtaccccccagagcttgtgtctctagctgcatatgtatcagaagatggcctagtcggacatcagtgcaaagagaggtccattggtcgtgcaaactttatctgcctcagtacaggggaatgccagggccaaaaagtgggagtgggtaggtgggggagtgggtgggggaacgggtggggatcaggaattcaaggcccatacctaaacatgataaaagcaatctacagcaaaccagtagccaacatcaaagtaaatggagagaagctggaa

SEQ ID NO: 3384 - DNA, 1000 bp, mus musculus
aaacctattttcctagtttgtcccttttcagagtctaatagcaaggtaaactgtttttctcatctgcagacatactagctcaagaaaagtaagacctgctctttaagctctcacctttcttactgtctagccctccttctctttctccattctgccctctccatgtggccatggcctctctctaccttctctccttccccctgcctttctacaataaagctctagaaccattaaaaaaaaaagaagaagaaagaaaggaaggaaggaaggaaggaaagaaagaaagaaagaaagaaagaaagaaagaaagaaagaaagaaagaaagaaagaaagaaagaaagaaagaaagaaaagtcctgagtcctgatttttacaggtgaaaataactaagaagacagaaatgagaaggcagatgaagcctggggggtgaagttgggtgattgtcactggtaaggcttcagtcaatatcatcagatctctgagaagggtaaattatggtaggtggtataatctaaatggcctgtgtatcaattacaaagatctattcactatctagacaattaccctaggctcccatgttctcaatcacttcattgtaacagtgatcttgtgctgtcatacagaacagcattcagtcttcagctaccatacaataccatcaacactaatctaccagacccaggtctgagagattttcctatggagaaggaacttggtggatcaaccttactttggtagtgcaaaatatggctatcaatctaaaagtgtccacaccttgtgttaggcccttgcagcaggcaaggcatagcacaggctttccctgtggtcagtgtttctacagttcaggtggaggtggcatgccctatctatcttctttagagacctcagtgttcgtgctagaagtggatttttctctacataacaggaagttttttttttttttttgattaaacatttaaagtgtcaaattcagcagacgcttaaagtgtctacctactt

SEQ ID NO: 3385 - DNA, 1600 bp, mus musculus
ttttaaatctcccatgtacctattctgagagtagaaaatgctattggcactcagcaggttcttgataaatgtaagtatgcatcaacctgaccattgcagcatatttcttctgcatagtgggaatcctcacgtaagaaacgtagagatgccttggaagcaaggtcgcttccagccagggctcagtctccttgttctcagcctactattttcagtttcaataagaagcaaacaatcttatcttgaaaggggattagatttatttttaataagagatctgaattggaagcttatatatttttctctccagaatataataacagcacaagtaggtcttacactatacttcttatgtgtaagagaacaaagcaagagagagagagagagagagagagagagagagagagagagagagaacaatactagaaaggtaaaagcaagcctgataccaccgaacctattcaactttcccagtagcctggggatgggagggcacctagtcaaactgtttccagcatcctctactgagagaagacatgaaagaaaacagggccagccccgtgccatcttgggagcaaacttagtgggccctagcccacccaagaacttgggatcactggtgagtggacacaacatctgttccacaacaactcggagggtcttgtgccagcaggaacagggacaaaggaaacctacccaaccagtagctgggtttcattccgggcagtgccagccctgcaccattttgggttcgaactgggctggccctagcatacccaggatcttgggatcactgcaggaacagagacaaagaaagcctgcccaaccaggggttggggtttgttctggtggctccagccccatgccatcttgggcatgaattctgctggccctagcacacccaggatcttgggatcactgagaacaatctatgcaagagagtatgtggattgcagaagcaacagatcttcttggacaaggtcccttcgggccttcatcctcagccagaaggcagagctgagaccctaaccctgggcaccttcccttccagaagacagtcagcctccagggagggctctgactccaagactcaagaggtggatctgagctccagacttctgtgcatgttccctgcaagaggagagcttgcctgcagagagtgctctgaccactgggactcaggaaatagttgtcatcccaggagtgctgacagacactaacagaatcataggaggaacaaccttccagccagagacagctagaacacctgacaccagagattaccagatggcaaaaggaaaacaagactcttattaacagaaaccaagaccacttggcacaatcagaacacagtatgcccaccacagggagtcctggataccacaacacacctgaaaagcaagattcagatttaaaatcgtatctcatgatgctgatagaggattttaagaagggcattaataactcacttaaagaaatacaggagaatgctgataaacaggtagaagtccttaaagaggaagcacaaaaatccctcaaagaattacaggaaaacacaaacaaacaagtgatggaattgaaaaaaaaaaaaccatccaagatc

SEQ ID NO: 3386 - DNA, 1200 bp, mus musculus
cagagagagcgcttgattgatgaaagtctaatcatcatgcttggtagaaagcacctttccatgctgagccatatcattgatctagaaggtaatgttttaattgtgaaactcattcagtctttgaacttccctagtacttgtgtggaatgcttattcacaatgcaaatatttgaaataataaggccacacccttggtaacattgttcttcatattattatggcttaattttttgtgactgataagaacttttggtaagtcaactctggtattactagtcttggaaagcattatagatagtacataaagttagatatagaaaccccaaatctctgattcttccatgccaccaagaaagtgaagtattagttaatcactaagaaatatgatgtgttcttctatcccttctaccccttctgcctgatgctgactgctggagcagactcttagttggtttgcttccataaaggctctatatccatatcctagagaacctgctgcactcagctcagttggacccactgcactcagagtagtggagacattgaggaccttctgaactcagagcagttgaggtttggctgcactcagtatagttgaacaatagcttgactgctccgctgaagacccaacaatctgaaggcctcccaggagatctactgaagtcagggcaacagatcagcaacttctctgcccccataaagagctcctagttcttaggcctcacagatggtctgatacagccaggacagcaagcctacgaggagacctgaagcaaccaagggacaaaagagcagactctatatagtcaccgagatcaacaaacaccagggatttccagatggcaaaagaccataagcaactgaagcaaaaatatgtgggcatcatcagaagtcagttctcttctcccaccatagcaagccctgaatacaccaacatacctgaaaatcaggaatctttcctaaaatcctatcctatgaaaataatagagtactttaagaaggctatcattagctcaccgaaagaaatacaggaaaacacaggagaaaacaggagaaggaattgaataaagtgatccaagacctaaaagtggaagtagaaacaataaagaaaatacaaatggaggtaaacctagaaatgggaaacctaagaaagagacaggaattacagatgtaagcattaccaacagaatacaagagaca

SEQ ID NO: 3387 - DNA, 1000 bp, mus musculus
gaagttttctaaggaatacactttgctgttcctctcatccacacattactgtgttaatagcaagtggatgcatttcatggccatgaattgatacaatcactctcactgtgaatgattggtcaatgtataatggttgtacaatcaattcacagatagcacaatggttccattaccttcttgtatttcagtgaaagctcaagtggcattttataatatacagaaatatcagatcctctgacacaggcgtccaaccccaaatatgctgggagagagcaagactcccaggagtgcagacaggactgtgagtgcaggtgggatcaccactgaggtagggaccctcccagaaccctcaggaatcaggaacagagggactccctgggagaggagtcttctgctttccctctgctaccacagctgatcctgtgccacagagtgacatacacaaataccaccaggagagaactggtctcccaggagtcctgcacacctgagagaataggtaaggccaccatttctgttcaaatttctgacccaagagggtcgctcacagaggcatcaggacacaggaaccaaggctcagctgggaataggatacttctagtctctgtctgcaacctagagctgacattgtattacaactctccctacccaaaaacctcccagagagaactggtctctcaggagtactgacacatagtcttgcaaaagggacaagccaaagtcagagacagcaagaccagttaacaccagagatagccaaacggcaagaggcaagtgcaaaaacataagcaacagaagccaagacatctggcattattagaacacaattctcccaccacagtgaacactggttactccaacacaccataaaggaagaatttgattttaaaaatcacattgcttaatgatgagagaggaatttaagaaggacataaataactccattaaagaaatacaagagaacacagataagcaaatagaatagaagacagtaaagaag

SEQ ID NO: 3388 - DNA, 1200 bp, mus musculus
tcagggagcattctttatgattaattatacttctactttcaggtcttaaattcttttatttattctgttctactgttcatgtgttcttatatttctttaaggtatttgttcatttaatttttaaagatatttgttatattcatgaagtctatttttaatatctctgtcttgtgcttcagcagttttccaattctcagggcctactgttgtaaggttgttgggttctaatggagacatactgtcctaactgttgtcaattgtattttaaggttggtgtctaggcatctgggcttgggaagattataattgtatgtgctaatacaattttgctaattttgtctttgttgggtgagtgttttgttccttggtttctgctgtcctctctgattcttaggaaggtggggtggttctgtcttgcctttaatgaattcttttgaaatcttgctaaatatgcccatgataggctcccatgagaatatatttataagtattggaagttgacagtgagcaagggtcataggagtgaggggctgcagtagtccaccataggaggtagaaagcaatgtatttttttatcatcagaatttgtttagtcccctgagaatgaagtgaaatgtgaggaaagtccacaacaagtattctaatccagagttaggaatgagattgggggagtagatattgaaaacaggaggaagagtcaagatccaaagcttgcctacctgctctgctggcctattgccttctttgtcaatcttggctgatgtgttgccagtaaaagtctgctggacttggggcccaggaaaaagggatgagtggggagaaagatttgaggaattctgtgcaatcctctggagtcacgtgcagataagagggggaagccacagcatgttatctgctacagagcagggcataaggctggcagattggatttgagtagcagaggcaaaggactgcaaatagcctacttgcctccctggcataatcactaatctcttatttttaaggatgagaagttgagattcagaacactaagtcaccttctcagttctcacaaatagtagttttgtcatcacaacaatgaattattaacaactttcaatgcttacatgaaatttaaaaagtctttgtatgatggttcagtaagtgagggcatttggaataagcctgaccatggtaagtgaggactaactccccaagtta

SEQ ID NO: 3389 - DNA, 1000 bp, mus musculus
agatgtgtcttgataagggttttacaactcttataaaggacaacatttaactggggttaacttccagattcagaggttcagtctattatcaaggtgggaacatggcaccattcaggcagatgttaggctggaagatctgagagttctacaccttcaaccaaaggacgcctgtaaccttccctcagcctgaagctggctgagccagaacttgaccttgctgccactaaggaaattacctagggtggagccttcctccctagatcactctattgcttagccactgtcactgttgctgttcctcttcaagatactgctacctgctgagaggccctggagctattcctgagactatgcagtatcctgcaagtcatcacctgcagttggttccaggctccaaggatgaattggcgggaatgggcttcccccacctttttataagtgcattcgccattaaacatttgagcttgatcagaatattgtcttggctccatttctctctcgtttgcctagtttccctttcttttagtgccggcctgccactcaggtgtaccccgtccatgtgaactgctggacagctcgcaacagcagacaggagaaaactggctcccaggtggttaagaggagggtcacattgaccttccccacagtgacacacatcttccaacaaatacatacttcctaaacgtcactccctgggccaagcatattcaaactaccacaatctgtattactgcaagtggccactaaccatagttatcagattgacttaaaatttacagagctaagatcacatactgccttgcataaactgtacaaatcagtttctcaaatgcaaaatgaaatcttgtgacctgctgtgagcactatgaccaggtcctgttgaaatcatgcctcaagacaacaattcctgtctcctcatcctcccacactggacatgttacaccaagctctgatccaaaatacttttggatcacttcctttaaaaactgaattcctccat

SEQ ID NO: 3390 - DNA, 1000 bp, mus musculus
ttgcttttctcatgtgatggtgtatccaggatttactatggtgggtgagtttggctctgatcatgccaagtaacctcagtttttgttgcttctgttcttatgcttgtctcctgccatctgattatctcaagtgcttgctgccctcaaaatatctgattgaaacctgtcctttctatattcccagttgattcaggactcctcagagtccagatttccctgtgattctgtgattccgggcttctgtgaacctgagattctgggtctgtctgagttcttggcagtcaagcttcctctgagaccatgagttcctggtgtgaccaagctcctgctatcctggtatcctgaaatcctaagattctgggtatgctataatgcctggaagtggtgtctcctctggggactgtgggctgtctggtgtgttggaaaccaaggtataccagcactgatcagaaggaactcgagcagcctgtcaggcagggctcctgggtcttatgttccattccccagtggtcctaaaatcctgggtgttctagggcacctgtgggatggaggacagtgggactgtctgatgagtttgtacccaagaaggcctgaagctggcccattaaattttcttttagacagaatgtactagggaaacatggctaacaacggggctcaattttgttagatcactgcttttgttctcttttaagtagacattaactattagttttatgaaaatcgatttaaaaggaattttccacaataatggaaattgaacctagatcctcacttctgttaggtaagtattctaacaaggagctctagccaaactccaggattttacaattttccttttaagaaaaaaagccagatcatggccgggcagtggtggccatgcctttaatcccagcacacaggaggcagaggcaggtggatttctgagttcgaggccagcctggtctacagagtgagttccaggacagccagggctacacagagaaaccctgtctcaaaa

SEQ ID NO: 3391 - DNA, 1200 bp, mus musculus
ttgactggcctgcagcaggagccactacaacatgcacgtatgtggtggagagttggaagagaaagagaagtggaacagtttgagcattatgaagtgaggtagaactggaagctcgagggtggagagaagtagcctgatgtgagcagcctgcgctgccacctgagaccatggtgaagtcccggcccacgttgctgctgagggacacgtctaggtttgtggccatgcagcagcaggggtctgtgtcactgtccatggagcatgttaccactatagatcatgcgaatgtccctggtctgggctgcagcctgggaccattttgatatcgaagggctgtgtagagttggccccaccccccactggctgccgcttttgggagagcaggccctagatctcacctgggcagcacagtaggggtggccctggtatcatgagcaagggagagctgtccctgccgtcatctgccttgagatggcacaagcactctttgccacttgagacagtcagagagctggcctgagggtcatgagagcaggagagctggctcagccccttgactgctcaggagagtgggccccacagctcacctgggcagcacagtagatctggctctcgtggtgtgggtgtgggtgggctggccctgaggacatgaaatcgagagagttggccctgcccattgctggctgtggtactggtgatctagccagggcaatgctggagagcttgatctggtggtgtgggtgcaggtgagttggcgatctgaccagttcagatacctctcaggctcagatccaccaaacccagggctttgagttggcttacaccagcatctacctttcagtgaactgcttgagcatgtgaaggggccggtcctgcagatccaaagctttaggacctccatgacataggataacaacaggatatctgagaagactcagtgaggacccagtattgatagtgtggcagaagccagaagcctcaaaccagaccaatgactccttgcaaatggacaggtttctgcaagtgaaattatgtggacaaaagggtggacagtgtgacacactgcagcttccacgatgagatgtttttatgctttgttttgtttttattttcttatcggggtgggggggagttgcaagagcagagggtggataggaagggatagggagatgaacagggttggagagcatgatgtgaactcac

SEQ ID NO: 3392 - DNA, 1000 bp, mus musculus
ctccacttacacccactgatcttggtggccatcccaaggtactggcatctccaaaatgtgggggtcttctgctgcaacgctttcactaatagcttctcctgggctctcttcatagactccagccctaccacacagtgccaggcctcagcttttctccacgactccttaatgcctccaaagacagcactacctggtgacttatactacagtgggctgccaagaggaggcgcaaccttggccactcctgggacgaagctcctgtgtgctgactctgggaaaacacttcccagacaatctggaatggactcttcaggcccagctgagcagcatctattaccccagcaaagcaaaggcacagattctcaactccaatggcctgggagtctttgcttccctctgaaacttcccaagccaggcctccatcgactgtactgctctcagcattgtttttctttttagatgtcggcatgtatatgagtacttggtctgcacgcactcttgcataccacaagagggcatcagatcccattatagacagctatagctgtgggctctgggaattgaacttaggacctctggaagaacagccagtgctctaaacccgagtcacctctccagccccagctctcaacatttcctatcttccccattcctacaagaacagcatggtccttccacaatcccaaacaacacgctcaggcctgtcacagcaataccccactatcctggtaccaacttgtcttagtttgagttttaattgctacgatgaaacaccataaccaaatagcaagttggggaggaaagggcttacacctccacaccatagtccatcgctgaagaaagtcaggacagcaactcaaactagacaggaacctgaagacaggagctgatgcagaggccatggaggggtgctgcttactggcttgctcagcctgcttccttatagaacccaggaccatcagcccaagggatggcattacccacaatgaatgggctgggc

SEQ ID NO: 3393 - DNA, 1000 bp, mus musculus
ccatttatgttgttcagagctggagagcaacctttctggtccttgttcttccttcctttgcactagctttgcaggggtaaggtggctaatttatacatcacaggaaataaaacagctgtgaatatggctgagcccagacatgtgtacagaactactggcagatctgggtagtgtccctgaagaattccgatcactgcaggaatggccatttctcccagggcagagccaattacaaagaatgctgcagatttcccagttaaggtagtgtactgctcaatccaggagatgccgctgggaaacgtggctgccattgaggctccatacacagaagtcgcgatccagagacaaagagggctcttgtcaaaaagcaccagaaagaaacatgagaccaggctgccaatgttgctcagcacaatcatggttccaggctgtaagagtgttgcaaagaagatagccaggcccctgcaggctgcaaaggttccccagaagatggagttcaagccagctgcctcactctcttccatgccaacatgggtggtggcgaaggagaatacgtaagagccgtatgttatctcagctcccacataaaagaagaagaagaggaagaggaggcatagcagggccctgtgatatttagcccttcgagctccctcagtagatgctctgggttttttctgccttgaatgtttcttacaaaacagaccaaacagaaagacagaaactactaaaacataggtgctgatagaagcatatgcccacagcagattcatgtcatcgggtaccgcgaacacggagcctgtggtggcgttggaggattggttcagcatcagagtgtcaaggtcggactcggtgtggttctgagcagatgctgttgtgccccaggccaacttagccagcaggggagccagaaaggcacccaaggcaaaactgaagtgcaaggcctgcatatgtggggctcctttgtccccccagagatccaagatgaggacgttcccaccta

SEQ ID NO: 3394 - DNA, 1000 bp, mus musculus
ttagagtttaatgaaaatgaagccatgcaacctcccacaagcctgaagcaggctgagccagaccttgactttgctaccactaaggagattacctagggtggagccttcctccctagattactctattgttcagccactgtcctcttcaatttactgctacctgatgagagaccctggagctattccggagactacggccctatcctgcacgtcatcacctgcagctggttccaggctccaaggatgaattggcaggaatgggctccccaccccacccccctttttaataagggcagtcgccattaaacatctgaaccttgaacagactagcatgtcttggctccattatttctcaacccgccaaggttccctcttttctttcagctccaggttgcctcccatgctcgaacccggacatgtgagccgctggctggctcgcaaccaagccacaacatacccaaccaatgggtcacaatgaaaaaagtcctaagaggaaaaatcatagctctgagtgctgccagagagagagagagagagagagagagagagagagagagagcatacactagcagcatgtcagcatacctaaaagctctagaacaaaaggaagcaaattcacccaaaatgggtagacagcaggatataatcaaactcagggctgaaatcaaccaagtggaaacaaaagaacaaaatgaactatacaaagaatcaaccaaacacaatcaacaaaatatttaaaatcttatccagactaactagagggcacaaggagtatcctaattaacaaaatcagaaatgggctctctgctcctccctgttccagaaacaaccgcatcttcttgtgcagtgccagcctcgtcccatagacaaaatggtgaaggtcggtgtgaacggatttggccgtattgggcgcctggtcaccagggctgccttctgctttccacatggcaaagtggagactgttgccatcaatgaccccttcattgacctcaactacatt

SEQ ID NO: 3395 - DNA, 1000 bp, mus musculus
gtgggagaattgagttctgatattgacatgtaaccttggtttctgttgcttttgttcttatgcttgcgtcccatcatctgattacctctagtgctacctgcctttgctatatctgactggaacctgtcctttctggatcctggttgtttcagaactcctcagagtccagctgtctctatgatccttttattccaggatcctgtgatcctgagattctgggtgtgtcagagttcctgggattcaagttctttctgggaccctgagatcctggtgtgaccaagctcctgttatcctgtgattctgagtgtgttagagagcctgggagtggagcttcctctgggtgttgtgggactggctacagagttcgtgcccaaggacttctcagggcattggcccagactggaaagctctctctctctctctctctctctctctctctctctctctctctctcaaagctggcatgatttatctctgtgtttttcctttcctgctggcctgacctaatgatgcattaagctgccatagtggtgcagaacttgttttcctttggtggtgatggggactgaacctgaatcactgtgtgtgttagacaagggttctactgcagttccagactcccagatctagcatgcacgtggaagcaagaggacaccctccagtgtctagccttctttttcaccttgtttgagacagattcttgttggttgccagtgtatatatagcaggctcagtggctaatgattctcctattcctacctcccatgtctccataggaacactaagagtacagatgtgtgctatcgttgctggccttacatgagtgctggggccttgaaccggccccatgctttctagggccttactcactgagcaatctcccagccctatagaacatattttttaatgtaaaatttgtgctgggatatttagagcaaccttataacttccagaaataagaaaccactcaagtgtctcttagctgatgaatgaacatgta

SEQ ID NO: 3396 - DNA, 1000 bp, mus musculus
attaagacgcccctccccccaaatgtgggtagcaccttctaatagcagcccagacacaaagggcattcattagcagtggggcagtatttgccagttggtgatttggccttgcctcttactgctgagtgagttgattttgtactgctactgtgctatgacttctttgctgatatcaaaaccagtgttgcctggcttccatgggtgactgaggaccagcatctctccagcaatcctttaggtcctgggtgagctttggactgcggagccacccaacctcaaacgcaagcaactacacagttctcagtctctggggtgtgctgcagctgatgttatgatttcaaagcaagacgacttaacagtctttgaacacattcatttgtcctattggttctgtgcctctacagctgtgattttcaatctgtgggtgcaacttcttttgtggtttgaaagactttcacagggtttgcccaagaccattagaaaacactgatatttacattaggactcataacagtagcgaacttagatatgaagtagcaacaaagatgattttatggttaggggtcatcacaacttgaggaactgtagtaggaaggttgagaaccactgctctagagaaagttggctaaaccacctctctctgatatgttggccatgagtgtcctagagcctccaaaaccaatacaggttatcttcattgttcttggttgcccaacagaatttgatgataagaccccattgctgaaaccaccacacatttcggtcacaggatgtggagtcttgaagatggtactgacagggagttatcctagctgattggctttcatagtacggtaaggtgctgtggagcttgctgcgggtaggtcaacaacagtccgttgtaacctccatgaactacgacgacgaccaatgtgtaatagctgtgctagcactgcagaggtaaccacccaattcctgcttggatctaagatctgctccacaggagaaaaagaaatgttta

SEQ ID NO: 3397 - DNA, 1000 bp, mus musculus
agctgtgtcaagttgacacaaaactagtcagtacagtggctcagtgcaccctgatagtttatggaggtgctgtgactggagcaacctgcaaagagctggcaaaccagcctgacgtggacggcttcctcatgggtggtgcatttctcaagcctgaatctgtggacatcatcaatgtcaaactatggacaatgcccatccctctacctgcctgcatagcatggactaggttgcccagaagtttagtaactgctctcactagtcacatgcttctgaggacatcatctgccccatcttgtggcctaatccacactgtaccttctggagccttttacagttttccataatggttgggaccaggctaatccctatcacttacaatgggtaggaacaaatatgtcaccaaggtggcttcctgggggagtggaaggagtagaactgactgtccctttaggccctaacaagtaaaattgccttccattggtttgggatggaaactcatcgttggaacacaggaagtgggcttcgtgtcactttggcctgtcacttagatggctttggttctagcttcactcccaagccctactggatgtctgaatttcagtatacatgagtgccgacatcctcttactctgagaggcctgggatacgcccctcccccacagtgccgaagccctagtattgtgtttgtgaaccatcctaacatgtaagggaaataaacacctgggcctaaaacaaacaaacaagcaaacaaagcttaccattttatctattttaatcataattcattaatgttaagtatatttacattttaagtacacttcttagcttgcaaaacaaacctcatgtctcctaagcagttttctattagtcctgcctgcaggccctagattcactattttgcatctgtctctttaagtttttacttgtcaccctgcataagtggagtcaaatagcatctgtctttgaaatttcagttgattgattgttttgagagtttcat

SEQ ID NO: 3398 - DNA, 1200 bp, mus musculus
acaatccaaaatggcggacttactattacttacatttaagatatttgccaataagggaactaaatgcatattgcaagatgttgctcggaaactcttaatatttatcaattaaaaaaagttttcggagtacaaatcctcatcaagaacccgcatccacttctcgcagttaacgctgctgcatttcttccccggttttatccttttttccaacaccaccgacgtctgtttccctcgcatctcttcccatcctgaattctaattcacaaactgaagtcacccagccagcccgagcgcgaaggctacccgacgcccgccggtacaaagcggccgggcgtgcggcgagcgcggagggcaggtgcgctcgccccctggcgggagcccgcactcgaggagcccgcaccgcggggcgagccgccgagaccccagcccgcaccgcccgcgccacccactccgagcccgcccgagccgcgcacggcgagcccgggcggccgcgctgaccgcaccgcgcccacccgcgcccagagcagggacccccaaggtgtgaacccggaagtacaagcacggcccgcgcctggagcgagagagcgggaggacggcgggctgcggcgctccgtcccgcacggcaacttgtcgcgggacctgtcacacccgccgctccgcgccacgccgcgcggcccttccgctctcctctctccctccctccccacgctggcgcctcagcgccccgctcctcagctcccagctccgctcgacgttgctcacgtgcgacacccgcacccgcgcgcaccccgggtccgcgcccgcgtcctcgcccgcgcggccggctgcttacctccgcggcctcatggtcgtgctgcccggcgcgctggcggaggggagagagagaaagggcggcggcggccgccgcgagcctgtcacttcctgacggagctcggccgcgagggccggcgcatggcgagccggagggctgtgcgcgccgagtgccagggaccgggcggcgtgggggcccgagcggctcgacccgagccctgcgtcaggccgaggctcgcgcacacctgcccgccgccgctccgagccgcgtcattggctgcccgcgcccagcgcgcgagattgaaccttccattcattccgggggccgggcgtgcgcgcgccgccgccccgggactcctgccccgagcgcgcgcgagcacgcgctcccac

SEQ ID NO: 3399 - DNA, 1200 bp, mus musculus
catgatccttcagcagcaggggtctgttaccaccaaaggccaggaagacatctttgttttggactgctgcctgggtacatgttgatatttgagggctgtgcagcactggccccatccctccccaggcatatagtgggagacctggccctgaataagtgaggactggagaactagccccacctcttgcctgctgcagcactagggggagcaggctttgcacctcacccagaaagcacagaagagttgactctggctacagcggttgcaggtaagcgaccctgagggtgtgagtgtgggagagctggtccttcaacttgtctgctgtgcagtggtgtgggagaaagagaaatgctcttccacatcccctctctgttcacccctcctcacctatggcaggtgagagaactggcccagggtcatgagaatgggagagcagatacttgtctctcacttgggacagtagaagtgactctggtgtcatgggtgtgagtgaacaggctctgaggacatgagcatgggagagcaagccctgccatttatgctgtacacatgggagagatgccccctgcccataccacctatacagcatgtgaaagagctggttggaaggtcacaagcatgggtgagttggccctgttcctcactggctgcagcacttggagcagcaggcccttcacctcacctgggcaatacaacagtgataaccttgctggcatgggttagggtgagctggccctgagagtgtgagagcaaaactggccctgcctcttgctggctgcagcactgggtgtgatagtcagggcagtgttggagtgctcactccagtgatgtgaatgtgggagagatggctccacccaggctcagatccaagggtttgtgttggcttgccgtagcatctacacatctatgaactgttagagtgccaaaatgggcacgtcttgcagttccaaggcttcaggatctccacgacccagggcaatggcaggatatctgagaagagtcctggtaaggatccagtattgataatgcagcagaagccaaaggcctagaaccagaccagtgactcattgcaatgaacacctgcaagtaaagctatgtggagaaaagtatatactgtgggatatgctgtcacacattacagcttctacaatgagattttatttattccttttggcggagggtggatataaagagacagga

SEQ ID NO: 3400 - DNA, 1400 bp, mus musculus
cacattgaatctgtaagcagcttttggtaaaatggttgttttcactaatacctggtgagcagcacaggaaggtaggacatcattcctggagccatggcacctcatgccatagaagtggtggggtcagctttcacttgctctgtccaaaagactggctgaaccattctactattgagctgtccagcaaggtacagcacctgatttccagagtaatgcagctggcaatgattagggccagctgacccactctcatgattctggggctagttctcctgattgccatggatggcaagatggagaagagggacagcattacctcatcaagggagatgagtagtgggggccagctctcctgggcactttcactcttgggactggatcactagcacccctgccaacagggccagctctgatatgcagtacagtgaggtacagggctcactttcccaacttctgtgcgtggcatggggcaggactagcttcctagagcttgtgagcctgtggacatctttctcagctgatggagatggccatgggcatagaagagcagcatgtctgtgcccatgccacccaagagcagatgagttgcagtgccagctctcccacactcatgcccttggagcttgctcatccacagctctgccatcatggtcatctccactgtgccacctggatgaagaacaggcctgtgctcctgagtgctgtctcaggtgagagatgaaaacaggtctctagtatgctacatcccatgaggggtggggccagttattcactgctcctggacatggtctccagaagctgccctgaccaaggacatcctcatgttctctagtggtaatttaagccatagacattgaaactgacccctgtcactatgtagccatttattcagagatggccctcagcagcagttggggctgagacctcaccatgtgccagagatggctattcacaacaggatacttctctcctgcctcaaatacccagttccatttatcttcataatgctcaaactcctcaacttctcttttctatctgaaaaccacaggctgaaacattctggcagctcaggctgtaagctggccacatggctgacagtcccctggtgacaccctccatcagtgatgtgtggtgtggcagtgtaacagcaagcaagtgcccgtagcccaactgtaccctgtgttggagggcagatctgtgggtgacatggtgatccacatgtttgtcttcctcgttctgcattgcactccctggatttgatttgatttgatttttatgagtcctgtgcagaaaacagctttggccaccaagctaggcatcaagataggataaacaaaggactgccatcttctctgcccctaacatagagttatctcaggttttctgagtgtttaacattg

SEQ ID NO: 3401 - DNA, 1200 bp, mus musculus
tctttttctatttccatttttagatcttggatggtttagttccctttacctgtttgattatcttttcctgtaattctttaagggatttttatatttcctctttaagggcttctatcttttcacctgtgttctcctgtatttctttaaggaagttatttatgtcttccttaaagccctctatcattatcatgagaacggattttatatccgagtcttacttttccagggtgatggtgtatccaggacttgttatggtgggagaactgggttctgaagatgccaagtaaccttggtttcttttgttcttttgcttgcctcccactatctggatatctctagtgctacctgccctcactatctgactggagcctgttattcctgtaatcatggttgtatcagaactcctcataatctagctgtctctgtgatcctgtgatcctgagattcctggtgtgttagagttcctgagcctcaagcttcctctgggacctttagatccttgtgtgcctaaactccttggatcctgggatcctgggatcctgggatcctgggatcctgggatcctgtctgtattagagtgcctgggatttgagtcttctctgggtgctatgggactggctgtagagtttgcccccaagttaaacccgcagaaactgaaggaatccaagccactggttgggtggggtttctgtatcctgggatcttgctggttccagttactcttggtgttttgggaacagatgttgtgtcttactcaccctgatcctagatcctgggcatgctagagagtctgggagtggagcctcccctgcatactgtgggactagctgcggagttgttgcccaaggtaaactggcacagactagaaggaacctgagccactcaacaacttatttctaagggcgtactacatgcccatcaacatatggtaagcaaaatacactcagtagcatctttgaaggtttattgactgataatgtggaccatggctttacatttaaattttacctttttttgtatatgtatacacatatatgtgtgtgtatatacatatgtgtatatatatatgtatatatacatatgcatatgtatacatacacacacacaagtatgtgtatatatatgtatatatatatggagatatatatatatatatatatatatatatatatatatatatatacttccttctctcttttg

SEQ ID NO: 3402 - DNA, 1000 bp, mus musculus
tgctgagtctgctttcttatagagccagtactaccagctcaggggcagaactgactaaatgggccggccctgcacctatggatgatgaattgacaaaatgccttacagctagttaaatgcctcttggaggcatttcatcagccgagtcacctactttctcttaggactctagcttgtgtcaagttggcactgaaagacccacaacatgaggactcccccacgttctgactcaggagaggcgacaccccaaaatcacaaacgagaaacggtcttcctgcaaattgcaagaggatttttattcaagagcgctctcgggcccacggtcatacaccacgcaggggtagaggactgtggcgccctaagtagctggataagagggtatttaaaggaaggaaccaaaactcaaggaggtgggaagggcgttgttggtaaataccaaaaataccagttaagagtcacaaggaagtacaaagtcacaagtgtcaggttatctctcaagacagtttctaagagcccctaacaatctaagagcccctagcaatagcacctttgcatagtgggttccagtagtggtcagggtgggtcagggtgactttctttgaatgaacactctttgaacccaggaagcgggtgggtggaggaatgtcactatctgttttatgacaagcataccttggagcactgagtttactactctttcagcacaaaaccaatcagtagaccctttcctccacagtctcaaaaataattgtagaagatggtggcagaaaaattattagttacaggggtagtggataaccataactgtagaggatgaaaaggccttgtacacacagataagcactggacaagccaggagcactgcatatctttccaatgaaatgaagtgtatggaataccaggaataatgtagctttacgacttggtgatcctttgcagtctaatgagacaggctttgcctgtatcttccagattatatttattccagacaatatccttt

SEQ ID NO: 3403 - DNA, 1200 bp, mus musculus
ctcaacttcagtattatgaaggccatagcacacattattttgtccataacacccaccaagatactttattaaatcctcagacagcatctgttaattcaaaaccatgttacaagcaggcctatccatggaaactcaataatatattgtatctctagcccatgactatccttttgtaaacactgtaaaaatgtgtatgtactgatcctttttcctggtaggtttatcttctataacatagaaacatctttctctagtacctgtgaactatatcttggacaagtaggcaacatcaagaaggctagaatctatctaccagtggccctggaagggtaggatctaactttataatccacatttagccaacataggtgacctgatcacatggaacattcccacttaaccctccagttttgttcttttctcttaccccatgaaactttctgcctttaatgtgtgtactgttgaacaaagtccatatagaagtctatttcctcctttcagtactctgaagaaaagctttcgtttttgtcttaaccagtatttagtgaataattttcttttcataatggcaccttgatcattgtagtccctggagacaatccaataatccttgattccccactatgtctgttgatatgctaactgtggtgatttgaatatgcttggcccaggtagtggcactattaggaagtttggcctcattggagtaggtgtggacttgttggattaagtgtgccactgtggggccaccttgtagatgctcctcatagttgcatagaagtgagcttactgtttgccttaggaacaagacagaactctttccacatcatgcttgcctggatgctgcaatgctcctgccctgttgatgatggactgatcctctaaacatgtaagccagacccaattaaatgttgtcctttataagtattaccttggtcatggtgtctgttcacagcagtaaaaccataactaagactccaactttttgctttcttgaaggtacagactatttttttatcgttggtatgtctaggatagtcactatggtgtctttgcatgatgttccttttaaagtagatggcaaagcactatctgaagtgattttagtaatacaaaaatgatactgtttctattttgcttacaatcaatcactaaatcctgattttatcttaagtaaaaccccagtacttaatagactaa

SEQ ID NO: 3404 - DNA, 1000 bp, mus musculus
ttcctcttctgtgttctcctgtatttctttaagggagttatttttgtccttcttaaagtcctctatcataatcatgagatgtgattttaagttagtgtcttgcttttctggtgtgctgggtatccagggcttactgtggtaggaaaactaggttctgatgatgccaagtagccttagtttctgttgtttatattcttgcccttgcctcttgccatctggttatctctggtgttagctggtcttgctgtctttgactatggtttgtcccccctgtaagcctgtatgtcagtactcctgggagaccagttctctctgtgaggattttgggtatggagagctgtggcacagggtcaactccatggtgcagatagaaaccagaaggatcctgacctcagctattcttagttcctgtgttctgatggcactgggagggtccctcttgggccaagaatttgaacagaagtggtgatcttacttgtgggcactccccagctccctcgtgctgtggcgcagaggaaaactggaaggctcctgtctcacgttgctcctcggttcctgtgtactgagggttctgggcaggtccctctgagcagaagtggtggtcttacttgcgcttataggcttgtccaaactcctgggaggctagctttctcccagtggtgtttaggtatggagattgtggcacagcatcagctctggactctgtggcacaggatcagctctgggtgcaaacagaaaccggaaggccgaagggatgatgctaaatctcagttgtagtaatctgttaagcttaccttgagaattttagaaaatataatgaaaatcatgggcacacacatctatatgcagcccatcccgcttcccagggatcaatcatttacaggaagaggattttaaattcctccagcaatttcttttcactcacaaagcaggggaaacttaaagtagcattactgatgttagaaaatatttgatactatactcacataagaaatgttaa

SEQ ID NO: 3405 - DNA, 1000 bp, mus musculus
cactgactgctgaaagttctgaactcggtgggggagtcgggtccccgtacgggccaccaattgtcgcgcccgctctcgaccagcaagaacgacacgaccaccagtccttctaacagcagtttattccgtcttcatctttcttctttctcttcatcagtaccattccccagctgaagagttctgaatccacgccggatccttctcaacagtctgttttacgggaacctttattaaccccttcttccccgttatgcagttctgaatcctccctgtagcagggggtcttcgctcgtgcctgaagatgtttcttgttcccgggtttcgggcaccacttcttgcgcgcgctcaactcgccagcaagaacgacgccacagcaggatccttctgcacacgtttattcagtcctgtttcttctttctttatatctcccttgtttatatatctcccttgtttttatatctcccttgtttatatctcccttgtttttatatctcccttgtttttatatctcccttgtttatatctcccctgtttttatctcccttgtttatatctcccttgtttatatctcccttgtttttatatctcccttgtttttatatctcccctgtttatatctcccccgaaccctgggcctctcactccttttatactctctctcatccacgaaccgcaggccatgccccctcgccagtcacgaggcttcagctaatcagggcagcaggggcaaatctccaccaaattggattcacctgtatcctggtacacctgcgcagcactcaagatgtttgtgtcttatatgaggaagtcaggtgcaagtcatatgacttagctgcagtccctggcgcctttgggactgccgccacacccgctccccacatattttcaatatcattttatgttacatgcctaaaagtcaattatagcaatatactaactattgctttgtaatgaaacaataaatacaattctagtaaaaagtgatatgataatctgttag

SEQ ID NO: 3406 - DNA, 1000 bp, mus musculus
tctgtaataaaagaggggttgaaaagaaaaagaggggcctggagccaatcgtctgccataggatccataactaaataatcctgggagagagcaagcctagcaggaatgcaaacagacctgtgagcacaggtaggaccaccactgctgctcagaggaacacacctggaactctcaggacacagaaactgaggagctgactaggacagggggcttccagtttccatctgtgcccaaacctgatcctgtgccatagaactacattacaaaaataccacctggacagagctggtctcccaggggtgcctacacacctgtgacaacagttaagaccaccacttctcttcaaattcatggcccaagagggaccctctcagagccataaggacacagtaacaaaggatcaattgggaacaggatccttctggtttcttgttggggaccagaagccccaagcattccagtattgtccttaggccatcacctaagactcatttgcttcttccactattttggttacattttgtaattgagttgaggaattttacaattagggcattcctttccctttacaatgagggcactcatttccagacctttcacaatgagaatattcctttccagacctttttataatggggacattcctttgacattaatgtgttatctagccccacagatttggcctgtgtacctgagcaaataccttttgcagttttcatctttaaaagccatccatttcccaagaataaacaaggattgaacaggattttcgtcttgtctctttccatcgtgtcttctgatcaaaaaatttgtcattgcagctcgcttctctccagaaccctgttgattaagccctgaaggttggggcagtttctgcctacaccccagagctgacactgtaccaaatctcttcatacctaaattcctcctggagagaatggtctcccaggagtactgaaaaacaggcttgcaggatgaacaagccacagtcagagacaga

SEQ ID NO: 3407 - DNA, 1200 bp, mus musculus
agggtttctatcttcagagttgcctcactttcacttttctttattgtatctacctccctttttatgtctagtatggttttgttcatttccatcacctgtttggatgtgctttcctgtctttctttaaggacttctacctgtttggttgtgttttcctgtttttctttaaggacttgtaactctttagcagtgttctcctgtatttttttaaatgagttattaaagtccttcttgatgtcctctaccattatcatgagatatgcctttaaatccaggtctatcttttcgggtgttttggggtgcccaggagtggctgaggtgggagtgttgggttctgatgttggagagtggtcttgttttctgttagtatgattcttatgtctgccttttggcatctgataatctctggagtcagttgttatagttgtctgtggttagagcttgttccttttgtgattctgttagcctctactagcaaatgtgggagactagctgtctcctgagtttcactggttagagcactctctgcaggtaagctcccctcttgcagagaaggtgcacagatatctggcattaggacttttctcctggcagaagatgaaggcctgaaacagggcctgtcccagaagccattagcttctgtagtctacactcttacctatgcagactagtctcagtaggatacaggaaccaagatgtctcccgcacatgcttctgcaactccctactttggcagggcggacacctctcctctggcagggaaggtgcccagatgtctggagccagaaagggggtctgcctcagaagttctgtggctcctgcctgtcccagaagctgttagcttctgtagtccacactctcacctgcgcagactagtttcggttggatgcgcaaaccaagatgtctcctgcagatgctcttaatgactactcttattgatatttcttacacatctaccttgttttgttttacatcgctttacattacattttgttttaattttttttgttttgttggtgctaatggaacccgattttatgtaatttaatgatgtatagtcaattaaaatattatgcataatctataaatcagcagcttacccactgatgcaatatacatttaattaatatagtcccttcatcaaatagcagtctgttttatgtcatgttgctcagattcttcattgctacaccaagtcac

SEQ ID NO: 3408 - DNA, 1200 bp, mus musculus
agttgacataaagccaagtattaattatgtttgtgagtgtttgaaagcgaagtatgaataaaagatttttaaaagtaggtgtaaggggtgaggaagagagtagtacagacaaaaactttcttaaaattaagtgtaggtatgtaggtaattatccttccagaatatgctatatacattcttccctgattacaattatagtgggagtagaatgtggggttgtgagctgtgcccaaccacctggtccctggtcaagcacatgccttgaaccccggagacccagtaggtgacatctgccttgggctcttggctcctgtcacagttacagcgtcccacaggtccccacagagaggcatgtggccattagtcacttaggagtagcaccaagccctcccacttaaatataaggattccccaagctctcagaacaagccaatgagcagtacctgttgtcagacccttacctgccccaaaactgtatataaggatcctatctggaaggattaaaggtatgtgagaattactccatcatttgagagcttctgtcataagaactgtaacacttgggaagagttctgctccccccaagtgctgtctgaagctcccctacactccacactcgctagttggcttttcatcagcccaggcccaccctactcagtacagggcagcatggagtaaccaagacagtgagtcagagacaggtggagccaactgcagcagagggaaaggcagaaacaacttcccctccctacttacactcgctcccctttgccagaaatcttgaacccaacttggtcagagatctctatggaaagcctccagtacacaggctcatagtaaagaatgcttatctcaagctgaaccccttctcccgctaggtatggctcatagaaaaatgattgttttttggtttcagtttgttgtcgttgttgcttgttttgttttgttttgttttttggttttttttgttttttgtttttttttgttttttttttttttaggtttggaatattcaggatacaaaattccagcccagtaggagatttaataaataagttaatatgtttatagttcagtagccttgaagtaatgctgaggagtcattcatcctcttgaaactcttagatgtgcagacagtgcaataggatgagtacatctcatagagactgagagttatacagatctgaattaatgtcctgt

SEQ ID NO: 3409 - DNA, 1200 bp, mus musculus
gaatctctcactgatcttcttaaaaccctttcctgcattagattgtcattaacagggaggtcacaactggtcaaagtggagagaacaagagactatagaatgctcagccataaatattacatgtctaacacactccttcctcctacgactcaaggaatgtgttgcaggagtggtaacccttaaggattggaagacccagatgtaatggatgactacaaggaagcagtgttacagctaagaactcacaaaacttttgacaatatacataagacctgtgaaataccgactaagataacaatctcatcatgtactggggaggtatgcatggaaagcataaggaacaagggtcaattgttgactgctggaaaaggaacatttaattttctttttctgtctttttaaaatttctctctctctctctctctctctctctctctctctctctctgtatatatatatatatatatatatatatatatatatatatatatatatatatatattttatttttacactccagccttttttcccctgccctgtttggccttctgactgttcctcatcccttacctcttcccctacaccctggctaaaagaggatgtccccaccctcaatctccaatcccaccatacctcctcactccctggggccttaagtctctctagggtttggtgcatcttcactcactgaggccagaccaggcagtcctctgctgtaaatatgtcaggggcctcatatcagttggtgtatgctgccttgttggtggctcaatgtctaagagatctcactgttccaggttcattgaaactgctcatcttcttatgagattgctcttctcaccttcttccagttgttcactaattcaaccacaggagtcgctgtctcatgtatggtacctcacagatttgactagacttctgcagtaggatacatatccaatagtgcttgtaaaagcaagcacaaattgaactctttagaacacaaaagaagatcacataatggtaagtaagttgggaagggagggaatggacttcggagaaattgatgaaagaggagtatgtaaacaaagtgtattgtacaacaaaatgtggatcaaataatgaaaatgtagtaaagttgaaaatagagtttcaattatctgtaaaggaatataatttgagatctaaaaaaaaaaaaaatacagtaagtgcagtaaccc

SEQ ID NO: 3410 - DNA, 1200 bp, mus musculus
tggctattaataacttgggaattctgagttttgcaggcaaatggatggaactagacaacatcatcctgagtgaggtaattcagaccccaaaggtcatatgtgttatgtactcactaataagtagatattaggcaaaaattttttaaaaagtacagaacacctaagatacagtccacagaactcaaaaatgtcaacaagctgaagggctcaagggaggatacctcagtccaacttgggaggaaaaagaaagcaatcacaagtggagaggaagggagggacattggagggaatgtgggtgtggggtggggttggagaaagaggaacctgatctggtattagatgaggaaaaagacctgaagtcctggaagccagcagaaagaacagaaacaggaaacctctggaggtaggaggttggggggaaccctccagaatacaccagagacgtgtgaagtaagagattctcaggactcaaaggtgggaccttagatgaaatgccctacagtagggagagggaacatgactatattccagaagacccaaaactcaaaactaaaagagtcagtgagcagatatttgcacccaaccaatggacagaagctgcggattcctgcggttgaattagggaaaggctggaagaagctgaagaggagggcgacccagtaggatgaccagcagtctcagttaatctggactcccaagatctctcaaacactgggcaattgactaggtaacatacaccagctgatatgagacccccaacacatatgcagcagaggaattccaggtatgggtttagtcagagaagatgtacccaaccctcaagagactgaggactccagtgagtttagacacctgggtgggtggtgaggaaatatggagacagtggggtggggaggaggtaggggatgtggaacaattagagggtgggactgagccagggagaataaagtctggaatataaataaatagatgaataaatgataagaaagaaaaagaaagaaagaagaaggaaggaagaatgaaggaaggatggaaggaaggaaggaaggaaggaaggaaggaaggaaggaaggaaggaaagaaggaaggaaaagatttaaagaaagaaggagaattaaagaaagaaggaaacttagaaggccatgggttccagatcaaggaacacagtgcacgctgaagacagaaaatgtctacccagac

SEQ ID NO: 3411 - DNA, 1000 bp, mus musculus
tagagtaaaatatcatattatacaattatattaatatgaaagatagaatgtatgtagttgaaatcaagccacagctattttatgtaaacatatacctgcaaatacatatacaaatgaacacaaccttataaaacttctttacttgaacaagtgcatggtttaaaattatagttaaataggtatatgttgccacatagagttcaaggatattgctaaatgtgtgaaatgagtaaaaagtgtgttattagaaattaaactatgtacatcactttgctacatttttcaactagacatgcctgaattctatctcatgtattcattagaagccaccttctaatgaaaaatatgtacttgatattttgaattattttaaatttctcagaaatacaaataaaagtctcttttagaaagtgaaggagtagcctagagttcaggaagacttaagggaattaatagctgttgttagttaaatgacaagggacacatagggctcatatatatttagtgctcagttggtggattgttaaagaattgagaggagtggtcttgttggaagatgtgggacaccgaaccctggctttgtggttccacaatcccaaacaaggacaagcctgccttgttctttcttttcctcctgcctgtggctcaggttgtaagctttctgctattgcccaacatctgttctgctgtctatcaaaatgtttcccactatgataatcataattaccctcggactatggaagaaagcagcttattaaatgttttttttttaatttatatatgtcaacttggacatggagtctcttcagaccaatggaacaataactgagagagattttataaagctcccaatcctacctctatgttttctgtctcccaggctgcataaccttgttggactttaacagacaaaggcaaacatggagagagaaggaaaatcatgccaaccgtggctcaagtgtccatccattcaccaatttctaaaagtgtcatctttgtt

SEQ ID NO: 3412 - DNA, 1200 bp, mus musculus
tttttctatatcccagaattttatacagtttccctctacaatttgcacaaaatccatgtatgttgttataagcttttaggcaaattgatagtcttaaaatcacagacacactcaagtaaataaagcattaatctaaaaatagttaaattggtcacataactattcagcagtagaaaatttaaaaaaaaatttattggctattttctttacatttcaaatattatctccttttctggtttcccctctgaaaaacaccctcccactctcccctctcccttcccatggctcaccaacctaaccactcctgcttcctggccctggaactcccccacaatggggcatacagccttcataggacaaagagcctctcctcccattgatgtccaactaggtcatcctctgctgcatatgcagctggagccatgagtcccaccatgtgtgctctttgactggtggtttaatccctgggagctctgggagtactagggctgactcattggcaggtagcatgtagaagaagacaaatcgacccattcttatctccttgtgcaaatttcttttcaatgtatataattcttttagtgtgttgtggtctaatagttgttttaggttaatttgtagtttgtctattgttgcaatgtcctttggatttaaataaattgtttctacacatggttgagcaaaaagattacagatcccagaagtataggtagaatgagacttagagctaatagttgaagcattaaggaatactgccccacctggggatccatcacaaaatcagccaccaaacgcagacactagtgcatacaccagcaagattttgctgaaaggaccctgatatagctgtctcttgtgaggcttgccagtgcctggcaaacacagaagtggatactcacagtcatctataagatggaacatggggcccccaatggaggagctagagaaagtacccaagagctaaagggctctgctgctccataagtaacagaagatggcctagtcggccatcagtgggaagagtccccttggtcttgcaaactttaaatgccccagtacaggagaacaccaaggctaagaaatgggagtgagtggttaggggagctgggggaggggtagggtataggggaattttgggataggatttgaaatgtaaatgaagaaaatacctaatgaaaaattgggaaataaaaaagaaaa

SEQ ID NO: 3413 - DNA, 1400 bp, mus musculus
acttccctttttaggtcttggatggttttattcaattccatcacctgtttggttgtgttttcctgcaattctttaagggatttttgtgtttcctctttaatgtcttctacctgtttggttatgttttcctgcaattctttaagggaattttttttcctctttaatgtctttacttgtttagcagtgttctcctgtatttctttaagtgagttatttaagtccttcttgatgtcctctaccatcatcatgagatatgcttttaaatccaggtctagcttttcaggtgtgttggggtgccctggactgggcaaagtgggagtgctgggtctgatgatggtgagtggtcctggtttctgttagtaagattcttacgtttacctttcgccatgtggtaatttctggagttagttgttatagttgtctctgtttagagattgttcctctggtgattttgttaccctctatcagcagacctgggagactagctctttcccctgagtttcaggggtcagagcagcctctgcaggcaaggtctcctctttcagggtggtgcacagttatctggtgtttggacctcctcctggtcgaagatgaaggcctaaaacattatctttcccagaagctgttttgctttggcctgtcacagaagccattgtttcagtaatccacactctcacctgtgtagactactttctgcggagtcccggaaccaatgtggccccccgcggaacctgaggcagaagcctagggaaccaaggtggcttctgaggaacctgagtcagaagcctagggaaccaaggtggcttctgtggaacctgaggcagaagcctaccagccgcgtggacacctgtgctctgaccaggaaggtggccggttgtctggagctgaaaatggcaccgcctcagaggctctgtggctctcgcctgtctcagaagctgctggcctctgtgtcccacactctcacctgcagactgcctgccagtcccggaaccaaggtggcttccgtggaacgtgaggcagaagcctctcggtctgggcggacacctgtgctctgacccagaaggtggccggttgtctggagccgaaaatggcgccgcctcagagttgagtttttttctgacaagtcttcttgtaacagatttgtagaaccactgtttgcccgtggattttcatacagaccatcccatttcaaagaaggacacattttctgtctcaccagccttgtacactgccactggaattccagacaagtattatgttggcaaaaatatgctgttctctaaatttttcctattatgaaatggatttccacaggcactgtactagtagtagttttgttgctttagaatggtttttaattttcatggtataaacattaaaatctttgaatttatattctt

SEQ ID NO: 3414 - DNA, 1200 bp, mus musculus
atatctaactccaacttctcagttaccctatctgcaaacctgctccccctattccatgacatataacttcgtggttacccctccatcaaaccccagacatatccaccttccatcctcccttttcctgtatgcgggtgcttccccacccactcacattctcgcacttcatcactcctgcatcccccaatgcttggacatcaaacctcactgggaccaaggaccacccctctcactgctgtcaggtaagaccatcctctactacatatgtatctggagccatggatccttccgggtacattcagtggctggtggtctaaagtatggaagaactgggtagtcaggcaggcctatgttgttcttccaatgggatttgtatcacctctacttctacaatccttcctccagcaaccccaccaggttcccttagctcagtctaatggttggctccaagcatccacatctgtattggttagttgctggatggatttctcaaggaactaccacactaggttcctgtcagcaagtgcctcttgactacagcaacagtgttgtgtttggtgtctgcagacatgatggatccccaggtggggcagtcccggattgtcccttccttcagtctctgtttcattttttgtccatgttcatctttggacaggagcatttctgggttaaaaactttgagaagggttggtgacccgcatcccttaaccaggggccatgcctatctatggaagtaatctcaatgggctctatctccccccttttattcacgtttctgctaaagtcatccccactgggtcctgggaggctcatgttacccttttgactgtgatcctccagtggctatccccagttcctcattccccctgctacctatttttgttcgatttcctgaccctctgtaccactctcacatctcttccagttcctgatactaccccccttatttcctccccctcttctcacccttctaggagctcttgactctagctgcatatgtatcaaaagatggcctagttggccatcactggaaagagaggcccattggaattgcaaactttatatgcctcagtacaggggaacaccagggccaaaaaggaggggggtcatgagtgggtaggggagtgggggggagggtatgggggacttttggaatagcattggaaatgtaattgaggaaaatatgtaataaaaatattt

SEQ ID NO: 3415 - DNA, 1000 bp, mus musculus
tcctgactatactctcattttgcccactgccatatgatagaattacaaattatcaagtaagaattcatacttggagaggcttctgcctcaggttctggagagccaccttgattccaggattccgcaaagggcagtctgcacaggtgagagtgtggaatacagaggccagcagtttctgggacaggcaagagccacagaacctctgaggtggctccattttccgatccagacaaccggccaccttcctggtcagagcacaggtgtccccctggcccgagaggcttctgcctcagattctgcggaagccaccttggttccgggactccacggaaagtagtctacacaggtgagagtttggactattgaaacaacggtttctgtgacaggccaaagcaacacagcttctgggaaagatcctgttttgggccttcatcttcggccaggaggagatccaaacaccagataactgtgcacctccctgaaagaggagaccttgcctgcagagactgctctgaccactgaaactcagaggagagagctagtatcccaggtctgctgatagagggtaacaaaatcaccagaggaacaatctctaaacagacacaactataacaactactccaaagattaccagatggcgaaaggtaaacgtaagaatcttactaacagaaaccaggaccactcaccatcattagaacccagcactcccgcttcgcccagtccagggcaccccaacacacctgaaaagctagacgtggatttaaaagcatatctcatgatgatggtagaggacatcaagaaggacttaaataactcacttacagaaatacaggagaacactgctaaacaagtagaagacattaaagaggaaacacaaaaatcccttaaagaattgcaggaaaacacaaccaaacaggtgatggaattgaataaaaccatccaagacccaaaaagtgaagtagacacaacaaagaaaacccaaagtgaggcaacactagag

SEQ ID NO: 3416 - DNA, 1400 bp, mus musculus
ctctatatatattaagtacaatccccattaaaaattttcacaaaaatttgcatatatatgtatatgtatatgtatatgtatatgtatatgtatatgtatatgtatatatttttcaaaatttacactgaaacatggaagaaaaaagaatacgcaaagcaatgctgaatgattaaaaaaataaacaaatgaagttgctatcatcagttacatcagttactatagcaataaaaccagaatattgtaggctaaagaacaaaaaagaaaccgggtcaattactgtggagctgtgggtataggggaagagggggaaggaagagaatgcgcccatcctgctagagttccagtgctctgggtaggcagatgctggacgctttccacgtgaccccggatgggcatctggctgtgtgaagccactgaccccacatgcctgggggtggggtggacaaggggcagccctcagtaccaggttctcagtctctgacatcccttactgaatacagcagaggagctgagtacagaataggggcccagaggcagcaataagccccggagatatggaaagagggtcagggggaaagaggagggtgctgggtagttcccacacaggtgagagtctttagtcctatctatggctggagcacaaaaaggccttctgacggaaggttagaagcaggctcgttagaagaaatcctatctttttaaaatattttattagatattttctttatatgcctttcaaatgatattctgataattccctataccttccccctgccctgctctcctacccatccactcccacttattggctctgtcattcccctgtactggagcatataaagtctgcaatacaaaggggcctctcttctcagcgatggccaactaggccattttctcctacatatgcagctagagacaggagctctggggatactggttagttcatcctatcccatcttccaagcacagcgggccttgataaacagagacagtcttggttttagagatttattgtagaaaggcagggggaaagagagaagataaaagagagactgtccatggccaagaggagagaaggggaaggaaaagagaaaaagagagttagagaagtaagaaaggtgaaggcttagagaaagagaggtaaaagcttagagagtaaggaaggtaaaagcctaagagagtaagagatcgaggaggggccaagcagcccctcttacagtgggttgcttattttgctgttgctaggtaactatggagggaaatctagcttgaaggccagaaacttgggacattgtgtacttgactgaaagccacatgcttttgtgggggctgtgggggcagtaacttcaacaggagccagggcccaagagacatgagggaatgccttctgtcccatgtag

SEQ ID NO: 3417 - DNA, 1000 bp, mus musculus
caagatgtaggaagtgttcaccaattatatgtcattgaaaagaatcttgtccttggcctctctctgcttcaactgctcacaggtgaggcactctgtaccacctccagcttctgctcgagtgtccaggcttaccctaggccaagcaatcacaaattgaattctttgaactatgaggaaataactattcctccatttgaagtcacatatgtcacattaaatttcttttgaaaaatatcaatgaatacctgagtcttacatgaagtttccccagctaagacactttattagtgtaataattaagttccattcttaattatttgtatagctcatatcttgtttattttaatgttaccatatgtgtaaacttgtcatgcctacaggttgttaagcaaggttatctcttaataattttctgcgtgaaccttaccttagttaggattatactactgtgaaaagacaccataataaaggtacctcttgtaaagatgacatttacctggggctggtttacatgttcagagagattaagtccattatcatcaaagcacttgcatggcagcatccaggaaggcctgctgcaggaagagttgagaattctccattttgttccaaaggcaaagagaagactagcttctaggcagctagaatgagggttttaaagcccatgtgcacagttacacacctactccaacaaggccactcctcctattattgccactccctcagccatgaatattcaaaccacagcaaaccatttatttttcaggagaatgatggctagactagcagagtttgtataggcagacctagtttagatggctgataacagaaactcagggttcatctaaaatttttttcaatgtattttattttctataataatcaacatgactgtattgagaactggatgaaaagtgaagcaaggcttgaattgtacctgtgtttcccttgagaattaatgactgattattagaaagactgacaatggatattgatagta

SEQ ID NO: 3418 - DNA, 1000 bp, mus musculus
ggatcagatgtagggggagaaaaaagaaaggagagtgaatggaaattgtcacctggctggaggtggggggatgacagtttttttagacatgccaaagacctgggaaaggctcataggagtctgtaggggtgactctagtcttgaccactagcagtgtaggatgtggagcctgaactgggcaacccctatcactaggcaggactcccagaggaggggtaaggacaacaatctacccacaaaatcttcaacctcttgcttttaagaagtgcagggataaaaatggagcagtgattgagggaatgaccagccaatgaccatctcaacttgagacccatctcatgggcaaggaccaattcctgaaactattaatgatactctgttatgctggcagacaggagcttggcataactgacctctggctccttctcccagcatttgactgaaacagatgcagaaacccacaaccaaatattgttcaaagctacagaaaccttgtgaaagaattgtgagaaaaaaatttaggaacccagaggggacaggaacttcaaaaggagaccaacagagtcaactgctcagtatctggaatctcacagagactaaactacaaaaaaaggacatccaggcactgaacctaaggccagtggcacatatgtagcagataagcagcttagtattcaagaaggtcctccaacaactgaagcagcggctatccctaaattttatgacttcctagggaatcctgttctcattaggagagggtctaatcctgcatggacttgatataactgggagagtggtacctgtgggtaggagctctcccttctcagagaggaaagggaggagggtgtgggagtgtaaggagctctgaagaggatccagggtgggggattgggaggaacagtgaacaaataaataaattactgaaaaaatttcaacaacaaaaacccagaaaaggtaaaataatcctgtataaaagaacatcttaaggtatcgccatact

SEQ ID NO: 3419 - DNA, 1000 bp, mus musculus
tctcttctgttgaaagattacaggtagtcagtagaaaaactgaggtctttaatatcaatgtctttcatcacataagaaacagttgaaatctttttctcctgtttcataaagaattctctgatatcaatgtttttcattacataagatgcagttcaaaccattttctcctctttctcttatgaggaattctctaaatcagtcaccttgtcatgacctatgttcctgttgttttactgcagtctttttcttctcttcacacatcactgtctgcttgggtgtccaaccccgtcctctctgacttctccttgttcttggacatgctgtgctaagtactttaaaccttaatgggaatctaacttatttattgcctcactataaaatacaagtttcattcagaaaactccttccacagcctacattttctttattcaattttgctttattccctcagtgagttttctttttgattcttttctctctagactctgggttttcagtgttccactctcactgaagttaaaaaatactgagctcttgctgctgtgcatatgtatgctcttcaaacagcaacatagttaaccatagctacccatgcctccagtgcctttttatttaacactgcttctgaatgaattgtgtaaggtttgcttgccctttagaagcttcataaaatacaatagaaaacaccaaggctttagtaactttgaatacgtaaaacagttaatgtattagcacttgtaataggtgaagattaaatgctagtaatggtttcccctcatactacagaactattgcttggcattatttattatgtgttaaattatagcttttgaaatgtatgacatattttaattcaaaactctatatgccactgtcagctggtacgttggaatggttttgcttattgcttaataccttctattagatgtatttattaacaacatgatgataatgatgatgaagatggtgatgatgacaacacggtagaaatggaaaaatc

SEQ ID NO: 3420 - DNA, 1600 bp, mus musculus
tgctggaatattcaaggaaacagacaaacagacacacgtcagacaccacatcatgatactgtagacaaagtgtcaccaggcatatcttttatctctgactttacaaaaataaaaaccagtaagtagctgtttttggttaaagagcctttggtaatttactacttagccatcataattaccattagaaaggatatggaaaatgtggttcatttacacaatggaatactactcagctattaataatgaggacatcctcagttttttaagcaaatgggtagaaagaatggaaacagacaaccacaggaggtagaaggggggccttccagaatgtaccagagtcctgggaggggagagactctcaggaatcaaaggcagggaccctagatgaaatgccctatagtagagaaagggaatttatagagtctacctccagcaggaagacaaggcaccaagtgaggaaggaggttgctatctcacagtcaaaactctgacctataatgttcctgactgaaataactgcagggatggaaatagagaggagcctgaggaaaagaaggtccagggacaggcccaaagtagaatccagctcaagggaaggtcccaaggcctgacactattactgaagctatggagtgctcacaaaaagagacctatcatgtatgccctccgaaagacccaacaagcagctgaaagagtcagatgcagatatttgcacccaaccaataaccagaagctgctgaccgacccctatgcttgatttagagaaaggctggaaaaagctgaggagggtgaccctgtaggaggaccagcagtctcagttcacatggaccccagagatctctcaaacactgaaccaccaaccaggcagcatacactaactgatatgaggtcccaatacatatacagcagaggactgctaggtctgggttcagtcagaaaagatgcacttaactctcaaaagactggaggctacaggaagtttagaggtctagttgtatgtgtggtggttggtgaggacatccacgtggagacagggggctagggaggaggtatgggatgtggaacagtaggagtgtagggcagggagagggaaatacaatctggggtgtaaaaaagtatgtgagtaagtaagtaagtaaagtaaataaataaatagataaagattttttttaaaaaaagagagaattttagcaaataatgaagagattgcaagtcaagactaggaagttaacatggctaattttattatatatgcaaatgggacttttaaataataaaaaataaagtaaaatttgataaaaaaataatgatgagcaaaatatctacaggtactactctgtcataaagatgttttcatggtttacttttccaatattggaaattaagcataacatgtttcaagtgctaggcaaggaattcccaaacttcctttgccttttatttaaaacaggttctcactaaactttctaagtttgtcttaaacgtgtgattctcttgtcccatcctcctaagtagttgaggttattgatcccagctacctgaattaccaggcttaaaacaaaataacgttttaaagagaattactttcattattttctgt

SEQ ID NO: 3421 - DNA, 1200 bp, mus musculus
ttccctttctgactttctgtcatattcaggccactggatggatcccaagtcccaatctataaaacaacaaatgtacattccatatcatctatcagatacctgtgagagagtgctacaaaggaaagttacagttactaacactgttcacctctgcagcatgtgtgttctcattgaagtataggctgtgttctttaaggatgattcactgtgctgagaaatctgtctagtgacattaaagaagaaaataatacaccatcgtgcctccaaccatgtgggagattcattttccatttaaaatttcattctctaagaagaaacatgtgtgatggtacatcggtagcttccagaaagttatgaatagagtatatcctttagtataatggatcttatcctctcattataaagagagcattctacatcacaagcaaagcaaaaaaaaaaaaaatacaaggaaagccttggggattcaggataaattaataagtatctagttgattaaccagtgtttcctcacgttctcaatttaaacagatttttctttaactaaatgtcctctttttttctttttttttattagatattttcttcatttatatttcaaatactatcctgaaagcccccataccctcacctcgccctgctctccaatgtacccactcctgcttcctggccctggcattcccctatactggggcttatgatcttcgcaagaccaaggacctctctttccactgatggctgactaggccatcctctgctgcatatgcaactagagacacagctggggggggggcggggttactggttagttcatattgttgttgctcctataggattgtagatccctttagctccttgggtactttctctagctccttcattaggggccctgtgctccatccaatacatgactgtgagaatctacttctgtatttgtcaggcactggcacagcctcacaagacatagctatatcagggtcctgtcagcaaaatctttctggcatatgcaatagtgtctgggttttggtggttgcttataggtgaggccatatacattttgtgtgcagatgttttatcccatttaacacagtggatggaatgacaaagtggaatattcggtggaatatataaatataaaccttcacagaaggcacaggttggttgttaaatggtaactaaaagacagtattactccatcag

SEQ ID NO: 3422 - DNA, 1400 bp, mus musculus
tactagcattatatcatgccaatggggaaaaacttatgaattttctgtcatgatgtgaggaggactaaatattccctagagcagttgtttgcaggaaggaagaattgaaattggatgcttatgcctgtgccatcaaggactagtggaaagaaaataccctcttctgaatgtttcttaccaataattcctttgagtgactctagtaaaataaacataaataaatagaaagccacaacacaacaatgttttagaaactctgtgaacatgatcactctaaagatttttgaccagaatttggttgttggctattttcaacaacattggtatttttcaatagaccttttaagagcaatataaaaattgcaattactaaggatgcaatgagtaagccagtgaaattctggctatgttaggagttctgtaaaatgttctttttttcttggtataatttctatttccttatacataatctatcacgttttatcctggctatgtaactgtctttcccccagtgggactgatacacctcattgttcaattttgatagctacattgaaagctcctttgtctcctgccaactggctcagatgtacacctgtccctctgtcactctcactgccctctcagcttgtgatagcccaactcaagctatctagacagtggatgattaggtagcctgctgtcctctaatcctcacttgtgtccaggtcagtgcagttatgaagcaacaaatgatccttcacagctctaatgttggctgtgtcccagaatgctgctgttattggttttatcctgccacttaatacatcaaatatgatttaaagttgacattgacaaaacagcttaagaagcttttatgtggttacactcatgactgacaatagttatcagaactactatgtcctggtaaaaatgagaagcagacagtgattcttttgaaacttggattttatcttatcttttcttgttccagaagaaaacagtgtcaaacccaaagttatcagtatctacgctcactgaagatgaagcttgcattatgaaggtataaataagttgaatgtatcatggacaaatggtagaatggactaaatgatttatactgtaatgtaaaaatgaaaacaaaagtatgaagcgtagatatagttttagaagagtatagaatgcttatgaaagaattgagtagagaagaaatagatatcctaatacatatgctacaatgcaattgtaggcaattcatttgtgtacaataaattatatatagtaatgtggacatctctaaagcgtaatagactggtagggaagcatgtctaaatgataacccaattagtgaattaggaagtgtgaattatagaaaaaagaaaacatttttacaaagtatgacaataggtagatagatatat

SEQ ID NO: 3423 - DNA, 1400 bp, mus musculus
tatagaatacagaaattgcagctttgtacttaaaacgtacaacatataatcatcttagacctaaattacctcactccctaaaattatttcgttctttgttgcacaaaacaaaaaaatatattattcaaaattagtctcttccaggaatatatatttttaaattaacttactctattgagtgtctttattttagtatatccaatttagatgtagattttagataagacaaaaatcattatttgactttttattttatcaaactcaccctaaaagtacctcaaactatatctagaatttagcgaataaatataatccacccaaattaataggaaaatgctgttgtctttggcttaagacgaggtttttgtgcgcctttctcacttatggttatatcctaatgaaggttctgatgcttcaatagggaatgtgcatgtgaacactgaaggtcctgctccctaattagtacttgattgatcaataaagatgcgagtggctaaaggttgggtggaagatgtgggacttccaggttcctgcaggcagggtaggagaatcaggagaaaggaggggttttaccttgctttggagggaaagagagtcaccagtcatgtgagatctcaggtggagtggccattggacacttccccagacagaatattagaaatgcaactaagctcagggcagatgtagggtattgagaaaggaaaagggaaaatgcacactagatgctggaggcttcgaagagcccagccactaaatcataaggcaggttaaaaatgagctatatatgtgtgtcttccatctgtggatgaaagggaactagggtgatggctggtagcaaggtccatgcagaccttagagcagggagagtagaaactatatgctacatcgtaaaaatgaattaaaacttaaattgcttagtattaaaaaatctaaaaatggggacttattctcactctaattaattataataaaataataagaatggtcactactcagagtggggtggatgcatgctataaagaccagagttctactaatgagttactgcccactcactaacagagctctgatttttcctataacatgaatttgaacattagaagctcttgatgatccatcttcaatagccttttacatgaatttttcttcatgattctttcccctgatagtgtcgcacactgaagtacctgcaattcctaacaacctggattccttgggcatccttaaatacgcatgacaccttgtagctttttttccatttgagatacttttactttagtccactagtaaggaagaaatcagatttgcagaatctcctttgccctccccaaggagctgtaagtttctctcaggagccaccatacatacttgtttttcttgccattctcttagcttgttgg

SEQ ID NO: 3424 - DNA, 1000 bp, mus musculus
agtcatctataggatggaacacagtgcccccaatggaggagttagagaaagtacccaaggagctaaagaggtctgcaaccctataggtggaacaacattatgaaataacccccagagctcgtgtctctatctgcatatgtagcaaaagatggcctagtcgcccatcactgggaagagaggccccttggtcttgccaactttatatgccccagtacaggggaaaccagggccaaaaagtgggagtgagtaggtaggggagcagagtggggggagggtataggggacttttgggatagcatttgaaatctaaatgaagaaaatatctaaaaaaaaaaatttaaaagaatgataaagtttcttgttttagggaaagtaggtgaatattgagattaggtttcactttgtctcacagactagccttgaacttgctatgtaggtcaggctggcctcaaagtactggtaatcttaccaatgcacatgcttgaatatagcaaagatgtattaccatgcctaggtataaagcttatttttaaaatttatttatttattttacactcagattttattcctcccccacaaccaccctctgactcttccacctcccatcccacctccccactcatctgtctccaggaggacgtcccaaaccccaaaccccactctacctgacctctaaactccctggggctttcagtcactagagggttaggtgcatcatctctgattgaacacagacccagcagtcctctgctgtatatgtgttgggggcctcatataaactggtatcctgtttagtggtccagggttgagagatcttgggggtccagattagctgagactgctggtcctcctacagggttgccctcctcctcagcttctttcagactttcaccaattcaaccacagggggcagaagcttctgtccattggttgggtgcaaatatctgcatgtgactcttttatctgcttgttgggttttccagagaatttgaatcgtttt

SEQ ID NO: 3425 - DNA, 1600 bp, mus musculus
acgagactgctgtagaaaaccaccttttagtcaaagttatttaaatataataacataatattcatactatctctatcttttaatacattgttcaatcttctgatgcttattttataaatacagagaaaatatatgttattaggctgttatttttctggatgtgtaaaacaagtgttgatatgtggctcaaaatgtctttcagtctcttcacagactgattaataataataacagtaataactaataactaactaacaaacaacaaaattaaactaataaaagaaaacatgccacaaaagaaaagaagaacttgcaatgtgctcgaggaaagaatgtgctgaagtcagccacagaggctgctgctcttaccagtgctgtcgtcatacacaactgtgacagttttccacttaaaaaactgcaccaaatccaagatggcacggctgagggaagagaagtctgggtagagactgacatagaaggaatccttattgtctgacacctggtgcttccagcgggtctgtatgtgaggaacccccagagcattgcagatggactgaacagcatttgctgatgaactgtgtgaaggaccgaagatggcagccaccccaagagacagctgatcacaagctgaaagggaaaaagaagtctgtcaataaagagaaggaaggagggcacgcgttgctactaaaccccagaaatgtcttcctgggaaagattcaatctcaaaaatattaacccagaattgctcctgtgtaaaggaaatgcagggacaaagagtggagcagacattgaaggaaaggccatccagagactgccctacctatgaatccatcccatctgttgacaccaaacccagatactattgctgatgccaagaagtgcttgctgacaggagcctggtataggtgtctcctgagaggctctgacagagcctaaccaatacagatgtggatgcacaaagccaaccattgaactgactacagggaccccactggaggtgtcaggagtaggactgaaggtgctcaagggagaacaatatcagaacccccagagctcccagggactaaaccaccaaccaaaggaaacacatggaaggacacatggctccagctgcatatgtagcagaaaatggccttatctgacctcaatgggaggagtggcccttggttctgtggaggctccatgcccctgcataggggaatgctagggcaatgagggagaagtggttggttgagtgagtagggaagcaccctcatagaagaagggggatagactaggagatttgtgcaggggataccaggaaagggagtaacattgaattttaaataaaataaccaataaaaataaatgaataataaaagaatttccttctttagtaaaatctgcatttcatatttcttcattccctttgctccctctaaactgtatctcatgttccttttttgttgcttgctttcaaatgcatggcctctttttctttaactgttggtctgtatgtttgtatgtatttctaaatacataaatagaacctgctttgtctatagaatgttgcttgtatgtatgtttgctaggctgaccatgcaacataggataacatgtt

SEQ ID NO: 3426 - DNA, 1000 bp, mus musculus
taatttaattttgacctaggtgaattattattattattattattattattattattttattttttcgatttttattagatattttcttcatttacattccaaatgctatcctgaaagccccctcttccctccccctgctctgctcccttacccacccactcccacttcttggccctggtgttgccctgtactagggcatataaagtttgcaagactaaggggcctctctttccatcgatggtcgactaggccatcttctgctacatatgaagctagaggcacaagctctgggggtactggttagttcacattgctgttccacctatacggtggcagacccctttagctccttgggttctttctctagctcctccattgggggccttgtgttccatccaatagatgactgtgagcatccacttctgtatttgccaggcaatggcagggcctcacaagagagagctatatcagggtcctgtcagcaaagtcgttctggcatacgcaatagtgtctgggtttggtggttgtatgtgggatggattccccgggttcagagctaagaaggaaaggccatctagagaatagttttatttttaacagcaaggtaagcttagtcttactaaagaggacaaagcttttgtttttttatttatttatttttttatttcttaaagacttgggcttaattcatttaccagtaaaaggatagaggccttttcttttactatgtaataaaaattatagcacatttttcatcaagaatgaatgagtcctttctgcaccggcactagggtttttgtccatatgcatatgtaagtatggatatgtgtgtgtgtgtgtgtgtgtgtgtgtatttatgtaaatatgagctaagtagttgagcctaactagaatgcatagaaggtgtatgaatatttatgcatgagtttgtatatgaatgtatgtgagtttatgctatttgcttgtgtaaaagtttttctttctgtgagtgactctcttc

SEQ ID NO: 3427 - DNA, 1000 bp, mus musculus
gtgtccttgagttcactggtgagttctctctccttacatgagctttaacctaacttaggaggctagacccttacaatcacacaaaacttccactgaatcagtggccccaaagaatgaaatcaacagaccacaaatactgaattttccaaaggcatcttatggattcatgggtgagaagagaaagggagaaggtaaagttcctgcagagcaagagtagggagggttcttagaaatgagacactgtcaaggggcgctgccttgtagtgaatatggctttactggaggtatggggaacagatgagtcattggtccaattggcctaatacaaggtactcaagtgcctctcagattcagtcatatcctcaagaataacttatagaaaggcgctgtcatttgggggaaatgaagcatggaaaaaccagaccttctttctggtatttataatctctggagagaataaaactactaagaaagtctaggacattcccagcgtcttagccaaggaaaaactgtttacaaccagggtctctcttataaactgcctgacaagtttctgtctcccagcctcataaataagagataaggcagcaagtaatactaatgtgggttttttatagtaaatctcctaaaggcacagtcagttcttgagcagaagctacacaatagtggggttctttgctctaagaaatgtttaaatgataggatttaaaatcttacaatgatataaattacgaatggaaaagtaacaatattgcattaagaggcaagcctctttgctgacaaacaatgtgcattctcaatatgaaataaagattattatatgtcaagggccatgcaggaggaacaacaaatgataggttatgggcctgcgaccactttgcagtggtcaaccaccacagtgacctggggaggccggactaacatcataacagaatttgttaagttaggaattgtcagtgaattctagaattattagattaaagatttagaagcccgtatt

SEQ ID NO: 3428 - DNA, 1200 bp, mus musculus
ttggcttttggggtttttttttcagtcattttatttatttacatttcaaatgttgacccccttcccggtttcccctccagagtccctcatcccattctcccttccctctgcttctatgaagatgtttccccacccactcacccctcaccaccctagcatccccttacactgagccccctagcctccacaggaccattgagataaggcagtcctctgctacctatgcagctggaaccatgggtccctccatgtgtactctgattggtggtttactccctgggagccctggggggtctggttagttaatattattcttcctatggggttgcaatctcttccactccttcagtccttcccctaactcttccattggggaccccatgctcagtcagatggttggctttgagcatctgcatctgtattggtcaggatctggcagagcctctcagcggacagccataccaggcccctgtcagcaagcatcagtaatagtgtgtgggtttgctgtctgcagatgggatggatccctaggtggagcagtctctggatggcctttgcttctttagtctctgctccactctttgtccctgcatttcctttagacaggaacaattctgagttaaaatttttgagatgactgggtggccccaatccctcaaccaggggccatgcctatccactggatatgttctctacaggttctatctcctctttgttgggtatttcaactaatgtcattccctttcagtcctgggaaccccttgcttccctagcatctgggactttccagtggctccctccaagttccccatcccccactgctacacacctctgttcaatttcctgaccctctctgtacttctcccaccaccacccccatctcccccttgcctgatcctgccccctccttccctctaactcctctctctccctcctaggtacctctctccctctatctccctgattattccagcttctaagtaggactgaaacatccacacttcgattttcttcttgagggaagcttgcatttggatctggtattgctattcaacactactttaactgttcatgaaggtattcagtccagatcaaaacattcaaagcaaagacttcctaacattgtcctctctaagaatcaaggtttccagcctgccttaattggctcacatatatatgggatcatcagagagcatttgc

SEQ ID NO: 3429 - DNA, 1200 bp, mus musculus
gagtggtcttgatttctgatagtaggattcttacgtttgccttttgccatcccgtaatctctggagctagttgttatagttgtctttgattagagcttgttcctcaggtgattttgttagcctctatcagcagacctgggagactagctctctcctctgagtttaagtggtcagagcactctctgcaggcaagctctccacttacatgaaatgtgcacagatatctggccttagggcctccctcctggccgaagaagaaggcccaaaacaggacctgtccggaaagctgagttgctttggcctctcctagacgcgtttagcttctgttctgtactctcacctgtgcagaatacactcagctgggtcccagaaccaagatgtcggctcccaatgctcaggcaaagtgcttccgggccatgtggacccctttcctctagccaggaaagtggccggatgtctggtacctgtgcagaatacactcggcagggtcctggaatcaagatgtctgcttccgatgctcaggcaaagtgctcccgggctgggcagacccccatcctctggctgggaaagtggccagctgtctggggcccgaaaagggggctaccttagaagctctgtggctcccgcctgtcctagaagctttaagcttctgtattccgtactctcacctgtgcagaatactctcggctgggtcccggaaccaagatgtctgctgctgatgctcaggcaaagtgctcccgggtcacgtggacccctttcctctggccggaaaagtagccggatgtctggtgcctgtgcagagtacactgggcgggttcccggaaccaagatctctgctgctgatgctcaggcaaagcgctcccgcgccgggcggacccctttcctcaatattctgatttttattttattttaactgaactgctcttagctctgattgggcagccctcagggccacactctcctctctcttaacctatggtcgctcccatttctcctcttctgctcatccttattcttctcctggttctcttctctctaagcctgcaacacataaaaccccatctatgtctcttttgcccagctattggctattggaatttttatttaccaatcacaattaaataaagacagggtcacttaactagtgtctacatgtagactcgctcatctctgggacagccagtcttgtgggctccaaat

SEQ ID NO: 3430 - DNA, 1400 bp, mus musculus
aaagtagactgaaaaaaaattctatgcatccatgtaacctaagagtgctctagaaaataacagaaaccaatttgtattcatttttctaatattacttgtagatgtgtaggtccaataacatcagagaaacatgaatgcactaaactgtttcactaattgatattctcaacccatgagtgaggtttatcttctaagaaaattttataaatgttatctgcagttaaaacccattgattacatatgaatctaatatacatctgaattctagtacaaatgccaatattctgtcatataggcctatttctatttccaattttgcattaaaatgaaagacataagatttctttttctatgaaagaaatatacttgtgtgtgtgaattttgaaaccacttactttttactttttgtgatgtaggtcgaggtcactgggatgaagatagtgtggtcagctctccagaccctgggtcagccagtgaatctggtgaccgataccgcaccgaacagtatcaaaatagcccacatgaacctagcaaaattgaaactctcataagagccacccagcagatgattaaagaggaagagaacagattacagctaaggaaagcccctccagaccaactggcttccattaatggagctgggaaaaaacactccctctgttttgcaaactatcaacagcccccacccacaggtgaggtctgccacagctctgctcttgccagcacttcaccatgtgaccatatccagcagagagagggaaagatgctcagccctcatgaaaatgactatgacaacagccccactgcactgtctcggataagtagtcctagttctgatcgcattacaaagtctagtttaatcctggctaaagactatctacattcagatatgtctccccatcagacagcaggagaccatcctgccatctctccaaactgttttggctcccaccggcagtattttgataagcatgcctatacattgactggttatgccctggaacacttatatgacagtgagactattagaaactattccttgggctgcaatggctcacactttgatgtgacttcccatctaaggatgcaaccagacccagcacaaggacacaagggaacatctgttataataaccaatggaagttgatgtttttctaaaatattttgttcttcaagggtctctgaaacatatttatagtctaataccccattagcaacatttactatgccacagattgttagaaagtctaagttaaattttagagttatttgatgagttcctgtgaaatcaaagaaaacatagcaccgacattcaaggttatacacaggtaaatgagctaaaatgtatacagaaattgcccacatattatagaggaactataaccgatacatttaatttg

SEQ ID NO: 3431 - DNA, 1000 bp, mus musculus
gtgctctcaccaggaaggtggccggctatctggagctgaagatggcgccgcccagaagctctgcgactctcgcccgtcccagaaacggctggcactctgtattccacacggtcacctgccctccgcggagtcccggagccaagaaggctcccgccggcgcctgtgccacaaacctctcaggccaggcagacccccgtgctccccactgtatctcttttaaagcagctatcacatgacatggagcttttaaaattatttccaaaaacaatttcacactgtgcctagttgataatgatatatatatctaagaacttagtgaaactcttagcaaacctataactattcaaagactaacaatacacctgagactattagaaaaagtagaggagaattttttaccttattgatgtatggacgatttttcccccctcaggaagaagtgagacttagaaataataagagggcctgagcatctgcgggagacatcttggatcccggactccactgagactactctgcacagaggataggtgtctgcccggcccgggagggctttgcctgagcatctgcaggagacatcttggttcccggactccactgagactactctgcacaggtgagagtgtggactacagagggtaacagcttctgggacagacaggagccccagagcttctgaggcagcccacttttcaggctccaaacatccaggcaccttccctgccagaggataggtgtctgcctggcccaggagggctttgcctgatcatctgcaggagacatcttggatcttggactccaccaagacgactctgcacaggtgagagtgtggactacagatgctaactaacagcttctgggataggtcctgtttcaggccttcatcttctgccaggaggcaagtctgaacgccaaatatctgtccaccttccctgaaagaggagagcctgtcttcagagagttctctgatcactgatactcaggagagagctagtctccc

SEQ ID NO: 3432 - DNA, 1400 bp, mus musculus
gtatatatacacacacatatatgtatatgtatatatatacacacacacatatatatatgtgtatatgtatatgtgtatatgtatatgtgtatgtgtatgtgtatgtgtatgtgtatgtgtatgtgtatgtgtatgtgtatgtgtatgtgtatatgtatatatacacacacacatatatgtatatgtatatgtgtatatgtatatgtatatgtgtatgtgtatgtgtatatgtatatatacacacacacatatatgtgtgtatatatacatacacacacacacacacacacacgtgtgtgtgtgtgtgtgtgcgtcacaaattgcttatcacatctataattgggctgcctgacatcgttgggtcttaaaaatagtgttctaggccatcttccttctgtgcccagtggaggccgctaagggctccaaagtgctctccacacctcagaacctcaggatcatcttgggatcaggggtgagtggaacacaacttcagctccaaagaatcgtggagggtcttgtgccagcaggaacaggaacagaggaaccctgcctgacaagaggctgggatcagttccggttggggccacccccacccctgcacccctgccatcttccttctgagcccagtggaggctgttaagcgttcgagagtactctcctcactgcaggacctcggaatcacctcaggagcatggattggggccagtcccaccatcttctgcttgaaccctgctgagggcaattagggcaccagaggactctccacgtcacaggacccctagcacatccaggacctcctgatcacctgagagcatgtgcgtgatagaagcaacagagcttcttgatcacagtcccctcaggccttcatcctcaccaggaggcgaagctgagactcagactccttggcacattccttgccagaggagagtctcggcctagagggagggttctgaccccagaactcaggaggtagatcagagctccagactgctggacacctgccctgcaagaggagagcttgcctgcagagagtgctctgaccacttgaactcaggtgagagttggactcccaggagtgctgacagaggctaacagaaatataggaggatcaagcaccaaccagagacagcttgattattaacaccagagatttccagatggtgaaaggcaaacctaagaatcttactaacagaaaccaagaacactggatattatcagaacccagtacacccccacaatgagtcctggataccccagcacacccaaaaagcaagatgcggatttaaaatcagatttcatgatggtggtagaagatttaaagaagggcattaataactcactaaagaaatacaggagaacagtgctaaagaggtagaagccctaaaataggaagcacaaaa

SEQ ID NO: 3433 - DNA, 1200 bp, mus musculus
gaagctgtagtatctttcaaatcacacatgttcttcacactatcccatccatttctttttttttttttcaggatttcttattttttattaaatattttctttgtttacatttcaaatgttaccccctttcctattttccccttcgaaaacaccctatcccctcccctcttcccctgctcaccaacccacacactcctgtttcctggccttggcattcccctacactagagcttatagccttcataggaccaagggctctcctcccattgatgaccaacaaggccatcctctaggccatcctctgctacacatgcagttggagcccaccatgtgtattctttgattggtggtttagtccctgggagctttgggggtactggttagttcatattgttgttctttttatgaggctttaaaccccttcagctccttgggtactttctctagttccttcaatggggacccagtgctcagtccaatggatggttgtgagcatccacctctgtatttgtcaggcactggcagagcatctcaggagacaactatatcaggctcctgtcagcaagcacttgttggcatccacaatagtgtctgggtttggcgattgtatatgggatgaatcccctggtggggcagtctctggatggtcattccttcaatctctgttccacactttgtcccttaaccccgttccatgggtattttgttcccccttctaagaaggatcaaagatctttgatcttccttcttcttgagtttcatgtggtttgtgaatcgtatcttgggtattccaagcttctaattaccacaatacttgcttattattttaaccaatcattttctttttttttttttttttatgtcaccatttattttattttttttttattttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcc

SEQ ID NO: 3434 - DNA, 1600 bp, mus musculus
attacacaaattaagcaactgtttaaacatccctcagatagtacattatttctaactataacaagcctctgatgtccctgtccctcagtcagagacctacaattagttcaatgtatttattgttctttctgaaactattttcctacaaaagggtctttatgagaaattcagaatatggctaatgaaaattcagtaaacaaaaaaaagtataaaacaaacagcaccatattgaaatgtgtaagatgaacaagtttacttatttcacagtactgccttactcaaaaaggcatagacagtgactttgactcacaacttcttccctgaaagaaaagagaagaaagtatgtacataacacgtaaggcctggtggagtctttcctgtactgctttacacatagtggtaatgggatcagcataagttaacatttgagactagctcagaacaaaatgatgaagtaggtggcttaatatagctagaatagttctgcaagattaatagaagtcacacaaacattagggagctcagtggtacatgcattacatcttctgttctgtgaatgtactacctttgcaaacagagagggcaacttactataaccagcatgattctaaaagatagattaaagtaagccttggaccagctgcctggttggtgcttcagtgtctcagagctcccaggggttaaagttagttgagacaactgcttgtcttcctatagggtcatcttcttccatcattcccataatgcaaccatagggatccccaacttcagtccaatggttgggtgtaccctattggggacagggggaggagaaatgggataaggaactatgggagcagcactggaaggggggcaacagatacttgaagatcttatcatacagatctttgacttccttagttagagtcacacccagatattttatattatctgtgactattgtgaagggtgttgtttccctaatttctttctcagcctgtttattctgtgtatagagaaaggccactgatttgtttgagttaattatatatccagctactgcactgaagctgtttatcaggtttaggacttccctggtagaatgtttagggtcacttatatatactatcatatcatctgcaaatagtgatattttgacttcctttccagtttgtatccccttgatctccttttattgtctaattgctctggctaggatttcaaatactatattgactaggtagggagaaagtaggcagccttgtctagtctctgattttagtgggattgttttcagcttttctccatttagtttgatgttggctactggtttgctgtacattgcttttatcatgtttaggtatgggccttgaattcctgatctttccaaaacttttatcatgaatgggtgttgaatcttgtcaaatgctttctccccatctaaggagatgatcatgtggtttttgtctttgagtttgtttatatagtggattctgttgatggatttccatatagtaatccatccctgcatccctagaataaaacctacttgatcatgatggatgatcatcttgacgtgttcttggattcggtttgcaagaattttattgagtatttttgc

SEQ ID NO: 3435 - DNA, 1200 bp, mus musculus
gagagaaagaaaaagaaagaaagaaagaaagaaagaaagaaagaaagaaagaaagaaagaaagaaagaaagagagaggggggagggagggagagagacagagagagagagagagagagagagagagagagagagagagagagagagagagagagaagaaaatcagccaggctagaaacccaagtcatcatgagggcttctagtagccacccagtaagcctcaggcttactgtggaaagtgttctacctggatccagggattttgaacagatgcaagagcctggaagtgggggtggaggggagccagagcagctttcttgggaaaggtcacccaaagggttgatgtcttaactcgtatgtcagatggaggcgtgactataaaatgtcaacaaccccttagcccccagaaaaggctggccagccctatctgggaaattagaggccctccagcagaccgaccctaccaattaatatgctggcgtctgtgtgagaattttagccaactggtaaatagaagtgtggaactgagtgggcttggtgtggggccaggcagaagccaggcctgcaagatggaccaggatggcacagctcacgtggttgaagttcgtatgtccagtagtagcggcagtaggtcacatgatggaagctgtgatgttggcagcagcgttcagccaggtgtcgagagttctggcccagtccactgatggggtgtaaccactctgagcagtgatgtacctatgacagccgctgccacaggctgcggggtgctggaccatgtatccacggtcttagcctccattggggtccccactgcagctgttggcattaccagctaagtttccaggttttcggcaccaaaatgatatgttataatggcaggtcgagtctcaacagcacactaagccaagatggttccacttggaagaggttttattgggtgagagagaggtggcaacagaaagagaagagagggagagagggggattctccttatttacatggaaaatgcaggtaaaggtgggaggtgagccaagtggaagctgggaatatggtgcctgttgccttggcaaccagtctgcatgttgttggtcgcactgtcacttatgtgatgacataggtttgggaggtcttgatgccaacaccatcaaccaggcagcatacaccagctgataagaggctcccaacacatacaaaacagagg

SEQ ID NO: 3436 - DNA, 1200 bp, mus musculus
aggtgtggtcttgttggaagaagtgggtcaccgtgggcatgggctttaagacccttgtccaagctgcctggaagccaatcttctcctactttccttcagacaaagacataaaactcaacttctccagatccatgcctgcatggatgctgccatgcttccactgtgatggtaatgtactgaacctcagatcctgtaagctagccctaactaaatgttgtctttataagagttgctgtgctggcagaacctcccagagaacagccacactaggttcctgtcagcaagtacctcttggcattagcaatagtgtaagggtttggtgtttgcagacaggatggatctccaggtggggccgtccctggatggctcttccttcagtctgctccattttttgctcctgtctttcctttggacaggaacatttctgaattagaaattttgaaatgggtgggtggccctatccctcaatggggggctgtgcctatttactggagatggtttctacaggttctctcttcccttggctgcacatttcagctaaagtcatcactgttgactcctgggagcctcttgcttccctggcatctgtgaccttccagtgcctacccctagttcctcatctcctactgctacacatttttatacaatttcctgaccctctgtacctctctcccattccctccagttcctgatcctgctctccttttttcctccccctcctctgtttctccgaggtcctcctccctccctccacctcctgcacctgaacaatgcagatgcagatgcttggagccaactgtcagactgaggttgaggactgtggtaggggatctggctggaggactgaaggagcagagggggattgcaaccccataggaagaacaatgtcagctggccagaccatccagtgctcccagggactagactaccaaccaaagagtgtacagggagggatccatagctccagatacatatgtagcagaggatgaccttgtctgacatcaatgggaagggtgattctttatcctgtgtaggtttgatgccccagcatagggggctactgaagagatggggcggggtgggaatgagcaggtaggtgggagagcacactcaatagaggaaaggggaggggcgagagggcagatgtgggatgggggattgtggaggggtaacagggaagggggatatcatttgagatgt

SEQ ID NO: 3437 - DNA, 1600 bp, mus musculus
tagaacatactgttaggtgctgagaagaaagtatattcttttgttctaggttgaaatgttctgtacatatctgttaaatccatttggttcaaaacctcttttagtttcactgtgtctctgtttagtttgtgtttccatgatttgtccattggtgagagtgggctattgaaatctcccattattattgtgtaaggatcaatgtggtttttgagttttagtaatgtttcttttacaaatatcggagccccaaaatttggtgcataaatgttcagatttgagagttcaccctgatagattttcacattaatgcatatgaagtgtctgtccctaactcttgataacttttggttgaaagtctattttattggatattacaacagctactccaccttgtttcttgggaccatttgcttggatttttttttccatccttgaagtctgacattgtatctgtctttatcactgacatgtgtttcctctatgcaacgaaattctgggtcctgtttacttatccagtctgttagcccatgtctgtttattgtggaattgagtctgttgatgttacaagaaattaaaaggagtgctctgatttcaggattcaggtgagattgccattttatttccagtgtctctgtaaggtgggtccactcaggagagctcaggccacagaagcaacagagcttctaggacacagtcctactactacaggccttcatcctcagccaggaagtagagctgatcctcagtcctctgtgcactagtcttgccaggagagagctggtctcccaggagtgctgacacaagcttacagactcacaggaggaacaagctccagccagagacaggtagaacatctaacaccagagattatcacatgacgaaatacaaatgtaaaaatcttaccaacagatatcaagactacttgtcatcatcagaacccagtactcccaccacagcaagtgcaggataacccaacacaccagaaatgcaagatttggattgaaaaatcataactcatgatgctggtaggggcttttaagaaggacattaataactccattaaagaaatacaggagaacacggttaaacaggtagaagtccttgaaaaggaaccacaaaataccttaaagaattacaggaaaacacaactaagtaggtgaagaaattgaacaaaatatccaggatctaaaaatggaagtagaaacaataaagaaatgtagtctcccctcccccagcctgaaacctgcttgctcagggtggagcttcctgctcattcgttctgccacgcccactgctggaacctgaggagccacacacatgcacctttctactggacccgagattattcggcgggaatcgggtcccctcccccttccttcataactagtgtcccaacaataaaatttgagctttgatcagaatgaatttgtcttaattccgtttcttctttcgccccgtctagattcctctcttacagctcgagtagccttctcagtcaaaccgttcatgttgcgagctgctggcggccgcaacaaagaaatcacaaagggagacaactctggagatagaaatcctaggaaagaaatcagaagccatacat

SEQ ID NO: 3438 - DNA, 3200 bp, mus musculus
cgaatatccataagaggtactcagagaaccttgtgcaaacccatgtaggctctttgcgtcttttccaactcactgaacccatacaagccctgcttgattgatgcactgggccagttctcatgtcattgaccactctgatttctgcagtctttcctcccaacttcctagggttccttgaatcctgagagaagggtaccaatggaaaccttcaatttgaactctctgcatgatgtctggttgtgggtctctgcatgctaccatcttctccaagaggaaacctctctgatgatgactagacacagcacagatgtacaagtatagcagaatatctttatgaattatttcattgatttttatttcagttgtgtttggttgtaccctaggtctctgagctatccagtttccagttactggacatctaggtatctgagggcatgagctctcttttgtgggtgggcctcaaattaaaccagacattgatcactcccacgagttctgcatcaccaatgcctcagcatatcttgcaggctggacacattgtaggtagaaggtttttgtggctctgctgatgtctgggtttctctttctgtaccctgcaggctgccttcccacatcaaagaagctagaacatggggtaaaggctccaagacagcaccagcttgacttctccattttcaataagctgtatggatgttgtccttggcaatgggtccagctgtcagtcttcagagagcaacctgttgttctagcatcagcctgggttatttagggacctctttagctaaaatctcaacagtcccttgactggaagccttttctagctacaaatggccagttcagactctgtatctcccattactaggagatctcaggagattcaccttcatggattgcaggaagtttccatcccactaggttcccacaacccccatccaaatgctcccagttccagtcactctctccatcctctccccatctatccatctcccacacctgatactttctgtgcactagcggaatctattctacgtcctcttccaaaggagatctatgtgtctctgtagaacccttctctttacctaacttctctgtgtatatggactgtagcttgattatcatttacttaacagctcgtatctacttctaagtgagtacataccatatttgtctttctgggtctgggttaccccactcaagattattttttctagttccatccatctgactacgaatttcattatgccattttgaaaaacagttgtgtaatacttcattgtgtacattactacattttctttatctattcttctactgaggtacatctaagttgcttctagtttctggctattatgaataaaaaacacaatgaacatagttcagcaagtgtagttgtaggatgcagtgtccttttggtatattcctgaatggtatagctgagtattgaggtagatcatttaaaaaattaaacttcatttatctgtcattaatttttcctaaatcaggtataattagacagctttttcctctttgttctaaatataccaaaataatcatttacaatgcaaaaaataattcatggatttgaatgctgccaaataatcttgtgtcagcaggagaattattaataagtataaaaataaatctgatttcatcacatcttaactttttttagaatgttaatagactttgattaaataagcaagctgcttaataatcttttagctttttaaaatgcattgactattaaatctgaagggaaatggtttttccataaatggataaaaatgaaattctcagaatatgctaggtatgaagataacaactttgtttatgtctctttctctcccatttcttcacacatatacatacatggatgcatatgcacaaatacaaataccagcttaatctagtttttataattactggatactcattttccttgctactccaatcagtttgattgcatttgttttaccctcatttttctttgtgtagaaatattattgatttcacagctgttccaaaatttcatcacaaaagcaaaacattcaccaaaaagcatgagctgagatttgatgttggtcattcttttagtttgtcttgcagctacaatggtttaagtgaatacacaaatatacaaatacacaaatacctgagttgatatggacaccgcagactgggatgagaagtgacctaaaccttgttccccttttctattaagtcacattcctaattttcataagaatttcaaagatgatttcttggtctacttttgttgctatgatagaataatggaaaatgagaacatatgagtacagaatgattagattgctgtactagagactgagaaattcagtatcaatgagtgaagacaagcacgagtgggagataggtcacctcctctccccccacactggataatgtctttgatctcaccagtgatggtagagcactggtggcctaattacctcttaatgacccttgatctctacatactcttgcaacagcaattaaacatttacataagttttggatgacataaatgtacaaactatagtagatagcttaagataaaagtaggacacatttttctggatgatgcccacatgcagtttgtatttattcccgatacctgtgtgtgaacacatgcaggtccacatgctgaatgtggaggtctggggaccaccttgggtgtcattcctcaggcaccacctacttttattttgaccttaacttgctcagactatgctgactgaccagcaagcccaaggatgctgggaatcaactccaggttatcctggttgcaaagcaagcattcatgctgtctgaaatatctgacccctgggcccagcccatttccacacacatcttgcattctgagagcatttgtgaattccagtgaagatgcatactgcatcaagaagtgaaccagtagagaagacctgaacaggccctctgaaattagcctttaaaatcctgtggcttttgggttgacattggaagttaatgtccagatggagaagacccagagttcctgtatgcattctctagcactgccctttataaaatcattcatatggcatctttgctctttcaggaccttccttttatccaggtgtaagagctgctgcatctggaaattgaatgtcctatttccacattttccttcttaccatttcatctatagaaaaacaatttcc

SEQ ID NO: 3439 - DNA, 1000 bp, mus musculus
ttacaccgtgtattatttccatcctttcattctactgtgttttcacagacaccattaagatcatgtcctctgaggtccttgtcttatacttcagctatgttgcattactcagagcctgtagtctcccctcccccagcctgaaacctgcttgttcaggggtggatcttcctgctcattcgttctgccacgcccactgctggaacctgccgctttgctgttctgaagccatcacgtgctcaccctactactggacctgagattattcggcgggaatcgggtcccctcccccttccttcataactagtgtcacaacagtaaaatttgagctttgatcagaataactgtcttggctacatttctttctctcgacacctagcccctcttctcttccaggtttccaaaatgcctttccaggctagaacccaggttgtggtctgctggccggacacaagagcctactgtagtagggttgttgggttttggtggagacatattgtcttggctgttaaggactgtattttgtgctggtgtctaggcatctggggttgggatgattgtggcaattgtaggtgttaatatctgtctcatatttgttgtgtacatgttcctgtttggtttcagacctgagtcaagggactgaggtgtacattttacataaccaaaccagatctagcttccaggttctccagcatccctcattctctacctggcatatcctgctccccatcctgaactttccagtccagattctgggctacccttctcccagatgttcctccctatgtaatctagatattttgtttaccctcctcctcctcctcctcctttctttctcactctgtctctgtctctctgtctttcctttctctcttttctcccttccttaaccttccctttcttccacatggtgacttccatggccttggtccttgggggtcagcgaaatctcccaagggcagcttttcaataaacttgcctttaatataatccaatctggctt

SEQ ID NO: 3440 - DNA, 1200 bp, mus musculus
ccatctcttgtattttgttgctgatgctagcatctatggttccaattttctttcctaggttttctatctgcagagttgcctcagtttgggtcttctttattgtgtctacttccctttttaggtcttggatggttttattcaattccatcacctgtttggtcgtgttttcctgtaattctttaagggatttttgtgcttcctctttaaggtcttctacctgtttagcagttttctcctgtatttctttatgtgagttattaaagtccttcttgatctcctctaccatcatcatgagatatgcttttaaatcagggactatcttttcaggtgtgttgggttgcccaggactgggtggggtgggagtgctgcgttctgatgatggtgagtggtcttggtttctgttagtaagattttatgtttgcctttgccacctggtaatctctggagttagttgttgtagttgtctctggttagagcttgttcctcaggtgattatgttagcctctatttgcagacctgggagactagctctcacctgagtttcagttgtcagagtactctctgcaggcaagctctcctcttgcagggaaggtgcccagatatctggtgttcaaacctgcctcctggcagaagttttgatccactcacagaggtcttaaggtccaatggaaggtcctgtggataccttgcgggtgtccgcagactctgtgcccaaggtacccctgtgctggcatggactggaagggacttgtaccctgattggattggagcagaagctgtgttccactcaccagaggtcttaagatcccgtgtttggtaccttacgggtgtccacagactcctcgcccaagctatcccggtcctggcatggaccggaagggccacccaaatctttaagagaatagattggaagagaggctactgaagagtagtttaggtagacaaaatcagttcgttcagtggagctgaaattagttctgttcagtttgtgcagcagaagcaggtgaatccataaataaagatatggaatattagaacaaattgccagagtgagtttgaggcaaaacagaataattcagtgagaaacctagagaagttagattaatttagtcatcttggagaggagtttgagccagaactagctagctagagttcggaaaaaaactagaaagtgtgagttcattcagcagttagccttaa

SEQ ID NO: 3441 - DNA, 1000 bp, mus musculus
ttaacatagaaactttgggtcaccgcctctcctttggttctgggactaccgattgcactggaacaataaattcctgttgctttttgcatcaattctggctccacgtggttcactcagggggtccctgcttctggctattacaaataaggctgctgcccttccggtcagctccagcaccaggtcaccttgggtgcggagtcagcggacacacccaaagtccctagaggactcttcaaatgatcttagaaccactgtgagtggaacacaacttctgttccatttcaatcacacgagacctgagacagcattagggaagcaggaaacctggcctgaccagggtcacaaatctcttctagtcagcaccagcaccagctcaccttgggcatccacagatagccccaaggtccctagaggacagcttctgaggcagaccccattttgggctccaaacttcagagcacctcccctgccagaggagaggtgtccaccccgcctgggagtgctttggtggagcaactgggggagccatcttggtttctgaatccctccaagactagtctgcacaggtgagagtgtggactacagaagctaaaagcttctgggacaggccaaagttacattgcttctgggtcaggccctgtttcaggccttcatcttctgctaggaggcaggtctgacgccagatatctgggcaccttccctgcaagaggagatcttgcctgcagagagtgctctgaacactgaaactcaggagagacctagtctctaagttctgctgatagaggctaacagaatcacgaaaggaacaagctctaaccagagacaactataacaactaactctggagattactagatggcaaaaggcaaatggaagaatcttactaacagaaaccaagaccactcaccatcatcagaacccagcactcccaccaaacccaatcctgggcacctcaacagacccaaaaagctacacccggagttaaaagcatatcttatga

SEQ ID NO: 3442 - DNA, 1200 bp, mus musculus
aatctgaaatatgcacagcagcaaatgttttgaatgcttcccccacccaacttagactttgttttgggaagttttagaaagaaagacataccaggaggaaacagggcactgaaatttttcctttgaggtgccttctgctttatatcctgttcctggattcatggtgtaagctgttttcctccactcctttcctaatacgattgacagaatcctttgaagccatggactggaaaaaaaccctcctctgtaggaccgtgaaaggcagcctggtttctggttgagctaagactggaaaccccagcgaacctgagggactttaggcattttgccatgctcctggacaccaggctactggcacaaggccacaggtatccataggtttgtggacatcagtcacataggagcaacgccccaagcccttccacaggaaaaagacattaatacaaggcatgtagactcaagacagatctcattttaatgaggtacctaacggcccgttggcttatccagttaaactgcccttcctagacactcctccctgcaaacggtatgtaacctcaggcttgccctgagaaggtagagtacggttttactcattgccactctctgccacgacaacaaatgctttaaaaccatggactgtctcttttcatcgggatctcctatggagagcaatggagaaagaaggctttcgcctaaagagcccgacctctcctggaaggtctctcagctctcccagacatcgcctctacgaagctaatctgcctggcgaacaaaccaaggattctccttctcatggaaccagctggagctaccctcttttttcccttggtcatgggctagatccagcccgtgggcccccactccattctcagttcttccctagctcctagaggctcctgggtgctcaagagcctgagaaacagatggttccagcctccctgcaggcgtgggaatccccgaggtcaggtctggctgtccctgggacctcagactgtcttccctacctaccagagctgtgccccataacttggcagaccctgacaccctccaggcattggcttggggtaagcgcagtcaaaactccctcaggggttcacgagtggatgcagaacaccccaaacgcaacactcctcacttttttgagattattttctcatacatatgaaaaataaaaaaaaaaaaaaaaaaaaaaaacaa

SEQ ID NO: 3443 - DNA, 1000 bp, mus musculus
ggctaggagcctgattataagcacacagtgagagaaaatagggaggtgtcgagggggtataatataatacagagaaaagggatggacatctggggcagatgctgattgtaggcatcttgcagcttatcatggaatgtcggccctaaaatggtcctggtcagccttcaaacattctgcagtttatcttggagtgccataaacagtcccaggcaccaaacagagacatggaggaggaggcgaagctgccttaatctaagcagttctaggcaccaagtggagacatgaaggagggagtgaagctggcagtctcaagcacctggtagagacaattaaggagtgggtgacataattcccttcaaagggtaagccagatctttagagtaagagttactgcgggacctagtttcccacagtttggtctctcacatctcccccccccccttttttttttattaaatttgcggggtggccatgaaaagagggtcggtgaaacacctgtcttaggcctttattgtggcaagcacccacatctagcaccacaatagctaggtcttttcaggttctaggtgggcaagcttaggtcttaggctatgtgagttgcctccactccaggcaccacgtcttattccaatgacttgatcaggctactggtagtcctgatgagcacccaggcaatggacccacaataatcccatcattgggtaaccttgcagccaataggtggtgtacatctggctcatggcaccgcaagatctggtcattggtaactccacagcttatggtcctcaaccactataagatctggaggtcactccatctatcattgtcatttccacagattatggaaccaagaaggctctgtttctgcagcaagggtggaaaactgaaggccaagggctgccctctctgcatcattggaagagggatcttcagctgagactcggatatctagacgatggtagtggactgaaactgttttgtttacggcagaatcaatctg

SEQ ID NO: 3444 - DNA, 1000 bp, mus musculus
ttgactacactaaagctaacgccatgcatattgattgtgagccaccttgtggattcaggaaactgatacaatggcgctgtaagaggaacaagtggtcttatctactgaactatctctccatcctgataaaaaggaaagcagtaaaaatagaaaaagtgtgtccacgcctttttctgcagcactactgtgtacttacctgattgcttactgtgcacttacctgatccttcttaaccatgtcccccacctctagtccctgaatctgctcctatccacctccagcaactgaagtgattcattgggaaaaaggaagatggtctaattcctctttaacctcacttcccatcacacacaatagttctttattcgactacagacaggactctaatgatctgtactggctgatttggtgtgtcaacttgacacaagctggagttgtcacagagaagggagcttcaggagaggaaatgcctccatgagatccagctgtaaggcattttctcaattagtgatcaaggggtgagggcccattgtgggtggtggcatccctgggatggtagtcttgggttctataagagagcaagcttagcaagccaggggaagcaagccagtaagaaacatcccttcacagcctctgcatcagctactgcttcctgacctgcttgagttccagtcctgactttcgttagtgatgagcagcaatgtggaaatgtaagctgaataaatcatttcctccccaacttgtttcttggtcatgttgtttgtgcagaaatcgaaaccctgactaaaacataatcaaagacaccctatatgagtattgttgtgctgtcgagataagcatcctcagtagctcccttcccaccacaccagcttccccatgcatggcaattcactcacacatggtcttccagagtctcttccatactctgtgtgtgcagcttcttgagatttttacatggctctcttctttccgtaccttacatctctgctcaaacctcagc

SEQ ID NO: 3445 - DNA, 1600 bp, mus musculus
tttggtcttctcattgtgtcctggatttcctggatgttttgggtttggatctttttggattttgcattttctttgattgttgtgtccatgttttctatggaatcttcagcacttgggattctttcttgcatctcttgtattctgttgctgatgcttacatctatgattccttatttctttcctagggtttctatctccagagttgtctcactttggtttttcttcattgtttctacttccatttttagatcttgtatggttttattcaattccattacctgtttagatgtgtttccctataatttttaaagggatttttgtagttcctctttaaggacttctacctgtttagtagtgttctcctgtatttctttaagtgagttattaatgcccttcctataatcctgtactagcatcatgtgatatgaatttcaatctgaatcttgcttttctggtgttttggggtatctaggacacgctgtattgggactactgtgttttaatgatgctgagtggtcctggtttctgttagtaagattcttacatttgccttttgccatttatcatctctggtgttagctggtctagctatctctggctggagtttgttcctcctgtgattctgttagcctctgtcagcactcctaggagttcaactctgtcctgagtcccagtggtcagagcactctcttcaggaaatttctgctcttgctgggaaggtacaccgagttctggagctcagctctgcctcctggctgaagatgaaggcctgaagggaccctgctcaagaagctctgaggcctgcacactctcctgtgcagactggtctatgagagacttgggatataagatgtggctctcacctgcatcctgtggtcagagccctccctggaggctgactctcctctggtggggaaggtgcccagaggtctgggtctcagctctgcctcctggctgaggatgaaggcccaaggggatcctgtcctagaagctctgttacttctgaagcctgcacagtctcctgtgccgactggtctctgaaagacccgggatacattatcaggtgttttcttttttaaatcacatttccatgatatgaaaatatactatatatgttggatttagtgtctccagagaccccattaaaacagatttgaataagagaagcagagaataagaataattatttgctgttctgaatgcattttgggaaacatccatcctgttctatacaaaatatcatatctgagactaatttgccctgaacattgggtacaaaacacaaaacacactgatatttttaaaaaggaaggaatttcacatgattaccgtgggtttatttataggcatggatattataatgattttctctggctctgtgcagtagtttcaaaatacaactacaataatcatcctttattcattcattttcagattcagctgaaggactgaacttcattaaccttgttggaaacatagaaatacaataaacctgcttgagcattccctttaacctataatttaaatgaatatgaaatgcaaagagatggaattcaaacccgaattggtggaattaaggacacactgtgatttcaagcca

SEQ ID NO: 3446 - DNA, 1200 bp, mus musculus
cccggaccaagatggcgaccgctgctgctgtggcttaggtcgcctccccagccgggcgggcacctgtcctctggtccggaaggtggccggctgtccccggcccacacagggtgctgcctcagtgcctctgtgcttccgcctgttccagaagctgtcaggttctctggcgcaccctctcacctgttcagactaatttcctaagttcggcgggtcccggaccaagatggcgaccgctgctgctgtggcttaggccgcctccccagccgggcgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtctcccttttttttttttttttttttttatcagatatttctttatttgtatttcaaatgttttcccctttccaagtctccccttcagaaactccctatcccattccccatctccatgccctacccacccactcctgtcttctcatcctggcattcccctacgctggggcattgaacctcctcaggcacaagggatgctcctcccactgatgtccaacaaggccatcctctgccacatatgcagccagatccaagggtccctccatatgtactctttgtttggtggtcctgtctttgggaactccagcagtctggacagttgacactgttgctctcccctatggggctgcaaactccctcagccccttcagccccttctccaattcctccttcggtagtcctgtgctcagtccaatggcatcctcttctatatttgtcaggctctggcagactctctcaggagacagccatatcaggttcctgtcagcaagcatttcctagcattcacaatagcatcccggtttggtggctgtatatgggatggatccccaggtggagaagtctctggatggcctttccttcagtctctgctccacactttgtctccatgtttcctcctgtgagtattttgttcccccttcttagaaccactgaagcatcctcactttggtcttctgtctttttaggcttcatatggtctatgaattgtatcttgggtattccaaacttttgggctaatatccacttatcagtgagtacatacatgtattcttttgtg

SEQ ID NO: 3447 - DNA, 1000 bp, mus musculus
ctgggagtgcaggaggtgctctaaactgccgagccacctctgcatcccctgccactacttccctcaaagcccacagactagtgcacgtctctgtccacatcaaagaagcctctgcttccagtgaacagcagttaatatggaaactcacaccaggtcaacgtacagagaataaaattctatgaagtgctcaaccacacagtacagaccctcaagactcaggacacaatgtagaagagggggcagaaaacttgaaagttccaggggactgcttccaaacaagtagcttatggacatggcaggattgttacacttatgaactgtcagcagcagctgcctgcatgggacctgcacaacactaagccagtcaacaggccaacccggactgtgagaagctgaagagagaagagccaagttttcttcagggtgtggtacctggtaggtaaccggttctccattcatgccctgacacctatgcatacatgggtggcatgaactggactcagtgggttatagagaaaaacaaatggatgacataaagtttggggaggatggggtgagagatggccttggggaagagaagaggtgggtgtgaccaaaacacactgtgcacatgtatgaaattttcaaccaataaataaaattgtattttttaaaaggtaacttcaggagcacgcaagtctatggagggaaaaggtcagcaaagatgacgtggagagtttgggcagtaaggtgtgaagaagactctgctgagcgcttcatggttaccagcatgggagcacttctgttctgccaagcatctcctccattctcctcccagcatctgtgcatgttatctatgccaactgtcagtatgacttcatgatggacatcattctgagggacaaatgacatctgaggacaagtctaatgcactctaaacagttcgctatgatggctaataagagaaagcttaagaagcaatcgtttaaggagaggaccttatgtagataatagaaggtac

SEQ ID NO: 3448 - DNA, 1000 bp, mus musculus
gcaaaaataaatgaaacaggatagaaacatgatctgatactctccccagcatcatcctatgtgctggttcttttgcatatacttgacacaagctacagtcatttgagaggaaggatcagcaactaagcaaaatgcttccataaaatcaggctgtaggcagacctgtagagcattttcttaattagtgatgtatggttggctggaccaactcattctgaacggtgccagccctgaagtggtggccctgagttctataagaaagcagactgtgcaagttataaggagtaagtcaagaattaacaatccttcatggcctctgcatcagttcctgtctccaggtccctgccttgagttcctgccatggctttcctcagtgatgaacttcgaagctttaagtgaaatagagtctttcctccacaactaattctttggtcatgggatgcaaaatagcactcctgcatggcctctgcttcaggtttctgtattgaattctccaggttgctattctgaattccgttcctgagttcccttcatggtagactgtgcgctatgaaataaaatgaagcctctcgccatcaaggtgctttgggtcacagtgttttgttacaatgaagagcaaagtaatatggcaccagagcagatactgtggaagtctgaataagcgtgacctcaggaggctcattgattcaatgcttagccatcagtcagtggcactacttgaaaaggattaggaggtctggtcttgttgacggaagtatggcccaatccagacccagtatccctctcttccttctgcctgtgtatcaggatgtaaaaccctcagctacttctacagcaccatgtctgcctgtgtatcaccatactcccagccatgagaataatgaacttaacactctgaaaccgcaaggcagccccaacgaaatgctttgttgtataagagttgccttggtcatggtgtctcttcacactgatccactgattggacagtgaccaagataga

SEQ ID NO: 3449 - DNA, 1000 bp, mus musculus
aaaaaaagtctttcaagtaaagatagttttgtcttaagagaaaggttcaactgagctgaggtccaaatagctttgatgacatatctagattcatcctccactggaatactgaagctgatcttgtcatctttgctctcttttataccagacagacactattgctgatgccaagaagcacttgctggcaggagcctggtatagctgtcccctgagagactctgacagcaccagaccaatacagatgtagatgcttgcagccaaaccatctaagcactggggccccaatggaagaattagaggaaggactgaaagatctgaaggggactgcaacaccataggaagaacaacaatatcaaccaaccttacccctcagaacttccagcgactaaaccaccaaccaacgaatacacctggaaggactcacagctctagctgcatatgtagcagaggatggccttacctggcatcagtgggaaaggatgcccttggttctgtggaggctcgatgccccatcctaggggaatgccagggcagtgaggcgggaggagggtgggtgggagagcaccctcactgaagtagggcgtaagggggatggaatagggggggttgcagggaagaagttgggaagggggacatttgaaatgtaaataaataaaataaaaaaaaaagaaaagaaaagaaaagaaaagaaaagaaaagaaaagaaagagccaggcagtggtggcacatgcctttaatcccagcacttgggaggcaaaggcagaagcaggtggatttctgagttcgaggccagcctggtctacatagtgagtaccaggacagccaaggctctacagagaaaccctgcctcggaaaacaacaacaaagaaaacaaacaaacaaacaaacaaaatacaaaaaaaaaaaacaaaaagaaaagaaaaagaaaaaaaaagggatagtgcagcagagcacccttgctcatcagtactataagtcacttgcatatgctgatcagaaa

SEQ ID NO: 3450 - DNA, 1400 bp, mus musculus
gaaatttgctttataaagagcaccatagctcttcaaagtataacctgttgtactataaagaagtgagtcccatgttattatgaaaagtggcaaattagcatattaaacactgtatttcaggattcactgtattttaggattcccctaactatataagttaagaaaaacgtcaatgataaggtatgtatttaaaatatgatattgttctattttagcattttaaaaaatgatgtttcatggtttgtatcttaccaataacttcttttgtaatatatacatgctatatgtctattaaatatagtaaagaaaatgaaattgaagacatatttctttgggtattaaaattaaataaagtagagaagtgtaaaataggtcttacataaatatatacaggacaacatgaagctcaagaagaagaaagaccacagtatggatacttaggtccttcttagaagggggatcaaaatacccatgggaggggatacagagacaaagtttggaccagaaactgaagaaaaggctatccagtgactgtcacacttggggatccatcccatatacagttccaaaacccagacactattgtggatgccaacaagtgcttaatggcaggagcctgatgaagctgtctcctgagaggctctgccagtgcctgacaaatacagaagtggatgctcacagtcatccactagactgagcacagggcccacaatgaaagagctagagaaaggacccaaggagctgaaggggtttgcagttccataggaggaacaacaatatgaactaaccagtagccccagagcttccggggtctaaaccaccaaccaaagtgtatacatggtgaaactcatggctccagctgcatatatagcagaggatggcctagtcagtcatcagttcaaggagaggcccttggtcctgtgaaggctatatgccccactgtagcgcaatgccagtggccaggaagtgggagtgggtgggttagtgatcagggggcgagggcatgggatgggggcttttcggtggggaaatgagaaaaggggataaaatctcaaatgtaaataaagaaaatatctaataaaaaagaaacaaacaaacaaaaaaccaatcatatacagcatacacatagacacacagaatgcatgacacatgcacacacacatatacaaaattaaaaaaaaacagatgtggtgaagcatattgttttctactgtatcattactcttatagcaaaaaggcctttcatcctcagtcaaatttgctacattcattggcttttgctctgtaactgtcatctgagtcaataacctatgtgtcccaactcagctagaacagtctaactctgggcctaagtagttttaacatttgaagaaaatggaaaaaatatagaattggtagag

SEQ ID NO: 3451 - DNA, 1000 bp, mus musculus
ataagattaatataaatttaaggataaaggtaaatattaaaagcagccttatcagtttgttgcttgaactagcatttgctcacactgatcttacttcattttagaaactaattctagaaccctggaggcctactgtcacccagagcaaatggttgagatccacaagcaccaagcccatatgtgctggatcctcattaaagcccagcagccataaagtttgctctttcccctttgtgctatattttccagtccatacctctaaccacatcccagaggcttgtagcaatcaggaaccaccaggtgagaaccctatatcccaattccctgccagctggaccctctggacaaactcagcagtggcaaactctgccctgttccttctgcactctatttcctgggccatggctccacctgcatcactggaggcttgctgctgcccaaggataacagataaggtcctcaagcaccttctggtccttctggcctctgcctactgggtcatctggcaaggccagaagtcttgaggtctgctctgtcacctctgtgctccatcttctggtccacacctgaacctgcaatccagggtgcttgaaaccatctggggccaccaacactacctgcatccctgtgggccctcccctatcccaaacaatctgcagtctgaaaccatcaggtaccaccaactctgtccacatacctgaaagtctgctgacaccagaacagtcaactcaacttgaaatcccagaggcctgctatcactagggactgttagctctacttgcagccccagagacttgctcctatcaaggactgccaggcctgacaacattagaaatagatggctccaggacaacataagaacacaatcaacaaaagtcagggcaatgtggcattcttagaccccaactattttacgacagtaagcccttgatatcctaaaagatctgaattgtgagaaaataaccttaaatctaatatataaagttgatagaggccttta

SEQ ID NO: 3452 - DNA, 1400 bp, mus musculus
gatctttttgcattttgcattttccttgattgttgtgtcaatgttttctctggtatcttctgcacctgatattctctcttctatctcttgtattctgttttttttgtttttttggttttgttttgttttgttttgttttaatgcttgcataaatggctcctaactttttttctaggttttctattttcagagtggtctccctttgtgatttctttattctttctactttcatttttagatcctggatggttttgttcaattctttcacctgagtggatgtgttctcctgtatttctttaagggagttatttatttccttcttatagtcctccatcatcatcatgataaataactttagatccatatctaaatggcatatccaggacttgctatggtttttgagtttggttctgatgatggcaagtaaccttggtttctgttctaacgcttgcctcctgccatctgattatctcaaatgcttgctgccctcaatatatctgactggaacctgtccttcctttaatcctggttgattcaagactcctcaaactccagttttttttctgtgatcctgggatcctgggatcctgtgaacctgagattctgagtgtgtcagagttcttggcagtcaatcttcctctgagaccctgagatcctgatgtgaccaagctcctgggatcccgggatcctggaaacctaagatggtgggtgtgttagagcacctggaagtggtatctcctctgggaacggtggggatgcccgctgtgttagaaaccaaggcagacctgtaccgaccagaaggaacccaagccgctagtcaggcggggctctgtgtccttgctcctgctgacatgggctcctcacaattgttttggaacagatgttgtactccactcacccatgatcctaagatcctgggcatgctagggaacctgcagtgtggagagtcctctggggactgtgggaccgtccgtggagttcgaacccaaggtggccattagctggcgctgaacggaagacttttccctttcagacttaaataattttactgtatgaagtcaaggttaagtaaattatatatttctacttataacttaccaattaacaacataagaataaatgtgttcagacattttcagtaactgtaaaaggaagagcattgttcattaaaaaaacacagtgggggacatcttgacagaaacaagcatcttaagcatttgatttagtaataatcgatacaactgtctatgttgtcaaggatctctgtgaaaacaaagaaggttttacttaatttattgaacgcccatattttcacatacctcaaaggattttgatctactttgtacactacacgtaacaacaataagaacaataacaaaaaactctcagtcatcattcat

SEQ ID NO: 3453 - DNA, 1400 bp, mus musculus
ttcttgagcagaactggatttcatctccacataaaactgaaggatggatcttaatgttctgaggtaggtggaaagcataacaagaatcataacagcactttgccatgtttcctggaaataccacacacgaatgatgcttatgaaagaaataccaacttaattctctagattctacaccaaaatttaagaagagctttaaaatatatcctggaatcactatgtttgatttttttttgttccctaataatccttttcaatactagatttttacatgttccaaaataccttctgaattgtgcctatgaacattgccagtccctcccttgtgaagaattatatcaaatgctaactataatgaaactgacaatttagaaatagtaatatagaacatgcccaagatcagaggatcagaggtgaggatgacacatgtgtccccaacactgggagtaactgggactggcaggacccaggcacacaggaactctgccagaccagtggcatgggttgcttctgatctgtctgggccagcgccctgaacagagcttggatgcaagctccacagccagcccaacacccagatgcagctccactccgagatgttctaacatgcccaggatcagagaatcccaggatcccaggagcttggtcacaccaggatcttaaagtcctaaaagcagcttgactcccaggagctccaacacactcaggatcacagaatcccagaatcacaggatcacagagacagcttgactcggaggagttctgacacaaccaggatcataggaaggacaggctccagtcagacatatccaaggcaggtagcactagcgataaccagatggcaggagttaagcttaagaacataagcaacagaaaccaaggttacttggcatcatcagaacccaattctcccaccatagcaagtcctggataccccgatacaccagtaaaacaagattcatatctaaaatcacttctcatgatgatgatagaggacattaagaaggacataaataactcccttaaagaaatacaagagaacacaggtaaacggctagaagcccttaaagaggaaacccaaaaatccctaaaagagttacaagaaaacacaatcaaacaggtgaaggaaaggaacaaaaacttccaggatctaaaaaatgaaactagaaacaataaagaaagcacaaagggagacaaccctagaattagaaaacctaggaaaaagatcaaaagtcatagatgcaagcctcaccaacagaatacaagagatagaagaaagaatctcaggtgcagaagataccatagaaaacattgacacaatagtgaaagaaaatgcaaaaagcaaaaagctcctaacccaaaacatccagaaatccaggacacaatgagaagaccaaacc

SEQ ID NO: 3454 - DNA, 1200 bp, mus musculus
attgtagaagggtctgtgcgtgaatgtgtgtttttgtgtgtgtgtgtgtgtgtgtgtgtgtgtgtgtgtatgtgtgtgaatgtagatactaagatagccagaagtgcagagtctccacaaactagagattcaaaggattgggaagcatctgacatggatattgagggtcaaactcaggttctctgcaagagcagcaatgtgctattcaccactgagtcatctcttctgcccctgcctttgaatccttggaagctttcgctaaagaaagttctattgtgtttaaaatccagaaaattcttatttaaaaaactcttggtggaagattcacttagaacaccagaggagtacacagtaagctgaacagagcttctggtttctctgtccacttgtagcagatcctctgccacagggctccacaggcaaatagctctgagaaggagcaagcctccaggagtgtgaaaaggcctgtgagtgcaggtaggactaccactgctgctcagagtaacccacctggaaccctcaggacacaggaactgaggggctgcctgaaacaggattcttccagtctccttctgtgcccagagctgatcatgtaccaccgagctacatacaaaatacgaccaggagagagctggtctcccaggagtgcctacaaacctgcaagcatagataagaccaccacttctcttcaaattcctggcccaagagggaccctcacagagccatcaggacacaggaaccaaggattatctggggaaaggatccttctggtctctgtctgcaccccagagcagatgctataccacatctctccatcccaaatcctcctgaagagaagtggtctctcaggagtacttctcccatcacagtgaaccctggttaccctagtacaccagaaaatcaagaccctgatttaaaatcacatctcatgatgatgattgaggaatttaagaaggacctaaataaatcccttaaagaactacaacttaacacaggtaaacaagtggaagaccttaaagagtaaacacacacacacacacacacacacacacacacacacaaaatcccttaaagaattacaggaaaacacaaccaaacagatgaaggaattgaacaaaaccacccaggatgtaaaaatggaaatagaaacaataaagaaaccacaaaggtagacaacactggagatagaaaacctacgaa

SEQ ID NO: 3455 - DNA, 1000 bp, mus musculus
atccaacaccccttcatgataaaattcctggagagattaaagtgatgcagggatctacctgaacaaagaaaggaaatttgcagcaagcccatagccaacatcaagttaaatgaagagaacctcaaaggaattccactaagatcagaaacaagacaaggttgcccactatcttcttatataatagagcatgaagacaactgatggagatcaaaatggaaacaaggaagtcaaagtatctttatttgcacatgatatcattgcatacataagttaccctaaaagtaccactgggaaactcctataactgataacacttggagtaaagttgctgtatagaaattaactcacaaaaatcagtagccttcctctacaaaattaaatacatactgaaaaactaaatcagggaaataataaaattcacaatatcctcaaaaaatatcttggggggcaactctagccaagcaagtgaaaggattgtatgataaaaatttcaggatatttgaagaaagaaattaaagaagatatcaaaagatggaaagaacttccatgcttgtggcttggtaggattaacatagtagacagggacatccaaactaaagaaatccccataaaatagcaatgcaattctcaacaaatcttgaaaggacaattttcaacattgtactggctggtttaatgtgtcaacttgacacaggctggggttatcacagagaaaggagcttcagctggggaagtgcttccatgagatccagctgtagggtattatctcaattagtgatcaagggggaaaggccaattgtaggtgggaccatttatgggctggtagtcttgggttctataagagagcaggctgagcaagccaggagaaggaagccagtaatgaacattgctccatgatctctgcatcggctcctgctttctgacctgcctgagttccagtcctgacttccttggtgatgaacagctgtgtggaaatataagcagaataagccctttcctc

SEQ ID NO: 3456 - DNA, 1800 bp, mus musculus
cagttgatagagcaagagctccagggggtccgtgttcccaccttgagtgggggcctgtgcttggcctggtccagagggctgtgccacttggggaggctgggattctctgcagaaggttggccagatgctagggatcgaggtatccatgcccgaatttgctgcttcctccaggggcagtaagctatcctgggaaccttcatgctcccagctgccagaatttctacccgaatccagtggggctggcacatgctcttccttttggacttcgtccagcagttgatcaaggaggaggagttccagagggcctgtgctgtctgcttgagtgcgggcatcttcttggcccgctccacggggctgtgccacttgggaaggctgggactctctgcagaaggagtttgagtcgctggggcttgaagtatccaggcctgtacttcctgcttcttcctgtggccaaaagctctcctgggaaccttcatgcaccctgccaccagggtctccatccaaattcagaggggctggagcaggctcttctacttggacttcatccagcagctgatcaaggaggggttccatagagcctgcgttgcctgcttgagtgggggcctcttgttggactgctccacggggctgtgccacttggaaaggctgggactctccgcaggaggagggcaagtcgctagggctcgaggtatccatgcccgtacttcctgcttcttcctgtggcaacaagctctcctgggcaccttcacgctctctgccttccggacctgcaggggccccatccgacccttgtgacgccagcaagtcttgatcttgagctgtgggcctgcccctcctgtggcgccaccgagctcttcggttttgaaaccatatgtggatcgtgtcctcgggcaaccctgtgtcacgcgccagctcctccctggtagcaaagcctggtcgtgggttcctctcaaaggcttgccctaggatcctgcgctgtagcgaggtgagtcgagtgcgaggccttctgccagatgagcgcatgcctctaccctgtggcctggatccaagctcttcctggagctgtggcgaggctagccgcctggagcctctgatggacctctttgaggcatgcccctcctctccactgcgattcctgcggttctgaaaccacacgcggatgcggcaatctgagacccccattcccttggccagctccttcctctccttgaagctcaggtatctcttctccttaaaagttgatagcagggcctgctcttgccaggcctgccaaaccatcttcctgcgccgccgggattcccgtgccacaccactgccaccaacagggctgccagcttctgccatggtgccaatgacggcctcccaggagtcctcaccttgggagactcgactcaggacagcttcagaacaaacacaagctgcaacaactgccagcagagtggctgtgaccactgccccttaaatacctctgcctctgctcaggtagtcccgcccactacctaccagttaggcgccttgggctacagaacatgcctacccctttctcgcattgcccccaagaagcgccaagcctgccacgcctggcacctgacatcagggcaccaggaggcggacctcaagcgtcctctgacactcagcaaaatctccccaaaggctcctcatccctggcaagccacggggtcgccagtctagacccacacccagggagcacacaagagtcagaggactcgccattcccatcagccaaatcattcattgactggcaggtggcacaggtaccaggacacctatgagaagggg

SEQ ID NO: 3457 - DNA, 1600 bp, mus musculus
ggccctggagaaggcacttcattattatccccacctgcaatcaatccttatagttagcgagacaccttgcatttcgggaagtcactggagttgggtttttgatgcacatccttgctgggatgggtcacttctccagttccaaatcgggtctcttcaggactttggcctctcgggtttctagaagcaagaggtactgtcggggagtcagagcatatctagaagagtctgatattcttctggagtgagaggcagatcaggtgttgtgtccatttgctcccatgtttcctccacattcacaggggcaggcccctgctcctcaagttggacttcggtcagcagttgatcaaggaagagctccagagggtccgtgttcccaccttgagtgggggcctgtgcttggcctggtccagagggctgtgccacttggggaggctgggattctctgcagaaggttggccagatgctagggatcgaggtatccatgcccgaatttgctgcttcctccaggggcagtaagctgtcctgggaaccttcatgctccctgctgccaggatttctaccccaatccagtgggactggcacatgctcttccttttggacttcgtccagcagttgatcaaggaggaggagttccagagggcctgtgctgtctgcttgagtgcgggcatcttcttggcccgatccacagggctgtgccacttgggaagtctgggactctctgcagaaggagtttgagtcgctggggcttgaagtatccaggcctgtacttcctgcttcttcctgtggccaaaagctctcccacgaaccttcatgcaccctgccaccaggatctacatcccaattctgacgggctggagcatgctcttctacttggacttcatccaacagttgatagagcaagagctccagggggtccgtgttcccaccttgagtgggggcctgtgcttggcctggtccagagggctgtgccacttggggaggctggtattctctgcagaaggttggccagatgtgcatcaaaaacccaactccagtgaagataaagtcacgaccatggttggggttaggggcagaggaagacacgaagagagagacaaacacagatgtggagagaaggggggaagggatttagggacagagggtggagggtggtaaggagagagtgacagagtgcagaaggaagggaagaatcgatacagagagatagggaagtagggaggtagaaagtggatgggggggagtgaatatgggagggtagaagaatggggatggagacagagaggggaagagatggtgaaatggaggcagggagggaaatggagggggagcaaaagaggaatggagggagagagagacagacagagacagacagacagacagagacagacagacagacagagacagagagagagggagacacctcacaaggtgtttctttcacagactgtataaaaaggagcctggaagcttgagacaccagtaggttgtgcactttctatggagcaggttgaagaaaagagttgatcgtcttcttgcatgtgctgtgtttgctggcggtatgttctgtgctcttagatctctggagttagccttgaacact

SEQ ID NO: 3458 - DNA, 1600 bp, mus musculus
cagatgctagggatcgaggtatccatgcccgaatttgctgcttcctccaggggcagtaagctgtcctgggaaccttcatgctccctgctgccaggatttctaccccaatccagtgggactggcacatgctcttccttttggacttcgtccagcagttgatcaaggaggaggagttccagagggcctgtgctgtctgcttgagtgcgggcatcttcttggcccgatccacagggctgtgccacttgggaaggaaaggactctctgcagaaggagtttgagtcgctggggcttgaagtatccatgcctgtacttcctgcttcttcctgtggccaaaagctcttctgggaaccttcatgcaccctgccaccagggtctccatccaaattcagaggggctggagcaggctcttctacttggacttcatccagcagctgatcaaggaggggttccagagagcctgcgttgcctgcttgagtgggggcctcttgttggcctgctccacggggctgtgccacttggaaaggctgggactctctgcagaaggagggcaagtcgctagggctcgaggtatccatgcccgtacttcctgcttcttcctgtggcaacaagctctcctgggcaccttcacgctctctgccttccggacctgtaggggccccatccgacccttgtgacgccagcaagtcttgatcttgagctgtgggcctgcccctcctgtggcgccgccgagctcttcggttttgaaaccatatgtggatcgtgtcctcgggcaaccctgtgtcacgcgccagctcctccctggtagcaaagcctggtcgtgggttcctctcaaaggcttgccctaggatcctgcgctgtagcgaggtgagtcgagtgcgaggccttctgccagatgagcgcaggcctctaccctgtggcctggatccaagctcttcctggagctgtggcgaggctagccgcctggagcctctgatggacctctttgaggcatgcccctcctctccactgcgattcctgcggttctgaaaccacacgcggatgcggcaatctgagacccccattcgcttggccagctccttcctctccttgaagctcaggtatctcttctccttaaaagttgatagcagggcctgctcttgccaggcctgccaaaccatcttcctgcgccgccgggattcccgtgccacaccactgccaccaacagggctgccagcttctgccatggtgccaatgacggcctcccaggagtccttaccttgggagactcgactcaggacagcttcagaacaaacacaagctgcagcaactgccagcagagtggctgtgaccactgccccttaaatacctctgcctctgctcaggtagtcccgcccactacctaccagttaggcgccttgggctacagaacatgcctacccctttctcgcattgcccccaagaagcgccaagcctgccacgcctggcacctgacatcagggcaccaggaggcggacctcaagcatcctctgacactcagcaaaatctccccaaaggctcctcatccctggcaagccacggggtcgccagtctagacccacacccagggagcacacaagagtca

SEQ ID NO: 3459 - DNA, 1600 bp, mus musculus; identical to SEQ ID NO: 3458

SEQ ID NO: 3460 - DNA, 1000 bp, mus musculus
aacttcagagttaaacaccctgctctatggaccaaccaaagcacttgctgccagcctagtactaagttgaatccttaagagagtatctgagacagtgtccacatgggtcatgtggagcaagaacttactcccacaagttgttctctaacctccacagatggccatggtgcatatgcgccaacacacagttaataaacataatagacaaccactgttataaagagtcagctttcacgggactcacataagctttgcttccctgatcgcataagaaaatcatttcccattcatatactgggaactgtatgggaagataagtgcccaaacagttcctatgttgtcatgtgcttatccagttagcattgtaaaaggaacatgcatattactaagaagcaaaaacatttcaggatgactgatttctttttttattaaatcactaagcttagttttctattttgttctccttataaatttttccttcataaaattacttaacatacttgtaactactaatgcatcttttacatttttaagcaaaacaaaacaaaaatttgccagttatctggaaaatattgcatacattgtgatgttggggaaatgaagcattttaaaactatattacacataaaatgcatagtattcaaatgggacatgaaatgcactataatgcagcttcgaatgtatggctttcaaaagtgagcgtgagccaggtgtggtggcactaggcttcaatcccagctctctgcaggcagatctctgtgagtcctaggccacccagggctgcatattaaaaccttgtttcagaaagaatgactgtatctcgtattatctttgtgctaatatctatacttcatacataatctaacttgccttgccttagaaaactgcatcctatatcaggaattctagatatttcttataatatcaaaatgagtattttgattgagattcataaatttagaatcattcaccactgatacatactttaaaaattcttttc

SEQ ID NO: 3461 - DNA, 1000 bp, mus musculus; identical to SEQ ID NO: 3460

SEQ ID NO: 3462 - DNA, 1000 bp, mus musculus; identical to SEQ ID NO: 3460

SEQ ID NO: 3463 - DNA, 1000 bp, mus musculus
aggcttagcacaaacaactcccagggcaggctagtggcaggtgtaggaggcagcactatgggctgcttcgagagtgctcaggactgccagcttcaggggcatttgctgagggcttactccagggcttccattgctcttctcaagtctgcagtgctcactggttatcttttgttttcaaagtcttcctttatacatcttctttgatgttaatgtttactcagtgagagggctggtacctctctctcaacaagggggtgtggctcaaggactcccaggttccagtgcccagcgttctatcagttctagtgccatcaaaccatagttcctagtgtttctcctaaaggtgtctgtacagagacgggagacacagtggcctcttttgccagaagaatcatgttgcccccctgtggacgcctttgttgtataagaacagtcactgcagtggagtcttgctggggatgtctcagtgttgtactcggagtccacagaagtccccaaacctccagcaccccttcaattcacctctccatctcttaaagtatccgtcatggctggaagttcctcgtgcttggctgaccatgagaagcttgtttaacaggcagcctccggtcattcatactttatatgattaggggaaaaaaagtcaactgttctggttttaagttctgtggcattgaagggaacaagggttggaggagcctgtgcatagtttctgtgtctgagagctagccagacaggaaactataagcttccccacagtgtgatgagagggggctgggagtggcagactgacctatgctccctttggccactcaggccagaaaagatgacctgccactgttgcagtaaatctccaacccaaataagctcgggcaatgaaaacacagctcagctaatataaatacatgctgtgcaactagattgggcagaactaccaccacactaccatattccccatctatgagaccccttagaacttgcagcttctccaggccatgtg

SEQ ID NO: 3464 - DNA, 1000 bp, mus musculus
ctgggcaggcagactcagtagaactgggatgttttccatgcggccccaggtgggcatctggctgtgtgaagccactgaccccacatggcccagccctcagtaccaggttctcagtctccctcatctcacaccggatacagtagaggagctgagaacagaataggggccccccggggcgacactctcgtcctcggagatatgggaagagggcagagagagagaggtccccatgcaggtgagagcccttagtctgggctttgatgaacagagacagtctatgggtttagagctttattgtagaaaggcagaggaaaagagaaaaagtagagagagagagagactgaccatggccaagaggagagaagggggaaaaggaaagagagaagaaaggctagagagtaagaaaacttaaagagagagaggtaaaagcttagagagtaagagggagagagtgaggtggggccaagcagcccctcttatagagggcttgttatcttgctgttgctaggtaaccggaggagtctagcctgaaggtcagaagcttggggcattgtgtaagtgactgaaagccaggagcctctcctctggggctgtgggggccgtaacttagacaggagccaggggtccaggagggaacgccttccattccatgtaggtgggaattaccacccattgggtttcacaggggttcaagacctcagctcgattggagaccaggctgtttgtgcatagcccattgccccacatgcactgacaaccaggatgactcaaagtgcttggggcatctgagagagcaaagcaggtgcaaatgtcctgcacctgggtgcattctatcgtgatgcaaggccagttttttcaccacatctaatacagaaggaactacaccatgggttgacttggcagttgcttcccatcatgtatgctgtttaaattacctagtgtctgaatattagtcccccaaaagcaagtattggtacttaattctcaatgtcatggtaat

SEQ ID NO: 3465 - DNA, 1000 bp, mus musculus
aggtgccattggacttagtgttggaacaagagtagagatcccgagggcagttgcttgagaagggctttagttatatgataagtaatcatggttgttatatgatgatttccatgcgctgtatattatattattattgctcttaggaataggagcttttcaaaagccacatattcctactagtatacagcacaacggtagagggtttgcctagcaagcctaaggctgcaagggtcggctcccggggctgcgcagcagacaaacgacagtgtatgagaactcttactttatcgccgcacttgggattattgttgccctttgcatatttattctgggaccgcctgcaaatgcccagcaacccaagagagccatctcttctgcagagaagaaatggggtgtcgctgccactgtcccggagagtgctaagggcttagaagacagtcactggcaataacgaagctccagaaagattcccagaagaggtgtggagggaaccaggcttgaagcaagtcaagagtttgaacagagtgtggaggggagggtagaagggggcggggatgtcactgtaacacactgtctgtctgtctttgtgaattaggattttatcacagtctgtcttcttggcagctgccagtcaaacaccactgccatcgttttatacagatgtggaaactgaggcacagggagcttaaatggcttgggagacctggatggcctaatagcatagcctctgcgcgtccagtgcttctcagtgtgagcgagcgcacagcttgatggcgtgtgccgtaatccacgtgtcatatagttcatccatgggacatgaaccacccgagcctggccacttggctaagtgggtggggtacttccccagcctacacaaagctctgggttcgatccccgatattctgtgagactgggcgtggcaaggctctgcctgtgacctgtgtccccagcccttaggacatggacacaggaggatcagaagttgaaagtcacccttgac

SEQ ID NO: 3466 - DNA, 1000 bp, mus musculus
gtggtaatagagacagagacaaacccaaggttgacaaacccaaggttcagagtatgaaaaagggacaagagagccataatgctgataggggtatggcccaggcagggaagcacagaagctggagagagggatgggttggagccacatgggtctggggcaggaccttgggcagctgtgtctcatggctctttgtcctttttgctgcagacctggccgactgcaagcttgtttctttccccatctgcatctacaaggtcctgaggaacgtctctgatcagatccatctcatcacgctggctaacaatgaactcaagtccctcaccagcaagttcatgaccaccttcaatcagcttcgaggtaggctacgggttagctcgcgcaaggagagtatgaccagccagaccttgactttcagggtctcaccccatctagggaatgtccccagagctagccttggttcaagccgacctatacagtcattcccaggggtagtctttgaagatagacctgtgcctggaggtctctgggtcaaattctatttccatttggctgaacggaagactgaagacaagaagatgagtcttggcttgactctctgatctgacgaggccagcaggcccaaggacatgaatgactgatccccttctagtcccgagcacggcttgctctttctctctttctctcacacattcctttcttggtgcagtttgtgacaggtgccagcaatgttggcttatctctctggcacacacagagtgagtggaaatggttcatggaggatgttaggcaggaggccagcaggtaggcattgtagatcttttgcagtggtatctctggtggctgagcatgatgtactgaaactgtgggaccgtggttctccatccttctggtccatggagcaagacacttgtgtaacagtaggatgctagggtaggagaggtcaggagacacaagatgcctgagtaaggcgggtcctgcctcctagggctctctgtctgtg

SEQ ID NO: 3467 - DNA, 1000 bp, mus musculus
tctcctcgccatacatcccttcttcccttctcctcagaaaacatgtggtctcctttgcatatcaaccagccttggcatatcaagttgcagtaatacctgatgcatcttctcctatgtaggctagacaaggcaggcctgttagggtaaagccgttcaaaggcaggcaatagagtcatatacagcccctgctccgttttaggagccccacataaagactcagctgcacaactgttacatctgtgcagatgacctaggtctgccccatgcatactctctgtctggcagttaagtctctgtgagcccctatgggctcaggttagtgattctgtaggttttcttgtggtgtctttgacccctctggttccttccccctcttccaaagattcccaagctccatttaatatttggctgtgggtctgtgaatctgtttccatcagttgctgggcgaatctctctgatgacagttatgctagactcctgcctgcatatatagcacaatatcatcagtagtttcggggtgggcaccctctcagggcctgggtctcaagcttggccaataatccattggtccttccctcaaatctgctccattttttacccctgcccatctcataggaagaacaagttgtggctctgaggctgggttgtagctgggttggtgtaccaatctctccattagaaaccttgcctggttacagaggatggctggtttgggcaccgtatctccaattgctacacattttagctatggtcaccctcacagattcctgagtttccattagcctaggtttctaattcatcccagagatgcccccttcccaatccagttgtctctcccatcttctccccaccctgtccctcctgtttccatcctcgtcctttccccacacagtctcctccctctatccatccttgatgtctcatctatttcctcttctcagtgagaattaagctttcccatttgggccctccttgttacttagcttctttgagtctgtgg

SEQ ID NO: 3468 - DNA, 1000 bp, mus musculus; identical to SEQ ID NO: 3467

SEQ ID NO: 3469 - DNA, 1000 bp, mus musculus; identical to SEQ ID NO: 3467

SEQ ID NO: 3470 - DNA, 1000 bp, mus musculus
gaatttacattttcatgccagcagagactgtcagatactctggaattggacttacagtcagttgttagctgccttgtgggggtcctgggaaccaaactcaggctctctataagtgtatctataactctttggacattctataacctgccagcttcccaataatgtcatggagacctttaattaattatgaaacctttaggccataggctaggtttattcccaactagctcttatacttaaattaacccatttatattaatctatattctgctatatggctcatttcctctcctcagtttcatacaatagacttcctctgtgtcaggctggcatctcttccagtgcctgactcttgcccagagtctgttctctccctgaaagtcccacctttcctcttctgactcaactatgggccttttagctcttcattaaacctaacagaagttgatggagggagtgtttacaagcgatgacacagccgtatgaagaacaataccaaagtccagtctgcactcaactctctgccagcacagacataagcatttgagtaatataaatgtaatctttacacagtgcacaaaagacgatcacttcaacatcaggatgttctgttctcctatgagctatctctctagccctccaagtttctcttcactccacttcagctccttcagtcctttctctaactcctccattggtgaccctgtgctcagtccaatggttggctgtgagcatctgcctctgtatttgtcaggctcaggcagagcctctcagaaaatagctacattaggctcctgtcagcaaacacttcttggcatccacaatagtgtctgcatttggtgactctttatgggatggatccccaggtggggcagtctctggctggcctttccttcagtctgctccacattttgtcaacatatttcctcctttgagtattttgttcccccttctaagaaggactgaaggattcactcattggtcttccttcttcttgagc

SEQ ID NO: 3471 - DNA, 1000 bp, mus musculus; identical to SEQ ID NO: 3470

SEQ ID NO: 3472 - DNA, 1000 bp, mus musculus; identical to SEQ ID NO: 3470

SEQ ID NO: 3473 - DNA, 1000 bp, mus musculus
gaagacaacttaggtaatcaattatttccgttatgtggttcccagagatcaaactcaggtcatcaagtttggaggcatatatatttacccactgagaaattctaccacctctatattttcttcaaattttttagctaattacttatgataattgctgtagaccctcttggtcccttgtctgcgaagaacgggtctctggctgcagatggacaaggagtcagcaaataaatgacaagacagaagcaacagaggagattgtgtagaatctgaatgcaatttttcaagtcgagcatctaactttttatacagaagagcaacaagaaacccggtaagatacatcctctgagttacagtgacacaataccaaaggaatgtatacatcaaaagaaggcggggaccaggcagacctctgccactaagaagggacccaggtgtaaagctagcctattgttaaacccaccaccaggggttcttagtaaatgcctgttttatgctgttcctttgggcatagagaagaaacctgactcagggggattccctaactctttcatggtaaacccacctattagctaggccattgtgaattcccttgtctgggtaagactggctattgtcccaagtaaacactctgcagaccagccctgagatattcatgctctgttctttgtaatgcataattagtttcaccagtctctactagaagtaaatttgaatgttacttcttacttaattccttcttactgaattcctactgaattccaagtttgtcagcttcaaggattttctgggacattggaacactggtgaaggcttagctatgtcagaattcaatctttaaaggcacttataataaaataatactaaaagagagcacatggatgcatacaccagactaactcgggatagggtatgagtatacgggttatgagaatgctgaggctccaggaggttgagtttccgtgaaattctttgcctcatgagtgcttccaggcctctcggc

SEQ ID NO: 3474 - DNA, 1000 bp, mus musculus; identical to SEQ ID NO: 3473

SEQ ID NO: 3475 - DNA, 1000 bp, mus musculus; identical to SEQ ID NO: 3473

SEQ ID NO: 3476 - DNA, 1200 bp, mus musculus
agaaaataaccttaaaggttctcagagaaatgaaatttggcaagtggatatgattcgttttacagaatttgataaactgaaatatgtgcactatactatagacacatattcaagatttccatggccaacagctttgagctctgaaaggctgacctatttttaagcatttataagaaatcatggctgaaaaatttggtgaacagtcgaacgatccccagaggactctccatgctgcaggtgccctagcacagctaggatcttgggatcactggtgagtagaacacagcatctgttccaaatcaaccaggaggggcttgggccagcaggaacagggacacaggaaacctgcccgaccagcagctgggattcattctggtttgcatcagccctgtgccaccttgggcgtgaactcagtgaacggacccatggtccccagaggtctctacatgacacaggtaccctagcacacccaggatcataggatcactgaggagagtgggcctccaaagagggctctgactctgggactcagggagaaaaccatcttgtatcctggatctctcagaaaccagtccacacaggagagcacactggccacagaagcaacagagcttcttggatagggtccctttgggccttcatcttcagccaggaggtagatctgagctccagacctccctgcaccttccttgccagaggagagcttgactgctgagagtgatctgacccctgggactcaagagagagtttgactcccaggagtattgacagaggataagagaatctcaggaggaacaagctctagccagagatagctggaacatctcacaccagagattaccagaaaaggcaaacttaagaatcttcctaacagaaactaagaccactcggcatcatcaggacacaatatgcccaccacagcgagttgtggatacccggacacacccaaaaagcaagattcagatttaaaatcatatctcatgatgctggtagaggattttgagaagggcattagtaactcacttaaagaagtacaggagaacacgggtaaacaggtagaagtccttaaagaggaagcacaaaaaaatcccttaacgaattacaggaaaacacaaccaaacaggtgattaaattgaataaaaccatccacgatctaaaaatggaagtagaaacaatagagaaaatccaaagggagacaag

SEQ ID NO: 3477 - DNA, 1200 bp, mus musculus; identical to SEQ ID NO: 3476

SEQ ID NO: 3478 - DNA, 1200 bp, mus musculus; identical to SEQ ID NO: 3476

SEQ ID NO: 3479 - DNA, 1000 bp, mus musculus
gagttctgcaggaccccggcacccagtagtcatgtggaggatgaaggctccggctaagaagcccttgattaaaagagagaagccagaagaaacatgggcagctgtcagaagaggctctgccaagaaaaagatccacccagttcaagtcatgagtgaattcagagggagacaagtctactgaataccctcatccactctagtgcccatttctacaccccaggctaaccacactgctttatttcatggttcattggttctttaatttcaccaagtttcagagttaagctcacaaataacataaaacattggggttaaacaagtgtgtaagatgtgtgtttgggatcttgtcattgtgtactctatacggccagcacaacctagttaactggttggtagtacctaggaaataaaactcacgggtgttgcttaccactacccttcagagggaagacttatgttcattacaaaatgagcgtaagtgataatgtgagttcctattacccagaaatgtctgcacccatgcattctatatccctgggaaggaaaaccctgacatacgctttgcacttgcattttgctagacataaaagagtttatcaactattttcccaattagcatccatactttctttaacccacctaaccttgcatctaacctgccaaaaatgtgtcaccctagccctgggaaattttaatcactgttcatcatgaataggttagatacctgtaaccgagtgggtgtggccaaccttcttcctagaatttaaaagtcaggcatgttattcaagaagtgctttgatgaccctctgtaggctgccatcttggaacataatgcttgaaccttgtatttctatagtgatcagaagttctggactcttagtattgggcttatcagagcatacctgtagagtcatcacccactggagaagtgaatttttgtttgttgttggtgtggggttttttttgtttatttgtttgtttgtttttggtattggaaata

SEQ ID NO: 3480 - DNA, 1000 bp, mus musculus; identical to SEQ ID NO: 3479

SEQ ID NO: 3481 - DNA, 1000 bp, mus musculus; identical to SEQ ID NO: 3479

SEQ ID NO: 3482 - DNA, 1200 bp, mus musculus
tttttaattaggtattttcttcatttacatttcaaatgttatcctgaaagtcccctataacctcccccctccctgattccaaaagcacccactcctgcttcctggccctggcattcccctgtactgggtcatatgatcttcgcaagaccaagggcctctcctcccaatgatggctgactaggccatcctctgctccatatggaactagagacacagctcttgtgggtactcgctagtttatattgttgttcctcctatagggttgtagatccctttagctccttgggtactttctctagctccttcatagcaagattcttatgtttgcctttctccatctggtaatctatggtatttgatcttcttgctgtctctggctggagcttgtttttcctgtgattctgttagcctctgtcagaactcctgggagtccaactctctcctgagtcccaatggtcagagcactctctgtgggcaagctgtcctctggcagggaaggtgcattgaggtctgaagctcagacccacctcctggctgaagatgaaggcccgaagagaccctgtctaagaagttctgttgcttctatgtcccatgtgctttcttgcttagactggtctctgagagacccaggatacaagatggtgctttcacctgaatcctggggtcagatccctccctggcggctgactctcctatggtgggtaaggtgcccagaggtctgggtctcagctctgcctcttggctgaggatgaaagcctgaagggaccctgtccaagaagctctgtgtgcttctgaggcctgtgtgctctcctgcacagatttgtctcctctctctctctctctctctctctctctctctctctctctctctctcagagactggggatacaagatggcgctgtcacctgaattccatggtcagagccctttctggaggccaactctcctcagtgatcctaagattctgtgtgtgctagggtgcctgtggcatggagaggcctctggggaccatggtaccttcctcagagttagtgcccaacatgacactgggctggcactgatctgaacaaaccagtacagaggtttttatactttccgaattttataaccaataccaccatccatttcagaactcacaatgaagcccacaaccacccatataacacatagtttcaagctcttgataaccatatactgtta

SEQ ID NO: 3483 - DNA, 1000 bp, mus musculus
gctaggaacatgaattagactgaggaagaacacaaagaatgactgcaggttgaggtgacttagacaacggcattttccactgacaaaagaaatagtggaggagtcttcaagtgaccaatagaagggtttaaattctagtcttaaaaatttctgccccacctaggaatccatctcatttgcacacaccaaacccagacactactgctgatgccaagaagtgcttgctgacaggagcctggtatagctgttccctgagaggctctgccatagcctgaccaatacagatgtggatgcacagagctaaatatccgactgagcacggggaccccaacagggaagttagggcaaggactgaaggagcagaaagcggttgcaaacacataagaacaacagtgtcaaccaaccagatccccccagagttcacagggacaaattcaccaaccaaagagtacaaatgggagggcacatggctccagctggatatgtagcagaggatggccttctcgggcatgggaagggagccccttgggtcctgtggaggcttccagagtagagaaatgctagggcgctgaggcatgagtgtgtgtgtgggatcgccctcatagaggcaggggcagatgagaagggatagggggcttatggaggggaaactgggaaggggtataacatttgaaatgtaaataaataaaataaccaataaaaagctttctataataacttgctaagtgatgatttgcagatttctaggaaagaatttaaagcccattacatgttatcttggctacatggaccacaggttgatttacatgaagtattaggaatgtaccatagcactgggataatgtcagtgtcagttttgtgttgtgggaaatattaaaaaggtgaatcagcacattcccacaatagtgttggctccaccaacactctgtggctagcccctgcaccaggagatctcacttgcttcatctctcaacccaccaactccccggccctgtggcca

SEQ ID NO: 3484 - DNA, 1000 bp, mus musculus
gcctttcaggtctctcagtaactccaagcctctctgaacttaggtcaggctgggccagcgaaaagctgccaatccagtgaggagtgcagtaggacctcgggtggctcttcaggagagaagatctcttcccaagtgttacatagagctcttggaacaaaagactcagacaaaggaatagttctcacatacctttaattccctgcatggatttatatacagttctgggggtgattcagggtttgacagcaggcacctctcattgacttggactgagagtttggcgaaaccttatttgcatgtgggaaggcttggtgctgttcctaagcagcctatagccatgcttctcttgtgggggttgtgagggcagtaacttcaacaggagcccgggtccaggagacatgagagaactccttccatcccatgtaggtgaattatcaccaccggttacctgggctcaagatcaagcctcgactggaaaccaggctatctgtgtgtagcccgttgccccacaactatggtaatagaaaatgtgggaatagctcctatcttcacagctactatcttacattgtggacaatttgaccaacacagtcaggtaagaaacaaaaataactttcactctttcttactacatctaatcttctctaatcacacaccttcactaggattcttactcaaagactcttgtccaactatgatcaagtattttattatttcctattatttcaaaatactattagatttgttatgggaattattgaattgtggcagtaaaattaaagctatctatcctgaggcctatgagatagcttagtagggaaaagttgtctactgccaagcccaatgatctgagttcgattcctggaatccacattggagagagggaaaagtgattcccacaagctgtgctcggactttcacttgtgcacaattgcctgtgcatacacacaatcagtagaaatgcaattaaatcatttttataaagactacaatataggaa

SEQ ID NO: 3485 - DNA, 1200 bp, mus musculus
cttctaacaacggaactaaggagtcctgtgtttaggaaagttctctgcgggggaaaaaaaagagataaagtggtggtatttgtgatgtagactttcattgtatgttgaagttcttcgattttttaaaaataattcaaatcaaatgttaatgaaatttaaaaaagaagaagaagaagaagaagaagaagaagaagaagaagaagaagaagaagaagaagaagaagaagaagaagaagaagaagaaggggggggatctgtttctgttggggccatacctgccatctttcttctgagcccagctgagggcgccaaggactccagagtgctcttcatgcctcagaacctcaggatcacctcgggatcatgggtgagtggaacgcaacatccactccaaagaattgtggagggtcttgtgccagcaggaacagggacggaggaaccctgcctgacctgaggctggaatgcattcaggtcagggccagccccgccatcttctgagtgaacccagccaagggtgtctagggcaccagaagactctccacactgcaggacccctagcacacccaagacctcctcatcacctgagaacacatgggccatagaagcaacagaacttcttggtcagggtcctgtcgggccctcatcctcagcaagggggcagagctgagacccagacccctgggcaccttcctttccagaggagagtcggcctacagggagggctctgaccccaggactcaagaggtggatcagagctccagactgctggacaagtgccttgcaagaaaagagcttgcctgcagagagtgctctgaccactggaactcaggtgagaggtagactcccaggagttctgacagaggctaatagaatcacaggaggatcaaggtccagccagagacagcttgaacattaacaccagagatttccagatggtgaaaagcaaacataagaaccttctaaaaacaaaaacactgggcatcatcagaatccagtacgcccaccacagtgagtcctggataacccaacacacctgaaaagcaagatgtggatttaaaatcatatctcatgatggtggtagaagattttaacaagggcattaataactcaaagaaatacagaacactgctaaacaggtagaagcccttaaagaggaagcacaaaaaaaatccctcaaggaattacaggagaacagtgcca

SEQ ID NO: 3486 - DNA, 1200 bp, mus musculus
tgtaagaattgccaacgttttctaacttgttttacaaagtgcaaagtgactaaacacactgcgggtgctcagtagatattttttagagagaggatggttaaaaaaggatggaggggccttgaggttgctcagaagataatggtgtttgtcatgaaaagctggcagcctgaatttaagtcccagaccccgtgaaaggtggggacagagaaaactaactccagagttgtcctctggcctgcatgtgtgctccatggtaagaagatctcttcatacacacctcccaactgcacgcacgcacgcacgcacgtacgtacgtacgtacgtacgtaattacgtatgtacttacacatctcccatcgaggtactcaccaagagaaggttaaaaaaggatgaaaggaataaacagaaaaggaaggaaagaaagcagctgatgggatgtggtgtttccccctccatcttcccagactgcacctcctgagcaatgcctctcgcctgcgtcctacctccatgattccatccggtcttctggacccattccttcactacactgaagttttctttctctcgagcagtagttgtcacaaggaccttgagttgtagctgtgtgtgagccaaggtgtcttggtctgtgaaggtaacctgaaggcatgggagcatgccttgcttctgtcagacatctctagggtcaggggtagccatgaggctgtgcgttcctttaaaatacttcagggtggcctaacttttcttagatggtggtctattttgtttgatcggctacagttcggtttgataaaggtgtgatgggaaatggtcccatttggaagctggctgaggcctagaagtacatgtagtactcagctgagcagcacgatacagacagattctcgctgatattctgctcttggtagctgtttgtaacggacaacaacaaagctttcatatgagttgactagtgatggtgtttttgcttgttgcctgtatatgtgtgaggtgtatacacatgtgcacgtgtatttgcatgtgagtggacaaacaggtgtgtgtgtgtgtgtgtgtgtgtgtgtgtgtgtgtgtgtgtgtgtgtgtgcgtgtgtgcatgtctttgtgaacatgcctggagaggcctgagattgacattgggtattttccttgatcactctctacctgatgcagggtcccacatttgaactcagctcacag

SEQ ID NO: 3487 - DNA, 1000 bp, mus musculus
agctgtggtcagtcaaaagcctgccttaagatacacacacccattcattttctctgttcacttggtccagtctccaggaagaggaagaaaagaagaaaagagggaggacattggcttcagcatccccgactctggcctcttgagtctcaggactgctgctgaatgctctaatgtctgtgggttggctggggccaagaaagcagcatgggtgcaggcccctgacagttgtgcagatgaaacttagctaagtctcctgaaaatccactttctgaagaagatgtcatcaggttagctgtgtaaacacaagaacctagcgttgtccaaatccctcccctcataatccccagggctcaaacctgttgtggtttttctttaaagatgtgataggaatttggagctattatttccttttatgagttgagaaggggtttgcaagtggtcttacttatgatgctagacactattgctatagctctccccggggagctgccattgtctggtgacacaggacactgctttgtaattctgacaggccgactctggtactgtccgtatgtccaggaaagaaaattttgtggtcaaacatctgaaaattggcatgccaggtattgaggacatgtacataaacacaggccagaactaacattgtatatttaaagcaaaaacaaacaagaaaacccagaaaagacagtaacacaccaaaaggttttcagtgtagaaagggatgaaggataccataaaggaagagttttaaagcatctgaaaggcaactcatatttttttaaagacagtcaaaatagtcttggaacaaagagagttcaaaaactgtttggtcctagtaccacataatctaaaagacactgatgttgggggacacattgatttcggggctctagcaataaaatctagatgtgagcctgtaacagataccaatgtaaatgatgtgtgcaggcattgacaaaacactttgcctgcctgctattaatgttttccataatta

SEQ ID NO: 3488 - DNA, 1200 bp, mus musculus
ctttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtctttgtcttttcttaacctcactgacctttccggtttaacagagtcccggagggacagcgtggccagcaaaccagttggctgatgaagggttgggggcagctgaggcaagggaaacacggatcaggaagattcttcaatgactctgctcaaatcccacagtccttcctgtgggaaggacacctagcaaagtccagaaaggacatggctgtgtactgtgtggtaggttatttctctgttgcgggttaaaatagccaattcaaaccagattagattatactaaagcacattcattgggaagctgctctcaggagagttcactggccccaagaattgaggccaggggagtcgcaatgggaaaagggctggggagtgggggcggagggggggggcgtacacgaattgagagaaggagaagagagaaggaagatttaaaagtctggattatatagggaaagcctctgggggaagggcagcccagcccctggggtggaaagttcaaggttggggggcagggtatgccagaaagggactgaggaatgctgggagaacctggaggccaagcggctttgatgtgtaaaatatgctcctcagtcctttgtcctggtccagcaccaaacactgtgttctccgcggttcctttactatggatgactttggtgaagataaagagacttctggacctggcatgaggtggacatcgccctgaaattcagccacgttgctcattcagatgatgaatccttgtaaagggatccagaatatccctgccatctacctacatccttggaagctttggtccatgtatgtctaccacagtctcttctggctaggctttgtcaaattacacaaactagagacagctgggaggagagaaactcagctgaggaattgactccattaagttgacctgtgagcgtctctggggcatcttctggatagctcctcaatgtaggaggctgttgtagccctggac

SEQ ID NO: 3489 - DNA, 1000 bp, mus musculus
ccttctcggtgtattgaagtggaaatttatggttgtgtcatttgatgcagactcagcatgatggtttgctgaagcaatatccatgagaggacacgtgacatttgagggagtagaagtaagacccaatagacagtgatgggacacttgcatagctagccttgccacacttcgttggtctcaagagtcttcactttgttgagagaggcacagcaacggacttctccgggcatcccatctggttctggtcactcctgctgactaatgtcaattccgaggaggcctggctgtttctgctggattgtgccaccgctgctgatttgtgtttggtatcctgacactactaagctggactgctagtatcctgataacagagtttagaattgctccccaaagaactacttctaaacaggtccacatccccttgtcctatttaccatcctttctcccctgactttggacagtaggctagaagtggggatagatgcatttaagaatccatattaaactgggttttgaacaatctaagcctagagggtagagtagtctgtgcaggcatctgcacagaaattagagatttgtgggttaaaagtggtgtcccacatccgctcgggactccagctgcttggtgagacgggacctggaagtttgactgcacacaccccttgcctggggtgggggactggggtgttgctgcgagaagccacaggaccccactccaggagtaagggaggtgcagtctcagactctctagcaccacagatgttgctgtgtgcctcggaagagcttggctgcatggagggcagggacatcaggttctagctcttggacaccacagataccactggatgtcaaggaagagctgtgaccgatagccacagaattatggagctggggcctcatgtcaggagcctagtgtctgggagcatggcaaacaccttccattccctgcagaattatctgctgggtctctggggtttaaacctagcttgaccagaaaaga

SEQ ID NO: 3490 - DNA, 1000 bp, mus musculus
ctttgatttattaagatttgttattgctttgatgttcttggtaggaactgccctttcccaccttctgggttatcagagataggtttgtccatctgcagcctgattcaaacagattaggccagctgacttcttttccccactctcattacatagcccaactgccctgccaaccttccttcatttcccaagtgctacgatcctttgctcgtggcaccacactggcttgccctcctcacttctggtctatcagttgctctttgctccccccaattcttcagaacaaacaccacctgggaggtgtgttttgacgtccaggcctttcattcgaccttcagttctgtgtgtttctggtgtccttcctccaccacgtcggtagtcctgccatggtctgacttctgctgtttgtcaccacccatgtttcttgtatgattttgttttgttctgttttgttttgttctcaacatggaaccctttacgatatacacaggctgccttcgagtcttttgtcttcatcccctacgtggcccatatttgctgtttgagcacacgtatttattttatcctcgtttctcccagacacatctttaattttcttctctcctgttatttctcatagactatccactccagggtttgttacaagcccagtgaatcttcctccatccattaaataaaagtatccagatggctgagggctggagtagatgctaaatctctctggttggccttggctctgccagagtctccagcagccatccagttcccgagaagacagaagttaatgagctggggagagagactaggggtgagaccaggataagggagcagcatctcagctcggaggaatcactgacacctgaaagtgccccctccccccaggcagctagaatgaggatcttaaagcccaaggttcaatgacagacctactctaacaaagccacacctactccatcaaggccacacccactccatcaaggccacacccactctatccgggcca

SEQ ID NO: 3491 - DNA, 1200 bp, mus musculus
ctgatactgaggacaacctttgtactgtaactccaaattcgatatcttctgtaaccaggtaaaacctcaagtggagggactgggacaccaaaccagccacaaaaccttcggcctacaggttgtcctgcctacagagtgttcttggacaggaacccagcagaatcataattaaagcgaccagagagacttcatctaacaactgatgggagcagattcagtctcatagccaaacattaggcagagttgggaagttctgctaagaagagggaggaaggatcagagaaaccggaggggtcagtctcacaccacaagaacaacagcctggcccacaggttattcaattgtctgggactgatggggactcagagataaggggtctgacctaggtcctctgcatatatgttatggaagagtagtttggtgttcttgtgggaatcctaatgtgggagcaggggctgtccctgaatcttttgtctacttgtgggacctttttcttcctatggggttggcttttccagccttgatatgaaggtatagcttgttatcctgtgtttggctgatgtctttggtaggcctgctcttttctgagtggaggcagagggaagatggatctggggaaggagggaggtgggggagagagagacactagagggaggtgaggaaactgtagtcagtatgtaaatatatgagagaataaaaaaaaactaaatttaaaaagcagagcacatatttccaatatacaatggcacagaatataccttaccattccaaaatggaagaaagagagataatgaggaaacagtgggccaaaacaagactgaaattcagcagggcaagctctaaattctgcatctccatgtctgatgtcaaaaatgctcttcaggtctccaactcttcttggctgcagcacactggtctcttaggctggttctgtatgagtctgcagctttcctcagcaggtctcttgtgactctggcatctccagcatgttgggtttactaacataatccaggcttcatctttacagcttcacacaatgccctctcttggcctccatgcagtgatgttctggcacatgccttgccccagcagctttccttagctgtggagggagtttccacaaccccatttttgtatccttgacactaaagctaggagaaggaggaggaggaggaggaggaggaggaggaggaggaggag

SEQ ID NO: 3492 - DNA, 1200 bp, mus musculus
aaattatactttacaacttacttcttacactttattagtgaaatatgtgaaattgtgtcttcatgatatttataaagataatgatagaatctctgtgtattagaataaataggataaaaagtttcaaattatgaagagttatagtttaaatgaggatacatgatatagctatttcttgtgagtctatgccagtgcctggcaaatacagaagtggatgctcacagtcatctattggatggaacacagggtccccaatgaaggagctagagaaagaacccaaggagctaaaggagtctgcaaccctatgggaggaacaacaatatgaactaaccagtacaacacccccccaccaccaccaccactgagcttgtgtctctagttgcatatgtagcggaggatggcctagttggccatcaatgggaggagaggcccttggtcttgtgaagattatacaccccattacagggcaatgccagggccaggaagcaggagtgggtaagttgagaagcagggcatggggagggtataggggactttcagagaggaaactaggaaagtggatagcatttgaaatataaatgaagaaaatatcttaaaaaacaacaacaacaacaacaaaaaaaaaaaaaaaccaaaaaagtgactcatgatgtttcaacataaagatcatggctgagagtcatccaattggttagaagtttagctttttttggacatccgatattttcttgttagcagtgacattaacaacccatgcacttagaatactaggtgtgggtttgatctcttgaatgccccagtatcaaccttgtgttgtctttgttgagttgggaggcctggggtcctaactgtaataacaatgatgatggctactgctgatcaagaattcatagatgtttaatttgaagtagctagaaacatgaaattaacaggttattctagaagtttctgttataattttttgttaaacaaaatgaagaaaaaatgttgcaagtgtcagagagaaaacagacagagatagagatggagggaggaaagcaagatgagaaaggaagagggggaagaactttctagtgcatttctcagtgctccataaattactcatgaaggaaataccttgttgttttctgcattgctacttattctgttagcttagctatatcctatattatattgataactattgttgaagaaatatat

SEQ ID NO: 3493 - DNA, 1000 bp, mus musculus
acccccctgtctccatgtggatgtcaccaccacccccccatgtcacctgacctttaaactccctggggcctccagtctcttgagggttgtgtgcatcatctctgaatgaacacagacccggcagtcctctgttgtatgtgtgttggtggtctcatatcagctggtgcgtgctgcctgatgctaaggagtgctcacaaaaagagacttagcatgacctcactccagaagacccaataagcagcagaaagagccagaggcagatagtttcacccaactattggacagaaggagctgactcctgttgttgaattagggaaagactgaaagaagctgaggatgagggcaactctgtagaatgtcccctttcaaatcatctgggattgtcaatcaaaaagtgctcatgtatcttatgcagccaaataaataaatattacaaaccctccacccattactatccaaacactgtgtggtaaaagtaaataaccacagcctatggatagttttactttcaaccaacagatacaggatctgaaatatggagaatgatattttattgaccttattttgcatggatttgcatattaagtcttgacaacttatctaatcttaatggagttcttttaaaattctattttcttcctgttaatgtaaagatggttgaatatgcaatattttaggcatatctatggtgagtaaaatttgtatataagtcaggctaaggggagaaaaccacaatcaaaaccctacggagtattgggagagatgagttgtgggttcatgcgagtcttggctaaataatgaaactctgtattgaaaatataaaaaagtaaataatatatctctttactacttattgaaataaaacacaaaaatcacatatgcctctatctacacatcagttcacctgtacacaaacctgatgcaacaggcccttggatgaaagtgtgagtcttgtagctacaccttctttcagtctttataacactcacatatatccagt

SEQ ID NO: 3494 - DNA, 1000 bp, mus musculus
ttttcctgtccatagaactagctgtggagatctttatctctccagctaactagcaaagaaagttgcccagtgagcaccaggtcacacgaggaaagatatgcaattctaatgaccaccagcactgggcgtcacatgtcctacagcatacttacctcttggctgaccaaaagctccttgaatgaaggaagagttcgttttgactcagagacttgggggttggggggtacagtctgccatggtgggaagacagggtgccagtgcatcagagagcagaagaaacatagggcagggtcttagctactctccaccttttctgtttaattctgtctgggtatccattccatgggatggatgtgggctgagtccctgaaagccttaactatggatgcaattaccttggcaacgaggggtaaaggttgacaaactccacttctaaaagcagagatctgagatgatggaaggatgttcacttggtgcatcatttagatataattttattacatattataaaagtaacgttctctctcttagatgtaagtgtagggattcagacccaggacaaacattgaggtaggtgcctattttacataccaaagtggacttggcctccaggttcttctagcatccctcaatccctacctgttactgagcatggctggcatgcccagccttgtccccggaacgttccagcgcagggcccgggcttccccagaagctctttaccacagaacacagatctttttgtatctcttcgcttcgctttgcttcgcctcacctcacctcacctcgcttctgtctctgtctcccagtgtgtgtctgtctgtctctctctgtgtgcctgtctctgtttctttctctgcctttgtctatctgtctgcctctctgtttgtttgtctgtctctctctccttaaatgtgcccactctttctcttttggtcttccacctccagtctgcctccctccctctccctggtggcttcactgaccaactcctgtgtac

SEQ ID NO: 3495 - DNA, 1200 bp, mus musculus
agaagcctttcaaaatgacatcttcctttagatagataacaatgcaaaggtccccaaatcctataagagataaataactaattaattttcacattataaaccccacatcaaaaagttgtttttagatggcaaaacaatccctacctttcctactttacacaagaatttatacagctttaatccattcagttgactttttaaaacatgcattcaatttagataatcctattcattctttgtatttaaagctccgattgtgatacatcaaaaattttgtttcatagcatgtaaagatgacacagccaatagtatcagcttttgaagcttttctctcaggcttggtactacacgaggtagcaacggaggggtgagttgcttcttagagtaagagttctgtccacattgctattcatccttaaacttgatggattaacaacgggttttatatttatttggggttcctgtgtttgagtatctttaggaaaaattgccctttcacccccaaagtaatatttttcttcattttatgtttttacacgtgttcactgcatgcttgtacaggacatgtgtgccacaagacacatgtggaatgtgtgtattttttgagagtcagttctctgcttccaccatgcagtcagactcggcggcaggtgcctttcaggggtcagtcactcccgagctccaaatttaagaagttgcaccccaatttgaatctggtttaatcagtaacctcgagttaaccatttgtgcacataaataaataaataaataaataagattgctcttttatgtttctttcttcttcagcatgtgtttaattttacttactgatgttgagtatatgtggtaggacttttgcagattttcgggttgagcagtgtgagagctatggaaactgggcacagaaggtgaggaacttgtccccggagcttccctgtcagggacttcccggtgtttattattgttttcccccatcagaggtaacttctttccttattttatatgcacaaaattgtatggggtcatagagtatttactattctgtggactcctcttccaaaaaatcgctggcacttaaatatatccttggactgcctggttttcattactgaggaacactcaataatgtatttattagtaagagtctgtgataatgagaagagacttgtggatcctggcagacaaatggtaattgtaaag

SEQ ID NO: 3496 - DNA, 1200 bp, mus musculus
cacacaaaaaaattatatataatataaaaaattaaaaagatttatatataaaaattatatatatgtgtgatttttttcttttttttttttaaaaggagctgctccctagaggcagtgccaacatggctgctgtatcacatgtgcatcagtaggtggcaaagaggagagaggctacgtctttgctcagtgttcggacctgtgaacatctgaatgattagtagactagccttccctgaaaaaggtgaacctgagaagacctctagtatggtgccacacgggcctgggcttgctccaatggtggagagcaagccgaagactagaagaaccctgcctggggctgctgcctggcaccagtcaagtgccctacaggcctggagaacagaccattcgcaaaatgagccctacccagtgccataatagacaatcaggacataacactcctaaaatcactcctgagacaaacccagaccctcacccctggtacataaaaggaggaagtaagcaatgaagaaatggaagagaaagagaaacagaaggatgcaggtacaatgatgacccacagaactgcagaggatagtgagaaacagcctgatgtgaatagccagtgttgccacctgggaccatgtcccattgcaatggggcttctgggtctgtgctgccaccaccaccagaggccacttctgagtctgtgccctgcagcagtagtggtcgcttaccaccaagtctgggcagatgtccctgatctgggctactgatcagggatatgttgatgtctgagggctgtgtgagaaaagagctgaccctgggggaagtgagagcagaagagctgaacaagcccctattcaatattcaagagagcagtctggcacattgtgggagttgcaggtgagccggatgagagtatgaaagcagtagagttggtgagatgactacccccagatacctgtcaagcctctatccagggctttgaattagcccacctgaacatcgaccctacagatgaactgctggagtgcttaaaggggctggtcctatagatccaaaacgacaggatctccatgacctagggtaagaacaggatatctgagtcccactgagggtccagtattgataaagtagcagaggccacactcataccagaccaatgagtcattgcaatggacatttgtaagcaaaggagtgtggacaaaagggtatact

SEQ ID NO: 3497 - DNA, 1000 bp, mus musculus
actgagaccagaggagacgatccttttaggtgtgtgggatccacaggccagcagaaaacagactcaggaacagcccttgctccagttgtttagcacaccaaggtatcatatgctattcatgtgcagggggcctaggtctagctggtgttcaatctttagttggtgagtcagtctctggcagcctctcagagtcgggctcagttgactctattggttctcttgtggagtccctgtcctctttgggtccctcaatctttctcccaactcttccttaagactactggagctctatttaatgtttgggtgtgagtgtgtgcatgtctttccattggctgctgggtggagactctcagaggacagttatgctaagctcctgtctgcaagcataacagagtatcattaatagtgtcagggatttggttctttcccatagggtgggtttcaatttggggcagtcattggttggccattccctcactcttcactctttgtctgtgcacaccttataggcaggacacactctgggtcaaatgctttatgggtgggttgctgcccttatccttccactgggagacctaccaggctacaggaggtggccacttcaggatctctatccaccactgctaggaattttagctagagtcacccccttagataccctggggtctctctctgtcacaggtctctgacatgccgtagagatcgctccccaaccccggtgacccctctttatctcccctgctctccctacatatgattgtcccctcttcccttcccatccccttttctacccagttccctccttccatcgacctctgatatccattttgtttccctttctgggaaagtttcaaacatctcatagaagccaaataacaaggatggcacaagcctcacttcttaatactgttgaacatgggtttaagattaaacatagattggacataagatacatatgcaaactggaacatttatgtacaaaattaaatgccttagtaaa

SEQ ID NO: 3498 - DNA, 1400 bp, mus musculus
tagtgttgtcacagtctttgtttaggctcatttctcctcctttcgaatgagaagatgagttaagcaatatctaattctcgtgtgtgtgtgtgtgtgtgtgtgtgtgtgtgtgtgtgtgtgtacacctatacatgtgctttcaaggataaagtgagtttaccaatatgatgtggatttgaagtcttaataattcaaaaagccacaaagactcattgttagctgaaaattagagaaacaaggcgcgccagatagtcttatgttaacgatacagagtatcagaaaggagggaacctcaataagaacatgtctccatagcatccagctgtcctaaggtattttcttaattagtgattgaaggggaagggaccaacctactgtgggtgatgccatgcctaggttggtgggcctgggttctataaacaatcaggttgagcaagccatgggaagcaagcggtagagggtaccttgcaatgtcctctgcatcagctcctgcctccaggaaccagtctgcttgagttgctgacatgatttccttcactggtgaacagcagcgatatggaagtgttctctccaattcctttctgatcaaggtgtttctcacagcaatattaactctaactaaaatggaagtttcctccaattcttccatcctagttcctttgtcctggatcaaagcaccacttctcaaaaagcttctagggatctttctcagacatattaggctttggaaacctcacaaataactttgtctttgttctatctctataatttcagtacaattctgtattctcttgacaaaacaattcaagacccaaactgcatgtgcttatttaatatatttatcatatgtatcaaatgcctattttaaatgtgtagtgtcctccgattcattcctctaaagcaaaaaggttggaggccaaaaccaggatgtacctttatatcttttttttctttttctccaacaaaatatctaagctcaaaagggccctaaaaggtgtaatgagtagtactccaatgtgtaccacattttctgtatccatttctctgttgaggggcatctgggttctttccagcttctggctattataaataaggctgctatgaacatagtggagcatgtgtccctcttaccggttgggacatcttctggatatatgcccaggagaggtattgcgggatcctccggcagtactatgtcaaattttctgaggaaccgccagactgatttccagagtggttgtacaagcttgcaatcccaccaacaatggaggagtgttctcctttctccacatccttgccagcatctgctgtcacctgagtttttgatcttagccattctgactggagtgaagtggaatctcagtgttgttttgatttgcagttccctgatgattaaggat

SEQ ID NO: 3499 - DNA, 1200 bp, mus musculus
tgtcctaccagagttccagtgctctgggtgggcagacatggaaggactgcggcacgctttccaggaggccccgggtgggtgtctgtctgtgtgaagccacagaatcccagcttgtgggagatggacgaggggcagtcctagataataggttctcagtctcaggcatcccatgctggatacatcggaggagctgagaacagaatgggggcgggggggggggggcaggtcagttagccccagggcagaagggaggagagggcagggggagagggcattgggtggttccaatgcgggcgagagtccttggtccagtctgtggctggactgcaggaaggccttctggcagaaggttagactcagctctttagaagaaagcctaacccatcattcaagtatggttggccttgatgagcagaggcagtctatggttttagagatttagtagaaaggcaaggggaaagagagaaggtagaaagagggagagaggccggccatggccatgtggagagaggtgggaagggaaagagagaaggagggccagagaagagagtaagaaaggtgaaagctaaaaagagcgaggaggggccaggcagccccttttatagtgggctgggctatcttgcagttgaagggtagctgtgaggaggagcatatctgggtatagtcaggtcactgtgggagtagagtctggccagaatcccagaagcttggaacattgactccgtgacttatagacacagaatcctggagtttggggctctgtggtatcaggcacctgactctgggaacgtggcttacttttccatcccttgtagagtttttttactgggtcacccagatcaagtctcattcaaccaaaatagtctgcctatcacagtcccacagtgtgtgtgtgtgtgtgtgtgtatctatctatctatctatctatctatctatctatctatctccctccctccctccgtccctccctccctccctcccttccttcctctctttctcttcctcttcctctttctctttctcattctctttctctttctctttctctttctctttctctctctttctctttctctttctctttctctttcattttctctttctcttcctctttctctttctccttcttctctttctctctctctcttctttcttctttctttcttttttttttattctttcttacttttatctcctatg

SEQ ID NO: 3500 - DNA, 1000 bp, mus musculus
ccatgctgctaagatactctctactgttctttagctaatttagcttcattctcataatatttctatttaactttcatctgtcttctcaggatttgatttgtctttctgtggtgagctcattgagccagccaccaccaacgtttttagtatcccttaaatctaagtttttatagttggccacaatttatataaagtctctattagctgatatgagattagaggggagcagttattgagatgcaccgtccacgtgactgcatccacacaaaagtctgaagtcgttacttcccagaatgggcgatctgtctagctgtattaaattttggctcaccttctggccacacagcactaaatatcaaatattatgaatcccaaggcatctggtcagatatccctataaaagaacaactgcctctgatacttcttctctctaacagattttaaaatttatagggaagagtagggcgataaaagtagcaactgtgtgatttgcagggacagggaagttagcagggaagcttgcattgcaggttccttgaacagcatccaggagagaggcatgcagatctctctgggcaagaggccactgcttgaagtcatgtttcttattctccctcctggaaatttgttattgattgattattgggtggttagggaaatctgtgtaaatcaatggctgcagggtgtaagtgttaaagaagtatggatacttccataggtgaggtgtgtatagctcaagatttaaagttacctctcagtgtagagtttctgttcttttctttcaagcaaaataaatggaatgggtgtatttctgataactcctttagaaaggaagacacaataatgcttgataaagtctcttttatgaaatctgtcacttaatgtagttcatgaattaactgagacatggccacattgacattggtggaggggttccttgatttgaatgctactgcagatgtttaaaaatcaggtctcaaactctcaagcctgagaattt

SEQ ID NO: 3501 - DNA, 1000 bp, mus musculus
gttctcctgtacttctttaagtgagttattaaagtccttcttgatgtcctctatcatcatcatgagatatgcttttaaatctggttctagcttttcgggtgtgttagggtgcccaggactgggtgaggtgggagtgctgcgttctgatgatggtgagtggtctaggtttctgttagtaagattcttacgtttgcctttcaccatctggtaatctctggagttagttgttatagttgtctctggttagagcttggtcctctcgtgattctgttagcttctatcagtagaactgggagactagctctctcctctgcgtttcagtggtcagagcattctctgcaggcaagctctcctcttacaaggaaggtgcacagatatctggcattcagaccatcctcctggcagaagatgaaggcctgaattagggcctttcccataagctgtgttgcttcggcctgtcccagaagctgttagcttctgtagtccacactctcacctgtgcagactagtctcagaggtatccaggaaccaagatggggcccccagatgctctggcaaagctctccttggtgggttggacacctcttctctggcagagaaggtgccctgatgtctggagctggaaatggggtctgcctcagaagctgtcctctagggaccttggggtgtccgcagactctgcgcccaaggtgacccagtgctggcacagaccagaaggggccaatcaatgaactctattataagctgtactcctttgcccatgcaaagcttgttgagtcccaaggaaggagagaaataggaaatggagatacatctgttgtctatatcatgtaaatcatgttcccatcatgatgttgtttccgtgttctatgttcgaactctgactgtgcacttggcaacatctattcattttataaaaagtgaatatctccatgttgagctgtcttgtgggctgaaattgtttctgatcaccactagtccatgaaaatagtgtccaact

SEQ ID NO: 3502 - DNA, 1200 bp, mus musculus
gaaagaaaaaaaaaaaaaaaaaaaactcttttcaactacatatatatataattttggagaatatctatatctatatatatatatatattcccccagagggctggagagatggctcagcagttaagagcactggctgctatacctaagttcaattcccagcacctatataagggcttacaatcatctgaaaactccagtgccagggttctgatgccctcttcaggcctccccaggcactgcatgtctgtggtacactgacattctcacaggcaaaacactcatacacacaaaactgtagccatacaggaaccccagtggagtgatagagacactaactcacccacaaagctttcaaccctaaatttatcctgtctacaagaaatgcagggacagggtatggagcagagactaagagaatggccaacgaacaactggcccaatgggcacaaatccttaacactattaatgatactctgttttgcttgcagacaggagcatgttatcctctgagaggcttcacccagcagctgactgagacagatacagacacccacagccaaacagtggatggagcttggggactcttatggaaaaatagaaggattgtgggccctgaaggggatagaaactccataggaagacaaacagagttaactaacctggacccttggggctctcagagtctgaaccaccaaccaaagaacatacatgggctggacctaggcctccctgctcgtttgtagctgatgtgcagcttagccttcatgtgggtcatgaacaactggaatgggggctatcccaaaagctgttgcctgttgtgggaactaaaagggggccctggggaagagaggaaggaaagaaccacaccctgccagagttccacctatgctctggacaggcggatgtgggagggctgccagacttttcactcagccccacgtgggcacccaagcctctgacccactcttcggggggtgggggagacaaggggcagcccaacctgtgagccctggggctactctctaaagccccagggttatgggagagagggaagagggaagagaggttcccacaccatcgagagtgagtgcagtggatcttgatgagcagagactctctatggttttagagctttattatagaaatgcagggagaaagagagaaggtagaaaaagagaggggaaaggctagagagaaaga

SEQ ID NO: 3503 - DNA, 1200 bp, mus musculus
ttacaggtgttgtcaacactccaggtttgcagactggtatatcatcacagggaactgcactcctgccacagacacactgcaacttggacggctgtgaagatgctatacccagggagcaaagccagtcacaaaggccatgtgttgagggtagtcctggcttctgtaagaaagtaggctcagcaagccacgaagagcaaaccagtaagcagcacccctccatggcctctcccatggcctctcccataagcttcagactccaggttcctgtcctgtttgagttcttatcctggcccagtaagcaggattcctccgtggcctctgcatcagttcctgcctccaggttcctgccctgtttgagttcctgtcctgacttccttctgtcataacatcactatggaagtttaagtttctttggtcatggtgtttcactgtagcaatagtaaccttaactaagataagttggtgccagaatagtggggtattgctgtgacagacctgactgtgttgttttgaggaggactgtggaaggactttggagctttgggctggaaaagccattggctgctgagagctcagtgagccgttctcaggagtttggaagataagaatcttgagagatggaggcctggcttgtgacgtttcagagggaaacaaagactctagttaaccttttgtgtgaagcatcagtggttctggtcagctgtgattaagacgaggccagcatcactgaggtgaaatctgggaaatgtttccttggggtcagcacacagaggctgtgctccagcggtggtcaaggttgtacctcctgatggcagctgaatttggaagtgtgagagtcacccacccaggtggtgctggttttgaaagcatgaaggggtcatggagagcggctgaggcttgtcactgcgtggcagaactggagtccctggagtggagtccctagcctgttggtgaaaatgtagcccagatacagaagaagactccactattttggagacgccagtaccaaagaacagcagcagcctggcatggatccagctgacacctacaatacaagctgtgtgtgctgcagagggcggagccagagaagtgacgcaagccccttggaggagcccagaagatggtgagtgaatccaagacactggatgtcgagctatttacacttttggagtttgggttttcccttttaagattacgtct

SEQ ID NO: 3504 - DNA, 1000 bp, mus musculus
gttgaagaacttaccaagagattccttgactcgtgattctggggtgctggtatcctggctataaccctgtggcacggctatgccacagctctgtgcttctacactatggcaaagaagcacaaaagaagctgcctcgtgcatagaggggacatgtgagagaaagaagcgagacggatgcagaggtgtcagcctctctctcccacagtgatgtgccttttttacagttcctctgagtgagaccatgatcctagaataaagtatcaaccctacttaaggacctacgtgcttgctgcttgtccctaccgatccctcactgtcctctggggaatcaaccttacagcatacgtaacactctgcaaactaccttcagactcagtacaacctttacaaaactcctgtcatggtcccctacaactccccactttttagaatttcataaactaatcctaaaagtcatggaagatgtaaaggaaagagaagccaaagcaatcctgggtgtggcttttagttttttggatttttgttttgttttgttttgttttgttttgttttgtttgtttgtttttgattcttgggatgaaggtctcatgtagcccagactgctggcttctgacttgctatgcagcctaggatgaccttgaactcctgaccctcttgcctttacttcccaagtaaagggattataagtgcacaccaccatcttgctttacatggtaaggaccgaacctaccgcttcttgcactgcaggcaagcactctaccaactacccagtatccccagactcccaaacaatcttaagaacaaagtcaggaggctcacatgttccagtcttaaaactcactaaaaactacagcaatcaaggttgtgtgagccaggctcaatagtacagactttgaaccccagctacttgttgagaagctgaagcatgaggtctgttcaagttcaagacctgcccaagcgacaaagtgagttctaggctaatctgggcaacgtagtgaac

SEQ ID NO: 3505 - DNA, 1000 bp, mus musculus
tcccccctagcccaaggaactgtgggatatctatgtgcagctctgagattctgcgagacaccttcagacaggcagtgcgtggagcacagggctgagcctcagttctcctgtacaggctcgctgtgggtcatctgaggatttaggaattgaatgtggacagagctccctggcacaaggcccctgggagcaagcacccctagtcagggtgtcttttcttccttttctctgcctgctcattccgcatggggcagcctcgggccttgaggggacatcaggagtgcggatgtggcatcagccaacccagagccaccgcggaagccccagctcgatttctaaggctgatgaagaagcagccttgctttcctgggtgacaggcagatcagggggaggaaggacgagccttccctcggggaagtgcaattgtgcagtttatttaaaggaggttatatttttggagccggcctcttggaacaggaaagtacagtcatcgcttcagaagaaaaagaaagaaagaaagaaacaagagttactgctaagtccccagagagaagttcattagcaaaccggtcagctaattgccttcaatgttcttctggagtttaaaggctgtgctacaatagtaattcgtgtctctggaacagtccactataaatagtggggcaatcagagctaagagctgcaaggaaccgggaaggcgcagggaatagcaagtacctggaaagccagttcgtgagtgctgactgaatgcacaggcggaaggcagaggaggcgccttctccagccctgcagcagtgtccctgccagcctggcacgcagcgtccgtgtcccagaaacctctccacctcctggccacaggcacccactcttgggtcagtgtagggggttgtaagtctgccctggcacatgcctgttttgtctggtcctgaggatccatgtggtaacccatgtggccttgcgttagcctggcacaaacagctctgctccaaacagctagggcaac

SEQ ID NO: 3506 - DNA, 1600 bp, mus musculus
ttgtgctgatgttctctgtgcaatcttctgcacctgagattctctcttccatctcttgtattctgttgctgattctcgcatctatggttccagatttttttcctaatatttctatctccagtgttgcctcactgtgagttttctttattgtgtctacttccctttttatgtcttggatggttttattcaattccatcacctgtttggtcgtgttttcctgcaattcatcaaggaatttttgtgtttcctctttaaggtcttctacctgtttagctgtgttctcctgtatttctttaagtgagttattaaagtccttcttgatgtcctctaccatcatgagatatgcttttaaatctgggtctagcttttcgggtgtgttggggtgcccaggactaggtggggtgggaatgctgctttctgatgatggtgagtggtcttgatttctgttagtaggattcttatgtttgccttttgccatctggtaatctctgaagctagctgttttagttgtcactgttaagagcttgttcctcaggtgactctgttagcctctataagcagacctggagggtagcactctccttagtttcagtgggcagagtattctctgcaggcaagctctcttcttgcagggaagatgcccagatatctggtgttcaaacctgcctcttggcagaagttgtgttccactcaccagaggtcttaagatcctgtggagggtcctgtgaggaccttgggggtgtccagaaactccgcacgcaaggaaccccggagctggagtggaccggaagggacttttccccctgatcaggccgggttatctgcttccctagttaatgcaatctcaggtccggcatgattggattggagcagatgttgtgttccactcaccagaggtcttaggatcccatgggggatcctgtgtgggttcttgcgggtgtctggagactccgcaggtaaggcaccctggtgctggagtttcctaatttctttctcagcctatttaccttttgtgtagaggaaggctcttgcttagtttgagataattttatatccagctactttgcacaagaggtttatctgctgttggagttttctggtagaattttgggggttgtttatgtgtactatcatatcatctgcacatagtgatacctgaatttttcctttccaatttgtatccctttgacctcctttagttgctctggctagaacttcaagtatgataatgaataaatagggagaaagtgggcagccttgtcttatccttgatttttgtggattggttcaatattctctccatttaatttgaacttggctgttgttttgctgtttattgctcacattacacttaggtgtgtgtttgaattctttatcactccaagacctttaacatgaaggggtattgaattttttcaaatgctttttcaggatctaatgagatgatcatgtgacacaacagtcaaagaaaatgcaaaatgcaaaattctcttaacccaaaacatagcactaaatgcctccataaaaaaaataaaataaaaaagatctcatatcagcaatttaaaggtacacctgaaaaaaaaaaagaagcaagcacacc

SEQ ID NO: 3507 - DNA, 1000 bp, mus musculus
caactccactcatgagactctgcctcatgggaataagatgaacagcgacatagcagggaacaagatgtcctcatctgtcctctgtgtatacacacacacacacacacacacacacacacacgcacacgcacacgcacacacacacacacagtggtgtgtgcctgttttctgaactatcagaggcaaaagcaggaggatcttctttgagatcagcttggagtacagagtgatagaaaacctaacagaggcatgtcaactggagcctgtgtagaccagggctgggtgagacctagaggtgttcacaccacctccagtaggtgggacaagcaagaagatgtccctgtctactccctgtaaacagtggccagaatgactcaggagtcaccaccagccctacacctccacaatcactggcccagggcagccaggacagattctcaccaagaaaaggcaataagggccagtgagatggttcactgggtaaaggtgctagcggctaagtctgctcacctaagggccccagcctcctcctccacctccatgaggtactagtctggaagtgccagctgcggtaacaggacaagagggggagatacaagctagacaaacagggacagaagaggtaaaggccgcttgttaaaggcctcctggaagctaaggtctgtggcacaacagttccaaccgccatgcactgcaagacatccggtggggctgcgccagggccactgaaggccagggcagcagactgtgcatattaatcagatccctcgagaagggagagaggaccacaaagtagaatgtcacacacatcccgaggcaggaggatctctgagttcaaggctagcctggtctatagagggagctccaggacagccagagctacacagagaaaccctgtctcaagaacaaaccaaaactaagcaaaagaaggaagaaaggaagagaggaagagagaaagagagaaagagagaaagagggaaaggaaggaaggaagaaagaa

SEQ ID NO: 3508 - DNA, 1000 bp, mus musculus; identical to SEQ ID NO: 3507

SEQ ID NO: 3509 - DNA, 1600 bp, mus musculus
gcgctgcatcacaatcaaatccacgtgagtgaggggacagccccgaggggttgtgctctgggtgtcactcgggtgtgtttgctgccagtggacaaatagtggcgtgtttagggtcctctctgtgacatgcttgtgtgtgctgcctagcctgccttggtcagatgctgaatggactgttgacctcttcctctccgtagcgccatctccctcttctacgagctctctgagaacgacctgaacttcattaagcagagcaaggatggctcgggcttcctcatcaacctcatcgactctccaggccatgtggacttctcttcagaggtgacagctgccttgcgtgtcaccgatggagctctggtggtggtggactgtgtgtctggtaagccttgggtgggagctgtaacagacagttgctggtgttttcatggcccagtaccacatttttgggggtgtaaattgaaatcatattcattttaaggcaaggatgaattctgctctaatttgaaattgtatgtgccagtccccatgtcagggcagggagattgtgaagtccacctaagtgtggggccagtttcctataatttcagtgctctgaggcagaggtgcatgggtctctggaggtgggaggggctgagtggcatagggcctggtacactggacacacttggagatttagcgcctgggcatccataccgtgtaccttggagagtgcttgtgtacatttcacagacaaaacatacgtggtcttcaggccttgaactgtcagtggtttagagtacttgagagttaagggtaaacacttagtccttttcaccctgtcctcaggcgtgtgtgtgcagacagaaactgtgctgcgccaggccatcgctgaacgcatcaagcccgtcctgatgatgaacaagatggaccgggccctgctggagctgcagctggagcccgaggagctctaccagaccttccagcgcatcgtggagaacgtcaacgtcatcatctctacctacggcgagggcgagagtgggcccatgggcaatatcatggtgcgaagctcttctatggggggcggtcagggccacgctccctgggaatctctgacccaccatgatgacggaaattcttcactttgacctgatgtctgttgaagaaactcagtgtctgagactgtgggcttgtggctgggctggctgctgaccatcttgccgggctaactgctgctctcctccctcagattgaccccgtcctgggcaccgtaggctttggttctggcctgcatggctgggccttcaccctgaagcagtttgcggagatgtatgtggccaagtttgcagccaagggtgagggccagctgagcgcagccgagcgtgccaagaaagtagaggacatgatgaagaagctgtggggagaccggtgagtacatggctgtgtgactgtctctacccctgctacttgtggacaatgcctgcctgccgatactatgtgactgctctctacaggtactttgatccggccaatggcaagttcagtaagtcagccaatagcccagatgggaaaaaacttccccgcaccttctgccagctcatcctggaccccatcttcaaggtgg

SEQ ID NO: 3510 - DNA, 1600 bp, mus musculus; identical to SEQ ID NO: 3509

SEQ ID NO: 3511 - DNA, 1400 bp, mus musculus
atgaaattcacaaagactaaaaagtggctgtcatggtttgcatatgctcatcccatggagtggcactattagaaggtgtggccttgttggaggaagtgtgtcactgtgggggtgggcttggagatcttcctggttgcccgaggatgcccagtccgttcctggcttcctttgggtaaagatataaaaccctcagctcctcctacaccatgccggcctggatgctgctatgcttctgccttgatgataatgaactgaacttatgaacctgtaagccagccccaattaaatgttgtctttataagatttgccttggtcatggtgtctgttcatagcagtaaaaccctaactaagacagtggctgtggagcgttttcttaattagtgattgatgcaggagggcccagccaaatgtagttgtgccatgcatgggctattggtcctgtgttctgtatgaaggcagactgagcaagccatggggagcaagccagaaaacagcaaacttctatggcctctgcctccagattcttccatggcttgggtttcttttttttttttttttttttttgggtttttcgagacagggtttctctgtatagccctggctgtcctgacctcactttgtagaccaggctggcctcgaactcagaaatccgcctgcctctgcctcccgagtgctgggattaaaggcgtgtaccaccacgcccggcctggcttgggtttctgttctaactttttgataatgaactgtattttagttagggttttactgcatctaggcaggcatggtgcaggagcaactgagagttctacaccttcatctgaaggctgctagaagaatacttctaggcagctaggatgagggtcttaagcccacacctgcagtgacatacctactccaacatatcccgagcttatccccgtcccgcgggaaataaacacaggacacaccagattcttccacggttaacttttacttctatatcatattgaggtagacaaagaaggctcagaaagtgtgtggcttaaatacttttggtgacgtgtctaaactaggactggtagcaacacccatgatcctcatgcaccctggggataggttaaagcccccaggggttgggcaaaagctggcataagctttatatggtttagcaccatctagtggcggcacatatattgcagccctttacaccaacaagtccatacctcctaatagggctactttctgggccaagcacattccactccctggcccccataggcttgttcaaacatatgagtccatgggggccatatctagccacagcataataaaaagtacatttaatccaacttccaaaatccccatagcattctcaacaatgttaaaagtccaaagttcaaagtctcttctgagatccatct

SEQ ID NO: 3512 - DNA, 1000 bp, mus musculus
agatattagcaaaaaaaaaaaaattacagaatatccaagatacagtccacagaactcagaaaggtcagcaagctgaagtgcccaagtgagaacaccacagtcccacttggaagagagaagaaagctatcgcaagtagggagggagggagggacctgggagggaaagtagatttggggggaagaggctgaaagagggaaacctgatctggtattgggtgagagaaaaggactgaagccccgaggcccagcagaaagaatggaaaaaggcaaccttgggagacaggaggttggggggactctccagaatgcaccagagacctaagaggtgaaagactctcaggactcaaagggagggaccttagatgaaatgcctgacagtaggaagagggaacttatagagcccacctccagcaggaagacaggacatcaaatgagggatggggttgccatcccacagtcacaactctggcccataatttttcctgtctaaaagaattacagggatggaaatggagaggagcctgaggaaaagacagtctagcaacaggcccaaagtggaatccagctcaagggaaggtccttaggcctgacactattaatgaggcaatggagtgctcacaaaaagggacctatcatgactgccctctgaaagatccaacaagtagctgaaaaaatcagatgcaattatttgcacccaaccaatggacagaagcagctgacccctgttgttgaattagggaaggctgaaagaagctgaggagaagggcgatcctataggaggaccagcagtctcaattaatctggacccctgagatctctcaaacattggaccaccaaccaggcagcatacactagctgatatgaggcctccaactcacatacagtagaggactgctgggtctgtgttcatttagatatgatgcacctaaccctcaagagactccagggagtttagaggtcaggtggggtggggggtgggggacatcaacgtggaaacagg

SEQ ID NO: 3513 - DNA, 1400 bp, mus musculus
aacttaatctgttggcttaatttcaacctgaatgtgtggggtattatttcagctgtgaggtagggggatcacttcaatatacactgagcaaccatctgtgtatgctagagccctgtgaatcaaaaactaagaaataagaaaagaagaacatgactggtcctgatttttggccccagatgaatgaataaaagaaaaaagtaaagaccatgattactcctagatattgtgagggagaattcttgtaaataaatgggagaatacagccagaggcagagataagtacgagatgaacccttaggcatgtgagaagaggagggaggggagatggaggaggcagaccaagaagtcaggcatgtaaagggtagataacaaaaaacaaaaccaaccaaacaaaaaatcctccaccccgcctctgagatatacgtggggaggacatatggggtaaagggtagccaagatcctagtctggagaagttcacggtaggggccaggcatgcaggccaacattgtaacaggtagagactgagatatgcagagggaacctggcagatagcatttttgataaataggcgccaaatttatttgtttctgggtttgagacataacactctctgcccaggaggaagacggggacgtgcctactgagtgcaggaaaagtgcagggaccactttgcagtccaggaacaagttctacagcaaagcctgccttatgatctaggcccgctcttggcctgtagtggaagccggagatgggaaacacgatgtctcttagggacactgctcctgtcactcaggcctcagtagccaatcagaacttcgagacgagccttcagtcatagtgggcgggcacttcctgtccgccatattacccgctttgttgtgaatctgaggaaagcactattgaccatctgccggtagttgagcggagagtgaggcgaacttggaatccgcgccatggtgagcgaggccgccgtccccacgcggggaggatccgcggggtcccatgtggggttgtcctggggtgcgggcaccggcagcgagatgtggcgaccttcgtaattgcgtttgtcacccgaagtcgccgagttcccttatcctccggtgtggaagcagcacctcccagtgagacggttccccgggctgcgccggcgcacagcataggaagctagagatgatgcttggacacgggcatccttcagcgggcacgcatgcgcgggttttgttgtcagtgggagagatttgctgactggcagagcaaattcttttctttagtgtcttccagaagttctgtacctggcacttgacattcgggtgtagcatccatcgcagttaactctgcgcagtgtaaagcctgtgtcattaacacattcgcatgtagatgccacggtggtccagtcacg

SEQ ID NO: 3514 - DNA, 1200 bp, mus musculus
atagtattataacaggatgaaaatgcacttaggaatactcaggttcagcatatctcatatctctatactgttcctgcattattagctatactttctcacagtatcactatggaattgctttgtgataacagggcaatagaatggatacatttttctattagttcaaaaaagttttcactctatattagtctgtggtttctggaccaataattctgggcagatttcagacaaaacaattatgtggtcaagaaccaatgaaaaattttattcttctctgtttccctgatctgcttgcagaaagcaggccagggcaggcttttgctgagcctctgccccatagcctttgccggactcagtctctaggtgcttcacctcaggctggcagagccagggaagggagccctagggcagaggtggacatcattgtcagccaggaatatggacacagcagttctcccacccagctcctaggctgccgagatggcagctgctggtgcccgaggcctgtggaccacctaccaccaactcatggataaagtggacttgttgctgccaaagaaattgaggctgctttatcacctggcaggccccagaacagtttttttcctgggctccaataatgaaatggggattggtatgtgttggattagctgacatgacatggtcagacctacagagaaactcagtgcagctcattccactgtgctgatggctacagggtttatttggtcaagatactcacttataattataccaaaaaattggagtttgttcgctgttaatttctttgtggggtcagcaggagcctctcagccgtttaggatttggagatataatcaagaactcaaaggaaatccagtaagagttcctgatcacctgaacattctagctgtagacagaaacattggaatctagtgtatttgattactgataaggtgatgctaactattctgataacattggaaaagaaggaaaacaaaatctaactgtagttaatagctagcacttcacaaaaaataaagcaaactttcagtaactgtctgtctttacgtatgcctgaagggactttgtttgtggatggcaccaacactgttttctaccatttgtccataataaaccgttcttatgataaaaacagctataaactttagtgaatgtttccgaggatgtagcactggctttttccacgtatccctttca

SEQ ID NO: 3515 - DNA, 1000 bp, mus musculus
gataatgttttaatgatggaactgttctaatcttactcatgtgccagtgagagctcagtgaggaaaattaatatggtatgcagaactctacctcatttattaattttctgggaaacattttgtcagtatgaaccttttcatgcttttgaagagtactaagacatgccaaggctttacctcattgattacattcacaggctttctatccagtatgacttctttcatgcctgtgtagaagattgttatgtgcaaaggttttaccacattgactgcattcatatcatttctctccagcatgattttttttctatgcaagtcaagacgcctgcgatgtgcaaaagtttctccacactgactacatacatggggtttctctccagtatggattctttcatgggtctcaagatgactgttacttccaaagactttaccacactgactacattcatggggtttctgtccagtatggattctttcatgcttcttaagctgactgctacttgcaaaggctttaccacattcagtacattcatatgccttctctccagtatgagttctttcatgtattttaagatacctcttacatgtaaacgcttttccacattgacaacattcataaggtttctctccagtatgatgtctttcatgcttgtcaagagaacctttatgtgcaaaggctttacttcattgattacatttatatggtttctctccagtatgaatactttcatatatttgaagagaactgttatatgtgaagactttaccacattgagcacattcatagggggtcctccagtatgaatactttcatgtatttgaagagcactcttacttgcataggctttaccacattgattacatttatgcagcttccttccagtatgaaattttttatgtatttggagagtacggaaacatgtaaaagctttaccacactgattacattcatagagtttctctccagtcggagttctttcatgtatttgaagatgactgg

SEQ ID NO: 3516 - DNA, 1200 bp, mus musculus
catcctgcgattttcaggcaaatggatagaactagaaaatattatcctgagtgagtaactcagttccaaaagaatatgcatggtatgtacttactaataagtggaaattagccaaaagaagtacagaatacccaagatacaatccaaagaattcaaaaaggtcaacaagcagaaggccttaagtgaggtcatgtcagtcccacttgggagggagaataaggcaattgtatgggggaaggtgagagggacccgggagggaaagtggacaggaaaaaggggggaggggacatgattgggtggaggaaaaggattgaaaccctcagagccagaagaaagaatggaatcaggcaaccttgggaggtaggaggttgggggtaccctccagaatgtaccagagacctaggcggtgagagacactcaggactcaaagggagggagggaccttagatgaaatgccctacagtggggagaggtaacttgtagagtccacctctagcagaacatcggggcatcaaatgcgggatggggttgccatcccacagtcacatctctgaccaataattgttcatgtctgaaagaattacagggatagaaatgtagaggagcctgaggaaaagaaggtccagagacaggcccaaagtgggatccagctcaaggggaggccccaagacctgacactattattactggggctatagagtgctcacaaaaagggatctattgtgactgccctctaaaagacccagcaagcagctgaaagagtcagatgtagatatttgtatccaacaaatggacagaagatgctgacctctctggttgaattaaggaaaagttggaagaagctgaggaggggggcgaccctgtaggaggaccagcagtctcaattaacctggacatctgagatctctcaaacattggaccaccaaccaggcagcatacaacagctgatatgaggcccccaacacatatacagcagaggcctgccaaatctgggttaagtcagagaagacaccctcaagagaggatcttgtggagttgctgaggtggggggtggggacatccttatggagacaggggtgggggcagaaaggaggtatgggatatggaacagtcagagtgtggactggaagggaattaaaatctggagtgtaaaaataaataaataaataaataaataaataaataaatctcacaaacaga

SEQ ID NO: 3517 - DNA, 1200 bp, mus musculus
tagagttatggatggcattcctgtatcttgaaattcaaggttttttttaaccttttcatatcttgttatcaggcttcaaactgaaatttaaaaactaatattagttttaatcttatagtcaacggcacatatcatataacatagacactatcactgtcacagtaatataactgtttaaaaatacaaatcaagagggtcacaatccctgccggtcggcgtcagcaccaggtcaccttgggcagagttggcggacagccccaaggttcctagaggactctccactcaatcttaggacctctggtgagtgaaacacaacttctgttccatttcaatcatgtgggacctgagacagcattagaaaagcagaaaacccagcctgaccagggttacaagtcccttctggtcagaaccagcacctgttcaccttgggcggggagttggaggacacctccaaggtcctccaactccccgcccaaggtgaagacagcttctaaggcagaccttgtttcaggctccagacatccgggcaccttccctgccagaggagaggtgtccaccccaccagggagggctttgccagagcaccttggttcccggatccctctgagactagtctgtgcaggtgagagtgtggattacagaagctaacaacttctgggacaggccctgtttcaggccttcatcttctgccaggaggcaggtccaaacgccagatatctgtgcaccttccctgcaagaggagagcttgcctgcagagagtgctctgagcacttaaactcaggagagagctagtctctcaggtctgctgacagaggctaacagaatcatgagaggaacaagctctaaccacagacaactataacaactaactccagagattaccagatggcgtaaggcaagcataagaatcttactaacagaaaccaagaccactcaccatcaccagaacgcagcactcccacgtcccccagtcctgggcaccccaacacacccgaaaagctagacccaaatttaaaagcatatctcatgatgatggtagagtacatcaagaaggactttaataactcacttaaagaaatacaggagaacactgctaaaaagttacaagtccttaaagaaaaacagaaaagcacaaccaaacaggtaaaagtccttaaagaaaaacaggaaaacacaaccaaacaggtgatggaaatgaac

SEQ ID NO: 3518 - DNA, 1000 bp, mus musculus
aagtggagagaaatttaatgcaaatccactaaaacaggtataagacaagactgtccactctctccataatcatttaacataatagtatttgaagtacaagctctaaaaataacacaactaaaagagatcaatgttttccttcaggtctgagtcagtgccctaagcagaccattggcactggctctgcacccagtcccacaacacctagagaatcttgactcccaggtgctctaacatacccaggatcacatgatctcaggagcttggtcacaccaggatttcaggaccccagaggcagcttgactcccaaaagttctgacacacccaggatctcaggatcacagaatcgcagagtcacagaatcccagagacactggactctgaggagtttggatacaaccagaatcacaggaggaacaggctccagtcagagacagcaataacaggtagtactagagataaccagatagtgagagacaaccaaaagaacataagcaacagaaactaaagttacttggcatcatcagaacccagttctcccaccatagcaagtcctggataccccataatactggaaaagcagattcagatttaaaatcacttctcatgatgataatagatgatggtgctccatattgggcaccatctagagagatcaacagatagatattatacaggtattaataaaatatgtttgtggctctaggcagagagacaaacagtaagatggtacaaagactgctttatatgcctccacaggatatccaaattctgtctaacatgagttccactggaatcttgggttatatttccagagcaattgagctatttataagtaaaaataaaatcctctttcataatcatgagaagtgattttaaatctgaatcttgctttcccagtgtgatggggtgtccagtacttgctatggtgggagaactaggttctgatgataccaagtaaacttggtttctgttgcttatgttcttgtgcatgtctctt

SEQ ID NO: 3519 - DNA, 1600 bp, mus musculus
ccgcggagagcaaagccagcccggcggggacagcagggggccccgtggctggagtcgccactgcgggcacgggcccggtagtggcacgggcaggggagccggcagagctgcgcgggccagcttcggtggcagcgggcggcgtggctcccccagagggggcaatgtctaacggggtttatgtcctaccgagcgcggccaacggagaagtgaagcccgtagtgtccagcacacctctagtggacttcttgatgcagttggaggattacacacctacgatcccagatgcagtgactggttactacctgaaccgcgctggctttgaagcttcagacccacgcataattcggctcatctcactagctgcccagaaattcatctcagatattgccaatgatgccctacagcgctgcaaaatgaagggcacagcctctggcagctcccggagcaagagcaaggatcgcaagtacaccctaaccatggaggacttgacccctgccctcagcgagtatggcatcaatgtgaagaaaccgcactacttcacctgagccacgcaacccagatgtatttgtctttccctctgtccccacatgagcctgttttcataataaactttattgtgacaaaaaaaaagtatgtgaaacttaaaggaattgacggaagggcaccaccacccacagaagcgagaaagagctatcaatctgtcaatcctgtctgtgtccgggccgggtgaggtttcctgtgttgagtcaaattaagccacaggctccactcctggtggtgcccttccatcaattcctttaagtttcagttttgcaaccatactctccccggaacccaaagactttggtttcccggaagctgcccggcgggtcatgggaataacgccgccgcatcaccagtcggcttcgtttatggtcggcggtatctgatcgtctttgaacctccgactttcgttcttgtttaatgaaaacattcttggcaaatgctttcgtattttcacaataaattccctcaatatagagagacattgcataagttctgtgactctagagaaccctgactaataaatacatggtccaaatggccactttatagggatgtctgagttggctgtaggcattgactggctttgtgaagtggaagggaggaggttccagagactattcttttgcagtgcagacagacacacagacacacagatacacagacacactaggctaacttccaccaagcagggagctggatagggatttctaggccaatcctgagttctcgtgaggtgaaatgtcattcagctgccaccctgaggacactttaataggtctacagagaagagtacacagacgccccctgagacaggtactaggaatgagggtatggaggtttgaataggtttgacccccatagactcatgtgtttgaatctttggccccatagggaatggcactataaggagatgtggccttgttggaggaagtgtgtcactgtgggtgggctttgagggcttctatgctcaagctacatctagggacagtccctttctgttgcctgaggatcaaaatgtagaatttcagctctgtctccagcaccatgcctgcct

SEQ ID NO: 3520 - DNA, 1200 bp, mus musculus
agggtgtcactgtaagaacgactgaactgtactttatttgacttgagcaaatggcacagtatgagggcaaagaaaattccaaaatgcaattcctcacgacgttaaccaatatcagactatgacaaacactagttaggacaatggtattttaaggccaatatttgggatccggaaagatggctcagcaatttacgagcacttgctactcttgcagaggacctaggttcgattcccagaacgcacacgttggctcaccgtctgtaactccagttccagggaatccaacactgccctagcttctgtaggcattaggcattcatgtgatacatgtacatgcatgcaggaaaaaccctcacacacatacaattttaaaacacacaaaaaaagtatttccagaagagaacagtgaagcacactcacaaattgtaaacaaggttgccatgttttccttgtttgaattggagtcttccatttgcagtgaagatggtacaaaagacaagctgtctgaggacacatctacatgacctgtccccatggcaacctcctgcgtgatagaagagacagccacaggctctaggctaaggccaacttcatggagggaaacagactctagggaggccaggttgtgtgaggtagagagtgccacgcttacagagttggtgctcatggccacggtgtggatggagtcactgagggtactgtcagacatcccattgacccggtttgcaatgtggtcagtttccatgaccacaggaagctccagaccattcccgtgaatgggtatcacaccaccatgtcctacagcttctgctgtaaggctgttgctcacagaatccacagagagaggctcatgacttctggagccatttgggatttggggatgctctcctgtaacaccgtccattgtaagctcctctgccattccatctgtggagattgggctggtaaccctagaaacattctccatggtgattgttgtgtccaatgctacttcgtggccatcattaggatgaagactttgggcaccatgtgtgtttacagagcgagagtctattgaaacaatgcctagttctaatccaacatttccattggcctgatacggatctagtgctgaagggttgttggtgatagataatgctgtatttccatcaacatttatagagttggggtggatatactgaggaggtggtctgtcagcta

SEQ ID NO: 3521 - DNA, 1200 bp, mus musculus
atacacatatgcatacacatatacacacatgtgtgtgtatatatacatatgcatatatgcacatatatatgatggtctaaaatacaaaagacctagaaatgctgcaagctatttaaatgaactaagtttgcaaaaggctataggtagtataaagtaagtggccagacacaacctgtttccaacaataaaaagtgctctttttaactctacgtatttttttttcaaatgtgtgtaagattttctttcgctcatgggtttcagtgcatagttagctggaaggtgaagtgcttgccagagaagtctgctttcttccaggtggacaggaaacaaaactagagaaataggccaagaacaggcacagccttagtgagaaacttctgctacctggcctccacctttgagtgtcttacattttccaataatatcatcaaacagtgagtccatcaattaacccagtgaccagttttgagctctcataattcaatcacgtctactagccctgccctttccccagcatcacatctggagtgaagtccccgacacacgagaccttagggtcattccatatctcaaccacaacagagtctttaaacacagaactagaagaagaaaattgagaaaatgtgaaatcagagcaaacagagcaacggcattctaaagagacaactttctgctaagggaaggaagtttcagtcagttgctgtctctcgtctaatcgcccttggcagccagcgtgactccttccattctctcccttttggagaagtcttgaataataatctatgggcaagaatcctgagcactgttcacttgcccttcccttctgtgggctgatgacacattacacatctctgtccaagacgcttggcagggaggcagacaggtagacagagctcaacggcaataccgcttgaatgctgtatcagaacctcagtgtgcgctggtggagaagagcttgctcttctttattacatataaagatagagacatgaaggtggaaggtgctaaggtcaccttttgtgtgtaggtgggtgggtgcatgcaggtgtgtgtatgtgtgtgtctgtgcatctatgtgtgtggggtgtgcatgcaggtatgtgtgtgtatgtctgtcggggtgcatgtatatgtatgtgttatgcatgcaggtgtgtgtatgtgtgtgagggtgtgcatacaggtgtgtgaatatatatg

SEQ ID NO: 3522 - DNA, 1000 bp, mus musculus
tccagtgccctatggtctatgtcatggatactttacacacacacacacacacacacgcacacacacacacacacacacacacgaacacacacagaggatagatagatacttagatagatggatggatagttagatagctagatatggtagatgaatgatggtagatagacagatacatagatattctacatataagagaagataagaaatgttttgtgtttctgattctgccatatttcatttaaaaataataatctccagttccattaattttcctgcaaagttatggggatcctcctgcctcagcttccccagcactgggattacaggtgctcataactgtgggttgtgggtgagtatcaaactcagttacacagcctcatgcagcaaacattttatgcctaccaagccatcccccacattcccttaatttattcgtattagtgtccatatctctaaaagtttctcctagaactgtcttaggatattctgaagactctgtaagttgtgtttcattttcatttgattctagttttaaattttttcactgtggtctactgtggatccaagagagtgttgctcagactccacaatacataccagtcttagtcagggattctattcctgcacaaaacatcaggaccaagaagcaagttgaggaggaaaaggtttattcagcttacacttccacattgctgttcattaccaaatgaagtcaggacaggaactcatgcagggtaggaccttggaggcaggaactggtgcagaggccatggaggagtgctgcttactggtttgcttcccctgacttgctcagcttgctttcctatagaacccaggactaccagcccagggatagcaccacccacaatgggcccttccaccttgatcacaaattgagaaaatgcccttacagttggatttcatggaggcatttcctcaagggaggctcctttctctgtgagaactccaacttgtatcaagttgacaaataaaacca

SEQ ID NO: 3523 - DNA, 1400 bp, mus musculus
tctataccaaggaccacatggtagaaacagagccaacttatacacattctctaagctctatctgcatgcacacatgcagcccccatgcatacactagaataaagtaattaaaatgccacttaaaaatattttactaatgtatttaatagtactgagcacattttctagatagtgaaggttatttcatcaaaatagatcataaataactgatatgctgccaaaagcttagtggtctgaaacacaaacagattttcacaatataatctgtatattttattgatttactgaaccttctctttcctaaataaaaaatgcttcaaagagaatagaaaaacataacagacccttgaactgttttcttttttatttagttaaatacttattttatttccattgtggtgctagagattaagctcatattttaacattttaacctaattttcatatcaaagaacatatacctcagaatcctagtgctacctcaaagatcttcctgtgtacaaccttcccacagagtcccaacagaacatgaaaccgcttaagaatttataaatgatactctggcttgaatgtgtccctggcactcatgttcagaaacgttcatgagtattacaggagcaagcttatgttccaggcagggatccgtaggaagcctgagttcctgttttcccactgacagcactgtaactgtcagtgctgtggtgctttctcatgcgtgatgatgtagcaaaagaccctcactagatgtggggccagcatccctgacttctcagcctccagaaccaacaaacaaatgaacttttttgcttataagtttacttgggctgtgacattttgttatagatatggaaaatggactaaggcagtattatcaaaattccttcttcaggtcactgccaagctatacctaccactggaatgaaaagtccaaacttctgttcaatatattcagctctttgaggcttaataggcattgcgagcctctgtgcttctcttatttgtggtttaatggtatgatgatctaaggtccttatgagtaatcacttagagactgtttctctctagctttatactcttatgccattgtcaaaccaaaagcatcattttattttttttatttttttttccattttttatttggtatttaactcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccc

SEQ ID NO: 3524 - DNA, 1000 bp, mus musculus
agttttatatatgtattttatgcagttggatcgtacatgtcccttacaccctcatatccctttccttcctctgacatcaccccatccttccaacaatgccataattctatcccccacgttcatatctctttctcttgtgacccactgtgaaggccaacttcatgagtgtaggagtgtggtcaactcatccatgattactctcttgttctacagatccccagtggccaatagttcctgcagagtctgtgagcccccttcccctcccatgactggatgttgacaggctcagtcttatgcagacctagtgtaggctatttcagctcctatgattacagtggtcatacccagaagataggatctcctagctcttctcttcatcatctagctcttatgttctttctgtctacacctcggaggtctcatttacagatgaccactctacagtctcttattcttagcaccttgagcagccatgagtctttgtgttagctatcatttttttgcaaaaggaatcttcccccatcaaggtggagagcagcacatgcttatggatctacacctaattattttaaggtagtttaataacatgttctcttagcaaaatgaaagcagcaggtttagccctcctgggtcctatgatctcagccatgggcacttaacaggtccacagcaccaggcacgaactccagtccatggaggggccattctcagatccacccaagatctgttggttgtccccatgacaatcatgacactatcataccatgttatcacttatttttctgagctacttgtgtagtaccttctgtactataaaagctagccatcagggaggacactttcagtttattaaacttcagattaatttctttaagaaactgtgatatcttcaacaatatggttagttctggtgtacagccgagatcaatgcaaacattctgtgctcttttgggggcatgtggggccttccagaactggttatttttatctctctctcttt

SEQ ID NO: 3525 - DNA, 1200 bp, mus musculus
cctccagtgctcagctcctctccttttgaattcagtacaatgcctatctttatgaaatagtgctactcactcaaggtgtgtctttgactatcagttaacctaattacaagaagtaatccctcactgaaactcccttcttaggtgattctggatagtgttgccatgttgacaatgaaaagccaaccatcacgagggaacttccattttctccttttattgagtcattgtttgtttgtttttgttttattgtttatttgtttgcttgcttgcttgttttggttctggtttttcaagtcagattttctttgtaagtactgagtatccaggaagttgctcactttgtagttcaggctggcctcacattcaaaggtctatgtgtacctctacctccccagtgctgggattaagggtgtacgccaccgctgcccagcatctcctgttttcttaaaccaagaatatatttaagagtgatataataagaattttaatggattcttggctttttcagaactgtttgttttaaacctgtatgtccaacaacttccgtttataattccacaagacagtggggttaagaagacagacaatattcagtgagttaaagtaaatccaatgtttaaaactataatttcaatttttcaatgccaatggcattattgctggctgatttcactcttactttttgtgggtttgccagtgctaagcaatgtttctatcacgcagtacgcatcctataaatgcttgttaaataaatgaaaatgcagactggatacaaaagacatcattgaaattttatataggtcaattgcactataattagattctcagacatgatatgctgcaaagaccaacaatgagtgatattaaccagccttattatttgggactgatggcatatctgctattcctttgatgactcccaagccacagcactagtgttgccgtttgataatgaaacgttgcattttcaagacagtatgccagacacaaagtaagtggcttaaaaataacatccaagcagcctcactaaatgagtctgctgtccaatgaaggccaaatgaaatgtttagttttctgacttaaattattagctccaagggtgccctatttttatggtgtataaagcattaatctgcctataagttctctcattggtttaaaaatacaaggtttataggaataaaattaaataaataggat

SEQ ID NO: 3526 - DNA, 1000 bp, mus musculus
gctgtcacctccaaatatcctccaaataaaatcccagccagccagccctcaggaaggcattcctgtattcctttttctcttctctttccagagggagcccctttacagcccagctcttttctccactgctccacctttcactaaaacctaactggatccataattagcagattaaggactggcctgtgtgtgcccaggctccccagcatggtttctctgtctgagatggagaattgacctgcactgtctcctgttatcacaaacaaacccggctaagcctctttatccttagaagaggtctctagcgactctggtaatttctgcctctgacaaattagcagatcctacaaccttagacagtgggaagtgttccaagctcctgctggaccagaggctctgaagagaacagtgtgagacccacccatgaaactgctagggcacagtgccttgagtcaaggtccagatgacccaaggggctagcagacagactgagcaattggttttaaaacaacaaactcagatggtctccagcttagtcaaaacttctctaggcaaagcaaaccccacatcctagtcacccaaaagatgctacagcttaaagtgtcctctagccaggacgatttggaaaccttaccaagccaacaaatcgtcttgcttctctatctcagcatggggcatgggggtaatctaactcagggtgagaggtaagaggccaaaagcccttcctggtgtgccccagtaacatctcaaaacctcacctacaaacacgtttagcccacagcattccaacaaaaagcaataaaacctaagtccctctaaggcccctgcataggaagcacatatcaaaaattactctcaaaattagcagcaatttggtgtcactaacttagctacacgttcagcaagtcactcagaataaaacaactttgactcaatgcttcctaaaatccccctcttccagggtccaagtaaatgtagaaaggtctagccccatctacct

SEQ ID NO: 3527 - DNA, 1000 bp, mus musculus
atgtctgtgggctagccttttctctgttaatgactgatgtgggagagcctaggtcactgcgggtggtgcccctctgggtaagagggcctgcgattcggtttctgccgccagcttcctgccttgggtttctgccttgacgtcctttcacgatgaaccttgggttataagtagtgataaaccctttcctcttggcagcctgctttggggcacggagttgtatcacagctctggaaagcaaactaggacaatggacttccaacctcaagcactgagagaaaaggagtgtgtttaagctacttggtctggggttttgtcactgaagcctaagcgaagtagtatgtattaaatggagaaagggggaactgtttgtgacaggaaagagcaggcagagagactggagcttagggagtggcctgaagggtcaaatcccttcacaccgctgggcttcaggagcaaatgaggctctactgccatctagtggcaacataattaactcattcattcattcattcattcatgggctgttccaaatgggcaaggctttctgttgagtaagtgatgttggtgaacacggattaacacccattgttgaatattgctactttcccctttcctctccctccccccccccccgcatctttttctttcagacaagatctcactatgaaatccaggatggcctggaattggcaatgccaacatctcaagtgctgggattacaggcgtgggctcccacgtgctttgcatagggaaattattcaagctttagtacaaccctctggcataagtactaggacttctgtttcacagaggagaaagccgagatcctgagacattaacaagccaacccattgacgagccaattgacagacagccagtcagtgggagaatccgaccttctccagggaacctggcttggggactctacaaacacactctttgctacggaggctattagagagtcttcgtcttacaaaccaactgctttagaagagtcacg

SEQ ID NO: 3528 - DNA, 1000 bp, mus musculus
gccctgggtattaattaggtttcagccatgagcttttgagaaacccagacaccctgtataataataatggtttcttctggggtgctcttgtgcaggttcacatccaaagaagatgtctttgagtggatagggaaataccccagccttgtttgtgctcctgagaaggtggggtggagctcatcgtgaggggaggagggaggcaggagtctctgttcccattacctatgtgatgtttctgtttgtacagtggtgaacacagccttctgtcggcttcctcccaagcacatgggaacattctagaactggtgtgcttgcatgagaactgacctccgggcccacccaagctgttgtggtgaggtcacttgtagccctcgtcctgggtctgtttgccatctttcctgatgcgtcaccaaagctgactgtgggccacacccacaaaaacaactcacagacagattttccccttaaccgtggatggcattggtgcattgggatatttttaactgggtcacatagctatctggttgatcattcttcctctattttcaacagatatttactgagaatttcttctcaataccctctctatgggtgcctggtacccggaatagaaagatgagccaatcctagagggatccttggtcacagtcgcagtaaagccttgtgttgggaggagtgttttaaaacatccttccaagcctctctttgttctatgacccttgacctctgtttggctcatatgctaatgttatcacttgcaaatattccagagcacccaaactccatccctttgtacccaggccagccctgatttgtcctctggctccattcattaacacagttgcaagcactctgaacaccttaccagaagtccctttgtggtgttattctctgtgaggactaggtctgtgatacccagttctgaatcaatgagtgagtgaagcaccatacatgtctgtcagtgtgtgtgtgtgtgtgtgtgtgtgtgtgtgtgtgtgtg

SEQ ID NO: 3529 - DNA, 1000 bp, mus musculus
agagcaggagtggatagctacaaaggtgtaagtgggattagtggggaaaattcttaaatgggagcctggaacaccggcttctcgttcttactgtcgccgagctgctgactgatcgtgtaaaccactctgagctttgcaggaccagatcatcagccctaaggactcttctgctgccagagtcttttgattctgacttctgacttaaaggaatcgctagcattccatatggatcgggggacttgggggcatttgtttccagtgcaatctttgtttttactttgctcctctgctgttttcttgtcactcccgtcggtcctgtccttcttcccttttgaagatacttaagaagggccctttcatcacgctaaaaccgtaaatatgcccttgaaacacgcaaagaagcttttgtgtacttccaacaggaggttattatcggacaagtaagtcacttgagtgcacggcattcctcagcccgctccacggagggctttatggggttatattgtcctatctccgcagataagactctcccgctctaaaaggtgggttatctgatgaagcggggtgcctcacgcttcaggggtgtaagccaaaggtttcgggtgctgcccaaaagtcagacatacttctccaagacaagtaggtgcttcactgagagtgttacagtcaaggacaaacgttctaaaattaaaccaaccagctgttcaactgcagacgcccacgtgccaattctgccgtccttgccttatctagcctttcagaacgcccactctctgcagggcttttgtcaagcccgaaacttcacaggctttccaagaggaaccctatccaccaaggcagaatcctgttgtggggcagaggagggcacctctccttctctcacagagcatatgctctctgcgtctttcagttggatgccaaaaccttcagaaggttcagaaggcttcagagggcaatggcatgtagccttcctcattgatgttaaagaatattaacagtt

SEQ ID NO: 3530 - DNA, 1200 bp, mus musculus
gcctccactttagccacctctgaacatctttccaggactactttggtccataagtccatctctttctccctgacagctcccagggatgctttggccactctcactacctggaggtgggacaggcggtaggaagaagctcttgagctcaggggcaaacactggttgcattctgtgctccaggtgaagttttggtttctatagcctggattgggatattgctggtctccaaccaggacctgcacagagtggtggtggcatctctttgctgctactcattggaggccttgggaggggaagagcaaaagaaactttacgtttgcttccttgaaacatctttcccatcaaggcactcagtgccaggcaggcttggcagttggtggatcttcccaggacatggtggaggctttcttgtctccttatccaggtggttatgaaacatgggttgccaagttcttctgttcatcttgacaaccgcacagtctgccctatcatccagtagcattgtcatttaatccttgcacacatgtttgacggttgtcagagtcttcatttggatacatctacaagaacacctagaatatgatctggtccttcacccaacagtcctattgaagccactttagatttctagcgctcattccactgtgttctcctcctggccaacggtagtgatgcttccatgacacaatctctctccttccctgccctagttatcagcactactcgtgctccaaattctttctcaatctggaaaaatcctccagactcctgcccataaagacccatgctgctggggttgtcttgtcttgtctgctgtgttcagccgctgttctgttcaccgtattgacttgaagccaggccttatggtccaatctgaggagggtgaattagtgagaggctgctactctacaatccacagctcctgggttgctcgtgggtgttctgctgagagtatctgctctgatcataatttgccggctgccatcggctgtgaagagaagtagatggcaggaggataggatggaggcgctgtgtgtgagtggctgcatggggtagctctcaggtacctggggataactgtagtcactctgctcatatctcaggctgtgctgtgctagctctccccgtgcatatctctctcagtgcaaagttggagttgactagtctcagtggccttgttatcatcctgtggtcttgcat

SEQ ID NO: 3531 - DNA, 1200 bp, mus musculus
gatgtttgacctcagaaacttggtcacataaaagattccttcatagaaaaagccattgattaaataatccattaaagcaaaactctgtgcccaataattttgcgtcaaattctgagtgatttttacatgctgtgggaaagaggtttggattggaaagaaagggccagaagacttgtgggagataaggcaagtaactccacttgagcagcagaccaggagggatgaagctctgtggctactcatgcctggggaaagactggggtgagtacaccagagacagacgaggcccagcatgttgctggatcccagtggcatagtcgggaaatactagaagctaaaatatgggcaaggaaaaatggtactaccaccctgggagaaggcatgtgtgaagatggggactcaaggtgagtccagttagaggggataggagagagatgaaacaggtcctgcatcccaggagaaccagccccactgtctccacagatgcctcgatctgaagacagctgtgcacaaaaattcctggatactgaatatatccttacatatgctcggagccttttgtacagttccggctttccactaacgggcaaactctgtaataagttcatttatcaccagcatgagaatcctttggtaaactatcagttctgttgtgtctgaaatagttgcattttaaaagttggctctgatttgacttgtatacacccgataaataaaactaattccattctgtgtggaaaaaaaaaaaaaaaaaaaaaaaaaaaaaaaaaaaaaaaaaagacctggcagccgtcccgggcgccatcttggggcgggggccccaccagctcctcacaggtcagaagaacggattcacagggatgctcattaatagataggcagctctgtcctctcctgttttcctgtgctatactctgcagttgtcagaataagtacaccatgactgactgacatgttttggtaaccagagactgaactctgaaatgcctattggctggtagatttgaaatcctcaacatttgaaaacttctgcatgtgtatacaacatgaatgctaactgctttctcccaagaattccccttgaagtggaatagattctatcaacaaaagttttctctttgtttaaacagcacttaagcagtttaccctaaataaaacaaaatgcgacttaaatgggtcaaaactccctttataataggt

SEQ ID NO: 3532 - DNA, 1000 bp, mus musculus
gaagaaatggcagaggagtgaacatggtcagaatatatgcatgaaaatattggcttcaattaatatagacaaaaggtgtaaatggaagtcagataaggagcgacagtggaatcccagtacagagctctcagattctgaacctgcaccatgccatctgcagcgaagagtgtacacctcacctgaaaagctgcttgtgccatgcagaaggtcgctgtcagaaaccgacccttaccctgcaaagcccgaccaccctccttcactgaccgatatgatgcaaattgatctgatcagcaattaatgcaaaagtagttaaaaccaataagggattcgaaatgagcaggtagagctcagaatgcagtgtcccagaggaaacactgctcctccatcacactgatggtcttatcaccccatcacccacttggtaggggaggacaaagcccaaactgagctgagcatattgagttagcacatgagtagaaacctgagtgcaggtctgggttatccacaaatgactgcttcatgtatttcacagatgaaccttagctaataaaggataggcagaaagggctttactgaatagataggctcaccttcattttagttgctgaaatgacatcacctctctcatttgctttcatattgaccgggtttgttgaaagacctgatgttaccatcatcacttgggactgtggcatgggctaactgcatgttcaagaaaagctgtgtcagagcagtcaaagaagctgggatctcttgcatctgtgggtcatgtgtttcccccggaaaactggaagcaggacaggtggccgtgcgttatcaatgttttcatttacccgtctgtctctttcaattcaaagtttgcaaaagagaaataagataatgtgattagagagccaaacatattcagagttctaaaaactaggccattgttaagattaactgatggattaaaggggtttagattttggatttgcatattctgtcaagaatcttggttctg

SEQ ID NO: 3533 - DNA, 1400 bp, mus musculus
agtctggcctgcacatggttaggactggttttacagatttaggaacaaggggttgggaggagagatcaaataccttcatcctaacagattgtaaacactcctcgcttcacctcttagttttcctaattcaatataacttcctagaagtgtcagggtatgttcacaccttgcagttcagtcatgagttaagacctggtcatcttccagtatattcaataatagcacaaggccaataccaggcacccaacctggagaccaagagcagaccgttactcagacaagctatcgatgacatgtagatggaatgtttctctgtacttgtaggagaaaggaagagctggacctggctgaggtctctgatactaactcacttgtacagtaaggaaaatcagaggtcacacagaccttatgagaatcttaccaaggcacttggctcaggtagacagtacatctattcccacaagagaggagggtatgtaggtccttctacataaacctccatagtttgtgaaaatgaaactagatcctaatacaagggccaggtaattcaaaccctgtgagcggctactacaattggagtgccgatgggcctgtctataacaggtcacttgagagatggatgctgctgctgctgctgattatcctgacagatgcatgaacaaggactgtccttgttgacctagtggctgagtgcagcactctagcaacggagtatgaaggtaacatggcccattatcgtcaccttgttgttgacatcttggctaaatttgatttctacacaatgataactggagttaaataggacatgaacttgacagcttgggtttgccttcatagtgaaggacaaatttcactgtgcgagcaaaaccatcaggagagttcttgtccttagttatatggtcttatacgcgttcgcgcgcccggccaggaaagaacacaacaaaccaaaatcttctgcggcaaaactttattgcttacatcttcaggagccaggagcgcaaacccccagccccaaaagcgaaagccaccccaattacatctttaggagccagagctccggcgcgccaaagcgcagagcgcgctctattgtttacatctttaggagcaagcgagcaggcgccagagccagagagaatggcggaaaccccgtcccctttaaggaggagttatccttcgcttaggacgcatcactccctgattggctgcagcccatggccgagctgacgttcacgggaaaggcagagtacaagtagtggtaaaatacccttggcacatgcgcagattatttgtttaccacttagaacacaggatgtcagcgccatcttgtgacggcgaatgtgggggcggctcccaacatctcccccttttcttttaataagagcaaataggccacccatatt

SEQ ID NO: 3534 - DNA, 1000 bp, mus musculus
cttttatattttccaaggtcttctcaggatgcaacagtagagcatttactgagagttaagaataggctttgggatatgggatggtggagatgtttgtgttggcaaaatgattgctgtgcagttatgcctgaattcagattccctatgtaaaaacctaggcatggcagcacttactctggaagtaagagaaaagaaaatccctaaagcttactgactggctagttttgagaaattaatgggctcagggttcaggaaagatcatctcaaaacctaaagtggaaaatcatgaagaagtgtatccggtgttgacatcagtcccctgaacatatgcacacacaatatatctaccataccatgcacactcaaacagacctgcacttcaacatgtacacacacacacacacacacacacacacacacacacacacctatgagcacacacacacacgtgctcacatgcacacacagggagcaaaggttttgcttaggctcagaaaggttgaaagagaaacactctgacagcaacagttgatgcaaaaccaataaatgtgttattagttgctcaattatgtactgactacaagaagggattcctgactactgtgcacaccaatttctgttcttctctgtagactgggattgagcttcaacagcatcaccgttatggagaatggcagtctggccaatgttcctcatctgagggaactccacttggacaacaacaaactcctcagggtgcctgctgggctggcacagcataagtatatccaggtaaagcaaatcagttccttttaggactatctggaaaggaatcctcccagtgtgattctgggaggaagggaactctggacagaaagttattcacgtcatggctctctctattgtaacaacatcttatgagttgggggtttggagagcattcatggcctcagatcagagtaacagtatcgctaggttctggtgagagcctcacccaaactctgagcttctgatatcacca

SEQ ID NO: 3535 - DNA, 1000 bp, mus musculus; identical to SEQ ID NO: 3534

SEQ ID NO: 3536 - DNA, 1000 bp, mus musculus
ggcggcacacatgcgattgctcgcagcacgtaccggctttccacacttctcccttgtccctcaccatctttggcatttgaaatagctgtttctggggtccagaaactagaagtgactctgtcctgtgcctgttgaaccactttggagaataagccctgcacctgacctgggcatcacagcagagctggtcctgaatcttgtgggtgtggatgagcctgctctgagggcatgaaagtaggagagttggctctgccccttgctggctgtggcattggataggccagccaggacagagcagcagatggtgtggttgtgggagagctggcagcatgacctgctcagatacttcatccaggactttggcctatccttacctcttccctaccaatgaactgcattaaggggctggctctatgggtacaaaaattaatggaaatccttgacactgctcaacaacaggatctccaacaagagtcccactgaggattcagtgttgatagaacagcagaagccagaggccttgtactggaccaatgactcattgcaatgtatatttgcaagcaaagaagtggataaaagggtatactgtgggacacactatgacatccactgtgtaattttcttttttctgttgaggggaaggttataatggcagatgctgtttatggtggaactaggagatgagtgggatttaggttcatgatgtgaaattcacaaagaaccaataaaacgttttttaagaaatgggaacaaaacacccacggaaggagttacagagacaaaatttggagctgtgacaaaaagatggaccatctagtgattgccatatgcagggatccatcccataatcaacttccaaacgctgacaccattgcacacactagcaaaattttgctgaaaggacccagatatagctctctcttgtgagactatgccgaaatatacagaaatggatgatcacagtcagctattggatgggtcacatggcccccaatgcagg

SEQ ID NO: 3537 - DNA, 1000 bp, mus musculus
ttttggccagagatgtactacttgaattagtttcgtgactttttcccttttctaaaagacttccctgtagaggaagaaagcaggtggtgatgaggaggacagaaggcagtgaaggcagagaccatgggggaaaaaaaaagttctgattattgcccttgacaatcagtttggttgtggacagaggtgtcattgtttcggccaagtagcagttttgtcctatccagaaaccagagtataatgttcagagactttggcccatgcacaaaggctctgggccacttccagatgctctggtccatgcacagaggctatggtccatgcccagaggctatggtccatgcacagatgctctttgggacctgagtagagactctggctcatgcacattagttctggttcattcccaggggctctggtttgcacatagcagctctgatttgcacagagggtctggtccatgcacaaaggctctgattgatgtacagaggtgctttttttcacacatagaggctctggttcatgcccagaagatcttattgatgtacagaggtgctttttcacacatagaggctctggctcatgcatagagagtctggtccatgtacagaggctctgtttcatgcacaaaggtattgcatcgcacacacaggggccggttcacacaaagaggactggttcatttacagggactgattcacacagagaaactctagttcatgtcttgcttttgttttttctctctccctctatatcttttcacagcaacctaatgagcagttgactagaagccacacacgtgtgggctgggcccccagtgcagtcattaggactgtgaattgcctagatgcacctcatggagttctattattgcagtgtcaggaccaacaaccccatcttttcatatctaagtccagtcagttcaaacctcaacctacttcctttgcaggtaaaaaggtcccatcaatccccagacaaagctcctcggtggcaacttcctcca

SEQ ID NO: 3538 - DNA, 1400 bp, mus musculus
actattacgaatcttttaaaaattaaaataaatagtactgctgaaataacgtttccccaaaaatccaaagcagccaagagtatattttactttggcgggtttgaatcgatatttacaaattcgttgatacttctgatcttgaaagcagtctgctcttactttcatgtacaaaagtcatagtcattcactttcggtgagaatcattttaaaaggtggaagatcaccctgtctacccatgataggtttatgaagggtctacagcttccacataaagctattcagtttctctcacttcttccccccccccccatctctttctccacttctttgtcttccttttgttctttttcttattcttcttcctacttcctcttcctcctcctcctcctcctcctcctcctcctcctccttctcctcctcctcctcttcctccttctcctgctttaccattcagcctaattaaaccagcttccaggccaggacatagatgagacagtcttgggaaggctgaagctgctattggtgtcctgaggacattcatgcagcagtggagaattgttcaaggaatacaggccttgatgatcatgtgagaagcctttgcaaaggaatctaaactcttaagtcatgagctcatattttcatagccctagataacctcatgacaataattgggactgtgctccatggctttgggcttggcctatcagagacacagagagatgaggaaagaacagatcccagagacaggaacaaaaaaactgggatcaaatgggtagtgctcactctgctgctcaagtaccagttatgcacaacaatccagaaccttggttcttgcactacatacagaaaatggagggggatccgtctctgtaggcaaacagtcctagctggcagccatccatggggagggcctatggttgccaattttgcacactgtcagaattcatacttagaagagagaaaggctatgtcatacatccgcgcctcaccagggaaacattgccattatcactggtctgactcactgggtcttcattacagttatgtcagcattaaggtcatctactctttacacattcatttgggggctctttaactcccccacaaaaccctatatatgtttactctttctgtgtagtaacttagcacataccaagctgtttaaacaaatatttacctaccacctactgttttccaggcacaaaacattcatgacaaatttaagacagtgctctggtaggtaactcaaacaagcctttgtttatttacctgttagagacactctttcaaacgactttgtgggcagaattaatttcattagagctgttaaattcatgtgaactcgtaattaattcaaatagtttggaaactttactgtttttctatattaaaaggtgagg

SEQ ID NO: 3539 - DNA, 1000 bp, mus musculus
acatagtgagaaccaggcttccttcataaacagggagactgagtttggatgctcagcaactatttaagatgaggagccagatgacatgcaccttaaaacctagcaatggggtgacagggataggagaatctttgaaacttgatggcccaacagttcagccaatcagcaaactcagtgggagaccatacagttttaaaagacaatcaagtagagcaattgaggaaggtactcaacttcaatctctgaactcttcacatgtgtgctcccatgcacgtgtgtgtgcgcgcacacacgctcacacacacacatacacacaaatggtcaagtttataataaagtaagctattcatcttggggctgttttttgttccttctccattcttcataatttgaataaaatagtagtatttctgatagcagacactccatcaaacattatttggcaggagagagtgacagaaatgtcttgttcaatagccatgtttctgtcttgtcaggctcagaggatttgctcatatttatcgaacaatgagagctctccttgacaaatttatggaataaaaagaaacataatccatgtttgaaaatgctaaaaatcaaaatatgagttagacagaaatgaaaagttctagacacatcaggtaaccagtaaagagtctcatgagactccctgaacatttcatagcaacaagagatactgtcctgtagaaaaaggagggagatatttggacagatggcaaaatggttgtgaatacagaatatatgcttgggacatggaactatggtgccttacttacttagcctttaagttttaacttctgggaaaacccgttgttttacatcttctgtttgctttggttctagacctttaaatatacacaatggaagtaattattcaaaccatccaaatcctcaaactcgcaaacattgcaagcattcagtgaagtctaacatgcaagttcatttctgtacctgctctatgcttacatttctttcattt

SEQ ID NO: 3540 - DNA, 1000 bp, mus musculus
gggcctttcacccttgatcactaattgagaaaatgccttagagttggatctcatggaggcatttcctcaactgaagctcctttctctgtgataaccccagctgtgtcaagttgacacaaaactaaccagtacaaccttgttcatggggattgggaggattagctagcatgagccatacattgtgtgtaacagaaaacgacttagaacagtacctgcccaggtgtgcgctttaattctggtaactactgctagtgactcacttccttccatctgtgacacacagactactaaacctcacagtgtgcttctatcactttacgctgaatgtggtttacacgaagcctgggttttcctcctcaagcctactcagtctttgcttgctttgctctggatgaccagcctgtttctccctgtggaatgcatcccccgttgagttaccctgatttattcagtgtatctagtaatcatagatctggagacccgggctctattttattcttttgagggcttttgctcaaagtgatcttcctgttcccctccatgtgctggggaactgttgctgtttgactgattttcgtctatagaaatggcactggcattcggctgacctaatgcaagggttctgctttttacttcctcctagatgtttccatcaagacaaggtcagtgaagtctcaagttttttcctctcttccctagaaagacctggactttgggttttggatacttggttttctgtgttcagattctaagacggttcttctgaaggccggatgtctcattgtactgtgccgtttccctttccttgttcagactggcgtgaagcatacactcttggttggttcgtaagcgtattgaagatgttactcagtgcttacattattaaagtggccaaaggacatacgatcaggacattgatgtcattgcacttggcatctttacataaactgttggtggattaaaaaaaaatcagggtcccaagcagttaataaaagcagca

SEQ ID NO: 3541 - DNA, 1000 bp, mus musculus
atttagataggcttacatgataggacttgagtaatccaccagtatttttctgtacttggagcagcagagaaaccagaaatttcccaggctaggaaactcagcattcccagtgcagcactgacagcctgcaaggttgctggtgtggaattcgtgttgctaggcagaagaggctggagtgtgatgtcagcagaggctctcagcagaagtaagagacacactcagaacgagcgagcgctctccccagcaggacacagtgatgctttctcacgtttgttttgcatgctggctgctgatggggaagagctacttacccggagaatgggtcctccccatcctcaggctctgactcacctgtcaatctctgaaaatgtcccccaaggcacacagatgtgtctcgtcagctctacacatctttttctccaatcaaggtgacaacttaaagcagccatcacaagacattgtgggtcgatgtagcctctgattctcctataagccaatctaatgggtctcataactgtgcacacgtcctgtcagttctttccctccggagagctctggcatacgaatcgtacaaacagtcagagtctgaaacagtccttaactttcttgatctcagtttgctttcagtgctatataatacggtctatttggtaagcttttttaaaattacagcaaaatcaattctcaatgtgtagttaataactgagagataaatatcagccattaattatttgaagtatagaatgggctctgttatgataagaacttcatcatcattttctcatttagcttttacaagaatcctaaaaatgggtcttagaatatcactacagaagaacctaaaaatactagacatgtgtcccccacctctcccctcccctttcctcccctcccatctcccttcctcccctgcccccaattccccttcttcccttccttccttcttttctttttttctttttttggagaaaggatatcactttgcagctctgactggcct

SEQ ID NO: 3542 - DNA, 1000 bp, mus musculus
cagaactcaagaaggttaacaagcagaagggcctaagtgaggatgtttcaattccacttgggagggagaacaaaacaatcacaggaggcagagggagggagggaccttggtggagaggggaggggaaggagaaaagggaaacatgatctggtatggggaaaggaggcaggattgaagccccaagggagtgaatggaaatatgtaaccttgagggaagagaagtgtggtgaccctctacaatgtaccagagacctgggaggtaaaagaatttcaagactcaaagagaggcacttcagatgaaatgcccaacagtggggagagggaacttgtagaattcacctccagtagaaaaacagggcatcaggtggagggatggggttgccgtgctacagtcaaaactctgatccagaattgttcctctctaaaagaactgcagggaaaaaaatggagaagagactgagggaaaggaggtccagtgactggcccgacttgaggtccatctgacaggaggctccaaggcctgacactattattgatgctatggtgtgcttacagacaggtacctagtatggctaccctctgagaggcccaacaagcagctgactaggacagaagcagatacttacaagactcaaccagtgatctaaagttggggatacctgtggttgaattaaggaaaggctggacaaagttgaggaggagagtgaccccataggaagaccatcagtttcaactaacctggacctccacgatctctcaaacactgagccaccaagccaggcaacagatactagctggtccaaggcccccaacacatatacagcagaagactgcctggtctggcttcaatgagacaagatgtacctaacccttgagagacttgaggccccagggaatggggaggcctgacagggtgtgttttgatgtgtaggaggtggaaacatcctcttggagtcatgggagtaggaatgggatgaggaactgtcactgtcggagtgtg

SEQ ID NO: 3543 - DNA, 1000 bp, mus musculus
agaaaacccctatcccgtaccccctaccccggcctccatgagggtactcctccacctacccactcccatcttccagccctcgcattccctacactaggacatcgaacccccttaggccctaggacctctcctcccactgatgtccaacaaggccatcttctgccacatatatggccagcgccatgggtagctccatgtgtattctttggttggtccagtccctgggagctccgggggtctggcctgttgacactgttgctccctccatggggctgcaaactcccttagctccttcggtcccttctccaactcctccatcaggacccccgagctcattccaatggttggctgtgagcttcctcttctgtatttgtcaggctctggcagagccgcttagagacagtcatatgaagcttctatcagcaagcaattcccagcatccacaatgacgtccttctgggtttggtggctgtataatggatccccaggtggggcagtctctggatggcctttccttcagtctctgcgccacatcttgtctccatattttcttctgtgagtattttgtttacccttctaaaaaatcactgaagcatccacactttggtcttccttcttcttaggcttcacatggtctgtggattgaatcttgggtattctggacttcggggctaatatccacttctcagtgagtatacactgtgtgactgagtcacctcactcaggatgatattctcaagtaccacccatttgcctgcgaatttcatgaagtcgttgtttttaatagctgagtagtactccattgtgtaaatgaaccacatgctctgtattcattcctctgttgagggacatctgggttgcttccagcttcttttcagcctcctgagaaggttctggctttttccacttgagctggaaaaccaagtgacagaagccaagcacaagggacagactcgctctagaaagaatcttctctcgaaacttctttagtctcccaaga

SEQ ID NO: 3544 - DNA, 1400 bp, mus musculus
ttgaacaacttctgaattcgtggaccttctatttatacacagatattttggactaactagcatacactttagaagctattccagtaaaattatatatatatatatatatatatatatatatatatatatatatatatgcatataaataaaaaacatatatatatacacatatatacaaaaatcagtcatcaatgatgtcttattactttatgattctagaatacttgtttatttctaaacatatttttattatggcaaaggtgaaaatgccaccttcacaaaagcaaccactacaatttacccacaaaacaactcagttcaaaataggtatattttagaattaaaaaaaaaaaacaaaaaaaacaggaaagagtaagagtgagagagagagagaaagaaagaactttacatggggtttaaaacaggagaaaataaaaagaaacaaaaaaggaatccaccatcgtctgcatggtccagtagccaattctcagtctaggcatcagagacaaggctctgggtcgccttcttttacagctttgctcagttgtttagctggtgtcaatcatttccaagtaagcatccagctgggcgtccaggtcctctgcagataggtgctgctgctgtttttctactgctgctgctgctgctgctgctgctgttgctgctcctgctaatcctgaacctcctgctgctgctgctgctgctgttgctgctcctgctaatcctgaacctcctgctgctgctcttgctgctgctgttgctgatcctgctactgctgttcctcctgctgctcctgctgctcctgctgctcctgctgctcctgctgctgctgctgctcctgttgctgtgagttcttgctggtgcctcttcctcttccatggctgcctccaagtgtccctctcctggagcctcaaccactaaaccttccagagccagagtttcttataatgctgcccctatttctactttgtgcaggtcttccttgtctatcaatctgtgaggtgacaaggtggatgttcatagggcggccatccaaaggggcgccattgtactctctcatagccttcagggcatctgctttcctttcaaagtgcacatgtgctgtccctaaacttcgtccacagcgatcatagtgcacagcagattttttcaacgttccaaattcagcaaagagtagctgaatatcagcatctgacactccgaagtgcagatttgacaggaacagcttcccaccagtatccacgtggttttgacccctgaagcctccaatgaataggtcatgctgccacttgtctggaagttgttttggtctgcagtatggtgccagcctgttccttccaccatgggtgaaagctggtcgatacctcttaggcccagtgcctcgcttcacccgggaatca

SEQ ID NO: 3545 - DNA, 1000 bp, mus musculus
agcagagctccgaaggattcagcagaagccaggcattcacaggaaggagatagttaaaagtcagctgtcgtgtcggggttgggcttacagcagctggattatcaaacctgcataaacaaggacaaataagatatttaaacaaaacttgttttctctttgtttcagttgaggtctgaaaccacaacactctaagagactagtactctactcctgagctacatcttagccattctttattttgagacaaggttattgcttatgtaattgatgctaactttgaccacatgttcctcctgtcttagtttttcaagtatggcaattatatatgtatgcactatgtaaatagcaaccaccagctctaatttcaaatgttgttggctttatttacttgttttaattaatggtgagggggactgggagtaacacatggggagggcagaggacagcttgtgggacttagttctctctccatcatgtgggtcccccataactgacctctggttctaagttttggtagaaagtgactccccactgagcaagcagtaccagatcccaccttttaaatacaaatcttacatgttaaaaatatataagtaaaacatacaatactttatgtgaaacacaagaataaatacattggggctcagcacttggggcatatgctgctttggtagagacctaagttcggttctcagcacctacactgggcagcttaccactgtctataactccaactccagggtatctagcatgttcttctggtctctattcttacctgtacacaagtggcacacacatataaaacataaagataaataataaaaaaagtattactataggtgccttagaatcatgttatcatttcaaaatctaaatcacactgcccaacctaaatgaaatgtctcagtgagagcaacggtatccatggagaaatgcttgaagagaaattagatgggctcttttcactaattattagaatgatccagactggcctagagaa

SEQ ID NO: 3546 - DNA, 1000 bp, mus musculus; identical to SEQ ID NO: 3545

SEQ ID NO: 3547 - DNA, 1200 bp, mus musculus
gtgtggaagtcagtttcattgactaaagcaaacacctgcacacctgtagtaaatgtaactatggaaccttggtttagtcatcattatactgaaatgcagttatttgtgaaatcatagatcagtgtccaacatgaaatgttagtaaaataaaacacagaaaaccaggtcataaagcctcatattaggtggtctatgcttcctcgttggtggtccattgtctgagagatctcgggcacccaagctacttgaaactgctggtcttcttatagggtcgctctcctcctcagcttctagtttttccctatttcaaccacagaggttagcagcttctgtccattggttgggtgtaaatatctgcctctgactctttcagctgcttgttggctctctcggagggcagtcatgatagatccattttttgtgagtacactgtaacatcactaatagtgtcagggcttggggcctccccttgagctgaatccaaatttgggtcggtcactagacctcctttgcctcagcatcttctccatttttgtccctgcaattctttcagacaggaacaactctgggtcagagtttttgactgtgggatggcaactccatccctctcttgatgccctgtctttctgctagagatgggctctacaagtcccctctctccatgatagggcatttcacctaaagtctgtccctttgagtcttgagagtctcctatctctcagatctctggtacattctcatgggttcccccacctcctaccttctgtggttacctgccattttttctgctggccttcagtcctgttccccccacccaatacctgatcactttactcttttcttctccctgtccccgcttttcacccaggtccctccctcctttccctgtcctgtgattgctttctccctcctcctaagtgtgattgaggcatcctcacttgggcactttggcttcttaacctttctgatttgaggtatttgagtattatgtatttttttgtctaatatccatttattagtgagtacataccatctatgtccttttataacttttatgatctagccttagatatgatcccattaataaagaaactttactgagatttgctgaagttaatgagataaatatttggaactgatagacacaacgaggtgaacatttgataaataaattattttgataagcaagtgcttttccca

SEQ ID NO: 3548 - DNA, 1200 bp, mus musculus
attctagtctgcacttttgcatttagattttgttttttcatattcataatatttttattgattattcaggtatgttatatcatgatcccagtcaaactccaattcaatctcccattcttgcaacttcctccacagaaagaatgtagaagaggatgaagtgaagaaggaggaaaaggaagaagaagagaaagaagaaaagaaggaggatgaggagaaagaagaaggaaaaggagaagaaacatccagtttgtattgcccatatactcactggagcacgatcatactagcaatagccaactcctactacttcaccttaagccctccattggacacttcagtgtccttatcacaaatgttagaattttcttagatagctttctgtctgagctgttactttttggaggtgggtattgtggcatgatggtaggagttgtcacagaagctctctatgactctccttctcaactgtgagtctgcagtcatttatgccactgcaaaagtagattccttgctcattacagttaacaggagcacagatcatgggcttacatatggtttcttgtaactgcacagattgcagacctccatatggcctccaatgtcagcatgtgccactgacctcaacattgtctcaggtggcagaacaggacaaggacatcaacatagactcaggtggcagtgcaggtcagagacatctgcatggcctttagtgataatatgagtcatagatatcagcacagacccaagctaaagtagaagaacagacaaacatgtcccttggccacagcatagacaaaaatatcatcatgcccttgtgaggcagcacaggccactcataccaacatggtctcctggtttgctttttaaagaaaaaaagaaaaaaaaactacctttaatagaaactaaataattttatatctctttaggcttgagaataattaaatgtaaagcactgcttttgcaaattacaagagtttagatgtgaaatgtcacaagtaattgtttcagggtcactttcactctaggctttcgtctactttcttattttatctgttctttcccaccttatttatctttctttcaatatagttatttactagtttatctgcacattttgagaaccttaagtttaaagtatggaacatcatgctctgtctttgtaaaagccattgttatttaatgagaaaattgattgcaagt

SEQ ID NO: 3549 - DNA, 1400 bp, mus musculus
cagtgaaatgaatgcaatgtattcatgtataaaattctcaaatatataaagtaacaataaagtccatattttaaatggatttgcaagtgttaacagatcttttgagattcctatagtaatgataatatgttgctactgaaatatactaaaatttttgctgctagaaattataaaaattatgttaaattatataattatatataatagtgagaacttccttatactttagaaatagatactcttagtaatgtcaatggtttacaatatgtatgctttctgatctaatttgttttgctatatatcatataactgaaaatactgtgatttttttacaaatgcaaaatttaaaagagaaggaattgagttagcaaaactttacattgcccttaattttataattgcaaaaataaaataactaaataaatatagttaaagaaatcttcctatgtatgcttacacttgcctaaggagaaaattgattatttacatagagatattaatataggtatcctgaggtcatgattcacagtcaaatagagctgaataagaagaaataaaaaatactatataatgttaagtgaaatgtttaagattcaaatatatagtataaaatatccagagcaatattgtgattaatatttggatataaactcagaagtgagcttcatgaatgagagctcatttgattaattggaaggatcgtgattttgatcttgtgtctgttgtattctgcttctaatacactcctaataagaaccctgaatcactcatatgtgctttgtaaaatgtggaaaagcttgtcagctgtgcctcttcctttccctggagaagacagcctgccaactccagaaacagacttgccagtcagcacccactgccaacttacaccttgcctttagaaaggcttattgcataatggcattgcttcattatgttgcctaatttgtgccatcttttccctttatgcatttataactaaatctcagccaaactgccctttcttttccttgaatttatcaacaatagctccatcacaaaaactagaactgtctcccctcaaagagccacatggcattacttttccaatagcatccttgtattcaaaccctgtatcataaaccacactctctatatgaggcatacacaaattttcacatcaacaacatgtgattgcacattctattattattattattattattattattattgttattattattattaattttaccatacttttatcattacatgacatatgcctgcttattttttcatatggatatcactcaaaataaactgtaaatgccatgaggatctttcattacagtattattttcagatcttaggtgatagtgttaaaacaattttgaatggttcagttaataaatttacagagc

SEQ ID NO: 3550 - DNA, 1000 bp, mus musculus
aatgaagcagaacacagaaagaaacaacatgtccggtcaggtcacagaaataagtaagatttgtcccaaagatcacctaatggaaattctcatatcatgaagagaggaagacatatttctcaatccccagtgtctacatagatctacttcattgtggaataagtggctagctgtgactttattgtaaataatatttgtgcagatttctcaaaataattttattttccgtttctaaatgttactaaatggaatttttagctaattcatataatgtagttgagatatggtactggctggttttgtgtgtcaacttgacacaagctggggttatcacacagaaagatgtctcccttgacaaaatgccttcatgagatccaactggaagacattttctcagttggtgatcaagtgtgggaggacattgtaggtgttgcatcactgggctgggagtcttggtttctataacaaagcaagctgagcaagccaggggatgcaagccaataataacatccctccatggcctctgcatcagctcctgctttctgacctgcttgagttacagtcctgacttccattggtgatgaacagcaatgtttcctgaaatgtaagctgaataaacccattcctacacaacttgcttcttggtcatgatgttttgtgcaggaatagaaactccaactaagacagatattaatatttttattagatactttctttatattcatttcaaatttcaaatgctatcccaaaagttccctataccctccccctgccctgcttccctacttacccattcctgcttcttggccctggtattcctctgtactggggcatataaaatttgcaataccaaggggtctctcttctcagtgatggctgactaagccattctgtgatacatatgcagctagagacacaagtgttctatcagatattaatatttttattaatgcttttagcctgctaaagtgtctattaatattatgcttctttttattct

SEQ ID NO: 3551 - DNA, 1200 bp, mus musculus
gctgctatagagtagaaacagaagaaaacaagaacccagaatgtgcatctgctcagatggttcacaaatctctcaagctctgtgtatcttcattgtgtggatagttaaatattgaaagttgtatttttttaattaattgattttttttacaccccatatttcatttccccattcctgacccactctctatctgttccacatcccatacctcctccccacactcctctctccaggggcatgtacccagcctcaacccaccatcccacctgacctctaaactccctggggcctccagtctcttgagagataggtgcatcatctatgaatgaacacagaccctgcagtcctctattgtctgtgtgttgggggctgtctgtgtggtagcccagtgtttgagagatctctgtggtccagattagagactgctggtcatcctataggattgcccttctcctcagcttctttcagccttccctaattcaacaacaggagtcagttgcttctgtccattggtttggtgcaaatatttgcatctgactctttcagctgcttgttgggtcttccggagtgcagttatgctaggtccttttttgtgagtgctcagtaatagtttcaggctttgggacctccctaacttctaaagatgatgataggttctgatctgtgggcttcatgattactgtattagttagggttttactgctgtgaacagacaccatgaccaaggcaagtcttataaaaacaacatttaattggggctggcttacaggttcagaagttcagtccattatcatcaaggtgggaacatggcagcatccaggcaggcatggcacaggcagagctgagagttctacatgttcatccaaaggctgctagtggaagatggacttccaggcaactagggtgagggtcttaagctcacacccacagtgacacacctactccaaccaggtcacacctattccaacaagcctacacctcgaaatggtgccaccccctggtccaagaatatacaaaccatgacaaatacatatgaagagctttttactactgaacagacttttcacccacaatgtcaattctaactttctttcagcgattgtataattatttgtgtttaataacctatgaattatagcaaagagattctgatatgaaatctacaaatatacactgttatcaccaaagctaaacattttc

SEQ ID NO: 3552 - DNA, 1200 bp, mus musculus
gtatctgaatactttgtaatttcaatgagttaaatcctgagtgaggtaactcaatcacaaaagaagtcacttgatatgcactcaccgataagtggatattagcccagaaacttagaatacccaagatacaatttgcaaaacacaagaaaatcaagaagaaggaagaccaatgtgtggatacttcattcctccttagaatagagaacaaaatacccatgaaaggagttacagagacaaagtttagaagtaagacgaatggatggaccatccagaaactaccccacctggggatccatcccataatcagccaccaaacccagacaatattgaataattcagcaagattttgctgaagggaccctgatatagctgtctcctgtgaggctatgccagggcctggcaaatacagaagtgaatgctcacagtcatctataggatggaacactaggtcccccaatggagtagctagagaatgtatacaaggagctgaaggtgtgtgcaacccccagagctcatgtttctagctgcatatgtagcagaagatggccaagtcggccatcattaggaagagaggctcctaggccttgcaaactttatatgccccagtacaggggaacaccagggccaagaagtggtgggtaggggagcagggcagggggagggtatagggaacttttaggatagcatttgaaatgtaaataaagaaaatatctaataaaaaagcaatccctgaactttggtacaatgtctcataaagacgcttaagagatccccaatcattgaagaacatttgctgctcttgaggaggacttaacatctattttttttattaggtattttcctcgtttacattttcaatgctatcccaaaggtcccccatacccacccccccaatcccctacccacccactcccactttttggttctggcgttcccctgtactggggcatataaagtttgcaagtccaatgggcctctctttgcagtgatggccgactaggccttcttttgatacatatgcagctaaagacaagagttcccgggtactggttagttcatagacttccaactatttttactccaagtacaggagatcaaagctcttcagaacttaattgacataagttcatggtgcacaggcatatagtcagacaaaacactaatacacataaaatatacattgtaaaagttaaaaagaac

SEQ ID NO: 3553 - DNA, 1000 bp, mus musculus
ttctctgagtgggtaggtgcccctgtgtaccccataccctgatacatcatgtctccatgaggctaggtgcattttcttccactgagcccagggaatgcaggccagctagaagaacatatcccacatacaggtgacttccttagggatagatgtgtgggtccatttgtttggaacccacatgaagaccaagctgcacttctgctatgtgcagggaggcctaggcccagccccttgtatcttctttggttggtgattcagactctgacaaccccaaaggtccaagtttgttgactttgttggtcttcctgtggagttcctagcctctgagaggctgcaatcctaactcctattctttcttaagtgtccccaagctttgggtgtctgcatctgtctgagtcagttggtgggcagagcttctcagagaacagccccttagagggcatcctatctgcaagcataacagtaccattaataagtttaggggctggtgcttgctcatggggtgaatctcaaggtggactggttattgtttgaacattccatgagtttctgttacatcctcaatttctaaattttatgtagacaggataagttgtgggtggaaatttttgtggatgggttgaggtccctattgctccactggggttcttgcctggtcacagggggcagcctttccaggctttatatgcccaatgctgtgagcaatgctaagaacaaccccactgatttcattcattctcagggcatatggcctaccccctgctccaccaaacaactgaccctgagcccccacactcctctcctgatcccctcttctacccagttctctctctccatctgctttccacaaccattgcatttttccttccttgcttatggcctcctcctgtccatcttccttagctctgtggagtgtagcatggatattctgtattttatggctaatagccagttataagtgagtacataccatgtttgtccttttgggatcatgttgcct

SEQ ID NO: 3554 - DNA, 1200 bp, mus musculus
ggaaattatcaccattacataatgagaaaaatacttacaaagctaaaatgagcatgtaaagatatgaagatattgttgtttaaatgcaatatatgaaaactgttctgatttgcctttaaatgtaaaatactattttcatggttttaactgagaaagactatttgtttctttttaaaattttatgtatttatatttcaaatgttatcccctttcctggtttcccctatgcaaacccccaatagtgcccccttactctgcttctatgagggtactcccccgcccacctacccactcctgcctcaccaccctaacattcctctaaaagggtgcatctagccttcacaggaccaagggcctttccttccctttgataacagataaggccccttcagctccttcaatcctttccctaactcctccattggggtttctgtgctcagttcaatggttggctgcgagcctccacgattgtattagtcatgatctgccagagcctctcaggagaccacttttttccttttttctttttctttttctttttctttttctttttctttttctttttcttttttttttctttttctttttcatttttctctttctctttctctttctctttctttttctttttctttctctttctcttttccttttccttttgtttttcttttctcttctttcctcttttctttttcttttcttttcttttttttttcttttcttttcttttctttcctttgctttgctttgctttgctttgtttgctttcttttctttttttcttttttcttttttagatttagtaatctaatggaatctgctgattctgtaggatctttaagacggagaagctattcaagggtgtagtctcaattccttattcagagataaaaggaggatgagacattttacacaaaaactaagtctagcactctggaggcagaggcgagatcctggacagctaggtctattacacagaggaaatgttttttaattaatcaaaccaaacaatctttaacaaatttctaaaatcgtcaagaatgctttctgtggatagactctttctgtgtacttattcagcattataatttaaaagtaacttcactatttccaattatatagaacaatgtttagctatcacttagccttgaatatgtaactggcacctggcaaaaatgattttttaaaatatttttcctt

SEQ ID NO: 3555 - DNA, 1000 bp, mus musculus
tctctaccacccccactctggggcatctagtcccagcatgtctaggaccatcacctccaactggggtctaaatagtagggaagggactccaatgatagcagacagagaacaagacaccccttcccccctgctccacttgttagaggacctgtctaggtccaattcctgtgtaatccctcattgatggcccaggctctgtgagcccccaagttcccatgttagttgactctagggtattcttgtggtgtccttgacctccccacttctatcccccactcttctacaaggctccccagacattgcctgttgtttggctgtgggtctctgcttctgcctccatccatggctggatgaagcctctcgggagccagagtcctgcaaggttcctgtctgcaagcatattacagtgtcattaacagtgtcaggtgttgactctctcacataggatgtgctcaggttggggcaatcattggactgctatctcttcagcctctgctctaccattatccctgcaaattttgtaggcaagagaaattttgggatgaacgttttgtgggtggatggatgtcccccctccctcctctggaagtcctgcctgactacaggacaaggccaattgagtctctatattcctctaaggtaggaatctaagttagggtcacccctttagactcctcatatcctctccagacccaggcctccctctagtccccagtgatactcccacctgtcaccttccattcttactcctagatctctcttgccccacctctccccacacatgatcaccatctccgttgttctcctcctcacctcctctccgtcccagttccttttctcaatccacctccaataaccatttaatttctccatctgagtgagatttgttcactcccttggaaccttcaattacccagttccattgagtatgtggattgcaatatggttgtcctgcagtttatgattaatgtgagtacacacaccatatttgtctttctgg

SEQ ID NO: 3556 - DNA, 1400 bp, mus musculus
attttatttcatattaaacagaatctataaaaatattgttttagacagttaaaagaagtaaatattagatgttaacttcaaaaataataggttaagatagtacaatgtgataaaacccatgctatttaacataaacagaaaatatcctatagtctgatgacatgctgtacataggattagcttacatttcacaaaacacaagtgagagaattgaagagtcatcttagaaaacagggcttattttcatatccttttgaattcttgtttcaaatgatcattttattcagatatgtgtgctgataacattttacctattgtacatccatctccctactccatacaactcactgtataggtgataagtcccagcctttgacagtgacaggaaagattagcaagaattttgactttgataaatcagatatattaaaactttgctgcagggatgcactcctcaaaagctggtttagcactgtaaacacggtcctccttgttgtttgctttctataaacctgtaacacagtaggtattccaattaaatgaagtgcatgttcatgtacacttcagactattttacattatcctgctggattatgatgccttaaagaaaagactatccaaatgattgtggtagaaggaaatatgagtcttttttttttctttcttggaacagattttattatcaacacagtcctttcgcgatttcatagacctgttatgtattcccacccctctctgccacactctcctctactggtcctccccttccattctcctgtgctccataaaaatctattttccttcattacaagttttggatagtttagtcttccagacccacttatgatacttttcaagctataagctatcaaggtcataaaagtaaatttttaaaggtttaattttggttcaatccaaagctgtttgtcagtcagttgagtgaggtaactcagcactttgacaaacagggttattggtcttttacgatttttctgctacaccaatttactgattgtcaaggtcaaaagagacatgttttcaaaatatattattattgatattctttttgaaactctatgagcatattgggaaataaactgatgctctctttcgatctttagcggccaagacagctatctagaacttctcagtgtactaaggtgtttgacataagcattgtctgacaactgaaaaataataaaatctgtaattcaccctatattcatgttaactaaagggtaggataagacatttgaataagaaatggtggaatgcccaagaaaatttttcctagggtaatgagtgtccttaattacattcaaaagtcattctatgttattctacttcttatttgattgaaacacaattctttctaatccttgctacaaaacatcacatgt

SEQ ID NO: 3557 - DNA, 1400 bp, mus musculus
gctttgatgaatactgatgagtgacttaaagtaatgttgactcatcaagtcttcttctatgatgaaaaaaaatactctatgatttttatttatttcaaagatgactcagtacttataggtgtaaatccattccttaatttaagaaagtagtaagtgtaaataattatcatagtttaattcccctttaaataaagttaataaaacatggggacccaattccaatcgtgattcatacatagaaggagctagcaagtatgtttctcataggtgatcagtttgttccttttcctggtgttaagaagtgtagtaccaatcataaattctaagaatgtcattagaggatatgctggtttttaaaaaatatatatatctttaatctttttttttacagtccagtccttatccccttcccatcccattccttatcccattactcccccacccctgccccatctccaagaggatgtccccaccacccaccacgcacccttctaggcctctgactccttggggcttcaagactctcaaggcttaggcacatcttctctcactgagtccatacccggcactcctctgctctgtatgtgttggggctttgtaccaactggggttacgatgcctggttagtagctcagtgagagatcccagagtccgggttagttgagactgctggtcttcctatggggttgccctcctccttaacttcttccagcctttccctaattcaaccacagaggtcctagacttctgtccattggttggttgcaattatctgcatctgtctgggtcagacatgcaggtcatctgtctgtaagcacaagatagcatcagtaatagtgtcaggccttggagcctcccattgagatggatcccaatttgggcctgacactggatctcctttccctcagtctcttctccatttttgttcctgcagttcttttagacagaaataattctaggtcagtgttgattggcaacttgattgaaagactagtaaattgttccttagcttctatctgtgaaagtgtttccatagaaagtcaaaagggggaaaaaatcctcccagaatacaggtggcaacaccagaaagatgcccaatgcctagacacttttctttctctccttttagtaggggtgatgtgagatgctctgcctcatgtcacaccttccctgcccagattcaatgaaaccatgaacctgcgacaccctctacatttaagttaatttctcgtgtactggttttcagagtaataaaagacagaactaggagcaggagatggagacaaaagtggataagtttgatttccctacacctatggccgcaccttcaattgtttatttttctaaactcagacttaactttcaacttaacctatggcccagtgactgaagcacattaa

SEQ ID NO: 3558 - DNA, 1000 bp, mus musculus
gcctcactttctatctttaacattcacaggggaattttaatccagcaagatggctcttctggcatccaaagaccttctaagtctggttgatctagctgggttacatacatgccctttctacacgcctttaatctaaaacaatgaagataaacatagtttagaggaagaagcagctatgtttgaaagtgacatgtaattgaggtgacaaatcagagaacgatttggtagaattaatcagagatagatatcccaacactcaggggaccagcacagaaaaggctacttaagagtagcacagggagagagaacaagtaagacactggtgatggtgtgtctgaaagaaagatgaaatttcaagacctgtaagtcatgtaatgtactcagaaattgctggttgtttgtgagcctagaggctgcctggggctgagaaaaaggaaaaacaacccgggtatgccctgtagttaaaaaattactgggaacagcttaaccttaaagataaagaggaatgtgaggacataacagggctatctgaactgagtcaacaactcacagaactctgacactctgcacgtacatgtaatttttctgctgatgtttgaataagccaacagtgtgttgctatgctgaatttcacacccctaagccccttactccataaaaacccctagcttttgagcctcatggccgacatccgttatctcctatgtgggatgcatgtcggtccggagctctgtcattaaatgacctcatgtaattacatcaagatggtccttcgtgattctttggatgcccgccgagtcgggaactgagttggggtttccccactaggttctatcattgtctatatggcagttttgccagggcagttggacagagacagggtatagaaagaataagctagaaacagctgaagacagaacaagccagagaatgaggagaagccagaagattagaacatattgtcaatgccggtatgaggccagacagatcaaatcagtca

SEQ ID NO: 3559 - DNA, 1000 bp, mus musculus; identical to SEQ ID NO: 3558

SEQ ID NO: 3560 - DNA, 1000 bp, mus musculus
ctttaacttgatgtttattgactattcattagaaataatagataaccattcattatcctggccctctgagcttctctcccccaccccctctgatcttgatcctgtgtccctttcgtgcctctcctatcctgcccaggtctctccctccatctgccttccatgattactttgttccccttctatgtggggtagaagcaacctcctttgggccgttcttcttgttaaacttcttatggtctgtgggttgtatgtatcatgggtattctgtactttatgactaatattccatgagtacataccatgcatgtccttttgggtctgggttacctcacccaggatgatattttctagttccatccgtttgactgcaaaattcctgatgtccttgtttttaaagctgaatagttttttagtatataaatgatccacaatttctgtatctattcttaggttgaaggacatctctttctttccagcttttagtggggttgtgaccattacttggtttgagttattttatgtgtatgctgtcatctcaccgaaaattaatccatgtgtaattgattgtaagcactagttcatcatctcttcacagactgtgtgacattaaggaattcgaagggctggagaggcattcaggcactcagtagaatatacatacttttacagtgcttataagagatcactgatcctcctgtgacccatgtttcctcaaagcaaagctcaacatttctaaagtagatggtacaagagatgcataccaacaatgcaactatacattgctgtcatacttttacacatgagctgctaagcatataggaattctgagtcagtgtgtttagaatactgttatttatcaagatagaacagaaagtcagtaaatggatttgagggcttttgaccacttcattgcacatagaatgagcaaactgagtgaagctagtcattaaagtgaaggtcagtagtcaaacaccatcaagccatataagagtatgataat

SEQ ID NO: 3561 - DNA, 1000 bp, mus musculus; identical to SEQ ID NO: 3560

SEQ ID NO: 3562 - DNA, 1200 bp, mus musculus
tttctaatggtgttgctttgaagatttttaatttacttaatttagtattaagagtcttaatatttttgttttgcttactagctttttctaatatttgtcattatgacattggtgtccttttcttctctttatgtcgtacatactgtgtttcctttaatttgatttctttaactctatatagtatagatgtaataaaaaggaaggtgtctttggcttacagatcagcagatatgcttcatcatgtcaggaaaggcatgatagctgaactggttcagttagtctgttgatgaaagaaaattaaattcaaggcccatgactcatgtggcttgctagttaggagggctttttgggcctagggcaaagaacaaaggctgttgctgtaaagtcattccaggaactggctagccataaagataggagaggcatgcaaggaccccctactatctcaactgagttatgggccatttggcccagtgcctccctgtctcctacccttatgccatgagttaaatgttgacatagataagcacccgcccttcagaattgctgttaccttgatctgcgcatacaatttgctgatgttaaactgtccaattgtgtgtaacagtgccaattcttcccctgcccccaacttttttgtatataaacccctagcttctgagcctcgagctcgactcctctgtctcctgcatgagatacgtgtcagcccggagctcagtcattaaactacctcgtgtttgcaacaagccagtctcccgtgattccttgggtgcacacaccatctcaggacttgagtgggggtctcccactatggtctttcatttggagatcccaacgagatttgtgtgacacccaggaaccccgaagaccccttggaggtacgtctgtgtgagtcttatatgttgtctgagtgtctgagtgcacgagtcatggaccttgaatttaatttttttcatggaaacaactgttgtatcttgtctgttccataatcagagctcagtcaggactagatcactgtcttagctgttctttattgacatctgctgctttaagctcccaccagaacagtctatcaagctcagctaacagcattctaagactcttctaacacacatctccaaactcttccacatgatccagtattaactcattagatttttgcattttcataccattcagagttgatacacaattcttata

SEQ ID NO: 3563 - DNA, 1200 bp, mus musculus; identical to SEQ ID NO: 3562

SEQ ID NO: 3564 - DNA, 1200 bp, mus musculus; identical to SEQ ID NO: 3562

SEQ ID NO: 3565 - DNA, 1600 bp, mus musculus
tccagaactattctaacacatagttttctatgggccactacattctctaggtttctatgtcttctctgcattaattatgatggccaatgatcataccatgcaatagaagacagctacttttcagcagaggggcacctttgggatggtagtatcatggatttcttgatgtgtatgagggcttatttcagaacacaaggaatgagaaagtcatttggtcttctgtttttcttaaccaccaagttgtcacgtgttcagtcagcatgtcacaaacacattacaatgataggttggatgcatagctacatcacagaactctttctaaagcaagagaggcaatacaattaagaataaatgctgtgaccacataatgaggaaaaagtcatactcaggcatgatgtcatagccctgtaatcctagatgtttgagagtctgaagcaggagaatcccaagttctagtcatgtctttgaaacagagtgatttcaaggtaaatcttgtaaacttagtgatattctctctctctctctctctctctctctctctctctctctctcacgcacacacacacacacacacacacacacacacacacaccaggaaccatacgcattctgttggattacatgtaaacacacacgggaagactttcacagtgaagcaggaacttcgatatcattttacaggcacaccccatggacaggagatggcctcgttgctgaccctccgcctccaaatctttacagtgtagggtactgtacctgatgcaggtagacaagggcccacacagcagcaattcaatagggtaagagaaggaacagacatgggtgcaggccctcgggtttgctttcccttccctccaaacagtggcagtgcatcacaaatggctgtttatcaaagtgggaagtaaaaaaccaagactgagtcctaaaaggcccagacgaatgaatacactatttctgtccatgctcttcaatcaggtggcgtggacagtcctgggggagggacgcgccacatctggccatcttctaggtgatgacagtgggcacagtgtggccagtcctctcctggagctaggacactttcagagcaatggagatcaggggcaccagcatgacctgagaggagcacaaaaggaaagaacccttcccatctcttttctttcttttttcttttttcttttcctttcctttcctttcctttcctttcctttcctttcctttcctttcctttcctttcctttcctttcctttcctttcctttcctttcctttcctttcctttcctttcctttcctttcctttttcttcttcttcttcttcttcttcttcttcttcttcttcttcttcttcttcttcttcttcttcttcttcttcttcttcttcttcttcttcttcttcttcttcttcttttggaatggttaatgctctgtttaatgaagtgtcaagaacaaacttctaagcatcaaaagcaggtcctctgctcacacgtaaactattggcaagcaatgccctcctgctcattaacactctctgttagtttctgaggtgttttcaatttctccagcaaggatctattagtcccaaacttctcagtgttactgtgt

SEQ ID NO: 3566 - DNA, 1400 bp, mus musculus
aacaatatagatatccccttaactgaagagtggattaagaaaatgtggtacatttacacagtggagtactaatcagctattaaaaacaagaacatcatgaatattgcaggtaagtggatgaaactataaaatatcatcctgactgaggtaacccttacccaaaaggacatacatagtatgtactcacttaaaagtggacatcagcttaaataataggatagccatgctataatccatataccccaaaaagccaaataacaagaaggacccaagagaagatttttgaatctttattataaagggaaatagatatgggaggtggaggaaggtaggaaactaggtctgagaggggatgagggtgggagcagggtggtggagtggtgatcaggtgtagggagagtaggggagagagaactgaagaaggtaataagtgggcagagggaatctctaggatgtgccagaaacctgggattgagggaatgctgcaggggacctagggggtgactctagctgagacccctagcagtagaggatatggatcctgaagcagctacttcctgtagccaggcaagactcccagtggagggataagaacagcaacccacccacaaaaccttcaacacaaaatatatcccgcctacaagatgtgcagggacaaagatagaggagagacttgaggaaatagcctactaataactgcctcaatgtgagacccatcctgtgggcataagccaatccctgaaactattaatgatactgttatgcttgcagatgggagccaagcataagtgtcctctgagaggttccacccagcaaccagtggaaagatacgcagaaacccacagccaaactttagatggagctcagggagacttatggaagagttgggagaaagattagggaacccaaaaggacagtgactccatcggaagaccaaaagagtcaactagcttagacccttggaagcttccagagactgaaacaccaaccaaagaaagagcatgggctggacttagggtaccgtacacatatgtaacatatatgcagctagatcttcatgagggtcctttaacaactggagacatagctgtccctgaatctgatgtctacctgtggatctcattaccctaattgggctgcttttataacctcagtgggagaggatgtgcctagtactgaagtgacttgatacagtttgaggtgttccacttcccaaagaaggggaacaagaaataaggggaatatctgcatgaggaggtactgggagcaggagtgtagagatgatattgatatatgaagtggatgagtaaattaattaattgataaaaaatactgcccctccgttagagttaacaattactgaagatgttttacaaaaaccttgcccaagtccctccaat

SEQ ID NO: 3567 - DNA, 1400 bp, mus musculus
ccatttctgctcatcttcaatttgtggtaagaattgacattttgttactaatatatacccataacaatatctaaatggagatattattcaatgttgaaagaaatacaagattatgtagattatctgagaacaccctcccattacagagacaaagaaccctgttctttcgtttgtttgtttgttgtttggttttgctaattatttatctaggattttcaattccaacgtctctgatgtgtgatcatctatatcaataacctgaactttagtgtttcaggcttattttagctgttaaatagtcaagctagaagaaaagaacaaaaaagaaagagagagacagacaaacagaccattttggatttaatgaaaagaaagacatcaaacatcttggttctgggactccaccaagagtagtttgcacaggtgagagtgtggactacagaaactaacagcttctgggacaggcagaagccacagagcttcagaggcagcccccttttcaggccccagacatctgggcaccttccctgccagaggataagtgtctgcacggcccgggaagggcttttcctgagcattggcagcagacatattggttccgggactcctccaagagtagtatgcacaggtgagagtgtggactacagaagctaatagcttctgggacaggccaaagcaacacagcttctgggacaggtcctgttttgggtcttcatcttcggccaggagggaggtctgaatgccagatatctgtgcaccttccctgtaagaggagaacttgcctgccaagagtgctctgaccactgaaactcagaggagagagctagtctcccaggtctgctgatagaggctaacagactcacaagaggaacaatctctaaccagagacaactaaatcaactaactccagagattaccagatggcaaaaggtgaacgtaagaatcttactaacagaaaccaagaccactaaccaacatcagaacccagcactcccacctcgaacagtccagggcagtccaacacacccgaaaagctagacctggatttaaaagcatatcacatgatgatggtagaggacatcaagaaggactttcataactcactcaaagaaatacaggagaacactgctaaacaggtagaagaccttaaagaggaagcacaaaaaccccttaaagaattgtaggaaaacacgaccaaacaagtgatggaattgaataaaaccatccaagacctaaaaagggaagtagacacaataaagaaaacccaaagtgaggcaacactggagatagaaaccctaggaagaaatctggaaccatagatgcaagcatcagcaacagaatacaagagatggaagagagaatctcaggacattccatagagaacatcagcacaacaatca

SEQ ID NO: 3568 - DNA, 1000 bp, mus musculus
gaaaaggccatccagagactgccctacctggggatccatcccatatacaaccataaaacctagacactattgtggatgccaagaattgcttgatgagaggagcctgatataggcgtctcctaagaggctctgccaaagccttacaaatacagagccagatgctcacagccaaccattggactgagctcagggtccccaatagaggagttagagaaaggactgaaggagctgaaggggtttgcaaccccataggaagaacaacaatatgaaccaaccataactcccagggactaagttatcaaccaaggagtacacatggaggaacccaaagctccagctgcatatgtagcagaggatggccttattggacttcagtgagagaagaggaccttggttctgtgaaggatggatggatgcaccagtgttttggaatttgaggagggggagtcttgagtggatgggtggaggaacacccttatagatgcagggggaggggagatgggaaaaggcttttcaggggaaagggcgaaagcaggaaaggggataacacttgaaatgtaatacctctcctgggcatatacccagaagatgttacaactggtaataaggacacatgctccactgtgttcatagcagccttatttataatagccagaagctggacagaacccagatgtccctcgacagaggaatggatacagaaaatgtggtacatttacacaatggaggactactcagctattaaaaacaatgaatttatgaaattcttaggcaaatggatggatctgaaggatatcatcctgagtgaggtaacccaatcacaaaagaacagggaatgccagggccaggaagcagtagtgggtgggttggggagcagggcgggtggagggtataggggacttttgggatagcatttgaaatgtaaatgaagaaaataatctaataaaaaattgtttaaaaaaagaaatgtaaataaagaaaatatccaaaaagaatgtat

SEQ ID NO: 3569 - DNA, 1400 bp, mus musculus
ctgtgcaaactggggttctggtggtgggagtccgaagcggcacttgtggggagaagcacgtggttcgaaacgtgccgccatccttcgtaacctaggtggaaactgcctagtgcatccgtggagaccggctgctttccaaatcaagttgggggtttgaagggcggggttcaaccgggcaagtccgagaggaaagttgctttcagggcagagatgcgctcctggggaaaaattgggttacaatattcctacgagtgggcggtgaggctggaggacagccagccttccttcttgagggcttgtgaatcatttgcaacagcaacacagactatcaaggcagtgtattcacgtgacccggatttgattctctcccgcttgagacatcctatgaaatggactgtccgaaaaccgacctttaggtctactctcggcacgtggctgctggagaaagctcagtttggagcttctctgcgcctcctggaaacgaaatgggtgacagagaaggaggaggaaaggatggtggcacagagatcttaaggaacgaatggagagggactaggcatccttctgccttctacgtagttgatccgcttggctggtctcggtgagatagcgcagaaatagaatatagcacactgaaacgaaagcgctgcacttttaacttccagccgaggaaagaatcagaatcttagaggtgcacttgccggtgcaaagggagacccacccgcttttaaagtctccaagggtgggcgttcttttcccttcggccaagaaatgtcactgaatgtgctcattagcataactaagaagcaatcgagttcttgcttccttctttcccttttcaatctccaccctggtggagaaaggctagagtaagacggggcggggcctggaggccagcgtggtgacgttgtaagtgtttgggtgcttatgcaaataagactgcagccattgcctctggttcaccctcctagtctcctcagaccttaaaggtataccctttcctaggtctgagttcttccatgcagagctgagaagaatgagaggaatgaaggctttcctttgggtactgcatttgggccccttttcgtcttctctgtaaaaggtattttatgactgcctgtgctcagtagctttctgaaaaagccaggaccagagcagtcccaacaagcttcaaaccccgagtgtctcattttttaaatgcagacacaattacatcttttccagctggtactaccctggagttttgtttgtttgtttgtttgtttgtttgtttttgtttttgttttttttttaggcactttataaatacttgaagaaatgaagtttcttgtttgttcatttacagtatgtgtatttctctcccacacattccgatgattttatattaccctaccaagttt

SEQ ID NO: 3570 - DNA, 1000 bp, mus musculus
ctgggctctcctcagcaaactcttcattccattcccccatcacctctgcctcttggagggtgctccactcttgtctcaacactctagcatcccccttctctgtggcaacaagccttcagaggatgaagtgcctcccttcccattgatgccagttaaagcaatcctctgctacatatgtatctggagccatggacccactcatatatactctttggttggtagtttagtccctgggagctctaaggggtctgattatttgatattgttgttattcctatggggttgcaatcttcttcagctccttaagttcttcccctaacttttccattggggtctccaggactcagtctgatggttggctgggagtatctgcatctgtcttagtcaggtggtggcagagcctcccagaggacagccataccaggctcctctgcaaacacttcttggcatcagcaatagtgttggggtcaggtgtctgcggatgggatggatcccaacacagggctgttttgtttgtttgtttgtttgtgttttgttttggccctgtgtttcctttagacagaacaattcaggattaaaaattttgagatgggtgtgtagccccttccctaaactgggggccatgtctttctactggggatggtctcttcagattctatctcttctctgttgggtattttggctaatgacatcaccactgggtcctggaagcctcttgcatccctggcatctgggactttctagtggttttccccagttcctccctacaccccacccctacttctacatatttctatttagtctcctggccttgatttctctcctgtccctttttatatctgatcctgcacctcctttttcccttccccttccctttccaccaaggtccctccctccctctaccccctgatgattgttttgctcccccttttaagtgggattgaagcaccaatgctttggccttccttcttgtaaagcttcacatggtctgtgagttgta

SEQ ID NO: 3571 - DNA, 1600 bp, mus musculus
catctcattttattgaatcatagcctacagcttgttcatattttccttggattttatgttgtattattcttttgatatttttgatcattttatatattcatatttcatttttgtttttcccacattggtttaaaatataactaagtgtgatccatttttatcaatcatgaagttttctgaatgtcttgcatgcatggcttggggcttgtaaaaatttgaaaatgtttaaagcattattcacttaggttcttttgctcagctttaaaatatctttcaaatttgagccattaaaatcacaaataaatttgataaaattttatcttaaaagtagagcaggatagttcattttttattgtcttatctgtacttgttattaaaagttatggcatttttattagatattttctttatatacatcccaaatgttatcctgaatgttccctataccttccctctgtcctgcccggctcccctacctacccactcctgcttcttggccctggcattcccctgtattggggcatataaagttcgcaataccaaggggcctctcttcccagtgatggccaactaggctatcttctgctacatatgcagctagaggtacaagctctggaggtattggttagttcatattgttcttgtctctgagcttgctatttcatcccaaggagctctgagggacaccaagagcttcctgtttaccttggaggtcttcagggttaccaagaacaactaacttgaaacactgcctcatcaattcctttccagtcaggtcttcctgaagcacagccaggagaggtgaattgtttgaggttcactgacctccattgtttggctctgtgctcaaccttccatcctgaccagctttgagggactccaagagcattctgtttccctgtggatgactgtggaggccccaaggacaactagcatggaaaactaacacactaatctattgccagttgagtccaccaaaggcacagtcagaagagctttgccccttgatctccatgtcttgtctgcagttcaggagcatcccactaacaaaagggatatccaaatgtctaaaggacagcataagaacacactgaacaatagccagatcaagatggcaccatcaaagcccagaaatcctgatactggaagccctggatattctaacaaaactaaaacaaaggaagtttatcggaaatacaaccttatgaagataatagaggcctttaaagaggaaaatacaatggaacaggtaagagatatgataaaataactcaagaaatgaatatggaaatagaagcaataatagaaacacaaaatggagcaatcctggatatggaaaccctaggaataagaacagacacaagccatcattagcagaatagaggagatggaagaaagaatctcaggcatagaagataagatggaagaaattgatacatcacttgaacaaaatgcaaaatctaaaaagttcatgacagaaaacatccagaaaacttgggacattataaaaagagcaaaactaagaataataggaagagcagaaggagaagattccaacctcaatgcccagaacatatcttcaacgtaatcatttaagaaa

SEQ ID NO: 3572 - DNA, 1600 bp, mus musculus
gttaaggaagacattataaacaggtatgcatttttctgggaaatatatctacttctaagaagaaaatatcaatagagtacatcttttaagaagttatataggtaagaatggagagataggtcactggttaagaactgtactgctctttgagggaactggagtttgattttgtgaatcaacatttggcttgaaactccagctctgttggaagcctatgtgctcctctggcctcctctggcctcctctggcacctcacatatctgacatgaatacacacatataaatacacatacacatatacatataaaaataagatttaaaaacagattatatcattaataaaattactagctgtaataaatgcaatgtctgtggtcattgagattttgttttgtagtatactcaaattgaatgagtaaaaatactataaaacatatcaatttatgtactcaggttgtttaaaatgaataaattcctttgcatataaattttaactgtataggaacttattttcatggtagatgaacaataatctattataatctcattgtaatattgctgttgacttatttacattttatatttatcatcagaaattttgacctaacaacttgaaaataattacaacgaaaatgtaattcattaaaaaatattctttaatcctggaaattttgtggggggatcctggttggttgacattgtgtttcttcctatggggttgcaaatcccttcagctcctgcagtctttcccctacctcctccattgaggttcccacactcagtccaatgtttggctgcatgcatctgcatctgtatttgtcaggctctggcagagcctctcaggggacagttatatcagggttctgtcagcaagcacttcttggcatcagcagtggtatctagtttggtgtctacacataggatgaatccccaggtgtgcagtttctatataaaccaccaaccaaagagtacacatggaaggacccacggctccattgggcgtcactgggaggtgaaccccttgttcctgtggaggcttgatgacccgggataggggaatgctagggctagggcactgtgataggcatgggtgggcaggtaggagagcaccctcacagaggtaggagcaggaggatgggacagggaatttgtagagggaaaattgggaggggggataacatggaaatgtaaataaataaaataaccaataaaaatgaaagaaaatgttctttaagttgttggtttaaaaaagcagacattaagtgaagagtcaatagaaaagtgctctgttagagacttgccatatgcaaaatccttgaaagctccacagacaagaagaaagagacaccatggcaggcaaaagagatatgttctgagtggcctaatgcttttgctaagaccatcaccatcaccatcaccataagtggagaaaacagcttctctgacatcatgagcttcttttactctaacacttcacacacacacacacacacacacacacacacacacacacacacacacgtcatagagttttacaattgccatctcgatattaatctaccctcaactactttcgaggggctagtttcttggtttaaat

SEQ ID NO: 3573 - DNA, 1000 bp, mus musculus
ttggattagacacaaatcatcaaagcaccggggcgggggtggggaaaggagagccagatgaagtgtggaaggagataggggagatgtacagagggtcaggaaactgaacaaagacatgtagcaatgggagatggggaactggggtagccaacagaaagccctctatgccaagaaagcaagaggctcccaggacccaactgggatgaaattagttgaaatacccaacaaaggggacagagaacctgtagagaccatatctagagactaggcacagctgtaggttaagggatggggccacctacccttctcaaattttaacccagaattgttcctgtctcaaataaatacaggggcagatagtggaacagagactgaaggaaaggccatccagagactgccccacctggggatccatcacctgtgcagtcaccaaacccagacactactgcagatgccaagaacggcttgctgataggagcctgatatggatgtctcctgagatgtggatgcttgcagtcagttatttgattgagcagggggatcgagatggaggagtgagagaaaggagtgaagaaggtgaaggggtttgcaacccaataggaagaacaacaatatcaaccaatcagaccacccagagctcccagggacaaaaccaccaaccaaagagtacacatagagggagccatggctccagctgcatatatagcagaggatggccttgtctggcatcaaatgtaagcgaagcccttagttctatgaaggcttgatgcccagtgtaggggaatgctagggcaggggtgtaggagtcggtgggtgggggaccaggaggtaggagggagaggggtgacatgaggctttttcagagaggaaactgggaagggcgataacatttgaaaggaaagtaaacaaaataaccaataaaaaatgtaaaagtcttaattccatataaagttactgcatcctagaatttttccattaaaaataagtgcttgtcaaggga

SEQ ID NO: 3574 - DNA, 1000 bp, mus musculus
gagtacatcagatgatacagaatacgcaagatacagttcacaaagctcaaaacagtcaacaagctgaagggcccaaatgaggatgtctcaatcacacttgtaggattgcctcaatcacaagtagggagagagggagggacctggttgggaaaggatatggggtaggaggagaggggaacatgctctggtattgggtggggggaaggactgaaaccctgggggccagctaaaagagtggaaacatgcaacctctagagataggaagtggagggatactccagaatgcaccagaggcctgggagctgagaggctctcaggactcaaagagagggacctcagatgaaagaccctactgttggaagagggaacttgtagaggccacatccagcaggaagaaaactcatcaagtgagagatggggttgccctcccacagtcaaaactctgacccataattgttcctgtctgaaagaattacagggatggaaatggagaggagcctgaggaaaagaaggtcaatgaaggcccaaagtgggatccaggtcaaggagaggacccaaggcctgacactacaactgaggctatggagtgctccccaaagggacctatcatgactaccctccaaatgacccaacaagcacctgaaagagtcagatgcagatatttgtacccaaccaatagacagaagctgctaataattgtgactgaattatggaaaagctggaagaggctgaggaatgtggtaggaggaccagcagtcttaattaacctgaacctccaagatctctcagacactggaccaccaaccaggtaacatagcccagttgatatgaggcccccatcacatatgcagtagaggcctgcctggtctggtttcagtcagagaagatgctcctaaccctcaaaagactggaggttccagggatttttgaggtctagtggggtggaggttgggatggtggggacatcctcgtgaagacaggaaaatagcaaggaggtatg

SEQ ID NO: 3575 - DNA, 1000 bp, mus musculus
attataccatttgtgatcaatacagacattcttgttcactgtgctgagaataacttactgggagtactcaatcatgaatgtgacgtctatacactcccccaaggctcaagaaagatgggaaggagttatgtgaaaagtcttttaggtatgatatgccagttgagcatatgaacttccagtgtcagtgattatttagagaagactatatatgacctacgttaaggtccctcaacagaggaatggatacaaaaaatggtgtatatttacacaatggagtgcagtgcagctattaaaaacaatgacttcataaaattcttaggcaagtggatggaactagaaaatatcatcctgagtgataaaccaatcacacacacacacacacacacacacacacacacacacacacacaaataaaacccacacatggtatgtactcactgataagttgatattagctcaaaagcttggaatacctaaaatacaattcatagaccacatgaaaggaaagaaaaaggaagaccaaaatgttgatgtttcagtccatcttagaagggggaacaaaatactcacaggaggaaatatgaagacaaaatatggagcagagcctaaaggaaaggctatccagagactgccccacctggatatccatcccatatacagtcaccaaacccagacactattgcagatgccaagaagtgcttgctgacaggagcctgatatagttgtctcctgagaaactctgccagagcctgacaaatacagaggcagatgctatcagccaaccatgagacagagcacgggctcctcagttgaggagttagagaaagggctgatggagctgaaggggtttgcagccccataggaggaacaacaatatcaaccaaacaaacatcctagagctcccagggactaaatcaccaatcaaagagtacacatggaaagacccatggctccagccacatatgtagcagaggatggccttgttgggcatcaatggaag

SEQ ID NO: 3576 - DNA, 1000 bp, mus musculus
gtctaggttttcggatgtgttggggtgccctggactgggcgaagtgggggtgctgggttctgatgatggtgagtggtcttggttcctgttagtaagattcctatgtttacctttcgccatctggtaatctctggagttagttgttatagttgactctgtttagagattgttcttctggtgattctgttaccatctatcagcagacctgggagacagactctctcctctgagtttcagtgctcagagcactctctgctggcaagctctcctcttacaggaaggtgcgcagatatcttgtgtttggacctcctcctggccaaataagaaggcccaaaacaggaactttcccagaagctgtgttgctttggcaggtcccagaagctgtcagcttctgtggtgcacactctcacctgtgtagactaatttcctaagttcggaggagtcccggaaccaaggtggtgcccgttgctcctgaggctgagggcttccgagccaggtggacacctgtcctctggtcgggacggtggccagctatctgcggcccgacaagggtgctgcctcagtggctctgtggctccgcctgtcccagaagctgtctggttctgttgtgtaccctctcatctgttcagactcatatttttcacatcacataatattctattttctgagattacacagattgttcagcacttaattttggacctctcagtcactcccaagtttggataattttgaataaatttctataaatatgcatatgcctctctttgtatgcacatgacttataatttcaatacaaaattatttaagaaatatttgctatattttgtggttgggacatatttcttttcagagtccctaaacaatccaccaaaatatgactattttatactcctatacaaaatgaataatagttcttttttacctacaccagggccagtgctaaattttatcattgttcttaatctgaccttattaaataagatatgttgttgcattt

SEQ ID NO: 3577 - DNA, 1400 bp, mus musculus
caattcataaactagtgttgttcagtgtatgacaaagaatgataaagcaccattttatacaacatggaacaatttagggcagggacagcctgatctcagctaggatcttaacaacgtgttctcaattgagctggtgcctagatgctattcttctgcacaaagacttacaatgtcctccaaaattctatcttgcttacatttcagaaacagctgctccttcacctctccatgtcagttaactgtgctactgagactatgatccacaactgtctgcattgtcaaagctctttaggtacccatagccttctgttgtagatgtcctgaactaaaagttttctgtttggtatatagtttttgattttccattctgactttcattcttcacaggctattagagaagtaccctctagttcacaatcacaaccagcagattctctgtagttcttgaagatatattcttgtgtggcctagtttttcgaagttctgttttgtttagttttttggttttttggttgtgaggagtgggtgcggctgctgccccaagatggcgcccgggacagctgcaaggtcttatgacctgcgcctgacttcctcattatctcagacttagccacatcccagtcgcctgcactgcacagatgccatgcctcctcagcctgcctgaggtgtcatcatttgttgtgaaacaatggactgctgttacctgactatggtgattgggaggagtcagtagggtatttaaggcacaccctggggttgttcaggggatttcctgtttctgctttgcaatgctaagtgttcctgaataaacctgcttgaagaaggacaacgtggtgttgcgtctttcctgctggtctgggtggatgctacatttggtatttcaagacaaggtttctcggtgtagtcctagctattctgcaactcactctgtagaccaggctggccttgaactcagaaatccacctgcctctgcctcccaagtgctaggattaaaggcgtgtgccaccactaccctgtttcgaagtctgttcttataacataatctagtccttatttgaaaaactcaagatgttagaatcatcattacagatcccatgggttataactaagttacttatgaagaggaattaataatattcttggtgaaaggcttagtttatctttaaatatcctctaatggaatcagttttacaataatcaccatcaattttgagatataaattaggtctgaagggatttcttttcatattttcatgagtttgccatcaaaaaactttaaacatactgatttaaaaaaatctttaggttttatagcaaagaatttctctacatattaactggttaaaatttattatagcctaatccacaattctagttggatttggataagaccctacctt

SEQ ID NO: 3578 - DNA, 1400 bp, mus musculus
aagaccagccagtttttctttaaatctaaaccctatcctactaagcacatgtgtttatttataaagggctgtcactgtggatttagtataacatttagaaacaagacccagaaagaacactaaggaagggtaagctgatgaggagaatggatacagaaaatgtgattcatttacacaatggaataatattcagctattaagaacaaggacatcattggtattgcgggcaaatggacagaacaagaaaatattatcctgaagaaggtaactcagaccccaaagaacattcatgatatgcactcacttataagtggatattagtcagccaaaaggtacagaatacccaggatacattacacagaactcaagaaggttaacaagcctaagggctcaagtgaagaggcctcaattccacttgggaagaataataaacaatcacaggggtgaggggagagggatggaggaacttaggtgggaaaggggacagggatgagaagaggggaatatgattaggtaatgagtggagggggaacaggactgaagccctgagggacagcaggaagaatggaaacaggcaacctcaggaggtaggaggtggggagaccctctagaatgtaccagggacctgggatgtgagagactttcaggactcaaagggagggaccttatattaaatgccctgcggtggggagagggaacttgtagaacctacctccagtagaaagacagggcctcaagtggagggatgtggttgcaatcccaccgtcaaaaactctggcccagaattgtttctggctgaaagaacttcagggacaaggatggagaggagcctgagggaaatgggggtccagtaacaggcccaaattgggatccagctcatgaggaggctccaaagcctgatactattactgaggctatggtgtacaaacaggagtctatcacgactgccttctgaaagacccaacaagcagctgaaagagtcagatgtagatatttgcacccaaccaatggacagcagaagctgacccctgtggttgaataggggaaagccggaagaagctgaggagaagggtgaccctgtaggaggaccagcagtctcaactaacctggacccctgagatttgtcagacactgagccaccaaccaggcagcatacaccagctcatatggggtccccaacacatatacagcagaggactgccgggtctgagtttagttagagaagatgcacctaacccttgagatactggagggagtttagaggtcttgttggggggggggggtcaggggatgggacatcctcttggagacatgggtggggaaaggaagtatgagatatggaatagtcagaggacagaccaggagggggataatgactggactgtaaaaatagattattg

SEQ ID NO: 3579 - DNA, 1000 bp, mus musculus
aaaatgtggtatgtttactcaatggagtgctactcagctactaaaacaatgacttcatgaaactcttaggcaaatgcatggaactagaaaataacatcctgagtgaggtaactcagtcagaaaagaacacacatgttatgcactcagtgataagaggatattagcccaaaagctaggaatacccaatatacaattcacagaccactttaacctcaagaagaagaaaggccaaagtgtgggtccttcagtccttggaggcgagggggggggcgatattcacaggagaaaatatggagacaacgtgtggagcagagactgaaggaaatgccatctagagactgccccacctagggctccatcccatatacagtcatgaaacacagacattattgtggatgccaaaaagtgcatgctgacaagagcctgatatagctgtctcctgagaggctctgccagaacctgacaaatacagagacagatgctcacagtcaaccattggactgaatatggagttagagaaaggattgaaggagcttaaagggtttgcaaccccataggaagaacaaaaacattaaccaaataggacccccccccagagcttccagggaaccaccaaacaaagaatacacatggagggacccatggctgcagctacatatgtagcagaagatggccttttaggacatcagtgggagaagaggcccttggttctgtgaaggctcgatgtcccagtatatgggaatgccagggcttggaggcaggagtgggtgagtggttgggtgaacaccctcagagaagcattggggtgggggaatagtatagggggctcctactggggaacttgggaaaaggggtaacattctaaatgttatacagaaaatagccaatttaaaaaaaaaaaaggaaaagaaaaagaaaagcagagaaagatagttgtcagttttctctgcctgtaagacttgtcaaaaaaatgtaggcagaagttgtctgattgaacaaa

SEQ ID NO: 3580 - DNA, 1800 bp, mus musculus
tcttcctctctctctctctctctccctctctctctctctctctctctctctctctctctctctctctctctctctctctctctctctctctctctccctttccctctccctctccctctctctctcccttgctccctgcctttcataaagctctaaaaccatggaccatctctactcatcaagaccagacatattagaacaatggaatagcttcttctaaagagctggagtctaatctccagcaagaaggcctcccagtgtttccagccaccagatcggaccaaagattctcgccctcgttggaaccacctaggacaccccccccctttttttttcttcagccgggctgacagagcttcccctgggcctccacctgttctcagctcttccacagtgtcctttgatgtcctgcgatgcccaagggctagaacctgtcatccctggccttcctgaggccaagggacagcagactgctccctctacaccccacaccccgcggactgggattccgtggcttcccacaaccagatgattacctgggtggtgtggagagcacacccatgcatctgcccgcctagagccccagagctctggaagtacggtacccgggttctctcccacccccttttttccctggcactggtgctgcccagcaaccacactcaagattaggttatgaaagactgtaacttctcttctgcatcaataggtcatattaaagaagctggtggagctgcctcgccaaaaggcaacaagatcctccaaccaatggcactgagggcttagtactgaacatggaagtggatcctttctcaataagtccttgagacaaaagcatctcctgcaggaggatttaattgagaactgcctaagagaccaaggattgcgggtgtagtcagtgtcagccaattgggaactgctgtttagaagatatgctttctggggaccaatgggggtgtgggtggagggtattaagggaagtcacagcagcactcagaagagcttgttgcatgtctcacctgctcccagagtctgtgttggttgactctgcaccaccaaccggaaggtagggtgaggctgcgagtagttcagagcacaggcaacagggcagtgtctgagtgctttaaatccagatcccaggcaagacaaaaagtgagggactgggccctttgtgcgcttttgaagtctcaaatctcagctgcaatgacacagctcctccaacaaagcccatagagttcaacagatggggcttaagcaggcaagtatctgagtttgtgggagccattctttccccaactaccacaagaagattcattaagattctttctaatcattaaaaatcatcatttcatcaatgatctacatactttgcatctcaaggccttggagaaagaagaaaatatcgattttaagacttgttggcattcacacatatctgccattttatatgcgttcaacttcaaccagagtctcagataagcttttgctttaaaccctagaagagaaatctgcttctttatttcctcttaaaaaaccacatctgtgtgacagctttatcccacgtcattttcctttctgctcttgacagaaaccttttccttttctttaaggtcttccactcatccttgactctttactcttaagggatgaccttcttgtcttgattgaaatgaaatggactggctcaattccctcagactctactacaccaaagtgcatctttaccaattttgacttctattatttctgtctaaaaaaaaaaatgatttttctaccacactctctactccgactttgcat

SEQ ID NO: 3581 - DNA, 1000 bp, mus musculus
tgtgtgtgtgtgtgtgtgtgtgtgtgtgtgtgttcaattgatctagagataagaaaaaatataaggagatgtaagtgcagaaaaatattaaaaaatatataagtataggaaattcaaggtggagaaaagtgagcagcatttcctggaaaggactttgaggccttggtgtcatcaacccttaaggtcactgagtctagcagagaagatgtcaggagcatcctgtaaagccagagtattttgtgaagtcatgaaacactgatagaggtgacagaaggaaacacctgaaaaacataatgaaatgatgaatcttggagaaaagaaatcatacagccaaatgtggcctaatgttcctttttattacttttattaattattttatttattacatccgaaatgttgccccttccaagaccctgcttgcagagttatgccaccccaaccacctccccttcacctctgagagggtgacccaacccctggacatccccccctctctgaggcatcaggtccctacaggattaggtgcatattctcccactgaggtcagacttggcattcctctactacatatgtgcctggaacctgtgcccagcatgtgtatgttctttggttggtggctcagtctctaggagcttccagaagtacacgttagttgacactgttgttcttctctgggctcagtccaaagcttggctatgtctgcatctgtctcagtcagctgctggtagaacctctcagaggacagccgtgatacgctccagtctgcaagcacaacctagcataagaaatggtgtcatggtttggtttctgccatttgttcagtctctgcttgatgtttttatccctgcacttcttttagtcgggaacaatttagggttgaaaattttgaaggtggattagtgtctccatctcttcactgagggccctaactacaggagatggtctcttcatttttctattgttgggcgttttggctatggtcacccacattgaatctagg

SEQ ID NO: 3582 - DNA, 1200 bp, mus musculus
atcaggaagtagagagacataataaaagttggtttttcatcaagtacgttgttagattttcaaatgctacattttccgcatgctttgcttcaagctctagatctgtgtaggagacatagctctaagaaagcaatgaaactacgtcttaaaacccgcagagcatcagacaaagtatctagctcccactcccttttggcaagttttgtctgataagaagtaagtatcagaatgaatgcatccttgtgctgcctagctgacaagtggagagtctaataaggcagcggagaacacgcttgtgaggaaccctgtaacacgtcaaaggctgagtgcaagctccaggcaggcctctcccggacccagactgcagcagacttccttcctagtggcaggcgggagcaggtgggaaggctttgattacatccctggaagcaggtgggaaaggatgcacggttctgcccctggccagagctgtgccgagtatagccagggaagaaggacaatcaaaccatcctactgtccgggggcctgccctgtttctattcccccagtccttgccgatcagtgaaatggctgcataaacttaaagcgtctgccttccgcggctcggactcatctggcagctcattcagaacacgcatcatttctaaggatacacttgagtgccagggtagggcagatgcagaccattctgttaggctgagtaaacaaatacacaaaaccaaacgaacacgtggcacatatccctgtgctttggacagcttgaagaacaccaggcaggccagtgagagggctgagcggggaagcgcgattgctgctaaagtccggcaacctgagttcaagtctcagaacctatgggaaggcgggaaaccaggacggaattctcaaaggcacgctctgacgttcccacaccagccctagcatcttctctgcatcctctaaactaataaacaaaaattaagagcgacaaaaacaaactcaaaccacaacccagtcagaaacgctgcctaggagctgtgctcgcaggctgtaccgctaacaattgtgtctcaaacctactcctactgaatcaacataatttagaataaatgagactctcttagctctatggttacagaaaggcttaacttgcctgataactgatacctggaaaagattaaggtttctttatcaggaagagttgtgtgagtctgggttatttca

SEQ ID NO: 3583 - DNA, 1400 bp, mus musculus
agttaactagtcctaaagggaacatatgagagcatctctgttgtaaacttcgtattcaatttttaaatttatgcttgaacatttagtaaacttttgtagaacaaggacacttaggaaaaaattgtgatacattcctctagaaaaggtacaaagaaactaggaactctgctgtcctccttcctcttcctatccttgctttttccttctcttaatctggctctctcctcctctgacataataatgccatataattaatgccttttcatcctctgctgtactgggattacacacctttgccacctctctggacattttaaatgtagattctgaggatgaaccattgtcaaaagaactctactgaggatgctatgccacagtgccccgagctgatcctgtgccatagtgctccatacccaaatactgccagaagagagctggtctcacaggagtagggacaggcctgtgagcacaggtaagaccaccacttctgctcagagggacctgctcagaaccctcaggaaccaaggagcagcctgggtacaggatctttctagtttccatctgtgctcagagttgatcaccacttctgttcaaattcctggcccaagagggacccacccagaaccatcaggacacaggaactaaggaagagctggtgacaggaaccttctggtttctgtctacaccaggagctgatcctgtgccacagctctccatatgcaaattcatccaggagagaatgggtctcccaggaataccaacacacaggcttgcaggagggacaaaccacagtcagagacacaagaccagctaagaccagagataaccagatggcaaaaggcaaggaagggcaagaacacaagcaacagaaaaaccaaggctacttggcatcatcagaacccagttctcccaccacagtgagccctggatacctcaacacaccagtaaagcaagactctgatttaaaatcacatctcatgaagatgataggggacttaaagaaggacatgaataccaatactcttcaaactattccacaaaatagaaacagaaggaacactacccagttcattctatgaagccacagttaggctgcatattcacccttggagatggaatggcttttgtctaatcaggaaattgtcacaatctcctttcatagacgacttcataagagatttctttctacttctatcatgttttatgttccaaatagattataaaagctggttgagtgcttattacttttagcttcagaagatatcatgtatatttaagaggcatttaactactataaattattttgatgacttaaaaaaagaaactaagagagcatattgtctgataggttttttcccccttttactttcctttagaaataaagaggatattagggcagg

SEQ ID NO: 3584 - DNA, 1200 bp, mus musculus
agctttgatacctcgttgattttctaagtttcctagtttttatatgtagttgattttctacggtacaatatataatttaaaaagtagatactgccatctattcctcgtgaaaaaactttcaaagatcctgaaaactagatgcaacaaataatataaacattatagttttagagaattggaactttaagtttagaatgcaagacaattgaaatgagtttctagaactccctagaagtacagtaagactctgaaccataaaaaatttattcctacaccccatcaaacttaaactaaacacataaactaaactaaatatattgattcctctgcctgcccaattccctttgtgacagcctgcctctaataccaagagtaactctctacctgagaacccactgatcacaccagtctcatcatcagaccctgtagcagattgctttcaggatcctccccaccatctctgcctccagtcactggacactccacagatccttgtagcagatggagcttttacccaacctgtggagctctccgtcctcccttctagcccatcctcattccttccagacagctcccaatgctacccagaaaccgcatctgagatagacagactcaagagcactcctgatcaggcaacccacaaccaccacactttctgagagatacagagatgtcaacataaagcaagggatggaacacccaaacaatgaagacagtagcagatatcaacacctagagtcacaatcacccaatatccttagacatcggtgcaaaaacccatccattaacaccaaatgcctccacccgaacccagcagccttactacagtatgccctgagaaatgcaataaaactgaagcacaaggcagagactttgaaattatactaggagtatgttcaaggagtttaaactggttatgaaaaaaatccattatgaagtctatgaaaacagaaatgagcaagcaaacaaactaggtatatgccaccaagaaaagaggtcaagacctgaaaatggaaatagaatcaggaaagaaagccagtctggactaaaactggaattgaaaaatgtaggaagtcaaacagaaacctcagagagaagcctcaccagaagaacacaagatataggagagagcatctcaggcattgaagacacggtagaagaaatagaaaccctggtcaaagataatgataaatcaaaaac

SEQ ID NO: 3585 - DNA, 1200 bp, mus musculus
ctcttagaagctgtcttgagagttaacaattaccaggtattccttgtgactcttgtaactttacacttccttgtgactcttaactggtatctttggtatcttccaacaacgccctccccacttccttaagtttcggtttcttcctttaaatacccccttacccagctactcggggcgccatggtcctctacccctgcgtggtgtatgaccatgggcccgagagcgctcttgaataaaaatcctcttgcaatttgcagcaagacccgcttcttgtgggtgattttggggtgtcgcctctcctgagtcagaacgtgggggagccctcacattgtgggtctttcactcccccacgaactaccttctcccgccccacccctccagcatccccttatactggggcatcaagcctccacaggaccaagggcttctcctcccattgatgtcagacaaagtcattctctgctacctatgcctctggagccatgggttcctccctgtacactccttggttggtggtctacaccctgtgaccactgggtggtctgtcaagctgacgtcgttcttcctatggggttgaaattcccctctgctcctccagcccttctgccagctcccccactaggttccctgagctcagtctgatggttggctccaagcatccacagctgtactgatcagttgctggataaactttccaaggagcagttctatgccatggactgggcctagtcggcccccctcaatctgtgggaatcaggggttcagacagatgggcatagagtgagaatgaggggtgacaaacagacagaacacaagggagtgtgttggatctgaatgtaatttgtcaaatcgagcatcaaactttttatacattggaaaatagggaagttgggtgacacaccagcaagatacaatgaggttaccagattcttacataaaacaaaggaatgcgttgaatcaggatcaagttgaccatctaaacagtcccatatcacctaaagaaatagaagcagttattaatagtctcccaaccaaaaaaagcccaggaccagatgggtttagtgcagagttctatcagaccttcaaagaagatctaattccaattctgcacaaactatttcacaaaatagaagtagaaggtactctacccaactcattttatgaagccactattactctgatacctaaaccacagaaaga

SEQ ID NO: 3586 - DNA, 1000 bp, mus musculus
agcttgaaatgtttcttgtattgttttcaaatgtgtgtgtgtgtgtgtgtatcccagctgtgtgtgtgtgtgtgtgtgtgtgtgtgtgtgtttgtgtgtgtatcccagctgttactcattcctagattacttaggttgttaggattgattcctacattataaagattgatttgttattttctcctcattttatagcataattatgaaaatgccaatttaatctcatttccaataaatattagctcaattagcatatttatttgattttggttcataatcagccacagataatgaatgtatgtattcttcagcctgttgtttgaagaagagttgactacaccatacattaatgacagtaaggtattcctatgaactatcaaactatcagattcccataggtttatttttctctcccctcttctcttagagcaggcttccgatttgatatgtgaataagttagaagtcatcatgcactccctcacagggaggaaaacacagaaatgggagccgctattcatcttagaactgcaaaggaaatagcttacagggcaaatctctgcactgaaactgtagagaaaagccatagagtactgagagcagaaggtcagacttgaagggcacttgaatgctgaacacagatcctggactgcttgcataattaaaagtttctcaggggatgttacacttttatgtatatacttctacaaagttctcggggaaataccccctttttcttctttggggagagaagagcataattctgcaatgtactgagagctctctgtgctccttaccaaagacctcatatgaaagtgaaatcatttgataagagcctcatcaaattagactaatccatagcacactgatgggtggagcaatgggaagggcacagacatgcatcgtttaagccctgtttactcctatcccatgttcaaaagatgagaccacctgagaaacacaaataaaggttacactccatagagaggttcactagaggtg

SEQ ID NO: 3587 - DNA, 1000 bp, mus musculus
gatttcttgctttctaatgatataggagaacccagcccactgaaggcggtgccattcctggggtagtgggtgtttatgggatggatcccgagatggggcagtctctggatgacctttcagtctctgctccacagtacacttggagggacccatagctctaacagtcacatatgtggcagaggttggccttgctggacatcagtgggaaaagcaacccttggtcctgtgaacgcttgatgccccagtgtaggggaatgccagggcaggaatgctggagtaggtgcgtggatggggaagcaccctcatagagacaggagaagggggggggctgatgatagggggtttccaaaggggagacctggaaaggagaaaacatttgaaatgcaaataaagaaaatatccaattaaaaaaaagattaacaaaaataaaacagcaagcggaataagccaaggactgaaaatatgcaactttttttttaaacattaagagttttattgtaaatttaaaacaatgacaaaatcactctaacaaatatacatttctctcttttcaagaattctaacaggggatttggcaataggacaatattgcatgttgcatgagttcattctgactgaattatctaagaagctagactctcagctgcctttttcctctacttttataggaacttatgcactcactctggtgggaatttgggcaggttcacattgaatcagtaaagtttccactgcacaaacccatgtactacttcttcagcaatatatactccattaatctctgccatcccatggttgttaacccaaaaatgtttgggaaatttgtgatagaaaacaaccccatctcccaccctcaatacatgactcagctctatttcatcctcagttttgtgactgcaaaatgccacttgttagcagcaatttcatatgaacctcatgttgctatatataatcctttggtttacaatgtgaccatattctctcagatttacagttcctt

SEQ ID NO: 3588 - DNA, 1000 bp, mus musculus
ctgcatagaagggagaacaggatgatcatgggaggtggaggggggatctgggagagagggaggagggagatgaaaaaagaggggtaggatcaggtactagtgtgggcatgagaggtacagagggtcaggaaatcaaataaaaatctgtaacagtgtgagatgaggaactggggataaccactagaaggttccagaagccatgcaagcaagaggcttctaggacccattaagaccaaccaaaattctttagagctttagcagaaatgctcagagaaggaggagatagaacctatagagactacctgccctagacaggcaatgcccccagtcgagggatgggaccacttacccatctcaaagtttttaacccagaaatgttcctgtccaaagtcaagacaggggcaaaatatggagcagagacttaagaaaaggccacccagggactgccccacctgaggatccatcctgtctgcagacaacaaacccatacactgttgctgtttccaagaagcacttactgacaggaacctggtgtggctgttccctgggagtttctgccagcacctgaccattccaaccatcaggctgatctcaggatccacagtgtgggagctggtggaaggactagaggggtggaggggggttgcaaccccataggaagaacaatgttggcaggccaggccacccagtgctcccagtgactagaccatcaaccaaggagtgcacacggagggatcaatggttccagacacatatgtagcaaaggatggtcttatctgacatcaatgggaggggaggtgcttggtcctgtggaggtctgatgctccatcgcaggagaaaattggagccgtggggcaggagtgggtgtatggatgtagaatcactctcatagagggtaaggggagggggagagagggcatatgtgggatgggggagttatggaggataaccatgaagggggatatcatttgagatgtaaatgaatggaatgattaataaa

SEQ ID NO: 3589 - DNA, 1200 bp, mus musculus
gaagcctgtttctgagtattttaagttctgagaaagaaaaaaacgttttctctcagtcttatatagctgatatccttgcttccaagttcctgagaatgtatacaaacttctaccaccacaactgctaatggtggctgttgagctccaagcccatctttatcatctatttcccaagggagtcttagctcctcccgaaagctagtctcttgtgtcgcagattcccccctcctctgctcagtgatcatactctacaccttcggttctttgcatgctctagcatcattttcccccttagaggtttccccttccatgtgaatgtgttgttccttcctctcttttcattgttagcaaatccttcacttaccggtttctttttgagaactcgtgctgcagagtgattttatgtgcccaggaaaatagtgcaggaaataaagcccttgttctggaaatgtgcagaactgtgtttggatccctagaacccacgtttattctgagcaggcaaagtagcgtcctgcatcccagtgctcgaggagcgtacagggatcccccagagcaagctgaattgctaatggagccaaactgacaagttctgtgcttagtgctttacgctgcctcactacatactgcgtagtgattgaaacggacgtgtgctaccaaacctttcttctcagcacgcacacacatggtcacatgcaactgcacacaaacacatgtgctcacattattcaggcccatcacgtgctcataattaccaaaattagtggcttataaatactgcttctagttctcccaattcacatttatatttgaaccaataaggttcagcttttctgtgttgttccaccaaaataacttctgtattttaatagcctattgctaattttcagtcctcctcatatttgttctcacaggactctttgaaattcatttgactgccaccgtctacttgattgacaggactttaagtacacatccatcttattcttctttttgttttgtttttgtttgtttgtttgtttgttgagccagggttaatctgtgtagccctggctgtcctggaactcactctgtagaccaggctggcctcgaacttagaaatctgcctgcctctgccacccaagtgctgggattaaaggcgtgcgtcactttcttgtgctccctgtgtcatcaattgcttctttacttttcattgctcaatgt

SEQ ID NO: 3590 - DNA, 1000 bp, mus musculus
atgtgtgtgccaccatgcctggatctgggattgtttcgtctcagatgaccttgaactcagggatctccctgtcttaatcttttgggatttgtagtcactgtgtctcaatatctcgatgtcaagatctaggtcagaaacttgtatcacccagcctctagattaggatcacaggtgagccttttaattttagattgtagtcattccagatatagtaaagttgagcaccaggaatagccactacatttgcttatgcttttgttggcttcagatgtaataattaaaaccttgaaaataatggacttttgatagaacagtggttctgaacctgtggtcatgatccttttggggaaggctgaatggcccttgtataggggtcacatatcagatatcctgaatatcaaatacttacattactgttcattgtatgagcaaaattacctttatgtagatgcaacaaaaataattttatggttggcaggtgggtgagtcaccataacagaagaaactatgttaaacgtttgcagcattaagacagttggaaaatgaactagagaaatggcagagtggctaaagagcttgccatgcaagaacaaggtgaattatcttagttccctttctgttgctgtgatagaattttcgcacaaaagcagtgtaagggagaacaggattattttagttcacacttgcaggttaatgtccatccctgtggaagagtcaaggcagcaacagtataagaacctagccaccttaagacataatcatacagacagcaaccaataaatgtctgcatgctaccggtcaggtcattttctctccatctacatagtgcagatccttgtcaaagggatcgtttcctgaccacaggaagccaccctggacagtcagcatacagttatgacatcactttggtccctgagtttctgatggcagtgactctgagatcagaaatgacaaggcaaagggtagagatccagattggtggggacatatcttgacacat

SEQ ID NO: 3591 - DNA, 1000 bp, mus musculus
ttacagctgtttcctccaaattgacatattccctatggtagagagatgaggttcatagagtgtgggaacttaatgaaatatacaaagcttggaaagacccggatgttaaatgatttgcaacacaccatcgctgaggtggtagaagaactctaatgaattgctagagaagtgaaaagtctctgacagaattcctaggaagtagatggggagcttccatggatacagcttttgtctcatgctgagatgatcagtgtggtgatgcagcgacctctgcgtcaccacgctccccctaaggacacctcacctatgttcctgtaagccacagcactaaaatctcaagactgactgggataatttctttgatgtgtcacaatgccccatctgtagtaaagagttatttattcacctctatccaggaaaaaaaaatcacacaacagcataccacatgtcatcttttacaaaatccacccactctctggtttgaaagccagacctccgcatggatgatccacaaggacttgtactcaggtcccagtgtagctcaatggatcaggctcatttccagttactgactgtactggtattaatagccccaaaatacaccacacacaatatgctcagcacctgccttcattcccacatcaagaccatcttcttttctttcacatgtatttaatgtcctggtttcttttcagtctcattactaactttgaaccaagtctgattcataccaactactggtgttgttctaagtaaaattctaagccatgtagcctgaagaaaaaaaaaaaaaaagaaagaaagaaaacaatctccttgtgtctgttgtgtatctcctccaccaactgattactgtctgtattacattagtcatatctatgtacaccctcacaggtcagaataactatgaattactcatattttatctagttttctccaacattgaaataaattttcttcaggataatccattaattgtgaatagatacgatacagaaga

SEQ ID NO: 3592 - DNA, 1000 bp, mus musculus; identical to SEQ ID NO: 3591

SEQ ID NO: 3593 - DNA, 1000 bp, mus musculus
gggcttctgttctgtgtgtactgagaaaagaattaccccgtgtctagttggtgggcagagtcctgctccctgctgatccacttctgtgtccctgattttacttggatcagtgtagtgccagttctctgactctttttagccttgcttcacctgtctgttatgatacactacctcttaccaagagcctctcaagtgacctgctaccctggtttgccacctgttgctcattactgtaatctctggacctggtgtcagcctctacgcatgtgcacactggcagctcattccagacctgtctctacatctcctgcacctgtctagcaagcagggatatcttgtttggagataatttgacactgcctcatcctggttttgagtcaagttagttttgacaagacctttttgaaaagaagatgcgaaatccctgcttatttctgtctctttaagatttaaagataatgggattaaaagagaaaatgcctttaggccacagaggaataatctatctatcttatccagctgttaatggtaatgaaatttgagtattttataacactttagattttagctgttgggactatagaggtagctaagcagttaaaaagcactgggtgctgttgcaaagggccctggtttcactctcagttgcacatggcaactgacaaccatattgaagttcagtcctaggggatccaaactctttgggcctctgcagctactatccacatgtggtgctcagcgatgcatggaagcaaaatacacataaataaatgcatagctaaaatattttcaagaatatagttcttggttttgatgcatctacaattttgtcaaacagaaagtcactttttggacataaaaccaacatcaaaacaactcagatcactatggtactataaatcgcccaatccttttcgtcaacttcttttaatgaaggttttggagagtttcaagttcctgtttcttttttcttttctttctttttttctctgtttttaaa

SEQ ID NO: 3594 - DNA, 1000 bp, mus musculus
ttgttaatttctttaagttatactgagtgttcttctgtatactcagccctcgggtacgaagtcaggctattcagtggtgtcatctacagggaagttcctgttggcgccacagaagcatggcgttcatcagcttacacacgtgcaacacaatgtatggctttattgccgtttttatacattgctatccagaaactcttcaaaactattagtgttgaatgtacatcaagctgacaaatactctgattcacttgtctatgtttttcgagaccatagtgggtgcaacctgtgcctgtaccagtgtaggcagctgagaaagatgctctataacttcataggtgaggatgtactttgaaattttcttttcactttttgcaaactgaagatcacagtacaatttaaatagccttgcgttgtctccgagagctactgagcatggaataaaggctgagcactctctgcagtgtcacgaggttactgctcagctgttcgggatcagtagatgatatcttgacactcataaaacagaggattcaaaagccaggggcatgcgtggaagtgcagatcattatgacagtcttggaagtcgtccataagaaacatcagcaccaccccggaggccaaaataacactaccaaatgaacatctacagcttttctttaaaatgaaatccaatacaaagggaaagtgtattctgaaacaggtatgctagaataataataataattttatatttggcttacttcaaaaagaattaaggacctcaaaaaacttgcatgatgtattttcttagacattttaaaatacataatatttaattctatataaaacaaataactatcttataggactgttttcctacaaccatctgtccataaaccgatcaacccagttagtgaggcaccatctaggaagcatgaagatttcctttgcccagttcatttcagaagcaagagggatgattttggctcctgggatctgaaaattctgtcttctatttgta

SEQ ID NO: 3595 - DNA, 1000 bp, mus musculus
tcactgctcttttgtccattttctctcttctttattcccatgtgcctgttatttttttccccatggtgcttagttaatagcacttgctagattttagtagggaacagacagggatgtggcatgcaatgggctgtgttttggagggctgacgtcatagactgacttgggcccttagcaaacagttacaagctgtggctgcttacgctgatgttgtatgtatgtccacccttcaggccttcgagcattgcaatgacggacgtgtctgtcttctggataatgctgaggttatgaatctggacggcagtaggatcgtcttctcggtaaaccaatgcttgatacacttggatattgccgttgggctgagaaggcgggaggaatgataactgaaacttggttacttcatccggtatcttctgaaatgtcatattattaggtggatccttgggcactgaaataaaattgttggcaattataatcttaaatgtaacattttttctcaatataaaaacgtttttccttcaaacttgtgttttaaaagactaatgacacaagctatataaatcatgtattatggacattagaaaaatggtcaggcattgactgtatttcccagaaattgccgtgataccgcagtttgtctatgtgccttgtgtatgtgctctgtgcttagcaccgggcattggactgagcccctcccattgcatcgcagcatcttccactgaattacacagaatgctcttcctcggcttctccatcattttattaaaaaataacacagattcagaggaagtcatcccaagagaatcagagccccacaaaaccttcatggagttcccaatggtgacacagcttatggcgttattcagtgtcaagccagagagcaggcatcgagctgatactgtttgcaagataacaggccgtattctgatttcatcaccttttcatggctttgtgtgtgatttacttttatgtaatcataagacatgtatagaatcccgta

SEQ ID NO: 3596 - DNA, 1000 bp, mus musculus
tattagcccaaagtagtcatcatttttctcaaaaaaaaaaaaaaagaaagaaaagaaaaaagaaaaagaagaaaggaaggaaataatgaaagaagaaaataaaacgtcaaagaatgaatgtgtaagttcacggaagagacaaaaataattctcaacagtcaccactgtcatgagttttgagggaaagtctacaaagtgattgtctacatatatgcagatgcacagatcatccagatgtgagtgtccatgcttcacacatgtgcaacaacaggacagttcagtgaccctgtaccatgtgacaaggtggcagagaccctctcaggcagtcacagataggatgacaaccaatgttctttgccctgttatccagggtgccggtctgtgatctgtatgtgccttgtgtgttaggttcctttttaacctgtgttgctgccttggtttcttagagagagagagagagagagagagaaaatataaacatttaagaaaaatggtgagggataaaaatgtaatgcactccggggcagccatacaacccaagttaaacaagcaacatggcgactggaattgatgttaattattgttctgacatttttctactttgtttcattgaaatgctattcaaaaaccacatatttcattccatgacccacaaatagatcaaccacttctgtttgaccagtaatggtttaacatgcctcaatagaagctcaggtcattagtaagaagaagtcaaagtttgggaaaatcctatctgcttctatggcttgtattgagaacatggtttgagcatattttaagtttcctgttcaaaatgtataatatgtaggagacttcaatcactttgccagggagacatgggtggaactagaccttacacataggcacaaccacacctaacactccaatcctgcccagcactactgggtaatatcactttttgtgtttctccaagacataaaaaccaaccatctgtttcatttgtttctctataactgca

SEQ ID NO: 3597 - DNA, 1000 bp, mus musculus
acaagaactaaagaaggaaatacaacatgtgtacctgttctctgcacatgaatctaatgccacagttccacgtagtcctagctgtcctggaaactgctctgcagacaggctgaccttgaactcagagatttacctgcctctgcctcctgagtgctgggattaagacatgcaaccactaccaccaccaccaccaccaccaccaccaccaccaccaccaccaccaccaccaccaccaccaccatctggcacatgccacatttctagtcaaacctgctttctttccaacttcaccataaccctatgatcatatctctcttgggacctttagagttcacttcattgagagcaggacatgagatcttccaattgctgtgtttccacaacgataactccctggactctaatctaaacttaatttctgcaccgtgtcattctctagctaatctgtttttccttttcacagactaatccagctgatgttaccatgtctacttaagtaataataatatttgtcttctcatgaatataagttccaggagaatagtataaatatatagttggcttacaaatccagtcttagtaacagagagagaaatacaaccaaatttaaacatttgttaaataaaaaattatataaacatattttcagtgatttatctccatgaacataggtatctttctaggaaactatggaatcacagctgtcttaactccagccgtcttaatcatctgcaagcatgtatctactagcaactttcataactgcctacttgattaatatgtgtttggccttgcttttgacactgaaaataatgctattttaaactgatattaagggactgctttctcatataattcttagcttgtgtttcaaacattatcttacatttaaaaaattaggaggtacattcaattttagaaccaagacaatgaatcctcttcaaagggtccttatactggaaaaatcatctatcttgcctataaagtaacccattgataa

SEQ ID NO: 3598 - DNA, 1200 bp, mus musculus
aattctttccacgtgccccaaagtccctctgactctttgattattataatagattataaattataacatataatacataataaaatatacagcatacaagataacctttgatatatcacatagtcatatattatatataattatatatatgtgtgtatatgtatatatatgtatgcatatatatatatatatatatatatatatatatatatatatatatatatatatatgtagtatacaatttttaaatacaacctgctgagtcccttcagtgttgctcatatgtgaatgtattatcaggggcttgagaagagggatctctgtctctttctctctctctctctctctctctctctctctctctctctctctctctctgcagacagtaattgcagatagtacttcatgtaggggtggggcctccatccacagctgacactggtgttatttttcaggtcttgtttaaacaaccatgttgttgagattcatgggtaccgcttacccgccatgtatatgtctaacaggagacacccagtcactcttcctgcctgctccaccttggctatggtttagggagacatcttcccaagctcagagtgctgcgaaggtggtgattatctgtcttagcatcattttctctgtgtcttaacagcagtgaggagggcttgggaggcgcgttttctatggagtttactgagaaaaaagtagaattctctttattgcatgcagtcatgactatcttttaatgtataaggtacactgattctgcttttttttttaatcttttcttttcttttaaattaaagcaaggatggacttctagatcatggacaaaccaaaattcctgcctacctatgtaagctatatttcttaacatatttattgctgaataggcaatcacttatgataacttgattagttaaaaaactttctatatatgcatattcacgtatatatgtatgtatacagttttgattgtgaagtgcagaaaaaactgcatagagagatcctgaatattattgcagcagaattaaaagtcttctgataggatagtaagaatatgaataatattttgctgttcttgttttatttaatgccactctcccatttttctttccttcaaaaattcactttgtctttttaaaatttaaatttctattaaaataatacataacatcacaaaactgtatctactttgct

SEQ ID NO: 3599 - DNA, 1200 bp, mus musculus
ttaaggtaaggataatttgtgactggttccttctgagtctaatacaattctaaggagaactgtattcaattttcctctgttagcagagcctatgaagaaaattaaagttttgtattaaggttgccagtttttcctcttcaaaagcagtataccgaaaacagggattaatgagtatgaaaaatatttttatttagattaattataagatgggtggtggtgcgtggtgcgtgtgtgtatgtgtgtgcgtgtgtgtgtgtgtgtgcgcacacgcatgctcatactcatgtatgatcatctggagatgggcctataaatacgtgtgtttgggattatgttgatatgtcaattgaggtggtaacacctgtacactgtaagcggcacaattctcctaggcagaggatcttggagtgtatgcgtagagaggaaaatctgagaactaatatgcatacgttccttcatctttctgaccctggatataatatgaccagatgtcaaagttcctgctgctgtgaacttcttgtcatgatggactatataacctgggcctttgagataaaagaagccctttcctccttattgctatgaaaaaaaacctctaaatatttcataagccacttgaactaattaatgtcccaaatgttgaagaatggaaaaatcattgaatgcttgaaacatcttaatgggccattttgatggggacttagaggaaaaaaatgctgagaaaaatgaatactgtgaagccaggctcccacaatttcagaggggagcaaagactggactaggagccattcatgtggcatctggctcaagaatctgccttcattccatctgtgtctccagtgaagacctgcccactatgggtgtgtcatttccttgacagggcattctggattttatacaagtggagaaaaagagctgagcactagcatgcatgcattcgttgctctttcttactgtgaatgggtgtgatgtggccagctaattcaggcaaggtgacttgcccaccatgatgaaaccgtaccttgaactgtgaacgaaaacatgcccacccccttaagtttcttttatcagagtatcttatcacagcaacagaaaagaaacaagacaatctgaactaatttacatttgtgggaactatctatggtgtttctagtatctttgatatgcaaaataagaccactgatgaccctaaatcctgta

SEQ ID NO: 3600 - DNA, 3200 bp, mus musculus
tccgcgcgattggattggggcaggcactgtgttccactcatcagaggtcttaggatcccgtggggaatcccgtgtgggcccttgcgggtgttgggcaagactctgttggcaaggtccttaaatttctaatttcttaaatttcttctccaaatgctgagttcgccatggcaactagccagcaccttcactaacaggctctcctggggtgtacttaggaagactctctcttctacatagagccaagcatcagctgctttctatgatcccttagaaactgcagtcccttgttctctaatggactctcctggaaacttatacattaccatgtttgggtagcggcacacaggacagcactggataactctagagcacagatctgtgttctggccccagggaaatagtcccaggcttatgatcctccatgatgcttcttaatcactacttcttcagtcctaggtaagtagcataagttggccaattacaacaagaatttcacttcaatgatcctgttctctttttttttaactttaaatggcagataaatggccctgaaaagtctttacttctctctgaaacgttacaagccttgcctccgttgtctgcaactcttctcagcactattttccaaactcccacaatagttcactaagctctgaactatagcagattttccaacccaaagttcctaagaccttccacaaacctctgcaagacatggtcaggtctgtctcagcaatatctcatgaacctggtatcaatatctgtctttgggtttctatggttatattaacaaagcatggtcagaagcaatttagggaggaaagggtgtattctgtcttatagcttgtagttcatcatccagggaagtcaaggcaagaagtgaaagaaggaactagaggcagggaacgtgtgagtaggttgagaaggagtgaggcttacagcttgcttcacatggtttgtttgttgtactttctcaagacatccaaccaccagaatggggataccacagctcacagtggcctaggccctcccacagatgttgcaaccaagaaaatgtcccacaggcttgggcttgctcaaaggctagtcccgtgggaacagtatctcagttgaggtttccacttaacaaataactctagcatgtctcaagttaacctaaaagtagctagcacaaggagccttcacagtaattaccaaatgttaagtgtttttcttacagtagtttatcaactagtcacaaataatgtaagaattttccttgacataatattaacatacatatatacatacacaaatacacataacatatatattgaagaggattcaaggttaagattgggccacaatcccatataacacatacacacatacagacacacatagaaatagacataatttctgtgtgtgtgtgggtggggggaggtacctttgcatgattcaccaacaaagtttttttttttctattggaatgtactgtactttccatcccacactgattaccagacttttaaaaaaggatagtaatgcattcttataacatgaacttaactatataatttagctaccattctatggaattatatgtttaaagttatgcttatttgagaactgaacaagtaaagggattgaacaataaaacatgattgtaaagagggaggcaaaattaggtgcagaagaaatggttctattggttgatctctagctggagtgcaactgtatgatgaaaatttgatggtcttttgtagcagatttccatgtgcagtgaagagatatcagaagaactaaactcaaaatagaacctaatcaaaatagggggcccacaaacagatgtgaaagatgaagatgacatcattgatatgtcccatgagaaatatgctgagaaaatcacaaatattcagtgatccacattatatctgcagaagcagcacagatcctcagaaacagagaagactattcaaggtcaagattagtttataatcccacattacacatacatacatacaaacacacacaagtagacatagacatacacacatgcacatgtacataaacatgtgcatacacatagacacacacattcacacataaaagcacaagtgtaagcacatacacataaacatacatacacatacatagacatatacataggcatagacatacacatacatatacataggcatagacatacacataacgtacacatacacatatacatatgttgttagtcatatgtacacatctgtgcaaatactttccattttcacaagaatccaggtctgtctcatttccatttgaaactggaaaaactaaggtggagatggttttcatacatcgaaactttatacttacaaaacccgattaaacaccaccactgaagaagtaggaattcaggatacaggtaagagaagatttcattggaagaccagccacatggttttttaattgaaataggagaaagagtgaggctaatagccaggttatagatgcccggctaaggaaggaagcagttgtgacttctcagctgcattgaccctttagacattttaaggaacacggacagtccacacccaatgagcgagcaggatctgctgtaaaacacacttagatttgattatttggttttgaattgatgaaaaagataaacactgaagaagaaaactaatctatggagtactggttccctcaacaaatccatctctatctcttatcatataaaatatctaattttatccatttattatagcctatcactcaatccaacatcgtttaatcccgtataccaaatacatcttagattttaaaaattatcccaattcaaatttcttttttcttactaatccatgaactctcgttgaacacttaaatatctcccactgatcaatagaacagagaggggagaaagagcagtaaattcccatctgattttttcccttttttcctttcctttcctctgagttcttaagctgtattttcttctgcagccttcctctggtgagttatgttggcagtagattcaggggaagattaaacgaggcaagccaagaccgttaattactaggggcttccatgcatccttcattcccagggctgcactgagggccatgtttccatgcctgtaacaatgcaactgcagactggagggagacattcattagcacaactctcataaactctctgacctgtgtgcccagcaactttac

SEQ ID NO: 3601 - DNA, 1000 bp, mus musculus
gaaggaaggtccaagtaaggaagcttgagtctcacttagaaggggaataagtcataagaggcagatgaagggagcgatttgggagggaggggtttggggaggggaatgtgaggttcaggataaggtgtccccaggacaagagagatggctagatggccatgaaaatgaatggaaatctgcaactgatggaagtgaggagatgaagggcatttccatgacaaagcagagacctgtggtaagaaggtgcccatgaatcaatagggttggttttagctgtgattcacaactttggggatatggagctgaagtggttgcctcctgtagccaggcagcaatcccagtggagtgatagagacacaaatctactcatgaaactttaaacctgacatgtattctgtctacaagaaatgcaggcatggggcatgaagcaaccaataagcagcccaaattgagacccattccatgggaccacctctaacactattaatgatagtactatgttatgcttgcatgttgtcctctgagagtttccacacagcagctgactcaaacagatccagaaaccaaagacaaacagtggatggagcttggggaatcttatggaggaaaaagagaaagaattgtgggccccaaagggaataggaactccatggaaagaccaacagaatcaattaacctggaccccctggaatctcagagtctgaaccaccaaccaaagaacatacccaggctggacctaggcctccccacacatatgtagcagaggtacaacttgatcttcatgagggtcctgaacaaatggagcaggggccatcccaaaagatgttgcctgaatgtgggatgtttttctagctgaactgccttgtctggcctcagtggacgaggaagcgaagcacctagcctcacagagacttgaagtgccagggtgggggcattcccaggtgtctcccacccctcaaaggagaagatgacagggcacggggaaggattgtgagagggg

SEQ ID NO: 3602 - DNA, 1000 bp, mus musculus
aatatttctacaagacaaaaacttgcaaggaaagctttgaaaacaagtaggaaatacctcctgaaattacctgtgataatgtggaagactgtgaatcagcaagtccacagcatttcatacgcatgaatgtaaatacagtcacagtgcaatttcgcacagcaagcaacaaaggagggtaaataattttcaactgtcacatcactgatcagcaagttgaagagaatctcgaatgtcttgctatcatccttagaaatacctgatactactggactgggaaggttacacaaaagtttcaacgaacatgataatgagcagaacaattataattatcatttttaataagcagaactctaggcatgttagtaggggattatctagctgggagaatctactcgatatgtgggtggcacctttctgtgggcccagaccctggacaataaaaagaaaaaaaggagctgagaatctttctcttcttcctgatggcaaatgtagtgtgagcagctccctcctgcttggctatcctggccacgatttccctgtcatggtgcattgcatgccctagaattgtgaaacaaaataaacctttcctgccttaaattactttagtcagaaattttattccaacactgagccaactaactaaagattcattccaaaattttataaatttcatatttgtttttgctaaaggctgggtgttagcatgctcaataaataaacaaagatattctaatgaaatacatttgaaatcttttgagtttaatatagatgaaataaacctcaggatttattcaatataagtcagaaaaatcatttttttaaatggaaaacttgtcatagaaaatttgaatgacattaaacattgcattaatgaaatcatcatccaagaagggatatatgttatctttcttctcaaaatgtcattaattgaaattaaaagtctgggataggtgtatgtcattaccatgatcaaagtcagagttcctcatgatttcaataa

SEQ ID NO: 3603 - DNA, 1400 bp, mus musculus
gcaactagaaaggtcttttgttatctgcattgtacaaactactacaccaagaactaatgaaagaagggtaataataaatgcctggcagtcaggatgactttattagtcagtttattatcagcaaaggcctcattaaacttggtagaagtagataccataccttttaaatttgtttagtgaacaaacaaggttaacaaataatgaaattgttgttaagataaaggaaagtcaagggtcactagtattctgagcttcaggaaaggggagagtcagaagagggagggaagcccttagagtattgggagtttatattatctttcatgaaacagttatttttccctaaacctcaattcttgtctgttgatttcttcaaaagatagtgggttttataatgattttggcattttgcttttagttttgttgttaatgacatgtagatgagtgatttttttttcaagacagggtttttttcatgtagccctggctgtcctggaactccaggctggccttgaactcagaaaatcacctgcctctgcttcccaagtgatgggattaaaagcctgtgccaccgctgccaggcagatgagtgattattgacatacacttgcttgcatacattatgtttgtgaaatcttcaactaagacattgttcagttctgttactaagactcaactaacacatagcttagttttgtcaataagactcagttataaatacaacagtaataaaggaagtgccagagaactgggatgggggaggatcccaggagttaatgctttgaccttagctgagaagcatagtagctgttgcttttctgtggaatccactccagaactgggatgcattgtctggcctcagtgggagtggatgcatctgaacctgcagagacttgatgcaccagggtattataggataccatggatggattggttgggggagggggttgcaccctctcagaggagagggggatggagagggactctttgatggggtgactggaagggggaaaacattaggatgtaaaattaataaataaacaaattaattgagaaacaaacaaaaaaatacttgattaccaagaaaaggctagactcaatttctaaggaacattttacttttttccatagcatttttgatgagaataaaactgcttaaggagccatcaaacatcatcccttcaccagagcattttatactccaaaatctgatattatatatgtaaggcaaaggggtagagctaggttaaagatgtgagtcttctgatttcaataaggtagaaaactactcaaacagccttttaagcccagttatggtacctgtgtttgtaagggcaaatgctgtagtattttaatgaagtatatggacatccacacaaaacttctgttgtattagtaagaaa

SEQ ID NO: 3604 - DNA, 3000 bp, mus musculus
cccctacactggggaatcaaatatttaatggaccaagggtctcttctattgatgcccaacaaagccatcctctgctgcatatgcagtcgaagccatgggtccctccatgtgttctcctaggttggtggcttagtccctgggagctcttaagggtctggttggttcatattgtttttcttcctatggggttgcaaatgtcttcagctccttcagtcctttctttaactcctccattggacactccatgattagtttaatggttagctgtggctctggcagggcctctcaggagacagctatatctggctcctgtcagcatgcacttcttggcacccacaataatgtctgcatttggtaactgtatatagaatgggttcccaggtggggcagtctctggatggcctttctttcagtttctgctccacactttgtctctgtatttgctcccatgaatattttgttctgtcttctaagaattactgaaacattcacactttgttcttccttcttctgctgtttcatgtgatctgtgaattgaatcttgagatatgtccttgaatttgattacattttgcccaccctgcccttccctttcttgagggtgtggtctgtcgagggtgtggcagaagcctttgagagagctctgcagggggtcgtggggaggagcttccagggctctatttaaagctcctcagctctatcagatccatttgctggtgagttccatcctaagaactaggcagaagcctggccctgggagcagacatgagtgaaacacaagtcgagaagcctggacatgtgaatttagagatgcccatcttggctccttccaagaccctgccccagagctccctgagactggaccaccaatcaaagaacacacatagagcaacccatggctcaggccgcatatctggcagaggatggccttgtctggcatcagtaggaggagcagcccttgggcctgagggtgtttgatgccccaatatagggaaatgccagagtggggaggcatgagtgggtgggtgggggagcactctcatagaggcggggggaagggggggcggggcagggatggaatagggggtttctggaggggagacctggaaaggggataacatttgaaatgtaaataaagaaaatatctaataaaagaaaaaaagtttttaaagatttatgattttggaaaatgtgggtaaaaattagggttcggcttcttttagaaaagagaaaaattcagatatggaaagataatggagatttagttcatgagatattgaaaaaacaaaatagtgtgtttcctagattcaatgatcaaacaaacacacatcagccattattgcatagatatattaatgttaatatatcacattaacattttccaaaataaaaaatataattttagtatttgaacaagtgtgtctagagaaatattttcatattgtcattccaaatgaaggagataatattaaaaatcaggttttaatatgaatttttttctatgtaaatgaatggtgttgatgcacagggacataaaatgatataaatatttatcaataatatagatacaaaagtaaatgtaatactatattgatgaaaaatattgcatatttagtatgaggttgaaatataaacttttatttagatattagtaattgctactactagtggagaaataaattgtaatttcttaatatcctttgttgtatctccaagtgctttccttaagtttctaaatcacattttttttttgtttttctaaggagaaatattatactaatctgttagaaactatagaaacgttagattgaaagataaaaatttacttcagtattgaaatttagatattattgtattacattagtttgtgttatacacaaacacacacatacacacacacacacacacatatatatatatatatatatatatatatatatatatattatatatacaatatatcttaaatttattttgttgaaaataagaaaattgatatcaaaaatatctacttcagagtgaattttaaatcccaattcatatgttctcttctcctatttcattagtagagttttgaaattatgagtgcctcacaaatttcaaaataaaactaatatacgtatgttgggctctgggtgtggggaaataatgggatgggagagatgacccacttcccgccagagctccggggctctgggctgacagacatgggagactgccacgggaccccactgaatcgcaaggggtggggtgttaggctgtgttcggccaccagaacctgctctggggttggggaaggcacagtctgggctcagattctcaggcaccacagacctgctgggtaccataggagagtcagctctggggtctctggcctcatggaggagggaagaggaagggggaaggggagggaaatggagaggggagtaaagaagcagaggtgtttgtgtctgggggtgtagcttactgttcagtcccttgtagaatttttctaccgggtctccagagtaaacctcgctcgaccagaacacagactgcctttcatagtcccatatatacacatacacatacacatatacacatacacatacacatacacatacacatacacatacacatacacatacacatacacatacacatacacatacacatacacatacacatacacacacacatacacacacatacacacacacacacacacacacacacacacacacacacacacacacataaagttaataacatgtgtgaaatttggacatatgaagctccatgattggttctaaatgttttactgaatagtcaagggattttaaacaaatagactaagtatcgttttcatgaacagcaaacaaattattagacaagtcgttctctactcatttcacagggattttatgtgaaagaggcaacatgatgtattccggttacttgacagtttgtgttatgcaaaccttttgacaatgaaataaatgatcacagggacgcaaagaa

SEQ ID NO: 3605 - DNA, 1000 bp, mus musculus
aagggggatataaacaagggagatataaacaggggagatataaacaagagagatataaacaagaagaaacaggactgaataaacgtgtgcagaaggatcctgttgcagcatcattcttcctgactagttgagcgcacgcaagagtcttcttacccgcgttctcgactggccaggaaagatgcagcaaaccggaatcttctgcggcaaagctttattgcttacatcttcaggagcaagagagcaagagccagagcaagagagagaaaaagaacaagaacaagaaagcaagagagagaaagcaagagagagaaaaagcaagaacaagagagagaaaaagaaagcaagagagagaaaaagaacaagaacaagaaagagaaaaagaatggcaaaaccccgtcccttttaaggagaattatcctccgcctaggacgtattactccctgattggctgcagcccatcggctcagttgtcatcacaagaaaggcagaacacatggcgggaaaactgcccctgcatgtgtgcagattatgtttaccacttagaacacagctgtcagcgccatcttgtaatggcaaatgtgagggtggcttcccacaaatgtaagccagattaaatactttaaaagtaatgtataacattactagcaaatcgattttagaatatatatgtatatatatatatgtatatatatatatatgtatatatatgtatatatgtatatatatatatatatatttgtgtgtgtgtgtaacaaatacacaattgttaatgtgataatgactagattaaaataacaaagcaagtatagtacactggaggggtacataaataaaaatgtagtagagagagagattcaagtcatcaattcacaggctgagattcaggagatgaaatgaaaataaaaagcaaagggcaaatagaaagaggcagagggaagcactccacagaataaatacatacacacacatgcactcacacacacacacacacacacacaca

SEQ ID NO: 3606 - DNA, 1400 bp, mus musculus
ttatgtagttttctcatgtgtacattaaaaaggtcagtaacctagggtttttactcctgtcaactgataaaatttttctcagtcagaagtgataattaataaacttttacctcattcattcaggactcttcaaacagttttgtatgactgtaatatatgggaaatttatcattttgaaaatatgcattttcaaatatgtattttcagtcatctaaaaaatagaacaaagccacctaaactttggcaatccgtaccttgttatctcatgagtatcctgtcagtaaataataggagagtagttgaatactatactagtctcttagctcttaaagctgtaaaagtgcagttctgtacttaaacacactcccttttactgcatgcaaaaggtagcctttcttcaagagacataagaccctacctgccacgatctagttccttttgtgctaaatgaaacctttccaccaacccatatcatccacatccttcttcaggttcgagcctccctgtttctccctgatattccccatctaaactctctcacttgctaggtctagctcagggccagcatccagtgttccagtcctagtttggtcacctctgcctgagctactctcaacatctaggcctctgttagaagtttctctacctacatcccattgcacagggttgtctgatgctaaattcagtctttctacatagccagatgtacttcacacagtggattggaccctaaaacacatcctgtaacctactcagtatcatctgtctacagaacttcactgcaaacaagccattttttggctgctaggccccacctgtccacacacatcctctcttctgctccaacattcttctttctatattagatttagaactcacaaaggaagttcatatacccagatcttatcataaaaacacaatctagaagatcaaggtatgatcttctccctaagttatagcagtccagtagaaaatgtttgccaatgagaatcagctacactgtgccaggacacagaatttacaagaatcaaaggtttaccaaggatttcaaggagtttgaaaaagacataaaaatagttcaatgaaaccaaagacaaataacttaaggactttgaaggtaattttcaaggttttttgtttgtttggtctttttttgggggggggggttaggaagtaatatggaccagatcatttggtctctttaaaccatattttattaatatgtttttcccaatttgttaatcaagaaataacagctcttgcctcataagggaatcatgtagaataaatgcatgaattctcagaaaaatgttagccactggtaacatcattatcttagtttatagaaagaggaagcaggtgtcctatactaactaaatgctgagaattccttgcaagct

SEQ ID NO: 3607 - DNA, 1400 bp, mus musculus
aatatatatgaataaattccaaaaatcttaacatcttttatcatcattcaagaacaaagacatgttttcatgaaattgtgtattgctttttatttagagcttttgttccttttttttttgctaattcttatagaatttcaacagcttacttctgttgtattcattatattttcttattgtattctgtctgcctttctgtgtgtctgtctctgtgtttgtctctgtctctctgtttctgtctctgtctctgtgtctgtctctttaaaacttctcccagatacaccttccattatttacacattcaattttatatcaccatttttattattttgtgatgcttaaatgttcttgagtgaatgagaatccactgtatcatgatcaacatactagggtttgagcacataacttatgcaaactcaagccagaaaaaaaataccatcattcgagagaaaatggtcgaccagactcctgtactgtacagataagcttcccttcccctacccatcttccctactatctgaggcatcagtgccaagccaaggttcctcagtagcctgatatcccaggggaacctccattctccctctgtctcttccccaccaccatcagactcctgaactatacaggtaagctgcccttccctcacatatcttccaggccaagccgagtggctatgagcagactgccatcccaaggggacattcattatcctgccacctctctgtccaccttcttcagacctgaggctcctgaaccatgcagaattgcaggcctgaaaccatatcactcaaggatactcaccaaccataccagtaccatcaaggtttgcctccatcccaatacctgttacaagaaaatccaaggaccaaaaccatctagatggatgaaagctcttaaaagagcacaaccaacaagaagatcaagaagactggcaaacccttcgccaatctaagcaagagacagagatacagtaaacaaaatcagtaatgaaaaggaagacatagaaactgacataggaaattcaaaaaatcatcatttcttcctttaaaaacttgtactatataaaattggaaaattgcaatgaaatcaatgattttctacacaggtagcatttaccaaagttaaatcaagaatagttaaactatttaaccatccccataaatgctaaagaaatagaagcagtcattaaaagtctacaaaagaacagaaaggaaggaaggaaggaaggaaggaaggaaggaaggaaggaaggaaggaaggaaggaaggaaggaaaaaaggaaggaaaaaggaaaggaaggaaggaaagcaggagggagggagggagagagagagagagagagagagagagagagagagagagagagagagagagaggaaggaagcaaggaagcaaggaaa

SEQ ID NO: 3608 - DNA, 1000 bp, mus musculus
gccaaatcttgattattcacaggtggattcctagcaaagcagtctcccatcacagcagatttcctcactcagttgcttcacaccacctcaggcaagctcagctctacagcttgcatttctgctgctcagtcagtctgccttgctatttgcaaattatgcaagatcatccacagcctcatccttgggcctcagctttgtgaggaccaatccacttctcctcacctaccactccctttatattctcagctggatcttccaggtctgcagctgaatatattcctcccaaaacaatacttctactttttcttacagtagtagcattggatattccctaatgagccttttgtacaaaccttaatatctttcttttttatttaatatgtcaataaagttttatttatgacttattctacctaaagcccataaatgcaggcccttgaccgggcgtatcttctgatctttaataataataataaaccccacaaatataacagacaaaatattattgaatagttgacaggtatttaattacacagggtaacagaagaataattatcagagttgcatttattatattatttttttatatttttattaggtattttcctcacttacatttccaatgctatcccaaaagtcccccatacccccccactcccttacccatccactcccactttttggccctggcgttcccctatactggggcatataaagtttgcatgtctaatggtcctccctttccagtgatggccaactgggctatcttttgatacatatgcagctagaaataagagctccggggtactggttagttcatattgttgttccacctatagggttgcagatccctttagctccttgggtactttctctaactcctccagcggttatcatgtagaagaacacgaattgatccattcctatctccttgtactaaggtcaaatctaagcagatcaaggagctccacataaaaccagaggcactgaaacttataga

SEQ ID NO: 3609 - DNA, 1000 bp, mus musculus
gatggcgttctcctttttgggacaaggattttcatatataccttgttttttgcagcctttgggattaacgctgcaatgacttaagcacacaactatgtctttggaatacactttctattgctggatctattgttgtagctatttttcattttatgagtaacttatatactattttccacaatagatatactaatttatattcccatcaacaaagacccagagtactttcttaaactcctcacatattatctatctttttcttttaaataacagattgcaggtctggaccttagctagggctttacagctttttatttgaacttcaaggatctgttcccaccataaagaaaactttatcaatggatcagttcaacatgcttcttgctttagaagtacaagcaagggacatttcgttcttctacactattgtcttcattcccctaagcaagttcttcacctttgaaagtttagtttagctcagttaacagtcttctaaacaatgaatgagtcttctttctgcaagcactattgtctcgtacaagaaaacagaggatttcttaaaaaatggctcctcaggcctggtacggctgtcctctcagatgctcttccagcacctgactaagacagttgcagatactcagagccaacagttgtcttgggcctgggaacaccaatggaagagttaggagaagggctaaaggagctgaaggggattgcaaccccattggaagaacaacagtatcagctaaccggagctctcagagctccctgggattaaaccacaaatcaaagtgtatacatggcctggttcaaggctcctgctgtatatgaagcagaggactgccttatctggcatcaatgagaggggaggcacttgatcctgtgaaggcttgatgctccagagaaggacactagagaggtgcagcaggagtgtgtgggtagtgggggagcaccctcttcaaggcaaagggggggtaggctgggaagtttgtggagggga

SEQ ID NO: 3610 - DNA, 1400 bp, mus musculus
gaggcattatgtcttggatcttgattcttttgtttgtatgctggactctaaagatctaggttcagggtattaaatatcttggtgtgaatttgtgagactgtcttagtaggatgggtgtgctgttctttggtttttgtttcttctatggtcttctggtatgtgtgtcctaggcttttcttagtctgtatggtctctggtataactgggaatctctgccccaattggcatttgaggaaatgcaactaaggaggcttaaaactgttgaggcagtgagagagaaggggagtttggcaggaggacaagcctacctggacttctctaaatatgtgaggtctttggtagagtaggaagtctccacccaagttgaagactagaacaaacaactatgagggtgctggactgtgggatatggtgggaggagggaggacaccgaaatagtgacatagtgcggggatttttagcaagctggcaagcctaccttgatttctcccagtctgcaaggtctctactaaagagaaaagtctatcaccctattggaggctgggacaccagaaggaggaggtttgggaactggaaatcaggttgtggaaaacagatgtagggagagagtgggaagtttgagtggcaggcagcctgcatgaccttctttcagtttgtgaggtctctagtatagctgggagttgaagccccaggttttggtctctggtatagcatgcaatctctgctcaggtgaaggctgaaatggtctctgagaggaaaggggatgtgagatgtgatgggcagtggctgacagtagaattatcccatctgcacattctctagtagagcagaaatctctgcccaagcctggtctcttgtatagcaggaagtctccactcagttgggggctagggtgtggcaactgagagtgtagaggactggaaacagagtgtgcagaggccaagtgttggggattttggcaggtgggcaagcctatctagatgtctcccagtctgcaaagcctctagtggaatggggtatctccactcagcaagtaagacattttaaagaatctattatggatgctagtgatataaatctgtgtgtaaatgtgcttgccatgcaaggctgacaacatgagttctgagacccaagaatccacctgaagtctcaacacagtagcatagaaaaccaacatatctatggtgaaattggagacaaacaggaaactctttagatgctaacaggacaagcagtctggcttacttaacagtgactctttcagacaagttatataggtgagtattgacacttgaagataatccatgttatgtatatgtacatagaacacattctcagtctacacacataaatatacatacacacacacacacacacacacacagagagagagagagaga

SEQ ID NO: 3611 - DNA, 1000 bp, mus musculus
tggcgggggccaggaaaggttcagcccaaaatattccaaccagcaggtggcactatttgggaggttatgttatccttgcattgtggggtctcagagagtgcactacaggtgggctctcaaatgtccgacatgcatctcattgcagtctaagtttgctgtcttctgtgctgagctgtggaaataggcagtcacaagtttctaccccatcagttgagatgctgacgctgatgctcctactgctgccaccgccatgtcttctttatcatgatgaacagaggacctctgaaactgtgagtcaaaggccattttccctctaagttgcttattgcaggtattttttttcatagaaacaagagcaaaaagtacagacactctatttatcattgaaggtgtggtagagacataaggattcatgaaagaagaggttgtataactcaaggttcctttacattggctaaaaacgtgacctttcacgtgcaatcattaacagtaggaaataaattaatctcctcccctttcatacttataagctttgtgagctgataatatttatattgaagtaactcttaaactgaaggttcatcaaattggaaaactggctggaagacaatattttgggtcagcagaagttaaatagagattatagaaaagcccataaaaagtgtccatcaaaattatctggacatattgatatgctcctcaatgtttttcttcaatagtttttatctacaagtgctttattggcttactaggaaaatagatagatacacatctgtaattaatattgaaagagttgagcctgttatgcaggtagtccacacctggcctttgcaatcatctttcgcttgcctcatggccaaagtacactggccgggccacagaagagagcctgaggtctagtgcatgcctggtagtactgtcctgtagagcagtgcagacagagtgaaatccatcctcattaaattcttgtctacctcttcagcagccttctgctatgtct

SEQ ID NO: 3612 - DNA, 1000 bp, mus musculus
gattcaacttaattttttcaactttatagagctaccaaagcaatgcacattggacagaaattgcaggtaaaagaccacataggctgaaattagcaatgatagcattaactgtggacagtaagagggacgaattatgtggtgccaatcaatcaatcacgtggtggagtaggtctgggaggagtggagaagggagaatgtgactgaaacactttgcacaaaattctcaaaaaataaaacacacatggggggaagatgatctgctctcctatcctatgggcattgggccgctatgcatccttgtcctttgatgtagcccatgtgcccaatttcaacagaatgtaaacactgcagtttgagattatatacagccaactctttcactcttacttatatttcctttctttctctccttccacacctttcagggagcaccatctccccttccataagaacgtactcaaaacatgaacggtcttcccatactctgctcatcgccacgacagataattaaagcatcacttgctgagacagaggaaggaggaagagttccctgcctaccacccttcctcatccattcagccatctcctcagtcccgttcatcttgaacactcttggcctccatttttctggactaaacgtttaaactgctcttgaactgaaggtactaaggagcctccagcagttgttctcttcttggtctcaagatttaaattccctcacttgaagcaagaaaaggagggaagtcaggaggtgagcatctcactttgaaaatgtttctgtcttctggactgtcttcctctacatggagtagaggagtaggaacagtctgccatacttgcctcaggggtgtgcgacattgttaaaggccaagaagcttcaggagatgtaaactcagatgaccttcactacaatgagaccagccacctttccccagcaatgacaggtgacagagaaagagctcaacagccaaagattatcttacatcctaagcaacaatcc

SEQ ID NO: 3613 - DNA, 1000 bp, mus musculus
cctctcttcctgttctgcttggggacagctggcaaggaagcctggttctgttttcatcccaagcacaccccaaccctatgccctgtattctagtcatcaactccacatgtcacctcagtaaagtaagaccgccccccttccttgtcttttcatttctgatttccttgagagtcctgtcctgtgctccccagttacctcgatgctgtaggcaacagttacattagtctggtactggtgctcagtactagtacccacatccaactttagacagacactcacctgcctctttacatagcgatcctctagattttaaaaaccactacaactaaaaccacatgtctgccactcatcctgtgacaaaaggaaaaaaaaaaatctcgggcaaactgaacttacttttgtccccacaacagatgatgttttaaaactagaaaataagtcgagtgatggagaagaaaattcttgtcttccccgctgtggctggcactggaagagctgcaccatctcgtccagattagctgatgctctgtcacatttgtggtccttctccatgccaccactcagcccagaacagtgctcaggcatgcaaggacagacatcagaattcctggaggatgctttcaaaatcacagatgtgcagcgcctagtccctgacgtggagtgagaatttgctaggaaggttcagggaagagggaagttacgttaaaagttccaaggcagagctgggcgcggtggctcacgcctttaatcccagcacttgggaggcagaggcaggcagatttctgagttcgaggtcagcctggtctacagagtgagttccaggacagccagagctacacagagaaaccctgtctcgaaaaaccaaagaagaaaaaaaaaagatagaatatatccctgtgctttatgatccttatttataaagtgggataaggtagaagcattgaaaagaatggttactaatatgtagaaatatcagaatatcgtatatcagaatcacttt

SEQ ID NO: 3614 - DNA, 1000 bp, mus musculus
tcatatcggcgggcttttttgttggtttgcgaaaccgtttctttctgacgttcttaagtggtggagtaatgccatgcttccagatatattttccctctgcttcctttttgtttcccactacagtagcaccagcagaggtagctggctcttctggggacgtgtggggatcaccatcatcggcgctgcacaatagcatctgggacacatcggctgttttataaaaggttttcccatcgtgcgttttcaggcttccaataacacaaggcaaatcgacaagtttggcagacagtgagacgccatctacctgaacgacggcacggcgtgaatcgggagacaagtcgatttttagtttctctctcatggcggcatttccagaacggatgatcttcctgaccgccgaagcctgttctgggggcagccgcagtatgaactggttctcgagttcgtgaggcggttcatctcggcttttgctcatcttgtctcttgggcttatccgcgccagagctgaggtgaggccgtgtggcctggggtcgaccttcctttcctgtgtccttgggggggacaaaggctgggccccgcggggctctgagggctgcggtgaggccgaggcgcttagagttcaagtctgccctgcccagggaggctcagtcagcgcgctggcccctggcacctcgttcctgtgtcccgggccaccaggtaggcagctggcctctaatggcttccccacacctcggcaggcttcggtggcctccgctggtaaccgcagggcctctgcacgtcacctcgggcctcgcagcctcctcgagcctctgtttgcctctacacctcctcgggcctccctagtcctccacagtcctccgcgggcctcgcggccaccctgcacctcaggacaccacctcaggcctcgcggcagtcctgggcctcaggacgccacctcaggcctcgcggtctccacgtacctctatgtactcctccacagttctctatgcgcctccctggt

SEQ ID NO: 3615 - DNA, 1000 bp, mus musculus; identical to SEQ ID NO: 3614

SEQ ID NO: 3616 - DNA, 1000 bp, mus musculus
tcattttccagttttgctaatcgctatgaaacaaaccaccatgaatttcaatgctagtaaactattgaaacagccagcacctggggcgtcccctgggatagcacaggctgcggctgtagacctgggctcagcagagtctctagaaatagtagcagtccgctagctccaggtgactaaacgaggcttcagctcgcaggctttctgattagcccagctagcaatggtaagggagtaacaagaagaacacagatggaagtcggatgcatcgcaacactcggtcagtttccacaccggtaagagagcccatggggatggggagagggtggtctgggtcacactgtgctgttgggagcatccacgctgggatttctgtcagcggctggtggggtgagtcagcacaaacgctctttgattcacagagaaacatatttagcctcaaagtctgaagtgtaaacatcctatcggttattcagcgtgtctttaccgtaagggctcaccatcccaaagactggatcccaaacgcatccatacaaacagaacccaaaagtttcataaaagacagttaggaaagcacatgttttctctgttttgtccagtgtagttaccacactaccatggggataggaggcagggggtgaccttatttatgataatgaaagaaggggtcacagggaggtgagctgagaaatctagatatgtttacaacaagggcatctggaacccccaccttcacatgcaggcttcactaaaaaatgccaggatctttttggtgcgtcctatgaagagattgctgaaggaaaggtgtccctacgagatgcccctggcctagttcctacctgggaatggcaggtctgctgctttccctccgtgaaccaagaaccttggattctaatcgtagtagctctcacacgaatcttggaccctggttagaaattatttatgacttcattagttgatctgcatagaaagtaatgctctctgataaggagaatctcaaaaa

SEQ ID NO: 3617 - DNA, 1200 bp, mus musculus
gaaacccacagccgtggaacgttaaaccattcctgcagcctctcgggggttgtgattgttcacttctcgcttagatccatttgtacgtctgtgctgttgatgtgcacatacctggctccccatagctaacggaaggttttcatttccctctctgctcttagcccttagtcacataccagctgcctcacctgaaatgtgaggaccagggagaggctgctctaatccaaagcacaaaagcccggagccagagaattctcggaagagaaaagtttttaatccaggtgaaaacagagagctgcccagtgggggcaggagggtcagccgctaaccactgccctacctccaggccaggggagcccagttctgtttgtcctggccaacagaaacccttagtagccttgacttcagtcaggcagcttatgctggtcctaaaaccagtctctgggtggggctggaaatgcacctggagagagcacagccaagtgccagggatttaaccactccacccctattcccctccccagccccaccaagcagcctctgctagatctgcagaaccttggctctgcttccactctcccagcctttccccagggacaaatgggaagagaagatagagtggtgtttgcctaagtcaacattgtcagttggatgctgctggggtgggggtgggggtggaactgcctgcaatcctgtcgacagagaactgtgcagtgtggaccagtctctgcattcctgacgacaggtcagaaacccaagggtctggatccagttacaaccagccttctttcccagctcatccccaactagtcattgctgggccctgctgtgacagtgccatggttgttccttaatgaatgttcaagtcacttaagcatttcaagcctccgtggctccttattaaaacgaaggagactaagatggatctctatgagttagagtccagcctggtctacacagtgagttaggacgatgtagaaagaccctctctcaacccatccacctccccccacaaaacctaaggagactagactgtggttcgttaagagtgattgtactggctagttttgtgtcaacttgacacagttggagttaacacagagaaaggagtttcagttgaggaaatgcctccatgagatccaactgtaaggcattttctcaattagtgaccaagggggaaaggccccttgtgggtgggac

SEQ ID NO: 3618 - DNA, 1000 bp, mus musculus
taagatttgcttttctttatgtgtgtgagtattcgccctgcatgaattatgtgcagaatgtgtgtgcctggtgctggtggaggtcaggtcccctggaactagagttacagatttttgtgagctgccccgtggttctgggaactgaaccagggtcctctactaggagcagggagtgctctccattgctgagccatcatttctgctcctcctttatatactgagaaatatctgaatttcccaaaaggcctttgcttatttgggctgtatctacttacacggtagaaacatttatgaaataattattaacttattttaaaacaacagcgaattcattggatgtaacacagacaacatactgttgatgaaaaattaagacaagaaaaatctgtgccttgttttattttatatttctgcctctgaattttgttaatgagtggctgaggtggtatccagtttcttgtgtttcctctttccctccctcttcttctcctagcctgttgggagccgcgcccacattcgccgttacaagatggcgctgacagctgtgttctaagtggtaaacaaataatctgcgcatatgccgagggtggttctctactccatgtgctctgccttccccgtgacgtcaactcggccgatgggctgcagccaatcagggagtgacacgtcctaggcgaaggagaattctccttaatagggacggggtttcgttttcgctctctcttgcttcttgcactctggctcctgaagatgtaagcaataaagctttgccgcagaagattctggtctgtggtgttcttcctggccgggcgtgagaacgcgtctaataacaattggtgccgaattccgggacgagaaaaaactcgggactggcgcaaggaagatccctcattccagaaccagaactgcgggtcgcggtaataaaggttcccgtaaagcagactgttaagaaggattcaactgtatgaattcagaacttttcagctggggaacgagagta

SEQ ID NO: 3619 - DNA, 1000 bp, mus musculus
tacctatcagtagcaccatcacagccagagatggggagagagggatgacaatcaattacctatcaccagcaccacagcctcgcaagagcgtggctggtcctcgagcagtgctaagatgtcttggttactgagttcacgattactaaggatacaagaaatttaattgtattgacaagttggtatctatttagaaggaagaataataaggttcagtatctcattgattcccattaatactcatgtatggcattaacctgtcattaagtgtgtctctgtattcctcccctagggttctctaaatgccatgtggtatgcagaggttggttgcttttgagttcttaaaaactataataatgcatagaatacttgtgtaatttcagttggagtaaaaaagtatttgtcaaaattgttcttagctactacaaatgtctccttgcctagtagtttggaataaattagctgcattatgcttttgcttaattgttttaatatctgctgaaacgcatagtctgatgagtgtatgtggctgttattttgcctgcctttctcattggactgtggctgtatcctgctttggctttcttatgtacttgtcggtgtttataaaagatccttggcaataaaggaaggcacctgaactctctgcgtaggttaaggagctccgagaaaaggccgaatcttacaggaagcgagttcaggggacacatttttctcgggaccatctgaaccagattatgtcggacagcaactgctgttgggacgtctcctcagtcacaagctcggaaggcaccgtcagtagcaacatccgagcactggatcttgctgggtgagatgttctttgtggaaagtgagaaggctgtgttatagcttgtgtgcatcataggatgatgtaggaaaatgacccagctaactcacaatctgctgtttagccagatgggtctcttatttcattatttaaaacttattctctgtggtaaatgtagctatattatacttgctt

SEQ ID NO: 3620 - DNA, 1000 bp, mus musculus
aaatatgcatttggtttgtttcaaacgctaaacactggaaatggatgcgcttcattctgaagaacgagagcagcaactttgtcacctggatgaggaagatggcttctgctttgtcatccgtaccttcctccacaggacagatgtgtggtaacttaaagctctgttctgaagttgggtagtcaggtcacctctgggaagagcagccctggccagatccctcgggaaaactcctgtccctcctggagtttgcctcagcgatgcatctcactcaccaccttgatcttactttgccagttggtcaaatggaagttgccagaattatttgaagggttattgtaagggttatttgtgaagattaggagtgattgaaatagggtcaggataccaaatcccctatgcattgggtagcagccaagattcagggcaagtggcttcccgagggagtatccctcagcaaaacctgatcagagaggagggggaattgctgctcagacagatggtatcaggtaaagtagagtcttggcctgattggtgagggactaaggtgccaatgtggctaacatggtacagacacactgtcattgaggtagactggctttgtgtgttccctgggagtcagccattatatctcagttagtgtctctaatgctgcaacaaaacaccatgcccaaaacagaaattgggattttgggggggggagggatttattcagtttacacttccacagcactgtttatcactgaaggaagtcagggcaggaactcaagcagagtgggaacctggaggcaggagctgatgcagaggccatggagggatgctgcttactggcttgctcatcatggtttattcatcatggcttgcccagcctgctttcttacagaaaacccaggatcacactagtctagggatggcaccacccacaatgggctgggttctccctgattgatcactaattaagaaatgtcttacgcagggcagtagaggcgcaagcctttaatcc

SEQ ID NO: 3621 - DNA, 1400 bp, mus musculus
cagggggagatgtgggaagccacatgtgccgttgctgagtggcactgactactgctggccaccatgcataagattggacaaacaaccaatgtgtacatatgcagtaaagttttttgcaaaaacactgcctggcccaggcatgataatgaggttctgtaaggtactaagagagtaaccaatcggatgtgagacatgcaaatgaggtatgataatgaggctctgtgaggtactgagagagagtagccaatcagatgaggaacatgcaaatgaggcttagtgcataaccaatcagggtatgagacacgcctctcctaggcctataaaagcagcaccagctctgggcaaaatggtcttttcgcctctgcaatcaagctctcccaataaacgtgtgcagaaggatcctgttgcagcgtcgttcttgctggtcgagtcgagcgcgcgcaagagcatgtcatcagtttatacgggcactgttgctgttaccgtaattacttttatcttcaccgagtggtacagagatggaccgcgtaagaacagccttccctctaagaagattcacgggtaaaacaggagagataaataaatcagcacctgcacaggttgtaacacagaaacaggaaaagacaaagcaacagaaagtcctccaaagacttcaactcctcaattaccaaatccaagggcactgaggactctgaagtgctgaatgggaaggtctccctgtaaacacaattaacaacgtcaccgagaaaaggaggtgctcatggggcccttctccttactgctcaactatggctggtgatagactctgggagatggggctcctttgtcttcagttgaatacctactggtgagcccaccaggctccagggaatagtttgaatcctaggaccacacagagagccctagaaaacccagagggacacaaatcaaacaggaaatcaatgcgggaaagagcctagtaacatgggagtgaagtgggcagcgagccagcgtgagagcgtcctagtgcattacacacgagtgagattaccaaagaccaaatttacctaataaaaaatgattgatggtttcaagaaggaagccggtcaaggaatgaagttaggaaatacgttgaggatatcactggggcagtgggcaatgtagaagaggcagaagacaaattcagaaaagacgaagtcagatttggggggcaaagaagggccaaagtgttggagatgaagaaattatactcaaacggataagcaagcaaaaataatgaaatccttgccagcagattagaccaaacttaagaaagaatatcaggcagggacatctgaggaatattaattactaaagaaaaaagaactgcagtaaccacagcatctcagaactctgagacacaactgagagaaaaaaaaaac

SEQ ID NO: 3622 - DNA, 1000 bp, mus musculus
catgtttccagtagcaacagtctcaccacgtcccttacgtggggcagatgttcgactgaacagtagaattttcatgattcaattaagtgaggtgattgctgtacttcagtgtagacctgcgcatgtgcaaggccccaggttaaaaacaaaactcgtaaataccatctaggtggaaatgcctaggaggaaaggctaggagagctttctctaggaaggtgcgtgggctctgagtaagtgcctgcttgtgtatgactcatggatccggggatcaaaggatagaaggacccatcgtctgaggagtttgcatcttagagaagggtcattcctcgccgcttgtacacaggacttgttttatcatattaggtagaattatgactttattagggaccaggatggctcatagcaatggctgcagacgccaaggtgacagggacagaatgatgactccgaatccaactcctcccgcttctcctctgctgcagtcaggattcactaaggcagttaggccagcctcagactcactcagtagcccagacgagctttgcgttatgagccccagcttcagccttctaagtagctggggacacaggtccatcggttttagccatttggctgatattagcacttacagtggagaacagagggacagattgctgtctgtaatgaatgtggcaggtctcctccaagagctgagagcctgactagaacaaacacgtcctcctctgtggagcaggagtctccaggaggctgcatctgcaagctgtctacgccatcagtccttgggcgctacccctcaccgttccgctggaggtgaattgtctgcctacctaggtatctgtgctctcgttccttagactggagcttggcatttctgaatccctggcatcatattggccacactaaaaccaaactgctatttaaatcaatcaatcaatctctctctctctctctctctctctctctctctctctctctctctctctctctccttcttcccttc

SEQ ID NO: 3623 - DNA, 1000 bp, mus musculus
ccttcttctgtttttttttttttttttggtaaggatcagctgtggttcctatgatttatacatttgtctgctgacagcatcttaagaatgtggccctcagctctagctgcacttatacaggagacaaatgggttcaggtcttggagatgttggtgttttacctgggttaccttagccaagacccagacctcactgggtgtcttcttatagtttcaggacctaaccactcgactgttctcaagaatgtggcagttcctggtgctttttatgaacattttgattacttgaaaaaaataaatagtagagagataaaaataaatggtggatggtattttcttcgctccattcactgggtaacaaaataaaaattaaccagtttcctcatgctggtggcacaagaagaggtatttgggaacagttgtggaggtcttggagttgtttagacaacctgcctggtcactccagtattcctgtcagtgtttgtagctggatagtttaggatggtgagttcattctctgtgttgtgtgaacctggggacgagaggctgcctgcctgaggctgagatctcagcagtgcctcgtctctgaatccatacatcacagatagtcacaatattgctttaattacttgaaaaatgaaggatataatttttggaacgttatgggaggaataaatgggtgaaataacaaagtacgtttccaatgacatagccacttgtgattttgtcttctattttgttttcttactccctccccaccccttttcttcctcatcttctttttggatgttcttggtggttattattgtttccaaaagctgaaggtttctctgacacattttcccttctcgccattctaaaggagttgtgaccatgaatatctttgaattttcagctgttatgagtttctggcacctaaaaggcactcacgaaattcttattaaatgaataaattaagaagaatatgcgaggttgctatctttcccctctattttgcttcc

SEQ ID NO: 3624 - DNA, 1000 bp, mus musculus
tatattacatcccaagtacaatttcagctccctgtattactcccagtctctcccctcacttctcctctctcccagatccacccctcctctccttctcttcagaaaagagccagcctcccaaggacattaacaaaacatggcatatcaagttgcaggaagactaggtacccttctcattaaggctgtatgaggcaacccagtagtaggaaaagggtccccaaagcagtgaaaaatattagagatagtcctgtccctatggttagtagtcccacaagaacatacaggcacatatgcataaggtttatgtagagagcccaggtcagacctgggcagctccctgattgaaagttcagtctttgtgatctcctatggatggaggttggttgattccctggaccattttcttgtggtggccttgatccctctgactcctacaatccttccttccctcttccacaggcttcccagagccctggctaatgtttggctgtggctctgcgcatgtgcaccagtgagttgctgcatgatgcttctatgatgatggttagagaactgctaggttttggatgggggatggtagtcagaagaacactagtatggattactaaggagagtgataaaacattcgtcaatgccagggacagacaaagagacaatagtatggtagaaatggctccaaggagcagttccgccacaattccagagacagacagcatggctatctgaagatagagttaaatgtgcaggtggcagaagtggaaggccattctaagcgctttgtgaggatgagggaggttttacagaaattgtctgcaaccaggctcattgattccaggcaagaagcagcaaagatgagggagtgctagtagatgttaactcacttcctagatgaactactgtggtgctaagatcttctgttagcttgggacttaagactgtctcagcagggtgcctgtgaaagggggaagagctctgcaggcacacaggtatattctgattt

SEQ ID NO: 3625 - DNA, 1000 bp, mus musculus
gttaaaaaggacaagtagaatgaatggaaatgtgcaacatgaagagggagggaggaggtggggggaccctctagaatgtaccagagatctgggagggaaaagactttcaggactcaaagggagggaccttagatgaaatgcccaacagtggggaaagggaacttgtagtgtccaccttcagtggaaagatagggcatcaagtggaggaatgggactgccatcccacagtcaaaaactctcacagaattgttcctgtctaaaagaactgcaaggacaaaaatggagaaaagattgaggggaaaggagactgagtgactggcccaaatcaggatccagctcaagaggggactccaaggcctaacactattactgatgctatggtgtgcttacagacaggagcctggcatggctgccctccaagaggcccaacaagcagctgaaagagtcagatgtacttacacccaaccaattgactaaagtcagggacccttttggttgaattagggaaaggctaggagaagttgaggaggaaggcaaccccataggaaaaccagcagtttccacaaacctggacccctgagatctctcagacactgagccaccaaccatgcagcacacactagctggtctgaggtcccagacacatatacagaggactgcctggtctggcctcagtgagagaagaggcacctaaccctaaccattaagagactcgaggcctcaggaagttgcgagatcttgcagtgtgtcaggggtgggtgtggggacctcatcttggagatgggggaggaggaatgggatgaggaactgtcagagcgcagaatgggagggggatgatgactgtaaaaaaaattaaagatgagagagagagagacagagagacagagagagacagacagagagagacagagagagacagagagaggagatcttaacaaggaatttgttacttagatcaccttgtgacatacatgttacagttagtcaatcgctcacaagt

SEQ ID NO: 3626 - DNA, 1000 bp, mus musculus
gctaggaggagagtctcaatgactaaccccacagtgacacacttactaaaagggcacacctcttttttttatttaatttaatttttttttttgcaattcagatttcattcccttccaggtccacccgctgtcggttccccatcctatacctcctccccaccatcctctttccacaaggatgtccccattccacaaccaaccccaccagatctcaaaactccctggtgctgaacccagacttggcagttctctgctgtatatgtgctggggacctcatatcagctgctgtacgctgcctggttggtggtccagtgtctgagaaatcccgggggtccaggttaattgggactgatggtcctcctacagggccgtcctcctccttagcttcttccagcttttccctcattcaatcacaggggtcgcagcttctgtcttttggttgggtgcaggtatctgcatctaactctttcagctgcttgctgggtctttcagagggcagtcatgataagtccacatttgtgagtggctgcatagcctcagtcagagtgtcaggccttggggctaccccctgtgctggatcccactttggcctgttactgaacttccttttcctcaggctcttctccattttgtgtccctgcagttttttcagacaggaacaatcatgggtcagagttttgactgtgggatggcaaccccatccctcacctgataccctgtctttctgctggaggtgggctctactagttctctctcctcactgtagggcagctctctggtacattctggagcatgtccccaaccttctgcctcctaaggttacctgtttccattctttctgctggccctcagggcttcagtcttttttcccaataccagatcaggctctgctcttctcgtcttccctgtcccctttaccatccatgtcctttcttcccttaccccctccagcgattgctttcttctccctctcaagtgggattaaggcatcctcacttgg

SEQ ID NO: 3627 - DNA, 1200 bp, mus musculus
atagatatagatgaaaaccacatcatgataaaatatacaatattatgaggctaagagtattttgatctcagaaatctcacatcaaatgaattatggctattaacaagttgaagaatcaaagaaaaataatatacaaggagtaaattgaatggtccataaattatatgtagaaatagactgtatctaatgactcatatggcaattgtggcagaacatactacagaatcttcacttactgaacaagggtacacatgcagattgtatcatctaagctctcttataaacttgggtagataaatccctgctcaaaaattttgtcccaaagcaacagatatggttgtacctagcatctcatatatatcacaaaactaaaatctggaagtaacccttcccgcaggattcagttattcgtgggtgtgagggggaccgcaaacctggaaggaaatggaaggaagggaaggagaggcaggagaccaagcaaatttgtcaaggtctcgtttattaggctgtggtgccttgttttaaagcatacatcgtggggaatagaggaggggtcgagggggaattttacaaagaacaaagaagcgggcatctgctgacatgggggccaaagtcaggcaccaggtagcaggcactctgcatcttatctccagaacatagatccttcttgacagcctttggtgtcaggctgggcttaggcgtaactcatgtccttggatggcatgggagttcaggaagagatagggaagaggggactataattcatcttttacagcttcaggtgccaggaagggaatagggaggagggagtgataaccagctcctagcatgaggccatttggcctgtcaaggagattgtgaagggcatgctttctcatgggatggtctctgacatggaagcaaggagtcttcagacaagaaaatccctctatgtggaaggatacactaacttcacttgtttgattcatgagtctcacagccctcaactcaactgggtttttggatagataaagtaaaagacaatacaaagtcccagaacccatattttctcaagtaaaagggaaagaacgacaaggataagaagaaggaaaaaggaagtagtggcagagaggaggaggaagatgatgaagtagcataatatcttctgtgtcactgtattgattatttgaattattattgtaatcttcattttaaaatttt

SEQ ID NO: 3628 - DNA, 1200 bp, mus musculus
gtacaactacacagcaaaatactatttagctagtaaaaacaaagacatcatgatttttgcaggcacattgatggaatttgactttcatcctgaatgaggtaacccagtcccaaaaggatagtagccataaaacatattctttgatgtatgccacagacccatagaagccaaaaaaaaagaaagacccaagcaacaatgcttgaatctcccttagaagagagaatgaaataatcatacgacacagatggaggaaaggaaatgagtgcaagaggggatgaggagggaaatgtgggcaggggttcaagatcatgtgttgggaaggacaggagagatggccagatgtccatgaaaatgaatagaaatccaaagctgatgggggtgaggaggtatggggcatctccaagaaaacacagcgtccccggtaagggtacagcccaagaaccaatgggggtgaccttagctgtgactcacaacattgggtatatggaagctgaagaggccatcacctgtagccaggcaggaactccagtggagcaatagacaccaacccatccacaaacctttcaacacaaactttatcctgactaaaagaaatccaggcacagggaagggagcagagactgagaaatggccaaccaataacctgctcaacttgagacacgtaccatgggcaaacaatccctgacactattaataatactctattatgcttgcagactgttattagacgcgttctcacgaccggccaggaaagacgcaacagaccagaatcttctgcggcaaaactttattgcttacatcttcaggagcaggagtgcaagaagcaagagagagagaaaacgaaaccccgtccctattaaggagaattctccttcgcctaggacgtgtcactccctgattggctgcagcccatcggccgagttgacgtcacggggaaggcagagcacatggagtgaagaaccaccctcggcacatgcgcagattatttgtttaccacttagaacacagctgtcagcgccatcttgtaacggcgaatgtgggcgcggctcccaacatctccccctttccttttaataagagcaaataggccacccatattaatgagagtggagatagaggtcaaatccccagtgtgtaggtaaaggagccatgtacaggattagctcttaggctcacaggcttttacccagagcaaccctg

SEQ ID NO: 3629 - DNA, 1000 bp, mus musculus
aggaggttccaagggaggggatgtgaacctcactctgaagagaaaacaaaatagtcatcagaggtggaaggacagagggaactgggtaggaaagagggtgaggaggggaacagggatagggatcgggtatggggaaaagaaggtggtgggacagggctaagagagacagcagaaatcaatggcaggcatatctgagactagttggacatttgggatggtgaaagctcccaggaatctaaggagatcaccctagctgagactcctagcagtgggggacatggagactgaagtgatcacctcttgtagccaggtagaacttccagtggagggaggcggaccaccacccacccatccaaaatttgtcctgcctgcaagatgtacagggatagagatggagcagaaattgagagaatggccaacccctgacattattaatgatagtctgctatgcttacagacaggagtttagcataactgtcatctgagaggcgtcatctcacaggggatggaaacagatgcagagacccacagccagacatcaagtgtagcttggggagtgtcttgtgaaagagttcaggataagactgaatgagccaggagagcatgggggtctgcccggcctgagaggtttgtgtcacaggcgccggcgggagccttcttggctccgggactccgcggagggcaggctgcacgggtgaccgtgtggaatacagaggccagctgtttctggtacgggcgagagtcgcagagcttctggggcggcgccatcttcggctccagacaaccggccaccttcctggcgagagccacagagcttctgaggcggcgccatcttcggccccagacggccggccaccttcctggccaaagcaacacagcttctgggaaagatcctgttttgggccttcaccttcagccaggaggaggtccaaacaccagataactgtacaccttccctgaaagaggagagcttgcctgcagagactgctctgaccactga

SEQ ID NO: 3630 - DNA, 1800 bp, mus musculus
agaataatgttggcctcctcacaaagaggttctttgcaatttatttttaaacccatggccctaaagaggcaaaactgttactacccaatagcaatattacataaggagaaaaacccatttttttattttctacttggaaagtggagagaaaggtttggagggttgggtttcattacgtaaacatggaggtgatgtacggtgacgtgcaaataccacagtgccatccctctcacgtgtcaataaataccagaggctaaattttcttgtggcacgcatcaggaagtataaaacttgggttgccaaggagactaaccagctctcctttgccgaataccttcttgaggatactctccatctgagtcactaaacagactcagattaaaatctgcacactggatggaccaccctcgatcatcgagcattgccccaggatagcctctccactccagatgctccatttggctcctccctatattgcccatccacaccttgtagtgaagagaaagagtgagatcaaataatgtgtatctggctttcatgtcatctcggggccaatcaggaataaaaaaaaaaaaatcaacccaccacatataaacacctgtggcttaaacttgggccctagtgattggatatgctaggttgcatcctgcaactcaaaagaaaaaaaaaaaagatttcttaacacacataataacttgtctgtccatgttttctgccctttatttgtggcagagaccacgggaaagttcactgaaggcagctctatcagatcttgttatttgtatcgatgtttcttccggcttcctagtcaggttcccagcatgctcaacatcagcacccagaactttgacttgtgaccaggttgggtcctcttacctggttccccatccccctgactcaacagcctactgtgtaggactcattctctgccgttggcgtgtgggccagatgcacttctatgctgtccccctgactcaacagcctactgtgtaggactcattctctgcccttggcgtgtgggccagatgcacttctatgctgttcctctggaagacagtgacgggatgctgatgactttgaaccccgtagcgtcatccatttggatttttctaccacgccccccctccacttccgccctagtattctatctgactcctcaaagtagctggagcttaaggtagacttcccactgaggccgccttactgtttgcattacatttagatagataaagctagatgttaaatgccgatcagcgctaacagatcagcactaacagccgaatgtatatgctctcccagctcctaccctcatctgggagtgacatgtccctctgccttatttattctctcctcctctcctactcaaagctcctctgattaatctgccagaatcttaacatagttagcaggacattaccacggctctttctgtttgtttgtttgtttgtttgtttgtttgtttttaaacaccttttaagtaatatcaattttgaaatattatccaataatcaataggttgaacatatattttgttgcttgtgaccctgaccaagacccttgggggcaggtgtaagaaggtgcagggtcaataacacagaggcggggagtcaggcaagggtcaaaagcagactcgtttattgcaggaactgggcaagccttcatacccacccccaccccgcaactggggccccattggcccatgaccaatcacttgatgtagttggcaccatatgattggttgttctagtcacatgatctgtcatcatttgtctccaagtatcaggctggttgtaggggtta

SEQ ID NO: 3631 - DNA, 1000 bp, mus musculus
gctggggagggagttagtgtcagagaccacaggttttgcagcatgctgagagaagaggcctcagtccctcttagaaactggggaagaaagagaaagagggtgtgaggagccagcccggcctggcctctgtgtaggaacagacaacatagaacaccacgaagccagccccaccccccactgccagccagtccaatccatgtttctccaccccaagtcttgccagcatcctctcccccttaacacatctctttctctcctgcttttctgcctgagccactgtccggggaaagcctgggagggacgcggcctcgtgcatctcagcaagactggacattttctcttgattcagcaaaggagctataaagtgtaccataacataggtctctctgaccatctggggtctaaaacaaacatggaatatgcccggtgacaccaggtcctggtgtgatcggggacttggtgtgattggggaggtgttgaagctggagggttagtggatggggaggcagctggtttccatttttactgaccgtactgttgtttctagctagagacaccgagagtctttggcagcatatgtcaatccaggagtagtgcagacatcacctttacacgaggtggcttagacatctctgtgtatctaaggctattttaaggctattttagggtaaaggcacaaggtagtagaccgatggacagcagcccttgcctttaacaaaaattttaatgtatgacagtgacccctagtggtagaaatgagtactgtgattaccaccagcacctaagggaaggcttggggccatgggaggtcagggttggctatgaatgagatttgggctttttagcaaatgtttctgtttggttttgatacagggtctcatgaatccaggactcctttgaactcatgatctccctgcctctgcctcgtgcagccatacagggccaagcaggagttggaagattttggctcagtcactaagtgcttactgaacagacatga

SEQ ID NO: 3632 - DNA, 1000 bp, mus musculus; identical to SEQ ID NO: 3631

SEQ ID NO: 3633 - DNA, 1200 bp, mus musculus
ggaagaatgggactctccagtggggaagcacagggcacaaggggacaccgtcagtgtcagagaagagggctgtcagcaccaccaggtcatggtgtttcttacccaacatttctattctctgcactcactggcttctggcatgaacagcaataagtatatacagatagcaccacactcacaagccggagtgcagagttagggagggcttctgagaatagccgtagagccccacacctacgacagagacgtttaggtctctactaaccacaccccaaaggcagcactgtaaaaacaagtgccaccaacattaatgagacctactgtgccaattcggtggcctgctggcaaggtacaaatgaagcttgtggcaaggatgcggcaggctgcaggtgggagctgcagctgggtctggatggtagagctgactgtgggcatgtatggctgcagcatgacagacagcaaggcagccatgttcactgccatgcctgtcactgtgcctgcccgctgcctgagaaagagagacatgtcaaggtcacaaagatgtagcatgtcatttaattcctatagccagccctagctcctgcacacacctgtccatctcaccacctttaatccgtttccagggctcattcacttgaatgtattggttgccatggcgagatatggtgaggatactgcgcaaggcatcccggatcctgggaagggaggaggcagagtgtatagggctgcaagccataccaacatatcactgactagaccgagctggaagtcacttaccgaaccttttccaacagctggtgatagtgctggagttcccaagagacatgggccaccaggcgtctgtcatcaggggttagcgccatctcaggcacacaaccgccaaaaaacttagaaacaaacatgccagctctgagggaagagaaaagagaagacagagttactgccaggtttttagagaaacttcatcccacttccataagtcttcatgcttgggccgccagatggctcagatgccaccaagctcgccgactgagttccatgcctggctggcatctccgtggtggagggaagaactgagtcaggttatatgctgatgttcatggcacactatcaatcgcaccccacaacaaacaggaaataactgttaaaaaacaaaacaaaacaaccaaccatacaggaagacttaactcccatggcatt

SEQ ID NO: 3634 - DNA, 1600 bp, mus musculus
tacagaaaaagttggaaacactgtgatttaaaagttctgtggttgaagagatagctcaaggtttaagaacatgtaatactcctgcaaatgagcagatcacctcccactatacatatcaggtggttccatagaatttaacatattcgtctggcctccatatataaatgctgcatacaaactgatgtagatacacacatacatacatgaaataaaaaaaaaaagaaaggaagaaagaaggaaaggaagaagggaaggaaagggaatggaagggagggagaagggaaggaaagaaaggaaaaagaaagcagaaaaagaaaaataacagaaaaaagaaaagaaaaaaagaacagagagaaagaggaatcgaaagttattatgtcaccatgaaaaatgtccatctataagtttggatatgctgtgtcatcattttcattgaattccaggaagtctttaatttatttctttatttcttctctgacaaagttatattgagtagagagttattccatagagtctacctcctgtagaaagacagggcatcaagtagagggatggggttgccataccacagtcaaaaactctgacccagaattgttcctgtctaaaagaactgcagggacagaaatggagaaaagtgagagaaagaaggtccagtgacaggtccaaattgggatccagatcaagggaaggccccaaggcctggcactgttactaatactatggtgtgcttacaaacaggagcctagcatactgccctactaaaggcccaataagcagctgagtcagatgcagatatttatacccagtcaagtgacaaacgctgctgacccctgtggttgaattagggaaaacctggaagaagctaaggagaagggataccctataggaagaccaggagtctcaactaacctagaccccagagattgctctgatactgagccaccaactgggcagcatacaccagctgatatgaggccctcaacacatatacagcagaggactgctgggtcttgactcagcgagagaagatgcacctaaccctagagatacttgaggccccaggatgtggggaggtctggtggagtgggtctggaaatttgggggtttgaggacattcttttggagacgggtggggtgggggtgggggggaagtatggaatatggaacagtcagagggcagaccaagagggggataaagactggactgtaaaaacagattaaagaataataaaaaaaagaattcatttaccttcccattccccatccccttctcctattattcggtttaataaaaataataacatactggaaaaaaaaaaggccatggagagaaaacttctcaacctgtgggtcgcgaccccattgggagtcacgtaatagatatttacattacaattcttacaatagcaagattacagttacgaagtcgcagttgaaataattttattgtcagagatcaataaaacacgaggttgcaacatcaggaaggttaggaaccactgatcctggaacaggcggaagcacagaggcgctgaggcagcaccctctgtgggccggggacagccagccaccgtccggaccagaggacaggtgcccgccc

SEQ ID NO: 3635 - DNA, 1000 bp, mus musculus
tcacttaacaccccaatatcagtctccctctcttcccagtatccccttacacagatccttgcctcattcctctctccccttctcctttgaaaaggggaaaccctacctctaggtgtcatatccttacccccacaagcccccatttatattaagtcactgcaggactgagggcatcctctcttactgaagccacacaagatggcccagttaggagaataagccggcaggcaacagcttcaggaacatcccctgttccttttgttggggaacccacatgaagaccaagcttttcatctgttacatatgtgcaggggggtcttgagccagccaatgctcactatttggttggtggtttagtctctgggacccctaggtccaggttagttaactttgttggtcttcctatagagttgcagtcatctttgggtccttcaatccttccaccaactcttgttgggagacttttaacacctgtttctatttcctttaaggttatatggctatttaaattgtttatgtgatcttgatttaattctggtaagatgaatctatcaagaaaatagtacctttaaataaattttccaattttatggagtacaaacttttgaagtaaggctaaatgattctttggattttctcaatgtctgctgttttgttcacttttcatttatgattttttttttggttattctctctctaccttgtttgtttggtgtggtggtttgaatatggttggctcagggagtggtactattaggaactctggccttgttagaggaagtgtgtcattgtggagatgggctttgggaccatcctactagctgcctgagagattcagtcttcccctggatgcagttggatcaagatgtagaactctcaactcctccagtgccatgcctgcctgaacactgacatgcttcctgccatgatgattatggactgaacctcagaatcagtaggccagccacaattacatcctgtcctttataagagtggcctt

SEQ ID NO: 3636 - DNA, 1200 bp, mus musculus
atctttaaagcattggaaaaacaatttaagtgatatcaaaatttttaatatttatgtctctaatgtatcttccagtcaacaggttgagcaacagatgttatttgtcatttgaatggaaaaataaagaaaggcaggtttttatttcataagactactcatctttacaaatgtcttctaaatgccatgccctgtctcttcaatatttttctatgtattttgtgctatggagggttaaactttgtgtatttaaagagaagaagattcataatggaaaaccgcacagtacccacagaattcattttattgggactgtcagatgaccctgggcttcagattgtgatctttctctttttaattctcatgtacatactaagcatcactggaaacttgaccatcatcaccctcaccttggtagaccctcatctacaaacccccatgtatttcttcctcaggaacttctctgttttagaaataacctttacaactgtctgtatccctagattcctaagcacaattgttaccagggacaaaactatttcctacaatagttgcacagctcaattgtttttcttcatcttcttgggcatcactgaattttaccttctaacggctatgtcttatgatcgctatgtggccatctgcaaaccactgcactacacaaccatcatgaacagaagagtctgcatattgctggtcttttctgcctggctggcagggttcctaaacatcttcccacctgtcattctctttcttcagttagattactgcggctccaatgtcatcgatcacttcgcctgtgactacttccccctcctgcagttatcctgctcagacacatggctcctggaaattattgggttttattctgcaatagtgatactgctcttcactttagcactgatcattctttcctacatgttcattgtcaagacaatcttgaaacttccatctgtcagtcagaggaaaaaggctttctctacatgctcctcccacatgattgtcatttctatctcatatggtagctgtatattcatgtatgctaacccttctgccaaagaaaaagcatcactgaccaaaggagtagctattctcaatacttctgtggctcctatgatgaatccatttatctacactctgaggaatcaacaagtgaagcaagcctttaaggacgccatccaaaaagtagtgcttttctctggc

SEQ ID NO: 3637 - DNA, 1200 bp, mus musculus
tagtcaattttcaggtaagcatactgggtacagcacacatagatgctgtctaacccagagccctcctaaatgcagccttacttgtaggtacaaccctttataaaacattgtgtagaggtcacggactcctatggatgattagggacaaggattgcaggcattgaagaggatagatactccacaggaagaccaacaaagtcaactatcctggactcttgagaatcgcagagactgaaccaccaatcaaataacatacacatatatgcagcagctgtacagcttggtcttcatgtacgtttggaaaaacttgtgtgggggctatccccaaagctgttgcctatctgtgggatatgttcttctatctgccctgccttgtctggtctcagaggaagagttaatttgagttattttggtatccaaccacttttctgaaggtgattgttgtggattgctgtttgtattttctactccctcaagaggggtgccctgcggaggagtagatcacatactcaggtgatgtcagatgaaatcttaattagtcaaataaattctagagcctatgattgggtaatggcaggaaaaggtggagctgaaaaaattgtctgcaagcagctagggatttcatagctgggcagtagtgtagtgtagggtatattttcccaatctaggtgtgcagttaactgaattgtgcattctttgcaaggacattttggggttggatatttaccgttataaatctggctgttataagtttctagtgttttcatttcaccgggttaaagggggctgggtgatctgtagctggcattctgcaagtcagccacagtgggtagatggcctgagaaatgctagcggtagctccaggcatttccagttaaaaactggtttggttagcttaggaagctagactgcagcatagacctagctatggggtgggcaataccaccaatgctggcacatagtaggatttagtgtgggtttttaaaaacaacatgctacatgtgattaacagctgtaggacttctctggtagaattttttgagtcacctataaatacaatcatatcatctgaaaatagtgatactttgacttcttctttctagtttgtgttcccttgatctcctgtaattatcttatttgtctggctagaacttcaactactatattgcatagttagtaaaggagtgggcatcttcaact

SEQ ID NO: 3638 - DNA, 1000 bp, mus musculus
gaggccttccatggatatcaggccaccttggcatataaggttgcaataggattaggctcatctcctattgtggctagacatgacagcccagttagaagaaagggatccaaatttgggcaacagtcagatacgggtcctgctgttagtcgttccatatgaagatgcagcttcacaactgataaacatgtgccaagggtctatatttgtcccatgcatgctctctggttggtggttcagtctttgtgggcccttatcagggtaggttagttgattctatatgatttatagcagtgtccttgacctcttcgactccttcaatccttcatcctcctcttccacaagattccctgaggtctgcctaatgtttagctgtgggtctctgaatttgttttcatcagtttctgagtggagcgtctcaggtgacagctatgatatgtacctttctggaagtatagcagaatatctttaatagtgtcaggggtaggtgttctctcatggcatgggtctcaagacagcccagtcattgattagccatccctccagcttttgctccatctttactcttgaatagcttgttggcaagataaattgtctaaggctttgtggctgggttggtttacccattgctctctggaagtcttttctggttctaggagatggccgtttcagactccacattccccattgctaggaattgtagctagagtgaccctcatagattcctggtagtttccatttcctagcttatcccagagatgcacctccaccaactcatgtttttgttcatgtattctctccttcctagacttgatccttcctcctcccctctcacatgatccctcactaccctccctctcttttccctttttagtgatatctaagcatcacccattgggatctccttgtttatttagcttctattgatctatggatggtagcatagttattctgtagtttatggctaatatcacttataagtgtgtaaataccatgtatgcac

SEQ ID NO: 3639 - DNA, 3200 bp, mus musculus
catcaaatatgagctattatgtgatacaaagatatgttcagacatcagcttcttcactaacctacagtaatacaggaatgacactcaagttagcttgtcttgagattggcacctgactcaactctgagattttataaaacctttcttatttttcaaccagattggacaagagacaataaccaagaatgaaaaaccgaacagtaacaactttcattttgctgggtctgacagatgacattaggctgcaaactctactttttatctttctgcttttttcttacatgttgagtttatctggtaacctaaccatcatcaccctcactctgattgacccccatcttaaaacacctatgtatattttcctcaaaaatttctccttcttagaaatttcacttacaactgcttgtattcccagatttctatacagcctatcatctggggataagtccattgcctatgctgcttgtatcagtcaactgttgtttatagacatctttgcagttacagaattttttctcttggctatcatgtcctatgatcgctatgtggccatctgtaaacctctgcattacatgaccatcatgaatagcagagtctgcaagaacttcatcttcttctgttgggtagcagcactgatcatcgttctcccaccaattagcctaggtttgggcctggaattctgtgactcagatattgttgaccatttttgttgtgatgcagctcctctcctgaaaatctcttgttcagacacatggttgatagaacagatggtgatagctggtgcggtgttgacattcatcatcacctttgtgtgtgttgtcctttcttatggttatatcatcaagaccattctgagatttccctctgccaagcaaaggaaaaaggccttttccacctgttcttcccacatgattgttgtttccattacttatggtagctgcatcttcatttatgtcaaaccttcatccaaggataatgtagctatcaataaagggatttcacttattattgtatcaatttcaccaatgttgaatccctttatttatgcactgagaaacaagcaagtaaagcaagctttcaattactcaattaaaaaagttgcatttctctcaaagatgtaaaaaacaaatgaagaattctaaacaaagtagggtgaatgattggaaaatctgaagctttgttatagtattattcaatatctttgttttttaatcttcttatgcttacactttctcctttaacttgtatactatgagcatgactttgtctatctctattaaaaccaaactttttgaatatgtttagtcttgcagtcaacctgaaattgttgtctgactgttattcctgagaataaagtagattgtggttttataccatgtttcccacactttcatgtgtgtctttttattttacattgtaactaatcaaatgagcacagaagttatatgtacatataaaaatattcattatccatttgccaccaagaaaacagatggcaaggtaaaactggaagggaaaaaattagaaactcaagcaagatactcagaagcaaatctgacctcagaatacaggagatggaaaagagaatcttaggaatagacagaatgatcggataccttggttggagaaaatgtgaaatcatgtaaaacgaaaaatccaggcctaaacttccaagaaatctgggaatctctgaagagaccaaatctcacaataataggaatagaagaagtagaaaaaaaacaatcaaagacacagaaaatattttcaacaaaataatagaataaacttactgacctctcagggtacaaggaacatacagaataccaaataccccggacaagaaaagtaattcctcacagcaccaaataatgaaaacctaaagcatcaagaacaacaagagaatattaaaagctgcaagggataaaaaagaccaaataacatgaaagcagacctattagaataaatctgaatattaatggatactctaaaagccagaagggctaaatagatattctagaaaccctaaaatataacagataccagccaagattactacaccagacaaaactttcaatcacaatagatgaagagagaaatgcattgtatttgataaagccaaactcaagcagtatgtgtccagtcctagagaaggcacttcaacttcaagaggttaaccattctcatgtaaacacaagggacaaaaattccaaaccagagacatgggcactatcccatctccttcaaatctgcacctccacctgtggttgatcaccacacctgcatccctcccacactccacagcacctgtctcccaggaggtctgccataaccagggacatagttgagacaccagccccaatacctaggacagatggaacccccacagagactagcatatgtgaattctattctactctgtctgagtcccactatccttctagtctgcaccttcctctgcaactggggcagatattgcccctggagccaaagcctgactgtctccaggagtttttccctaaccaagaacacaaatggtctgctgtaaccagggacaaacaaaacaaaacaaaacaaaacaaaaacaaaaacaaaaacaaaaaacccaaaacaacaacaacaaaaacaggctctaaccaggcacacaagagactcctccaaaatgagacagcactgcctacctcccaggaggcctgctctaaccaaggtcacagagccccccctgcatccaaggaggctagttccagttggagacacccaggccagttaacaccagagataactagatggtaagaggcaagctcaagaacataacaacagaagccaatacaattcagcaccaaccgaacccagttctcctaccacagccagccttggataccttaacatgcctgaaaagcaagattctgacctaaaattcaatttcatgaagatgatagaggtctttaaggaagatataagtagcccccttaaagaaatacaaggaaacaggcaaacatgtagaatcccttaaagaggaaacaaatgaatcccttagagaaatacaggaaaatataatcaagcaggtgaaggaattgaataaacagttcaagacctaaaaatggaaatagaaacaatgaaatcataaatggaggcaaccctggagatggacaacctagtaaagagatcatgagctacagatgcaagtatcaaaaacaaaacaa

SEQ ID NO: 3640 - DNA, 1000 bp, mus musculus
ggaagaggaacataagggtatgggcactatgaaggtgggcagaactggagacttgagggtagtgatgagcaccttgatgtgagtatccagttatgccacctgggaccatggtggggtcctggcctgtgctgccacatctgggtccctggccctgaagcaatagggatctgttaccaccaaatgccaggcagatgtccctgacctgggctgccatctagggacatgttgatgtctgtgggctatgtgtaactggccacaaccctcacctgggcagcatgggagagctggtcctgcccctagccagctgcggtactcaggagagcccctgggagcacactgcaggagttgcagatgagccaacccctgaagatatgagtgtgggagagctggtcctaccactcatctgggcagtgatgtagatgagggagagatacctcctgcctctcttgcccattgccacctatgggttatctgagtgggagagctaaccctgcccctcacctgctgcaacacttggggaaaggtcccctgcacctcacctgggaagcacagtgcatttggtccttgatgtgggggttgtgggtgagccagcctgtgtgcatgagaatgagagagctggccctgcctcttgtctgctatgtggtggcatcagtgagtgagagattcccctcccctccctttttgtcatcaccaccaaagtctggcgaagagttggcttaaatgagtcatgagagtaggagagcattccctgaacttatctaggcaacacaatagaactgatcctgatggctgcattttgtgtaagctggccagagagtgtgagtgtgtgagagccggtcctgccttttgtatgctggatagtggcattcctctgccccatcctttgccatttatagcaggcaggagagctggtcccaggagcataaaaatgggagaacgggccatgtccctcactgtctgtaatgcttgggaaagtgggcactgccccttgtttgggcag

SEQ ID NO: 3641 - DNA, 1400 bp, mus musculus
tgaaatgtgaaatacccaaacacaaagaaccagtgccaagaggcacttagtaaaattaatattgaccactatggtgatttatactacttctcaacttactatgatctagaatcatcttggatacaaatctttgagcattgtttgagattgtccagattaggttaactgagttgagatgatacattttaaatatgggtggcaccatttaaggagctggagtcacagactgtataaagaggagaaactagtgaaaaccacattcattgctctttgtttatttttaaaatattattatttttttattaggtattttgttcatttacatttccaatgctataccaaaagtctcccataccctcccccctcccctccccacccactcccacttcttggccctgtgttcccctgtactgaggcatataaagttagcaagaccagtggacctctctttccactgatggccgactaggccatcgtctgatacatatgcagctgaagacatgagctccagggggtactggttagttcatattgttgttccacctataggcttgcagatccctttaggtcctggggatccatcccataatcagcctccaaatgctgacaccattgcatacactagcaagattttgctgaaaggaccctgatatagctgtcatttgtgaggctatgcaggggcctagaaaacacagaagtggaggctcacagtcagctatgggatggatcacagggcccccaatggaggagctagagaaagtacccaaggagctctttgttttctgataaaatatgcaaggtgagcactggcctcagcttccccactttatgctttccttgttgctgtgaactaaatcctataagctgaaataaactctttacttgagttgctttttaaaatattttaatttaattaatttattttacttattcacttacatccagctcactgtccccttcctggtaaccccctcctacaatccttcctccctcccctctcacctctctccttctcctcatagagagttgtgagtcatctgacataggtgttgggaacagaaatctggtccttgctacaaatccatgataaataaagagattgtaagagcatgacacatctagtctggggaagatcacctcttgaaatgaaacacagcagcaaacttgccagcactaattcagtgactttatattttgacatagaacttcattgtcaaataaataaaatgtgagattaggaagatgtagctcagaaagtaactgagaactaatacaacgtttatcacacttcatttaatgtgaaatcgagtataaaagactatagctggctggtgctaaacaaataggtcaaacaactatcaagtttttaaatcaccactgaaaacagtatacactatttt

SEQ ID NO: 3642 - DNA, 1000 bp, mus musculus
aaaaccaaccaggtagcatacaccagctgatatgaggccccgaacacatatacagcagaggactaccgggtctgggttcagtcagagaagatgcacctaaccctcaagagactggaggccccatgcagtttagaggtttggtggggtagggggtgggtggtggagacatccttgtggagacaggggggcagggagtaggtatggaatgtggaacagtcagagggtggattgggaggtgaataaaatctggagtgtaaaaaaatatacaaatgaataagtaaataaataaataaaagattaagttaaaagtaaataaataaacttctaaagaggaaatagtggctttcatgtcttagcagtaaccaacagttctgtaattggacttaaagcctactcaacaggaagcaagtctactcaatgcctggtactataaacctagtcaattacccaggaatggtgaagtcattgatcttagaggagaatctactacagccactttactagacttgcctgattaccaactgcatgcaaatgttatcctatacacactgataagggtagctttcatccatcatcagagaaacatcttttattttttaagatttttatttattttatatatatgagtacactgtcgctgtcttcagacacaccggaagagggcatcagatctcattacagttggttgagagccaccatgtggttgctgggaaatgaactcaggacctctggaagagcagtcagtgttcttaacctctgatccatctcttcagtccctcaaagaaacaaacttctatgtgtcatggattaagaccatcacagaaaactaccagtggtcacaatagagtacaactgatcatgcagtatcctgccactgatggatacatagacaagacaacccttaaaggtaaggctcaggggatttcccagaatagggacaaacacatttctgcaagatccagagagcaggaagcttacttgtgtcttagagaaattacag

SEQ ID NO: 3643 - DNA, 1400 bp, mus musculus
taggagctgatttccaaaggactttttgtaaactgtatgttttgtaaatgtctaaaactttcatgtatttaagacatccacaaatctgatatcctacaaaactgataactgacacttaaaagtaaaacatcctcacagtagatttaatctatagttttattaaataattagtataagtcttatcaacattatatatattatatcaaaggaaaagatcaaatcctgtgttgttagctcacatattttcatactagaaagacaaactgtgggtttactgactgatatatctagtcatggtttcagcaaaattgtgtctcattttaatatcttgattaaagtttcattattactttataaaattactaaattatttccaagtaaatttaaggataaccaaaatttgggaaattcaaaatattctacattgacttttcatgtcttagcagtaaccaacagttctgtaattggacttaaagtctactcagcagcaagggagtctacttaatgcttggtactgaaaacctagtcaattacccaggaatggtgaggtcatggatcttagaggagaatctactacagccacttgactagacttgcctgattaccaacggcattaaatgttatccttattcccacaggtaagtgtagatttcacccatcatcacagaaaatatttgcagtggattgaggccaccactggtcaaaatagagtacaactgtgcttgcagtgtatagcccccaatagatacctagacaagacaaaccttacaggtaaggctctagggatttagtagaatagagacaaaaacattttaagatccagagaccaggaagcttatttgtgtcttgtagaaattacagggaagctacatcaaaaatagagtattgaagaaagatttaattcatcacctcattctttgatcttgtcttcatttgacacttatctttttactaatatatccatcttctttctcagcaaaacaatttagcatttctgtaatcaaatgtgggtatcccgttattttcaaacataggaaaaagatatttgtttttcaacaactgaatttggcaattggaaattatcaataagttatgcttgttcaaaatacattgatcataatcaacatttccagaggacttttttttctgttttaatcatatactaaaacatgtatattggatgctcttgtaaaaagtgacttctaacttttcgtgtttgaatgacttttaacatgactaggttttcacacattagccaacagggggactataattttctccacaattttccagtgtggtttcaagttcaaaacctagaaattaaaatataagtacctgaatcagacttcataacttctattttatgaatacaacattggtgagaaattataactgtttta

SEQ ID NO: 3644 - DNA, 1000 bp, mus musculus
aaagcactttttacctctgtattccttaagctataaatcagaggattcagcattgggatgataagtgtgtagaacacagctacaatcttgcttttctctggggaggagatggacccaggctgagcatacatgaagaacactgttccatagaataaactcaccactgctatatgagagccacatgtagagaaggttttactcctaccatgggtggaggggatcttcaggacagtggaaaggatgtaggcataggaaaccagaatgatagtgatggtggagatgatgatgagagcagagagaataaacaacacaatctcattcacaaaagtgtcaacacatgagatcttgatcagagctgggacatcacagaaaaagtggtccagcctgttttctccacagaaacgcaagctgaaggtgaatcctgtttgtatcatggagttgatgcatccacagatataggagccagccaccaaacgaatacaagctggctgagacatatggactgtgtacaggaaaggcgagcaaatggctgagaagcggtcataagccatcacagccaaaagaaaaccttctgttccaacgaaaagagcaaagaaaaagaactgtgttgcacattcattatatgaaattttcttttccttggagaaaatagtagctagagttttgggtgcaatgactgtggaatagcagagatctaaaaaggataaattttggagaaagaaatacattggtgtatgaagtctggagtctattttaatgacagttagcatgctgaggtttcccaataaaatgaccagatagataaacaagaacagtaagaataagggaacctgtgcttctggagacgtccagaatcccagcaggataaagtctgtcagctcagtatagttcctgctctgctccagtttcataactgagacctatctgaaaaaaatagatcacagagcagtgttgtcaacttgtggctcctattcagggaagacatctaatgtaaattaac

SEQ ID NO: 3645 - DNA, 1000 bp, mus musculus
ctatccacctagccacccccactctcctcatgtcctgcctcccacccccaccatgagggcacaccttttcctactgaggccaggcaaagtggcccagttaggggaacaagattcaaaggcatgtaacagatttggggacagcccccattccaggtgttagggaatctgcatgaagaccaaactgcacatctgctccataatggagaggagggctacgtccagcctgtgcatgctttttggttggtggatcagtctctgggagctgccaagggtccaggttagctgacttagttggtcttcctgtgaagtcctgtcctctttgggtccctcaatccttctcccaactcttccataagactcctaaaggtccatctaatgtttggctgtggatctctgcatctctttccattggctggtgggtggagcctctcagaggacagttatgctaggctcctatatggaagcataacagagtatcattaatagtgtcagggattagtgcttacccatgagatgggtcttaatttgggccagccatctgttggatcatttcctctgtctctgctctgtctttgttcctgtacattttgtaagcaggacacattttgagtcaaagtgttattagctataaagtacaggatagccatactataatacacagacccaaagaagccaagtaacaaggagggaacaaaggaggatgcttgaacctttctcagaagggaaaataaaatagctatcagagatggatggaaggagggaaatgagtgggagatggagtggagggggttcaggtgtagagagaacaggggagagagaaaacaaattgggagggcatctctaggatatttcagagacatgggtcaaaaggagacccaagactgtctatgggggtgactctaactaatactcttggcagtgggggatgtggatcctgaagtggccacttcctatagccagaaaggactcccaataaagaggcactgcattttataaactg

SEQ ID NO: 3646 - DNA, 1000 bp, mus musculus
attttctttatttacatttcaaatgttatcctctttcccagtcccccccccaaaaaaaaatcccctatcccatccctcttcccctgcttctgtgaggaatgttcccccacccactcacccactcccacctccccatcctggcattcccttacactggggcatcgaacctttacaggaccaagggcctctccttccattgatgcctgacaaggctatcctctgctacatattcggcaggagccatggatccctccatgtgtacttttttgttggtggtttagttcctgggtgctctgggaggtctggttggttgatattgctgttcttcatgtggggttgcaaaccttttcagcttcttcagtcctttctctaactcctccattgaggatgtcatgctcagttcaatggttggctgcaatcatctgtctctgtacttgctctctctcaaaggatgccattctttgtcgctaccatctccgaccagcagaaaagaagcgatgaaaccgatgtccttctcaaggcagtttattcaggaacttcataaatgtgtaggaaaaagcaaatgccccgacctctccagtccactccccctcaccccagtccacgtaggcacagttcattggctcaggactacattcggcacatcatccgatcttacatcatggtgcatctgcgcaatgcagctcaaggtacgtggctatcttgagggatatgaggaagtcaggtgccagtcataagacttggcagcagtcccaggtgccatcttggggccgcggccacacctgctcctcacaattcttcatagttaaccctaaaggaataaagtgagttaaactctatgtacggtctgccttcttgaggacatactattcacatggcttactcagattcttctctataggatatttgactatttgttaccatttatttatttaaaggtgtggttaatcatttatttatataagtacaatcacagatttggattctacaatgtaaatca

SEQ ID NO: 3647 - DNA, 1400 bp, mus musculus
tgctttttcaatacaaagaaataaaaagtattttaggttaatatgtcagttccacagatctaatcattttgcattgcataagtgcattgaactaagacattgcaactattaaaaatacataaaattattatgtgtcagtaaaagtatttaaagtgtaatccaaaaacatgtaggtcctaaagtcagactcccattgtgaaatttcagtactgaaagacatcagtcatgtggcccaatagaggaatgttgtgcctcgtgcctcagatttccacatgaaacatgaaaacctgttattgcagatataatacttcagtaaggattatattgtgttatatacgcaaacaagtttttttgtttttttttttgtttgtttgtttgttttttgttttttttttttagttttttgagacagggtttctctgtgtatccctggctgtcctggaattcactctgtagaccaggctggcctcgaactcagaaattgcctgcctctgcctcccaagtgctgggattcaaagcatacaccaccatgcccagcaagatcatttttaaaatgacaaccattcaattagtactagcttttaggataattatttatccaagtagcaatctaagggcataggcaaatgttccagattccatctagccttttctacatttatatcatccagtgtcctacagagagcatcatttcacattcataacatcctcttattaccaccttatgcatctccctctttgctcaatttccttatgctatgcaatggaatctcccatcctgagagcctatgcctgcctccctcccatttcctttcctgatgccctctttcccagggaatccaggctcctagggacagctgcagctgctccatctgcctgcagctgctgctcagaagcaggaaaacatgtcagcagtgctccctcccagggctgattttctttctcatttatccttgaaaatcttgttggactgtgccaactgcaggcacaatttcatctgccctctgtctgtccctgatgcttctgctcagggaccttttgtattcaggctccagctgagtcacacactctagactgtaacccagtgattccttctgatggctttcgtgagtattcaaaaccatggatgcccctatgggtcacctttactctttggtctgattctacattagtctgtttcaccattccagtgtagaagatatctcgctcttctaggtgaaactgtagatggtgatgaaggcaatgatgactacaaattattaaaggagagagtgccaggccttatactacataacatgtcaactatgcttattattataaaaaaaatcactaaatcttattgtaattatttttcagatgaagactttgatgtttagaaaattttgaaatttgtccaatgt

SEQ ID NO: 3648 - DNA, 1000 bp, mus musculus
gacaactcccctgcatcttacatcttccacccagaaaatgcagtgcctgtgcagtcctggtttgatgacatggcagatacagagttgctgaacctgattccagtcttcgaggagctaagtggaactgatgatgtctacaccagccttgggcagctgcgggccccttagccttcctgctccaagaaacggccatcccaacaggggactctgctacactgtgcctttgtggtcagcctcactgacagggtctgcaagtagccagggcgtgtgggacaaaagcaggtcacacgcagagcaggaaatcagaccaagacccagagctctctgcaccccgtgctcagttcccaggtggttgtgtgggtgtgtgtgcgtgcatgtgcccgtccggtaaactatggtcctgggtgcccagttgtgcagtagggggagaagctgaaagataaggactcaacccaagtcatttgtcttctttcctgctatgctgtgagctactgagctttacagccatgaaaactattgtaggctccctcgccaaaccatggctttccctcagcatcaagacctgtgccaaggagaagggagaggccggaggctgctttggatgcccagacacacatctttcagaaaacacagaaacctagccagcagctgcagacatgtttgggaatatgagagcatgttcgcagacccaccaggttctgtgtcctatgggctacacctggctccagcaagaatgcctgccatgggcacttctctgtacccgggctccagtgccaggccagcctctcactcccaagccatagtcctactcccatgggaaaggaggtcttctctctgccctggaggaggacatatagctgatttctgttcttttaactcttaaaaatctctttctaaacttggagtggtttatattcgcccgagctccagtcctgggcctgaggtttgtgtgggaagcgctggggtacaaagaaaatgcaaatgttcaaaaaaaaaaaaa

SEQ ID NO: 3649 - DNA, 1200 bp, mus musculus
tgttttgttttttcgagactgggtttctctgtgtacaccaggctggcctcaaactcagatgtccgcctgcctctgcctcccaagtgctgggctgaaaggcgtgggtcaccaccgcccagctgtgtttttttttttttttttctgattggcgagcacagctgagtgggcggggccggtgattgacaggcagattgaggtcgtggctacataaccatgtcatccccctgcctcagctccttccttactcaagggaatccccctgccttagggtgaccaaagctgagtgatagggctggcccaagtacaagggcttctgctctggcaacaccctggcaggtgacctgaacaggaggtctaaacagctgtttggtgcctgtctatttgcaatagctgtggtcctctaacctgtgcctgtgagccaccaagagtgaacggaaactagaagcattgccaccaacaactggagcagtgaccacactgaagtttctctgtcgagggggaaggggagtaaggagaaaaaaaaaaaaaaaaggcaagtaagcaagcaagccagcaagcacaggagcacactctcgtggaggcccacaccctccctgtgcctacccaagatgtgtcagtcagagaagcatccaggaccggagctccaagcagcagcaaaatggtgagatgctgcccatgagacctaaccctcaatgtaccccggcatagtttcaggagggtcagacaccaagtccagtggcctcaggggcagggggagtgactaaaggggcttggagagggagtcctctgtgccctgagtaggagactcacttcaggtacccatggctctggctgggggaatggggtaaggcaggggaagcagtgggcttctatcctgtgtcttggtctttggcaagggcaccgaggccccctttttcctccctagacccctgcttcctctaccagatcctcccccaagctcttctggactggcgtctgcgcttctgcagtgacttgggcagggcagcccacaggagaatgctgatttgtctttgcttggtccctgccacctcctcttgttttttagagacatagtggggtcctgtggaagacaaaggaggagagcaggacagttggtgtgctgtggtcttagcctgtgctgctcaccagttctctgttgcaatccccttttgttctttgctttgctcagtttctaggaga

SEQ ID NO: 3650 - DNA, 1200 bp, mus musculus; identical to SEQ ID NO: 3649

SEQ ID NO: 3651 - DNA, 1000 bp, mus musculus
tgttatagcattaagaaatagactaggagggcatgcacggcgcggacatgctgccccagccctacctagatgccagctgtcccatgctacccactgcgctggtgagtttcaaccgctcccccagcgcacatccaggaactggagccttgccacccgcggcgaccacgggccggggagcagcgtccagcctgcgcaaaaggaaggcatccccggagcctccagactcagctgaaagcgcactgaagctcggtgaggagcagcagaggcagcagtggatggcaaaccagagctaggcgctgaagctcacgatgtctgtggcggggctttgtggcgcccggacacgcagcaggggtgaccgcctccgccccctccacccctgggacctcattccaatcggaccaccccgccggagtcagcccctcagaacggtccgtcccccatggctgccctcatgtcggtagcagacagtttgggcacagctcattcgcccaaggtcggcagtttagtgcactcgaccactacatctgctaggcgaaacagcagcagtccggtgtctcccgcctccgtgccggggcagtgtcgcctggcatctcgcaatggggacctgaatttacaggtggcgcccccgccacctagcgcctacccgggcatagaccaagtacacccccaaaccattccggattccccaatggccaacagcggatccctctgctgtgccatttgccacgaacgtttggaggacacgcatttcgttcagtgtctgtccgttcctagccacaaattttgtttcccttgttctagagagagtatcaaggcccagggggccacaggtgaggtgtaatgccccagcggagagaaatgcccgagagagacccttgaaccgcagggcagcgacctcctttgccctagaccacctcttcttcaatctagagggcccttcccccacctgcctccacctaccctatccaccaagatgtagaattgtgaaaataactgcaaa

SEQ ID NO: 3652 - DNA, 1000 bp, mus musculus
tcaaccaccacggagactgcttattcctacactttagggaggtcatcaagggattctggtctagcgtagttatcacaattgcacttcaagcactgtgctctaataagggcaccatgtaaattggaagcagatgcatcagtctccagtgattttaatactgtggataaagtgaaggctaagataatgccaagggtaatactggactgggagtcagaaggactcacttctaccactgtgtcacctaggaattgctaagtacttaaacaacttctgtcctctcatttcaaaaagtggtgttgactatgttggtcatcggcatacatgtatatgaaagtgctttgaacctgtaaagtgctataaaaagaggagattaccatgtaggttctatcttgatatatcaagaggccttttcaggaatctggttgaagccttgtgagatggttaggtaaagggattcctcagtagaatttcttaaattggtgtgaaaagttttggttcctgagtaacccgaagatgatactatgaggaattcaaaatgccttggttttgatcccaatgggtcagaatatctgctttgtcatttagtagacagctacagattttgaagtaggaaaagaacaagagtccagtggccttgacaggatcctaggcagtttatgaaacttcaatcatttgagattgtggagtagggtccaatgctgttctcagagatgcctttcttcagacagtgttgacaatataaacaaaacaaaatcccctggtccaaatttactatgtgtctctgaagaataaactgcagaaatgaactgtacatttatggaataaacctggcctttgttgtgataaaatagcttcagttatttggcttgaagactcttgactgcactataaagggctgtgctgaatctgggcagagtaggacaggagtggaggtaaaggccacatcatgatggctgaatgcttcttgggtcacagtggtccactggaatggtgtcttctt

SEQ ID NO: 3653 - DNA, 1000 bp, mus musculus; identical to SEQ ID NO: 3652

SEQ ID NO: 3654 - DNA, 1000 bp, mus musculus
tataaaccaggctggcctcaaactcacagagattacctccccatccctcccaagtcctgggtctgaaggcatgcaccaccatacccagctcatcctgcttttctgagcaagttatcttctccttgaaggcctctgagcccatgcctgtggttcatgttcctggcctggcacaattctgggggttcactaatcattcaggttgctgttgctcaggtatgtaggttggtagaaatgtggcttgtttggtagttggttaactcattgcttggctgacagtttgtctgagtagctaagtaactggggatgggttgaaggattgactcggatggctgactggcttttagcttggttggttgtctggctagcatcttgatgactggcatgttggctggctggctggtttgttctgcagctggatttgcatggccagctggttatttggagattgactctgtctgaatggtttgtagctggatagagaactggatcagctacttggttggtggctgattaattttctgtctggccaacttgttaagtttggtgaatcagtaaattgtttgttagcaggctacctagtttgttggcacttggctggatgttggtagactggttagcttattgattgtctgatgaggaggctgatgacgggctcacttgtgcagtgggtaggtgactgatagatggctagttagttggctttcttgggtgtgggtctgagctgaccaggttcattatgacttctgtatcactggctctgtccattgtggaaatgtggcccagtggcttgatctctccctgtatctttcagccacgaaactgttcccggtgggctacaatctcatgaagccattcctgagtgaggacacacgaaggaagatcgtggtgttgggaagtagtaagtccttccagagccctgcccccaggcttcacaccgaggctgtagagtaaggctggtccatccccatgcttcacacctaagttgtagagtaaggctggt

SEQ ID NO: 3655 - DNA, 1600 bp, mus musculus
agcaacagacacagaagccctgaaattggcaagatagacgtcagtgttagcagaactagcttcactgatttaaaaaaatagaggtgcacaatgctttggccactccttgaacctgtgtgtctgccaatgttctgaccaggtgtgtgcccattgctgcaccttcattagactctttccttgtacccctcccatacccatttcttgaaaatagacattgtttagatctaataagtcccacctcagtttcaggttccccgaataactgggaaataccccaagccttgtttgaactaaccaaccagctcgcttctcgcttctgtaaccgcgctttttgctccccagccctataaaaagggtaaacaccccacactcggcgcgccagtcctccgatagactgagtcgcccgggtacccgtattcccaataaagcctcttgctgtttgcatccgaatcgtggactcgctgatccttgggagggtctcctcagattgattgactgcccacctcgggggtctttcacagtgagcccactgcactgtagatacagtcaatgccatagaactctgtgtctacacaggaatatgtcacgtatttctttatcataattttgaaaggcagtatgtccttcactttctctttctgtctttgcctctatttctctgttttgtctctgcatattatgtttggaagtgtctcctaaaggcccacctgtcaaaggctctatcccagcgcctggcactatggcgagatggattatttaaggggtgagacctggtgaaagggagttgggtcagtggagacccccatcctctcgtcctctgcccccccccccagctgcatgtgtgaggtgaacaagtctcctccaaaacttgctcctaccaaaggcccaagcaaccaggccaggaaatcatggactttgtccatgcgggtatgcatgttcacacatgtgggtgtacatgtatgtgtgtgggtgcatgtggaggtcagaggttgacactgggtgtcttcctcaattactctcagccttactcatgagttctcacttgaacccagaatgcactgcttcagccaaccagcttgctctggcatggcctgcccctcctcctgagcactgggctcgtaggctgacaccgtgcctgcttgtcatgcctgcctttacatgggtgctggggatctgagcctcagtctcctgtgagagacatgcactttgcccactgagccacctctgcagtccctggactgacacctctgtagcagtgagctaagacatatttctccttacttgattaactcacagcaatggacactaacactctctgtgtctctgtctctgtcgtctctctgtctctctctctctctctgtgtgtgtgtgtgtgtgtgtgtgtgtgtgtgtgtgtgtatgtgatcactggcttcggaggaccctattgccatttacaacgatgcttacatggctctggggaaaaacttaaggagtggaactgagatcatagaaggagccatcttggaaatgaatcccaagtcaagccctggatagacacagcccagactgtagtcaccattgccctaggcaaggtcaggatgccctaggcaaggtcagg

SEQ ID NO: 3656 - DNA, 1000 bp, mus musculus
tcctgtagagacctcagggaagggtcactgttctgggagcatttaggcatggctccgccctcataccccgccccaccgcgcaaggcagaggcagagggccagcgacagacgtctattctctgctcctattggctccgggcacacgcgccacacacgctggttggccgcctggccgttgccctggagacgcgtgctactgtgtttccgcgtctctctaagagtttggagtcggtcttggagccagccctcttggtacgaagttcagctacagggggtgtaaatcccagatccggagagcagggagtcttacagtgacctagatgcctgccaaaccctgcggcccgtgatgacctatagcacacttaatatgcttctgttgtctaccctgcgtgcacgtgcccttgctgtttaccccgcttaacgtgcccggtgctgtctacccgcttgccggatcccctatggtgtactcactgaatgtgctctggctgtatattctgtcgcatgtgcccctgctgggtatccagcgtggacacggtgctgtcctgtgaccgcagtggacctgccagctcctgggcgtgaggcgtctgcaggtgtgtcagctggaagcgggtggaaccacaagcgcagtgactttgcccctgcagcctctgctcccatcaggcggattggcagcgcccagataaccagagaacccgggcttagcagcacatttctcttcccgacgcggacttgctcatagcaccaagccatgaggaacaccagcaaggaagtgcagagcacctcttaccgctatgctccctgcggtgagtgaggatgggtgagagtggtggggtggtaaaagttggaagggtaggtgcctctgcttttgatgtgtccgtgctgggcttgaagccagggcctttgcatgcaaggctacagaaggtaggagcccattgaaattcgttttgtagcaagttaagtctcctaactcccacatcttgcttggcagtggctgtagcct

SEQ ID NO: 3657 - DNA, 1000 bp, mus musculus; identical to SEQ ID NO: 3656

SEQ ID NO: 3658 - DNA, 1600 bp, mus musculus
tttggagctgagacgaaaggatggaccatgtagagactgccatatccagggatccaccccataatcagcttccaaacgctgacaccattgcatacactagcaagattttatcgaaaggacccagatgtagctgtctcttgtgagagtatgccggggcctagcaaaaacagaagtggatgctcacagtcagctaatggatggatcacagggctcccaatggaggagctagagaaagtacccaaggagctaaagggatctgcaaccctataggtataacaacattatgaactaaccagtaccccggagctcttgactctagctgcatatgtatcaaaagatggcctagtcggccatcattggaaagagaggcccattggacttgcaaactttatatgccccagtacaggggaacgccaggccaaaaaggggagtgggtgggtaggggagtgggggggagtgggtatgggggacttttggtatagcattggaaatgtaaatgagctaaatacctaataaaaaatggaaaaaaaagagagagattgaagaaattatccaagttcagtagcatgccctgtgggtgcagtgctgggaaagcagagacaagtgtctcttacatccatttagccattcctaattgggaagcctcaagacttcatctcaaaaatcaagttgggccttatttataatagccagaagctggaaagaaccagatgttcctcaacagaggaatggatacagaaaatgtgatacatttacaaaatggagtcttacatgtgtttgcgcgaccggccaggaagaacacaacaaaccggaatcttctgcggcaaggctttattgcttatatcttcaggagccagagagcaagagcaagaaagcaagagagcaagagagcaagagagcaagagagcaagagagagcaagagagagcaagagagagaatggtgaaaccccgtcccttttaaggagaattatcctccgcctaggacgtgtcactccctgattggctgcagcccattggccgagttgtcgtcacggggaaggcagagcacatggggtggagaactacccttggcacatgtgcagattatttgtttaccacttagaacacaggatgtcagcgccatcttgtaacggcgaatgtgagggcggcttcccacatatcccccttttcttttaataagagcaataggccacccatattaatgagagtggagatagaggtcaaatccccagtgtgcaggtaaaggagccgtacacataacctccttccaggctcatcacccagaggggtcctggtctggtcccgtgtcgtttttcctggggagaaggacacttggacactcaaccttcttgaaagatgacatgtctccctagaataggctcatatatgccgcagagcccttctactgcagtgcttagccgtgcaactctctcgggctgctgaagcacactcactctatcccgtgcaatgagactagcctcgtggggtgcaagagctgaatggccagcgacctattgcttaagcatagatatatcaggggaagcaccatgttctagagctgcaagtgcctgggcaataaccaccttgtctctcctagtt

SEQ ID NO: 3659 - DNA, 1400 bp, mus musculus
tacctattatccttaggtttggtcttctcattgtgtcctggatttcctggatgttttagattagggtcttttggccttttgcattttctttgattgttatgtcaatgttttctatggtatcttctgcacctgatattctctcttctatctcttgtattctgttggtgatgctttcatctatggctcctgacttcttttctagggtttctatttctagaattgtctccctttgagatttctttactgtttctacttccatttttaaatcctggatggttttgttcaattttttcacctgtttggatgtggatgtgttttcctagaattctgctctcctgaattcctttaatggatttatttatgtccttcttataatcctccatcatcatcacaagaagtgactttggatccatatcttgcttttatggtgtgatggtgtatccaggacttgctatggtgggaaagctgggttctgatgatgccaagtaaccttggtttctgttccttctgttcttatgcttgtttcctgccatctgattatctcacgtgctccctgccctcgatatatttgattggagcctgcccttcctgtaattcccggttgagtcagaactcctcagagtctagctgttttctgtgatcctgtgattctgagatcctgtgatcctgagattctgggtgtgtcagagttcttgtcagtcaagattcctctgagacctggagatcccgatgtgaccaagctccttgtgatcctgggatcctggaatcctaagatcctaggcatgttagagagccttgaagtagtacctcttctgggaaacatagggctgtctgctgagtttgaaaccaaggtagaccagtgctaaccagtaggagccaaagccactggtcaggcagggttcctttgtcactgctcctgttggccccaggctgtctaggttgtgttggaacagatgttgtgtttcactcaccagtgatcctaagatcttgagcatgctaatttgactggggattggagaattctctggggaccttgggacagtctacagagttcatgcccaaggtcagaactaacgtatgttatgactcaaatgaacctaacaaatatatacagaccatatcactcagacataaaggaatataaattcttttcagcaccttgcagaactttcttcaaaatccataccgttagttacaaagcaagtctcaaaggatacaagaaagctgaaataaccctctgtatcataaaagacaaccatagataaaagctatacttcaacaacaacagaaccacagaaagcctacaaaatcatggacaataaataactctgtactcaatgatgatttggtcaagaaaaatttaaagaaaaatattaaagaatttctagaattcaatggca

SEQ ID NO: 3660 - DNA, 1200 bp, mus musculus
gtgtttcctctttaagggcttctagctgtttacttttgttctcctctacttctttaagggagttatttatttccttcttaaagtcctccatcatcatcttgacaagtgactttagatccatatcttgcttttctggtgtgatggtgtatccagaacttgctatggtgggaaagtttggttctgatgatgccaagtaaccttggtttctgttgcttctgttcttatgcttgcctcctgccatctgattatctcaagtgcttgctgttgtcaatatttctgattggagcctgtccttcctacaatcccagtttattcaggactcctcagagtccagctttctctgtgatcctttgattgtggactcctgtgaacctgagattctgggtgtgtcagagttcttggcagtcaagattcctctgagaccctgagatcctggtgtgaccaagctcctgttatcctgggatcctggaatcctaagatcctgggcatgttacagtgcctggaagtggtgtctcctctggggaccatggggctgtctaatgtgttcgaaaccaaggtataccagcaccaatcataaggaacccgagccactggtcaggcagggctccggtgtccttgctcctgctgtcacaggcccgtcacaattggtttggaacagattttgtgttccactcagtagtgaccctgagatcacgtgaagagtcctctggggactgtgggactgtccaccgaattcgcacccaaggtgacctggggctggtgctgaccggaagggacttgagcccctgcccaccttctttaagaagtgttcaaacatctttgcaccttgccatgacttgtggttgacatcttctctaatctatcagttacatgtatctcacttttccatatcctgtatcattttcagatcatagcagttcacaggatcacccctttctgattttattcttgtatcaacctagtgtctcttgacctttggaaagtgagtataagtctctcctgctctggctctgataggacttaatgccattactgtgacttgcctgtagtcctcccactatttttgtgattttaattccagcaactgcaattgagttcaagagtttctcagcactatcaataaaccagaacaaatagtattcaatgacatcaacaatcaaaatgcacattttcaaattgaacagctgttagcctctactg

SEQ ID NO: 3661 - DNA, 1200 bp, mus musculus
atataaaggaacactttattataaatgttcaaattccttacttctttttagggctaggaactcaactcagggctctttacatgctaggcacagttctctacaacttttgctccattgtgttctaaatttgccttttattttacatctgcatttgtgagtgggcacattagcaattctcttcccttggattgaaggaaactggagcagataagaggacatgagatctctggcttctctggtctaagatatagtaattaaactccattttactctctcatgtgcattcaggaacatctccaaagaaaagagaaattgatttgataggataaaagtggtcattgattgaccaataggtttacagtgatgaaatgttacccacttgctttatcggtgaatgctgggccacaattgtagcttgccggtatcgggctatcagcctgtacattgaaatatattcagtccattgctctgtaagccagagattcctgggtggagcctcccagaacaacgagcacaggagaacctagcatgcctggatctgacattcccaggacatataatacaacatgtccagcagcctgcctgcttgggtttcaagtcagtgtggtgatagccccttccaaatagggaagaggataggctggctgtgtgctgtgaaggcaagcattaggtttcagtccaggaggaagagcgtatgggatccctggtgtcaggttggccctggcatggttccctccggaaacttcagatactcaggttggtgctgaaataccctgtttcattagccagtgtttccctagtggaacacccttatgtctgagatacaagggcagaacatatacaaagctttattttagtttttgtgtgtatgtgtgtgtttgtctctggattgctatccttcctgactatattaaccaaagcagagtgctataggaactcttggtcttagagtatttgtaaagagactaatataacagatttcaagttagaatctccatggatagacacacagcttgtaattttctgggctggaaagctagggcatattacttgaaacttctgaagtaattttttaaatctataaaataaggataatactattagtgataattaaaagcttatataattgtgatgaattgagaaaatccatgctcttgcttcagccataattgctgggctatgtttgctgtttgatggcct

SEQ ID NO: 3662 - DNA, 1400 bp, mus musculus
ttattgtgtctacttccctttttaggtctagtatggtttttttcatttccatcacctgtttggatgtgttttcctgtttttctttaaggacttgtaactctttagcagtgttctcctgtatttctttaagtgagttattaaattccttctttatgtcctctaccatcatcatgagatatgcttttaaatccaggtctaccttttcaggtgtgttagtgtgccctggactgggcgaagtggtcattctgggttctgatgatggtgagtggtcctggtttctgttagtaggattcttacatttacctttcgccatctggcaatctctggagttagttgttatagttgtctttgtttagagattgttcctctgttgcttttgttaccctctatcagcagatgtgggagactagctctctcctctgagtttcagtgttcagagcagtctctgcaggcaagctctcctctttcagggaaggtgcacagttatctggtgtttggacctcctcctagctgaagatgaaggcccaaaacaggatctttcccagaagctgtgttgctttggccaggaaggtagccggttgtctggagccgaagatggtgccgcctcagaagctctgtggctctcgcctgtcccagaaactgctggcctctgtattccacaccctcacctgtgcagtctgccctccgaggagtcccggagccaaggtggctcccgcggagcgtgaggcagaaacctctcgggccgggcggacccctgtgctctcaccaggaaggtggccagttgtctggagccaaagatggcgccgccaaggcaactcttataaaggacaacacttacttgaggcttgcttccaagttcagagcaccagtccattatcatcaaggtaggagcatggcagcatcctggcaggcatgactcaggaagtgctgcgagttctacatctcattccaaagccaaacaggagaagactggcttccagacaactaggaggaatgtctcaaaccccaccttcaaagtgacagacttcttccaacaaggccacacctactccaataaggcaataagacacctcttaatgatgctactccattggccaagcatattcaaaccaccacaacagagaaaacccatatcaatggaaatctggatgtgaacaatttaagaacttaattaaataggaacctcagagtcatgcctcattaacaggatgaaagagacagaagagagaatatcagacattgaagacacaatagaaaaatatacaccctagtcaaagaaatgttaaatctaaaaattattccaggtataaaatgttatgaatatatgggacactacaaaagaccaaatctatgaatattaggaatagaggaaaaagaagaaacccaagtcaaaggcagag

SEQ ID NO: 3663 - DNA, 1200 bp, mus musculus
tggataaatagctgtatatttattactcactttaaatctctctctcttttttgggggggggttgttggttttttttaagacaggatttttctgtataaccctggctgtcctggaactcactttgtagaccaggctggccttgaactcagaaatctgcctgcctctgcctcccatgtgctgggattaaagacgtgcaccaccgccacctggctaaatatatctttttgcattggtactagtgtatatgaattctttgtttcaggtgaggtattttgaatcttgccatattgagtaaatccctatggtccttaaacatgcatgtattatgctgtctccaaatccaagttaaatgctctgctttagatggttttgatttgtactccaaagtaaagaggatcctgctagcatatggacaagagaaggccagcttccctattcagcttcactgacacccagtggagatgtttctccttttcctatgtggccacttctgtcatcatgcaggtattactcttaatgaactggagaaaactcttatagttgtctctgaaacctcctttctctctactctagtgggaagaacagaagtttgataatttaaagaagagtagaaaatattaatctatgcctattaacacaattagcctattaacctatagacacaatcggagaatatgaaatctagtgaaacaagttagatgaagtggagaaaaacattttcattcatgtgtgcaatcagtagggaacatttagcagtgtgtaattgaaatgcttagaaatggagaatgtgataataagtagaacagaaagaaattaacagaatatcctaggtgaggatgaaagtggagatggggagaattacaaaatagaaatgtggggccaggcagtggtggcgcatgcttttaatcctagcacttgggaggcaggggcagaggcagaggcagtcagatttctgagttctaggccagcctggtctacaaagtgagatccaggacagccagggctatacagagaaaccctgtctcaaaagaaccaaaaaaaaaaaaaaaaagaaaaaaaaaaagaaaaaaagaaagaaagaaagaaagaaagaaagaaagaaagaaaaatgggggtaggggggatatgaccaatacgtatgatatatttctttgtaagatatcataatgagcactattaatttaataatgaatatctgga

SEQ ID NO: 3664 - DNA, 1000 bp, mus musculus
agaaggcagaaatagaaattgtggagggaagggaatctttatgctggcttacttagcttcttatactgcccagaactatttactaatgggatagtgctgccagcaatgcctgaaccctcttacaccaaataatactcaaggcaattcttcacacgtgcctagaaaacaacataataaagacattattcagttattcaaggctgtggaaagatgacaaagccaattaagataccagatatacaagaataataaattggcccaatagcattaactagcttgttttaaacactaattttgttaaaattgaagaacaattgggagaatataaaacatcttataaaatatttgattgcttgaaggcataaatatgacaaaactttataattgagattttaagtatttaagtatttattatcattttatgtgtattagtattttgcctgcaggtaagtaaatgcactatttgaaatcattgcccacagagaacagaagaccagaaggacagctgtgtggtgtgagcagcaagctagtcctctataagaacagtgaatagttagtaactttttcaggccatggatgtgtctgtgtgtgtgtgtgtgtgtgtgtgtgtgtgtgtgtgtgtgtgtgtgtgtgagtgtgagtgtatgttagtagggagctacacccagagtcagtggtgttccccttctcaaaagataaggggaaggaggaaatgggggagggtttgtttgaggaagtactaggaggaaaggctaggaagggctgatgttctactacatagtgaataaataaatacagtaaaaaagtaaaaaggaaacattaaaaatgcacacacacacaaattgaagcattttttttaatttgtggataagacttttgattagaaactgtaatcattataagaaaataatgaattccagtgtaaaacctcagagtttgcttttgtgaaacataattagcagatattaaaacatttttgtctagcatgttattttaagaa

SEQ ID NO: 3665 - DNA, 1000 bp, mus musculus
tttcttagatattttcatttacatttcaaatgctattcccaaagcccctatatcttccccccaccctgctccccaacccacccactcctgcttcctggccctggtattcccctgtactggggcatatgatctttgcaagaccaagggcctcttctcccattgatggcagactaggccatcctctgctacatatgcaactagagacacagctctggggggtactggttagttcatattattgttcctcctatagggttacagacaccttaagccctttgggtactttctctagttccttcattagaggccctgtgttccatccaatagatgactattagcatccacttctatatttgccaggcactggcatagtctcacaggagagagctatgtcagaatggggaacaaaattcccatggaagtacttacagagacaaagttcaaaggtgagattgaaggaaggaccatccagagactgcccaactccgggatccatcccatatccaaccaccaaacccagacactattgcatatgccagaaagattttgctgaccagaccggttaattcttaacaacaggtttattttttctggttcaaggacagggcatttttttttctgatagacttgggttgcttttcatttagcaataaaagggtagatgcttttttgggcccaacaaaagatgaatgtatgtatacacatatgagtgtttatacatattttttgtacacaagcttttcctttagccagtgtgatcctcttctcctggttcaataaagatcaataattctacatttctctcccacctggacagcgagagtctatggttctaagcaaaagagaaagaagcccggagcctagcaaacacctaagtggatgctcacagtcagctattggatgaatcacagggcccccaatggaggagctagagaaagtacctaaggagctaaagggatctgcaaccctataggtggaacaacattatgaattcaccagt

SEQ ID NO: 3666 - DNA, 1200 bp, mus musculus
tgataagttgttcactttccatacttttataagctttctgttgtccctgttgctgctgatatccagttttaatccatggaagtcaaataggatgcaacatattgattataatattcttgtgtctcttaagactagctttatattcaaggatgtggtcaattttagagaacgtttcaggagttgctgagaagaaagttgtgatggtttacatatgtttggcctagggagtggcaatattaggaggtgtatcattgttagaataggtgtggcactgtgggtgttggctttgataacctagttctagctgcctgaaagtcagtactctgatagcagcattcagatgaagatgtagaactccttatgcaccatgcctgcctggatgttgccatgttcctgccattatggtaatggaatgaacctctgaacctgtaagccagcccaaattaaatgttgtccttataagagatggtttgggcatgctacctcttcacacaagtaaaacccaaactaagtcagaagtgtattcttttcttcttttgtgtttgtgtgcaatattctgtaaacatgatatgtcgatttggttaagggtatcagctacttccaactttactctgtttagttttttttttccaggatgacctatgaattgttgagagtggtatattggattcacccactaactccatgtgaagtccagtttatggtttaagttatagcagtacttattttatcaactttgttgccagttttgctagagttactagccctggttcaactgaggcagtggaccattctccaatcatgagatcctgtttcaaaacaaaagccaaaaggaaaagatattttcaataggaagacactcaaattgcaatggtctgtggaaaacttgagactacattactcgtaaatgaatgggagttacccccttagttatattcagtcactccaagacaagagaccaatactggatagaatgaacagaaaaggacactgagacacagttagtgggaatgtaccgacacagccactagagcaagtagagaaaacattacacagaaaactagaaatagagctactacaaacatgaccctctaattctactcctgaatagatatctgattatgcttgcttcaatagcttactagataaaaggggtggtgttttcatgcaatttgcatgtaacgactagacatgttcttc

SEQ ID NO: 3667 - DNA, 1000 bp, mus musculus
aattaatgaataaaagagaataagaagtggaaagtgattttgaggaagacaggaagtgatagaaaattatataattatactatggtctaaaacattttaaacagtaattccaaatgaaaatacaaaaattacaaaagctgattaatttaaaaattaatttgttgaaattggctaggagtgaagaagtaatgctaaatttttataatctcgtatcagttaccttaatagtaatcctcatcttgttgtggttttgttttgttttattttttgagacaggggtttttgtagaacaatcttatccttgagattgctttgtagaccaagctggtcttgtactcaaagagatgtgcttgcctgtactttctgagtgctgggattaaaggcatgtgccaccacacctgactaacagtgattatatttatctgtggatgatttttatttgttaaatttactttgatgagaaatcagtttcttattaaattgaaatatgttgtagccagccagccagccagccagccagttcatcagaaacactgagcaagcattataatcacaacggatatcaggaattcctagtaagagattgtgaggagcaggtgtggcggcagtcccaagaaggccccagagactgcagctaagtcttatgacttgcacctgacttcctcacctgaatataagccacaaccaagctgcgcaggtgtaccaggatactggcaaatccattttggtagagatatgcccctgctgccctgattagctgaagctgtgtacctggtgaggttacgtggcctgctgtgagtggatgagggctgagagtatataagagtaagaggcccgggttagtgagaggattattattagtgggagatatagatgaagagaaagaagagagaggaagactgaagtttgctgaataaactgctgttagaaggactggtggtcgtgtcgttcttgctggtcgagagcagacgcgacaagagatccctaaaccccaaagttt

SEQ ID NO: 3668 - DNA, 1000 bp, mus musculus
ctcctcgtaaattatttctaaacaactctgggaataaatatttctttcccttttctctcagaattaagtttttctttcttttttgtttaaaaaattggatattttctttatttgcatttacatagctaagcataacaaaacccaataactccagatggaaatgttaaccagaatgcccaaccctttagagatagaatatggagataccacatccagtagatagacagccctcagtgaagggaagggggtcaccaacctaccttccaaatttttacacagaattgtttctgaataaaagaaattcagggacaaaaatggagcagagattgaaggataggtcatccagtgactggcccaatttgggatccatcccatggtcaggtaccaaacacttgcactattactaatgccatgttgtacttgcagacaggagcctatgatggctgtcatctgagaagctctaccatcagctgactgagacagattcagatacttacagccagccattggactgaaatagggaacccctatggcagaattaggggaaggactaaaggagctgaaagggtggcaaccccataggaagaccaatagtatccactaatatgggaaacctgtgttctcccagagactaagccaccaaccaaagaacatacatgggctcattggaggcctgtggtacatttgtagcataggattatcctgtctggtatcaatgggagtgtatgtaccttaccctgtaaagacatgatggcccaggaaaggggaatgaaggaggtaggatgaggtggtagtgggtgcaagggtgagggggtatgtgaatggaagggtaggggaagcaccctctcataggacaaggagacagggtatagggtgaagaattcttggcttggggactgggaagggggcaacatttggaatgtaaataaataagagaatttttttaaatggaaatacaaaatgagaccctcagtttaatctctgtaaccacatgaataaa

SEQ ID NO: 3669 - DNA, 1800 bp, mus musculus
tcttccatttctattattcttagttttcattttctcattgtgtcctgattttcctgaatattttgatttaggagctttttacacttcgttttttgttttttgtttgtttgtttgtttttggtttttggtttttgaccagtgtgttaatattttctatggtatcttctactcttgaaagtctctcttctatctcttgtactctgttggtaatcatttcagactcctgatctcttttctagattttcaatctccctttgtgacttctttattgtttttaatatccatttctagatcctgtatggttttgttcaattccttcacctgttttgttttgttttgttttgttttgttttgtttttcctgtgtttctttaaggggtttatgcctttactctttaaggcttctacctgtttacctatgttgttctctatttccttaaggtagctatttatgtccttcttaaagtcttctataatcaacaggagatatgattttatatctggatcttgtttttccagtgtgatggggtattcaagacctgctgtggtgggagaactgggttatgatgatgccaagtaaccttgatttctgttgtttatgtttttgaacatgcctcttcccatcgggttatgtgtaatgctgcctgcccctgctgtctctgactgtagcctgtccctcctgtgatcctggttgtatcagaactccttagagtccacctgtctctgtgtttctgtgaatctaggatcctgtgatggtgagatcctgggtatgtcagagcacctgggattcaagatttctctgggtgtgaccaaattcttgagatcctgtgatcctggcatgttagagcacctgggaatcaagcttcctctgggtgtttgggactgggtggtgtggagccaggacctaaggtctgctcatggcaccagctcagacaagaaagactatgagatacttttttgcacgtatgtattcatgtaagctcattcctagaaacctagtgtccatgaagctgatcagtagccttaatagtgtatttttatgtaaaatcttcagttttccatttttattattactggacataaattctctttatctttttcatttctttggggatattaatttttattctctattttattaatgctgaggagtaaatcaagagcctcatgaccactagctatgttatctagaatagagtaaaatacctatcaaaaatttaaaatgtaaacattaatttaagcaacattagaggtctgagtaggaattttctgctatatattgtattgtaataaatgatggatatgattattattagagtgttgtaattgttattctgcaaataccaagacattttaaaaatctcatttataggaaatgcaaaatatcttgtgtttggtaaataatgttttcaactttagcatactgaattaaaaacttgtcttcaaatgaaacatttagaaaatgtgcatgtaattaagagaacagaaaagagatattcttcatcaagctgaatcaattgaaaattatgttatatatagattttattttgagtcaacatttaatttgtttctggttatgaacctttttgaggctcaacgaaaatgattcataaatcctggaaacactaagaatcaaacatatctgcctgaactcaaatttaataataaaataaatatagcccagtgtttctatagttccttaagttttgtattggttattactataaaacacacacacacacacacacacacaaatacacaaaatttcttcaaaattaaaactatcttgaccaacctagga

SEQ ID NO: 3670 - DNA, 1000 bp, mus musculus
ttcttccaaaactttctaatatcttgactttatggcacagggtggggtctcgcctctcccagcgatcatacttgtaattagaaaaaggaggagtcttccaatactcttcccagcatgcctctctgatacacagcagcactaaaggagtaatcgttgatggttttcatacaggatctctctgtgttgcccaagctggccagcctcctggtcttctttcaccgtggtacagttacagactcgtgcacatgcctgggtagacgtctgaaagttaatgttatgacggaatcatgtcagtaacctatccgtacgtcccttcattaaagccagctcttgcatccttatgagtcggcataaggttgtgatcggctgcacatctgcactgactatttcactctatgacaccaattggtcacatctgtgaatatcaccactgactcgtcacctaattctctgaccactggaatgatttcgggctcatcatggacgttacaaagttttaacgtttgcgtgcctatcaatttttcattattagcaacaaatcctgtatatttcttaacttgtgctttttttttttttccttttttttcccgaattttttgttaggtattttcttcatttacatttcaaatgctatccaaaagtcccctataccctccccactcccacttcttggccctggtgttcccctgtaatggggcatataaagtttgcaagaccaaggggcctctcttcccaatgatggccgactaggccatcttctgatacatatgcagctagagacatgagctctgtggataccgattagttcatattgttgttccacctatagggttgcagaccccttcagctccttgggtactttctctagccaggtggtggtggcactcgcctttaatcccagcacttgagaggcagaggcaggcagatttctgagttcgaggccagcctggtcgacaaagtgagttccaggacagccagggctacacagagaaaccctgtc

SEQ ID NO: 3671 - DNA, 1400 bp, mus musculus
atataaaattgttagaacatacaaattcttaccatttacaaaacaagagcatacgccctaaatctgataagagaatgcatatttcaaatgaccaaaacatatcaaaacaaaagcagaaaaaaaaaaaaagaaagaaagaaaaagagtacttgacaaggatgaaaatggtactcaatcagatcaaacatttgataggatctttcctatctcaaatccagtgtaaataagcaggagtattattgattcctaaccaatattattggactttgacagaaatgcccataatgccctaatatcaatgctataaatactgttacttatccttactttaaattaattaattttttaccatccatattccattcctagcccccacaccccacaccccaatctaccctctgtctgctccacaccccacacctcctcccccctccctgtctccatgtggatggccccaccttcccaccccacctgatctctaaactccctggtccctccagtctcttgagggttaggtgcatcatgtctgaatgaacacagactcagaaatcctctaatgtatgtgtgttggtgtcctcagatcagttgatgtatggtgtctgtttggtggtccagtgcttgagagatctaggggttacagattgagactgctggtcctcctacaggattgccctgctcctcagcttctttcagccttccctaattcaacaacaggggtcagctgctatcgtcaattgattgggtgcaagtatctacttctgactttttcagctgagtgttgggtcttttggagggcagtcatgatagatcccttttttgtgagcactccatagcctaagtaatagtttcaggccttgggacctccccttgaactggatccaactttgggtctgtcactggaccttcttttcctcaggctcctctccatttccatccctgtaattctttcagacaggaacatttatgggtcagagatgtgactgtgggatggcaaccccatccctcactaggtgccctgtcttcctgctggaggtggactctgttaagttccctctccgtactgtcaggcatttcacctaaggtctctccctttgagtcctgagagtctcttacctcccaggtctctggggcattctggagtgtccccccaacctcctatttcctgaagatgtctgtttccatttcttctgctggctctcagttgcttcagtctttttcccttaaccaataccagctcaggttcccctctctccccaaccccccaccccatctacttcccatcccacttccctccctctctcccaacttgtgactgctttcttctctctcctaaatgggtctgaggcatcctctcttgggcacttcagcttgttaacatttttgaattctttggactgtat

SEQ ID NO: 3672 - DNA, 1400 bp, mus musculus
actataaacatgttaactttaatgattttctgattattttactttaaactcccaaatgatttctctatataaaaactcacttgcacgagatcctattggttaataagaaggaagaagtagaaattaactttattttttattagatattttctttatttacatttcaaatgataaccccttttctagtttcccctctgaaaatcccctacttcctccccctcccactgctccccaacgcacccctcccacttcctggccctgacattcccctgtactggggcatagaaccttcacccttcacaggaacaagggcctctcctccagttaatgacaactaggccattctctgctacatatgcaactagagccatgagtcccaccttgtgttttctttgattggtgatttagtcccagagagctctggaggtactggttagttcatattgttgttcctcctatggggctgcaatccccttcagctccttggctgctttctcaagctcctccattgggaaccctgtgctttgtccaacagatggctatgagcatctacttctatacttgtcaggcactggcagagcctctcaggagacaggtttatcaggctcctgtcagctaattcttgttggtgtctgcaatagtgtctaggtttggttgttgtttatggaatggattcccaggtggggcagtctcagggtggtcattcctgcagtcttcactctgaactttgtctctgtaactccatccatgggtattttgtttcctcttctaagaaggatcgaagtattcacactttaatctccacctcacaccagtcagaatggctaagatcaaaaacacagatgacagcagatgcttttgaggatgtggaggaagaggaacactcctcattgctgctgggactgaagctagtacaaccactctggaaatcagtttggtggttcctcacaaaattggacatagcagtactggaggatccagcaataccactcctgggcatatatccagaagatactccaacttgcaataaggacacattccccactatgttcatagcagccttatttataatagccagaagctgaatagaacccagatgttcctcaacagaggaatgaatacagaaaatgtgatacatttacaaaatggagtactacactgctattaaaaacaatgaatttatgacattattagacaaatgggcatctggaggctatcatctgaagtgaggtagccaaatcataaaagaacacacataatatgaactcaatgataagagtggatattcgcccagaagctcagaatactcaaggtacaatttgcaaagcacatgaaactcaagaagaaggaaattaactttatttatatatagaatcaactgccttctttgtcagaaaatg

SEQ ID NO: 3673 - DNA, 1000 bp, mus musculus
tgtaattctttgaaggatttttatgcttcttctttaaggacttctacctgtttagcagtgttctcctgtatttctttaagtgaattttaaaagttgtccttaacatcctctaccaacaccatgagatgtcattttaaatctgaatcttactttttgggtgtgttggggtatccaggactcgctgtggtgggcagactggtttctgatgatgccaagtggtcttggtttctgtaagtaagattcttacatttgcatttcaccatctggtaatctctggtgttagatgttctagctgtctctggctggagcttcttccgcctgtgattctgttagcctatgtcggcactccttggagtccaactgtctcttgaattccagtggtcagagcactctctgcaggaaagctctcctctttcagggaaggtgcacagaggtctggagctcagatctacctcctggctgaagataaaggccttaagggaccctgtcgaagtagctctgtttcttctgcagtccatgtgctctcctgtgcagactggtctcagagcaacctgggatacaagatggtgctctcacctgagttccggggtcagagccctctctggaggctgactttccccagtgatcctaagatcctgggtgtgctagggtgactgaggattggagagtcctctgtggatggtggagccatgctgtctgccgagtttattcccaaggtggcacggggctggcacagaccaaaatgaaccccagggcctggttgggcagatttcctttttccctgttcttgctggcacaagatcctccaggttgtgttagaacggaggatgttgcattccacgcaccagtgatcccaagatcctgggtgtgctaggccgcctgaggtgttgagagtcctctggattccgtgggactgtctgctgaatgtgttgtaaaatttgaaacttagaatgtacaaaaatatttaaaatgacatgtatcaaataaaacaagcctacag

SEQ ID NO: 3674 - DNA, 1000 bp, mus musculus
tcaagaagaatgaagactgaagtgtggacactatgcccctccttagaattgggaacaaaacacccatggaaggagttacaaagacaaagtttggagctgagatgaaaggatggaccatgtagagactgccatatccagggatccaccccataatcagcatccaaacgctgacaccattgcatatactagcaagattttatcgaaaggacccagatgtagctgtctcttgtgagactatcccggggcctagcaaacacagaagtggatgctcacaatcagctaatggatggatcacagggctcccaatggaggagctagagaaagtacccaaggagctaaagggatctgcaaccctataggtggaacaacattatgaactaaccagtaccccggagctcttgactctagctgcatatgtatcaaaagatggcttagtcagccatcactggaaagagaggcccgttggacaagccaactttatatgccccagtacaggggaacgccagggccaaaaagggggagtgggtgggtagggaagtgggggtgggtgtgtatgggggacttttggtatagcattggaaatgtaaatgagctaaatacctaataaaatatggaaaaaaaaaagaatgaaacatctcccccaggcctcaggtcatatcacaccaggcttgtaatccatagttccttcccaagtaaggaacattgtgtgccattttggggctctctctgaccttgtcttcctctattttcagcactgtttataaccctgtgcacctagtaaccttgaagctcatgctggcatcaggatgagatgacaaaattttcaaggaattctgagctctacctcctgaggagatatttataacaaaaagtttgattcaagaatttagaacctcaaacacaaggcctaaaatagggacatccatcaacttttagaaagtattagtcacgggcacaaaaccacacataaagccatagcttaaaaggcataatagaataa

SEQ ID NO: 3675 - DNA, 1600 bp, mus musculus
aaggtttatctgcctatatcatagtatgaatattttccttaaaatatacaatatattttcagcctgttaacacaaatttgtgaaagtacacttttaaaacttgctagtttttctttggaattttcccattgcaatgcaaccgagccagaatacatgttactataattggactcagcaacatgtttatgctcatgtcctgtgttgcaggaacctcttccttttcactactcctcacacacatataagcagtacatgttgactctgtttaaatgtcagaacctactgtatttgcactgttgtatttgatttactgtttagagaaatcatttgtgaatttctgggcacaataatctgaatttttaactctagaagttaaaaaaaaaaagtctgtgatcttgggcacgatcagtggaggtccccaaggtccccagaggattctccacactgaaggcatcctagaacacctgggatcttgaaatcactgggaagtggaatgcatcatcagttccaaaaaccccacaggttcttaggctagcagaaacaaagagcacctgcccaaccagtggttggggttcattctagtgggcaccaccgccatgccatcttgggtgccatctccatggaaggtcccaaggtccccaaggattctccatacttcaggcaccctagcaaactcgggatcttgagatcactgttgagtggaacacaacatcagttccaaaatcccagagggtcttgtgctaccagcaacagggtcaaaggacaaaggcaggcccgagcacacccagaatcttgggatcactaagacaagtccacacatgagagcacgtgggcagtagaagcaacaaaacttgaacagggtcccttcaggccttcatccttacccaggagacagaactgagacccagaaccctagacaccttccctgccagaggagagtcagcttccagggagggctctgaccccaggaatcaggaggtggatctgagctgcagacttctgggcacctttccagcaagaggagagatgacctgcagagagcactctgaccactgggactcaggagagagttggtctcccaggaatgctgacagaggctaaagaatcacaagatgaacaaactccagccagagtcagctagaacatctgcaccagagattactagatggtgaaaggcaaatgaaaaaaacttagtaacagaaaccaagaccaattaataatcagatcaacaaatgcactaaatgaagacagaatattaaaagcaggaaggggaaaaggtcaagtaacatataaaggcagacctattagaattacaccagacttttcaccagagactatgaaagccagaagagcctggacagatgttatacagacactaagagaacacaaatgcaggtctaggctacaataccaagcaaaactctcaattaccatagatggagaaaccaaagtattccatgacaaaaccaaattcacacaatatctttccacaactccatcccttcaaaggataataaagggaaacaccaacacaaggacagaaaatatgtccaagaaaatcaagaaagtaatccttcaacaaacctaaaagaagatggcc

SEQ ID NO: 3676 - DNA, 1000 bp, mus musculus
ggaaagtagagcaggagatgagtaaaggagggagaatggaagaagaggaggaaggaaaatctaaagagaagctagaagagtcgtggtaagagcgggaacccggaggcccacgaagcaaaagggactcggacctgagacctagaggatgagaaagtctgtagaagagagctgcggactggtcagcagcgagagcagagatatggaaattcttccggaaaacttctatcctcactcttgtcctcgcctgggttctccgaacccgcaggccaggcagactgaactgcgaggcacaagacctggcagcgctttaacgctagcaccgggccatccaaggggagcacagccttcagggatgcggggcaccacagggactctccagagtgtctctaagatagaggaagccgccagaacctcggttacccttagtgaccgggaaccggcgaccatgggaatgcttggggacgacaggaactctccagggtgtcactaggacagaggggaccacggagaccttaggaattcttggggagagccgaggacttagtgatgcccaaggaagacatggagaccccgggaactgcttgggaatctggcgcggggacggggaaattcagggattgttccagggagggacaagggaggcaatccagcccctagcctggcctcgggactgagtgcggttgggacctgggtcgttcttccgtctcttaaattgcttggtttgaagcgtttcaagaagggaagacgggatctctactagcagttggggcgctgcagtatcgcggcgcctgggactgaagaactcgggcgaggttgagcatttgcacccttgtcctacaggtggagctcttacccgacagagacccggacaacgatgggaccaagattagtgtgagtgtcacagggaccagcgacagggggcacatcctttagtaaactaccaagcagatccaagatggatattagtagaaacggttttagatgtaaaaccgtttaattc

SEQ ID NO: 3677 - DNA, 1200 bp, mus musculus
gtgaacacctatgattttcatcttagagatctttcattgaataaatggtaatagataatgcaatgaagcccaataccttgtagatattagtgtatagaagaaccttatttttccaacatttgtctactttcctctagaaactgcaagtcttgagcactatgacttttcagagacagctatgcagcattagactcagcatgcgtcacttcacttctgcctgttttcaaaactatagctgtacatgtctacggttttcacgtatgtgccatagttattttaaagtgttttgagaaggccccactgatagctgtgtactggtaccaagaaacattggctctcacttgatgataacatctgaagattcaatgaggcatgtctaggaaagctttctctcaggccgtgtgagttaggcacagataaatctatctcctttgtatgatgtttgtgccatgtgagtcagagctctgccctcttccctggagtgtgagagggagcaggagatgctgctccaggggcccccagaggtgaatatgcagaatcttgccacaagtcctcctgggactcattgctatgcttggaaaagctgacttgtcacttctccggactttcatttatgtcctttgacaaaagtagaacaaattattttacattcttaaaagtatgtacctctttccaatttccaaagcaacgaaagactttccttcacatcctcaagtctggtgagtcatctcagtgatcagtgagaggagactgaatgcccagaacccattctcacactggcctccctgcgattgttatcaaactgagaagccttataattcaatgtcatctactgagcaaggctccccttacataaaagtacacattttcctgttgctgtgaaagactactagacagctcctttgtaattttatatttcttccttagaacttgacctgaaggcaagaagactcataaagccagttttcctcatctttgctcaaaagcagcagcagtctgagttaggatttgttctggtaatggaatcctgactgtcttttacattatctgtggcacacaggctgaaggctttatctttatcagtgtcatgattcgaacaacaaaatagttctggctaacatatagtgacaggtaaatcatttaaaaacaattgcacaaaaagttcttttcagttgtgattatcgttcttaatagtatttg

SEQ ID NO: 3678 - DNA, 1000 bp, mus musculus
tatctccatgatattgatttgttgtcctttgagtaggtacccaagagttgtacagaggagtcatgtggtagagttgggatttatttatttattcactttacattctgatttagcctccccacctctcccctccccccaaggctccttctcccattcctccctctgtttcatctttgagaacaaaagggggtccctcctgggaaaacaacacaccctgacacctcaagtcacagcaggactgggtacctcttctcccactgaggccagacaaggccatccagttagagaaacaggatccagaggcaggcaacagagtcagggcaagcccctactccagttgttgggggacctgcatgaagatcaagctgcatatttgcaacacatgtgcaaggggccgaggtccagcccatgtatgctcactgattgattgttccatctctgggaggtcccacagggttcaggttagttgactctgttggtattcttacagagttcctaatgtttttaggtctgtaaaccattcccaaacctcttccacaagacctcctgaactccatctaatgcttggctgtgggtcagtagagttgtttttatattaacatgtgtagctttcaatccagtatggtcactcttgcatgcactttcatgacctggaacaaacagcatctcagaagtagggcacttgttatatagtattcaaaataatgaaagtcacatgagagcctgcaagaggcagagaaggaggtgacatcttggtatacaaaacataatttacttcatcattactttgataatctgatctgaagagtgaagttgggtgtacatagaaaagcataatattgaatggtgtagcccatagattcttgacactatcttacagcaatatctaatcatggttttctctttccttttttttgttttggctttgatctttgatttatgcatcttatgcttgaaaaatcctttctttcttgaaatgagcgaactgactccaccaatt

SEQ ID NO: 3679 - DNA, 1000 bp, mus musculus
aggataaacaggctgtgaaagaaattagggaaacaacacccttcactatagccacaaataatataaaatatcttgatatgactctaaccaaacaagtgaaaaatctgtaagacaagaacttcaagtctctgaagaaagaaattaaagaagacctctgaagatgaaaagatctcccacactcatggattggcagaattaatatagtatatatggccatcttgccaaaagcaatatatagattcaatgcaattcccatcaaaattccaactcaattcttcatagagttagaaagagcaattctcaaattcatttagaacaagaaataacccaggacagcaaaaactattctctaaaataaaggaatatctggggggctcatcatccctgacctcaagctgtactacagagcaatagtcataaaaacttgtgacttcccacggccacatgaaccgggtcctcctgaaaggcaggctggggctaaaagagaataaacggggagaaaaaggacgaggtcaagacaaaattctgatcaaagcccaaagtttactaaaaatctgtgcttatatagagggaaagcccatctcccacagattcactcttgatgcctgttgccagcctgtaagcaatctgtctgacagcactggtttggcaagaaagtgtcaatcactgggttgcctgctgtctctggaatctctcaggaatctctcagcctctcagcaggtagcagtgtcttggagcgggacagcaccagtggtgacagaacaatagaaccatctaggtgggaaggctccaccccaggtggtctcattctcagtggcagcaaggtctcagccagcctactcaggtctgggggaggctacaaaaactgtgtggtattggtacagtgataggcaggaagatgagtggaatagaattaaagatccagaaatgaacccacacacctatgatcacttgatctttgacaaaggagcaaaaaccatccagtggaaaaaaggccagc

SEQ ID NO: 3680 - DNA, 1800 bp, mus musculus
tttctcattgtgtcctggattgcctggatgttttgggttagaatctttttgcatttctcattttctttgttgtgtcaatgttttctctggtatcttctgcacctgagattctctcttctatctcttgtattctattggtgatgcttgcatctatggctcctgacttctttcctaggttttgtatctccaaagttgtctccctttgttatttctttattgtttctgcttccatttttagatcctagatggttttgttcaattctttcgcctgtttggtagtattttcctgtaactctttaatggatttttgtgttttctttttaagggcttctacctgtttacctgtgttctcctgaatttttttaagggagttatttatgtccttcttatagtcctccatcatcatcagaagaagaagaagaagaagaagaagaagaagaagaagaagaagaagaagaagaagaagaagaagaagaagaagaagaagaagaagaagtaactttggatccatctcttgcttttctggtgtgatggtgtattcaggatttgctatggtggaagagttgggttctaatgatgccaagtatccttggtttctgtggcttctgttcttaggcttgcctcctgccatctgattatctcaagtgctccctgccctcaatatctgattggagcttgtccttcctgtaatcccatttgagtcaaaactcctcagtgtccagctttctctgtgactgtgtgattccgggaccctgggatcccgagattctgagtgtttcagaattattggcctgagatcctggtgtgaccaagctcctgggatcctaagttcctggtgtgttagagcacctggaagttgtacctcttctggagaccttggggctgtccactgagttagaaaccaaggtagactagcactgataggaaggaacccaagctgctggtcagatggggctcctgtttctctgctcctgctgaccccaggcactcccagttgtgctggaacagacgttgtgttccactcaccagtgatcttaagatcctgggcctgctagagtgcctggggggtggtgaatcatctggggaccatccgctgagtttgcacccaaggtggcctggagctggcgtagactggaaggaaccttgagcagatttctttttttttttttttttttacttttttttttctttccattttttattaggtatttagctcatttacatttccaatgctataccaaaagtcccccatacccacccacccccactcccctacccgcccactccccctttttggccctggcgttcccctgttctggggcatataaagtttgtgtgtccaatgggcctctctttccagtgatggccgactaggccatcctttgatacatatgcagctagagtcaagagctccggggtactggttagttcataatgttgatccacctatagggttgcagatccctttagctccttgggtactttctctagctcctccattgggagccctgtgatccatccattagctgactgtgggcatccacttctgtgtttgctaggccccggcatagtctcacaagagacagctacatctgggtcctttcgataaaatcttgctagtgtatgcaatggtgtcagcgtttggatgctgattatggggtggatccctggataaggcaatctctacatggtccatcctttcatctcagctccaaactttgtctctgtaactccttccaagggtgttttgttcccacttctaaggaggggtatagtgtccacacttcagtcttcattttt

SEQ ID NO: 3681 - DNA, 1200 bp, mus musculus
tacacaatggaatactactcagctattaaaaatgacaactaaatgaactttgtaggcagatggatggaactagaaaataccatgagtgaggtaactcagacccaaagtgagtacatggtatgtactcactgataagtggatattagcccaacagctcagaatacccatgatacaactcacaaagcatatgaagtttaacaaaaaggaaggacaaagtacggaggcttcaaatccacttagaagggggaacaaaataatcataggaggcagagggagggaggggtctaggtgggagaggggagaggaagggaaaaaggggagcaggaccaggtatggaaggagacaggtgagaagtccagagggcctggagaacgaaaaaaaataagaggcagttgaggtggagaacttggggaaccactagaaagtcccagccgccagggatttgagagtttcctgggatccggtggggatgacattagccgaaatacccgacagctgggagaaagaacctgaggagacaacttccagttgatagacatgacccccagtgaaaagatggggtcacccacctatctaaaaaattttaccccagaaatgttcccatctaaaagaaatacagtgaccaaaaaaatggagtgtggttgaaggaaaggtcatccagcgactgcctcacctagggatccattccatctgcagacatcaaatcccaatactattgctgatgccaagatgtgcttgtagacaggagcctggtatggctgtcccctgagaagttctgccagcacgtgactaagacagatacagatactcacagccagccattggactgagccaggggaccccaatggaagagctaggggaagggctgaaggagctgaaggtaattgcaacaccataggaagaacaacactatcaattaaccagaccattcagagctcccagggcctaaaccatcaaccaaagagtatacacagacaggatcatggctccctctacatatgtagcagaggactgttcatctgacattagtgagagaggaggcacttggtcctgtgaaggtttgatggcccagagaaacggaacgttagaggggtgaggtgggagtcggtgggtgggtgtgtgagggagcaccctcttagaggcaaacgggagggggatgtggtagggtgttcatagaagggagaccaaccgggaaaggag

SEQ ID NO: 3682 - DNA, 1200 bp, mus musculus
tgtatagcctaagtaggcttttgtaggaaacccactgtctgtgagacagctctgtgcaatggtttctatggaacaatgagttttgagtggaatttagaacccagcagaatcctttgctgctgagtacagagggaatgccccatttgctttgccacttctggcaccgtgaaaggcttcctcagccacaccgtggaacaagcgatgaactttaagtcaaagtgtttcttccctacagaaaagaattttgagaaaaaagacaaagaccacttccggcaaaataagtacccactctcgagggaactttataacctgatttttggtgaaagaaaggtacaaaggtattattaggtctggggtacttggactgggatatatgctttatttagttggtgtttcctctaaatctgtcgacaacacctgtaccacagacagacattccctgcaaatggttctgactcctttttctctatgtattacaagcatataaaatcaaacatgatttctagttgggtaaaaatcatgaataaaggtgactatttgggagggataataagctggaatatcttaaagaacaagaatggctatttcttctttaacccagatattccatatagataaatggcggtgatgacccttcaagcacaagggaacatctaggtttttatgatgctgatgaagcagagctaataaaatgtattgtgaaatttcttactatttagaggtaatcatggagacactgaaacctaatgttgcttatggtcaaagatggctataaatattttccccactttcttttaaaaattattttatttttgaattgtgtatccatgtatgaaggggtggtacacatggatggaggtgccttcaggggccagtggtgtcaggtatcgaactctggggagttggagttacagatagtgagagcctgccacagtgtgatggtaagaacctaactccgatcctccaaaagagtagcatgtgtcccttactccagcaccttctttccagcatccttctctctgttgtttaaagctttcttctcctataattctattcttccctcagtactaatcatatctctggcttctttcttccatcactgaataaggaatagaagtggacatttcagggccaacttatcccaaggttgattgcaacatctctatttttttcctaaagtgacttccagcttcaatttgg

SEQ ID NO: 3683 - DNA, 1000 bp, mus musculus
tccaacgtgtccttcacccctgagaatcgaggaacctcttgatttaagtaggtaggatctgagaacagctgcacaagcaagaccagctcactggcattgaggggaggtgagtgagccaggtagcaactggagcagagctctggctctctccacctgcagataagaaggtgtctgatctgctgagcccttatctggtacgagatatcattcacaccgggtgggggcgggatcctgtaataaggaggatcccgttagctcctaatttgacccacacctgactgaatcaaggctctggaacaatgctccaacataatgctgtgactcccgcagggaaggggactctggattcccaagctatcacaatgcagagccctgagaagactgaccaagaagagccccggaagccacagtctatagaagcaccagggcctgaatgaaacttccaggtctgctcagggacctgtcttagactggagaaatgacaagcttcacactcctttttgtctgtgtttagattactgaagctgagggtgacacagaggagtcaagtcagaggagaaactgctagcctgtctctagagagagttgattagaatccctccggtagggctggcgagatggctcagtgggtaagagcactgactgttcttccaaaggtcctgagttcaaatcccagcaaccacatggtggctcacaaccatccgtaatgagatctgacgccctcttctgtcttctgaagacagctacagtgtacttacatataataaataattaaatcgtttttttttttaaatctctccagtaaagataattcctggtttagacaagtgtctccaaaggtttatgggctaaagtcttggtcccatgtcgaggaggtgctatgatattttgagatagtgtaacagggaccccaaaagagtagactatccagagtgtgaatgtgtccaggaagccgagacctcagagcgagagcagcctgaagccttggcaccaggaaaga

SEQ ID NO: 3684 - DNA, 1000 bp, mus musculus
agggtgctccctccaccactccggttctcctgccctggcattcccctgcactggggcattgaacacccccaggcgcaagggcctctcctcccactgatgtccaacaaggccctcctcttccacataagtgatcagcaccatgggttgctccatgtgtattctttggttggtggttcagtccctcggaactctggggtgtctgtcatgttgatactgttgctacctccctggggcttcaagctccctctgctccttcagcccttctccaaatcttccattggggcccattagcttggtccaatggttggctgtgagcttccacctttgtctttgtcaggctctggcagagcttctcatgaaacagccatatcaggcctccatcagcaagcacttttggacatcacacaataacatcagggtttggtggctgtgtatgggatggatacttaggtggggcagtctctggattgcctttccttcagtctctgcttcaccctttgtctctacatttcctcctgtgagtattttgttcacccttctaaaaaacactgaagcatacacattttggtcttcctcttcttagtcttcacatagtctgtgaattgaattttgggtattctgaactcttgtgctaatatccacttatcagggagtacacaccatgtttgttcctttgtgactgagtcacctcacttaggatgatattctcaagttccatccatttgtgtgtgaatttcatgaagccattgtttttaatacctgagtagcattccattgtgtaaatgtaccacattttgtgtatccatttgtctgttgagggacatctgggttgtttccagtttctggctattataaatatggctgctatgaacatacaagcatgtggccttatcacatgatggagcatcttttgggtatatgcccaagagtggtctagctgggttctctggtagtactatgtgcaactttctgaggaactgccagactgatttccaaaacc

SEQ ID NO: 3685 - DNA, 1000 bp, mus musculus
atttaaaaatcttaaatacatttaatatttcttctctttgtgaaagaatggatggaatccatatttttttatgagagttatgttgctagcactgtttagaaatggagactgaaaagcaatttagcttaacatcaatgtgtatttgcataccactatacaatctcacttaggtgacacagccagagtagtcaagctcgtagagagagaaggatgctgcttacagagctgggaggtcgggagaaatcgacactcaatatttactgcatcagctttctgttcttttacttttatttatttagctttttacttttaatttcttacagtccactagttatcctcctctcggtctgccctccaacagttccttatcctactcctcctcccccccccctgaacctccccccacctctcccatggctttcacacaattcctggctgcagcacagaccataaacacggttcagagctgcagtaggaccacggatccagacaaggacctccgatacagccaggaccatggatatcagcatgacctcaggtggcagtgtactagatcattatggcccctggcagaagcacaccccactacatcgccatggcttcaggttgtagcacagaccatggacatcctcacggtctttggcagtaacacaggtattaacccagaacctggctgcagtaggaccacagaccatgatgtggtcctcagtggcatcatgggacagacatcaccatggcatcaggtgacagcacagggcattcacatcaatgtgatccccagtagcagaatgtcccacagatatcaatatggcttcacctgcagcacaggtcacagattctgcatagcccagggtggtaacatgggccacagaccattacaaggtctctgatgtggtgggcgtggcctggtggctggctcggtagaatttcagtaaggttgaaaataaatttgtgtgcacatgtatgtgcagtaatttgtgaggtatatttttacacattt

SEQ ID NO: 3686 - DNA, 1000 bp, mus musculus
cctatggtctagcccagactgtgaagccaaactagacagtaatgaacagccatgcccataacttaacctcccatcatgagcagctgcagttacaaaattaccattttcatgatttagccatgctagcaactcccatgtttttacctccagtacaaagctgtctcctgcgtttaggacacctcattggcaagtgtctatgtgacctccttatgtaggtgttgtgacaggctttgttgtacttctctcatacccaccatgcaacagatacatcaaacaacaaattccagtaatttacagtgtagacttatttagagatagggtctttacaaagggaaccaagttaaaacaaggtccttgggctagatcctaactaacatgaccagctttcttgtagaaaaagaaagtgtaggtacagagatagtcacacgtgtaaaaaagattatgcccattgtcagggttcttgcatctgttgtttctgctaggtttttcctaggttttctaggtttttccatctccaggaccccctcagattgtgttttctttattgcttctatttgcattctcagatcttgaacagtgttatttatttccttcaccatctaactggcacgatgcagccaataataacagcaaaaaagattgctagcaattgccagaagatgggaccaattctttcctagggttagctactagtagagacagacagacagacagacagacagacagacacacacacacacacacacacacgaaggggggcaatttatcatacagacatatttatttcaacttctagcttttataactgtaagataataaatttctattttaagcctgtcttgctgggtatttgataacatctctgaaaaatcaaaaacagatgccaaaaaagcatttgaaccctaacatggttccagccccacccttcttcccatttttctctgttgtgggaacttcctctgctatttactgacatcaaacaatttagggtcatcctcta

SEQ ID NO: 3687 - DNA, 1400 bp, mus musculus
ttttaggaagcattttcacatatatgtctcttgcccagttgcatgcaattctctatggtacaccgttaatgatggatgttctgagttgtcaggagtgtatcttcagatttactcagtagcacaaatgcctctattagtggcaccagtgttgaaaatttgcactcacaatgtcgcaagaatgcgtgtttgtggggcggttggctgtgcacagacagcctagtcccctgttgagcaaaggtctggaaccccggtgacctggtgggcggtgatttctgcctgcatgagacagaaggtgttcagccacgcctcctggactcccccacctcctgttgcagctgcagcctcctacaacccccccacccccagaattatgtggccatcagtcatgtaggagcagcaccaagccctcccaaatgtaaataaggtttctccaaagctctcaggccagaccagagagaagtacctgtcgtcaaacccttacccacctcaaaactgtatgtaggattcctatccggaaggattaaaggtgtgcaagaactactctgtcgtcccgagccttctgaacaagagctataacacttgagaagtgatttgctcttccgatgtgcctcctgaagctctgctgcactcctcactggctagttggcctttagtcggttttggtcggcccagcccgacccaactcagtgcagggctgctcagagtagcccagtaaccaggaaggagacggaggtggagccaactgcagcagcagaagctgcagaagcaacctctcttccctgcccacacttgcttcccttcgcaggaactcccgcaccaggccaagccagacacctccatcgaaagcctctggtgcataggcccacacatagactgatgtatgactgcaatatcagactgctctaagtcgtctcatctgatgagacacacgcaccacctaccgctgttttagcttgcgtttttctaattactaaaaacacaggatgattttctttattaagcatgcagaactcgcctattgtgattcactgttgctccttttccattggatcatggttggccgtagtgatttagagtaaatatagatggaggttctgagaatcaaacctggagcacgccagacaagcattctcgctgagctatatcttcagcccaagtattctgggtagcaacagtaataatggtcagtattttgagagttctcactgaatgcaatctcatagcatctcatagcatcatagcatcgcagcactgtcaacctaacctcttttataaaaatacaaaaattaagaatctagaggctaaatagcttgcctaaagtcacatgacagctacgaggcgatggagtcatgacttagacccagctgttctaagcaaagtgctaatcttctgccactcac

SEQ ID NO: 3688 - DNA, 1000 bp, mus musculus
gaatcctagaggacagacgccatctttaaataacaacaagaagcttaaacaaaacacttagcaaaacgttacaaaaaaaatgaatactggaattgtgttgagtcaagcaatatgaacagtttaatgtactttgctgtgaaggtttgaatctgaaatgatcccttccagctcatatgtttgaaaatctggtctcaactcttggtgttgttttatcagtctgcggaccctttgagatacagagcttcaccggcagaagaaggtcaatatgggcgaggcttcaaaggttaagccagattttgggttgagcttatgcttgctgcctcttggtctgcttcatgtgaatgagccaccactgcatattcagccactgtggatggaagccgcgccttccctgttatggctgtatcctctaaagctgagccaaaacaaaatgacttttccttccttgggtggcaatagcacaaaaatgacagtacccctttccggtaaggttttgtttgtttttgttttttgttttgagatagaatctcatgcaggccaggcttactttgaatttgctaggtagctatgtagaggctaaccttgaactcagggtccttctcactcttcctctcattggaattcatgtttacaccaccacttctggttgcactggatcccccataagccaggatgcgaaggctctgacgcccatctgtaatacctttgagagatggtaatggtggaagtttgaagaggttgaccctgtgaagaaagtgcagttgttgactatgcctttgaaaagatattggaactgcggctccttttcttccaatttccatcgtagccaccgttctaggagcaccgtactctcaccttgactttctgccttacagagtccacagcactggagctgagcaacaatagatgggaagccctgaaaccacggaccaaaatcaaccttttctccttggagttgcttatctctggtgttttgtcacatagtgagaaactggctaac

SEQ ID NO: 3689 - DNA, 1000 bp, mus musculus
ggtatgtactcactaataagtgaatattagccaaaaaaagtaaagactacccaggatacaatccacaggactcaagaaggttaataagccaaagggccctagtgaggatgcttcaatcctatttgggagggggaagtaagcagtcactgggggcagggttgggaggacagaaggaggaacaagggaggaagaggaaaaagggggaacaagatcgggtattgggaggggaaatatgagtgaagccctgaggattagcattatgaacgggaacaggtaaccttgggaggtgtgtgtgtgtgtgtgtgtgtgtgtgtgtgtgtgtgtagcctctagaatgtgccagagatctgggagatgagagactctcaggactcaaagggagggaccttagatgaaatgcccaatggtagggagagggaacttgtagagtccatctccagtagaaagacagggcatcaagtagagggatggggttgccatcccatggtcaaaaactctgacccagaattgttcctgtctaaaagaactgcagggacaaaagtggagaagagactgagggaacggaggttcagtgaccaacccaaattgggatccatctcaaggagaggttccaaggcctgacactattactgatgctatggtatcttacagacaggagcctaacatgactgcccttcaagaggcccaacagattgagacagatgcagatacacccaataaatgcactgaaatcagaggaaagcctggaagaagttgtggaggagggtgaccccataggaagaccagcagtctcaagttacctggacccctgagagctatcagacactgagccaccaactaggtagcatacactagctggtacgagacccccaacacatatacagcagaggactgtctggtctagcctcagtgagagaagatgcacctaaccctggacttgagactccagggcgtggggagacctggcagggtgggagtggggatatcctcttggagatgg

SEQ ID NO: 3690 - DNA, 1000 bp, mus musculus
tggttgctaggaattgaactcaggacctctggaagagcagtgagtgctcctaaccactgagccatctctccagcccatattaaaaatcctcttaaaagatttttatttttaattcaggaaggggcaagacctcatgagtctctcttcttccgtgacagtgttggcttgcccagtcctatgccagccttgcacaggtgaccacactgctgagagttcaagtgcaacagcatccagaagtcagcattccacagcttttcacccttccctctcacacctacatgtattcactcttgcatggtgttccctgatccgtaaggaggtgatggagatattccatctacgactgagaattcagcaactgcactttcggcacttggacatccattatgagtctgtgcaataaccactgcccactacaaaaagaagcttctctgaccacagattgcagcaggacgattctgataacttaaatttcagtatgtagaaggtagttgaacagacacatcctgtcagttatcaaaacagcattagcatcttcctcactaaggtttatagaattgctggccatgagttattggcaaggtttatagatctacactcaaattccctcatgtgagcattcctgaagtctgataaaaagccattggttgcctgtctgaaagccatgccacccttgtgccagtgagtcttgtctagcaagccattagattagcacagagggttgttggtccgtaacccagaaaagatttgaccagagccatctcatgccagcccacatagctctgctggcactttaagggcggtccttcaggagggaccctcccgctcagtgtcagtttcattcctctgtgttttaagcccacaatagtatgctgtctttatcaagagtcttccagtctagttctgctgacaaccagcaggaataaccatgtcctttgttctggggatctcaggagcctgctgctgaggttttagttaataaccttatgttttctgggag

SEQ ID NO: 3691 - DNA, 1400 bp, mus musculus
tggtcttctcattgtgtcctggatttcctggatgttttggtttagaaaccttttgcattttgcatttactttgactgttgtgtcaatgttttctatggtatcttctgaacctgagattctctcttctatttcttgtattttgttggtgatgcttgcatccatgactactgatctctttcctaggtttcctatctctagggttgtctctccttgttatttctttattgattctatttccatttttagatcctgggtcattttgttcaattccttcacctttttggttgtgttttcctgtaattctttaagggctacctgtttaccagtgttctcctgtatttctttaagggagttatatatgtctttcttaaagtcttctatcatcatcatgaaatgtgatttttaaataaaaggcttgcttttatggtatgttgaggtatccagggcttgctgtggtggaagaactgggttctgatgattccaagtagttttggtttctgttgtttatgttctttcccttgcctctccccatctggctatctgtgtgtacagggtgttgctgtctctgactgtggcttgtccctcctgcaagcctgtgtgtcagtacttctgggagaccagttctctctgggaggaatttgggtatggagatctgtgtcacaggatcagctccaggtgcagacagaaacttgaaggatcttgtgtcctgactgttctgggtggttccctcttgggctaggaatttgagcagaagtggtggggttacctgtgctcacaggcttttcagcacttcttggagaccagctctcttctggtgggcagtatgaagtactgtgtcagggaatcatctctgggcaatatggcacaggatcagctcctggtgcaaagggaaaccccagatggaggaatttaagactctgagctctccacagtgcgtggccagccttacgtttgaaccatgtgtgtggttaatgcttatccacccatgttttattcaaccatagtggtacccagaagctatactctccaggctgtgatgggggtgagaagattgatgagatttgcttatactccctcttatcattgacatctcagcacactctctcctctgacataagttctgtgctatgagccagacagttcagcaggtgactacacctacatccactgggaccccaataatcaatgattcccacatcaataaattctcttcctattagtgtcttctactgcctccttttgatgggctcatatcatagtatcctggggaagttttggctacattggagaaaaaaaacagacaatgtttgtacaaatggaaccatttttcttcattggttatttgtctattcttctcgctgatagaactgttttaaaggcaaggctgcaaacaacacaag

SEQ ID NO: 3692 - DNA, 1000 bp, mus musculus
acgcaagtagaccttgccttgtaaaagcccgattcagatttcaaataatttgattttactttttgttaaaatagccttcatctccttgctcctgagagctaatgttggatctctccagatgggggccttagggggtgggcagaaactactctgggggcagggtacattgtgccctctgctggggagccaacctctagagcagctggggtcaagagcccattccaaggaagttaaaggagaaatcggtttccaaagtgaaaatctctattccaaacgtggtctcactctcatctctctgagtgcttcattaaaccagaactcacctgcagccttcctcacaaaacgtgtctgcctgccatgcaaagtgatagcagaaatgatgaacacattacaagtttgtagaccctaaaattaaactccacctcatttatttcatatttcagcagagcaggggaagcctggcaaagaggcacaaatccttcctggtgagtctgctgtttctacactggtaagggatttgtgctctctggtgtatcctcagttttcctgaaggcccagctctgcttgcgaataggaggcaggtggcagtattatgtatgaggagaggagtcaggaaccccaggtctagggagatgccagtgctatcttaccaatcttagccccctctatgtctggatagcatttagatcagtgctactaactgtggttagaggccagcttcagcaccacttttgcatcaatagaaagccataaacctaagcctcatcccagatcctttgaagcaagatcttcatgttaatacaagaactcatagtctatagaggtgtcacactttcagctgcaccactatagacatttgagatcaagcacaagcacacagagtacagaactttacagacaggaccttcacccagttcctcagttaagatgatgaagacccagagacaaacacagctgcatacacattttatacagcagagtatgttttatagacctcagt

SEQ ID NO: 3693 - DNA, 1200 bp, mus musculus
tctcttattaatgattctaaaaaataaaatctctgtagctatcagcaatacaatgataacttgcagtgtcctgttggcttcaataaaaggggggagcggaagcggttcaagttgccttggaggggactacataaagcagtataaaatgtatatttttccacatagaaaataaaaggcatgtaataaaatatatgcagtctccccacttctaattcccaaaggaggcactagtatttgggataccactgtgcactacattgtaaagacaaatttaagcacttgttcattcttcaaccatgaggagacaaaaaggtaagtaggaaggtgctaggctgtcaggaggaaccacacagaaaggaagttcaaacacggctatgttcctcctgaacccagcagaggccaccaagggccccagagggctctccatgccacaggacctcaggatcacctcaggatcatgggttagtgaaacataacatcagctccaaagaatcaaggagggtcttgtgtcagcaggaacagggacaaaggaacactgcccgaccagaggctgggatccaccctggtcaggtccagccctgccatcctcctcctgaaccctgttgagggccccagaggactctccacaccgcaggacccctagcactctcaggacctcgtgatcattgcagagcacgtgggcaacagaagcaacggagcttcttggacagggttcctttagacctccatcttcagcctggaggcagagctgagacccaaccccctgggcaccttccttgcagaggagagtctgcctacagggagggctctgatcctaggactcaggaggtggatcagagctccagacttctgaacacctgccctgtaagaggagagcttgcctgcagagagtgctctgaccactgtgactcctgtgagagttggactcccaggagagttgacagaggctaacagaatcaatcacaggaggaacaagctccagccagagacagctagaagattaacatcagagattaccagatggcgaaaggcaaacataggaatgttactaacagaaatcaagaacactgagtatcatcagaatccagtatgcccaccacagcgagtcctggataccccaacacacccaaaaagggagactcagatttaaaatcatatctcatgatgggggtagaagattttaagaagggcagtaataac

SEQ ID NO: 3694 - DNA, 1000 bp, mus musculus
tcagtcaacacctcatagcctgatttcagcaagcttgcagcctcacctccagcaagcgcgggtggcagaaattaatcaatatgaagaagcgtattcagtatatattgtggctttggtctgatttgggaataaggtgtgctttgagggctggatagtcaatgaagggcaaccagatttcggagccatatcaatctaagagagaggtatatgccaagaggccgtggtttgttaataatacaccacagagccatgtttgtgcaaaataaacacaaacaagctgcgtatattctcctttatggatatgaatggcttgggaaaatctgagatcctaagacaggcacagccaccacccaccataactcccaggcaggactatggagcataaataaatcttatgtctcagtctagctatttttattatataatttgggaggaattgtagcctgccccagtctgaagcaggctggtacaaaccttgtcaccactgaggtggggacacctgtggtgcagctttccgacctggctggctcctttttgaagtgacaactgccctgctcttctgctacctgacgagacgctgaacctgtctttctgagacattcctgaataagcaaccagcctggtgaccaagtgctgacagaatggctccaggcaccaagagtggactggtggggtggggtggggttggccttcctccttgtaagcacggtctcttagtaaacttatgggccttgaacagaaaatgtgttttggtcttcattaatttctctcacagtctaagtctctttcagcctcagcctgcctcccaggtgtactcggttcgtgtacgctgtgggccggcataaagcaaaagcccaggaccagatgggtttagtgtagagttctataaaactttcaaagaagacaatttccaatactctcatactatcccacaaaatagaaaaagaaggtactctacacaattcattctatgaagccacatttactctgatacctaaac

SEQ ID NO: 3695 - DNA, 1400 bp, mus musculus
atggagctctgaaccagcagcgtctcttccaaaaatcctttgccgtttctcagtcccacattggttcgccaattgttgtgtccggccagcagaccacaacctgggttctagcctggaaaggcattttggaaacctggaagagaagaggggctaggtggcgagagaaaggaatgtagccaatacagttattctgatcaaggctcaaattttattgttgcgacactagttatgaaggaagggggaggggacccgattccctccgaataatctctggtccagtagaaaggtgctcgtgtgtggctccgcaggttccagcagtgggcgtggcagaacgaatgagcaggaagttccacccctgagcaagcaggtttcaggctgggggaggggagactacataaggccatgtccctggacatcagctcagactaagtacatttacctcactattgatggtaacaaatctctgctgctataaggccacagacccagatgtaggccctggtggcagcacaggccagaaccccaccatgatccaaggtggcatcactggctatacatatctggctattcctcactatcctcaaatgtccagtctcttcattgagaaatgaaatgtcattgttctcttcattgtgcccacatccatgttcctccttcttttccatttctccaccacttacttgcttctcttagtgctgcccagagtctctgagaatctgatgacatctcaggatttgtctcgcaatgcatacattatagcactgagcagggatcatcttgggcatgccctacccagacctgtgctgcactggactggtggtcatctccagcttgcttttttcagggaattctagactgctaattacttagatgttcacaggtcagaacactgagtgtagacatagcctttctcctctctgaaacccactgatgcacatgcgacacagcagctatacctgtaatgtttctagaagaaggtaaaatataactttaattgaaataaaattacataactttctttcctctttttctttctccatccctctgtgctaccctcctgctaatgcctacaatactattaaactatcaaattgatagccactttttctttattattaatgcatacatatatgtttatatctatgcaaatacaccagattcttagtttgtaccttatttacttttaatcagtaacaattctgccaagttattccactatattcactataatccatatactcatgggttcctaagcatttattgtttcacacttctttaaaatagaaaaacagtgttgagaagttttgtaacaaaccttcccctgaatatataagatttcagcttatatatttcagcttcattcaacttctgattttacattgttattgtgttctaattga

SEQ ID NO: 3696 - DNA, 1200 bp, mus musculus
actaacagttaaaaaaaattttaaaggtacattgtcagaagctatctaggaaaggcaaatacattttctggagatgtccattttgcatgattttgatgtctaagctcaagatgtattttcacatagtactgttgtgtagatgaattaatgatttcataattcctgaaattgattttatagaactcctaaattgatactagatgagagacaatggaccatgccaggaagcctgttaaggtagaaatgttttagaccctggaaactcgagtacacaacaggaacgataggtgcctccctgctccctgccagattcctagcctagaatatgtaccacactctgcacatctgtcattgtagcctaaaacacagttctccacgctaatgagctacctagaagccctgaggatttagctaataagctccccttcctgggcatttctctttgaaaaagatatttaatctcttgtccactctgagaagttggtatgcatccattttccatgattaacaaccaataaataatttggaaccaaggactgtctctttcattgagaaccaccttggggagcatagagaaagctttttcctacagaacaacaccttaaattttcttttgaaggcccatctgtgcccccagacaaccaccactatctttgccaatgaactaagctagagtgcccatgcccttagtccagggctattcatcatactcagcctgaacacccttgattccactctgaactcctcatgactcagtgatgcctggatgtccaggagtttgggagcactcagtgccagcccatggcccccaacgttttgtttctgacttctctgtatggttcttccgactggaagcccagaagtcagggaaccccaactttgactctacacatctcagaatgtgtttttctatccccatagcagtatgtatatccatgcttccctgaagcctggcacccataggcagaggcttgggataagtgaagttaagcttcccacataaacgcagtcccacaacaagtaatctcaattaaataatagcttcaaatagcgctctgtaaacattctgtgtcacaggttaattgcactaggaaaagagcagacttgaaacaaacgtatgatcaaggaaaacactccttctaggttagttgtgagacaattgtcaagtagctaaaggtcttaagctggaagtggacttga

SEQ ID NO: 3697 - DNA, 1000 bp, mus musculus
gaaagagaaacacttttctagaagacctggccagcaggaaaacagctctgcccaccagaagatctgaatgcagcaaaaatctctgtgaatagaagaagagcaaaatgttgcaaacttgaagagagaggccatattaggtcactaaagtctcccagaagttgttgctggagacaaacctagaagtgtagctttcaggattagaggatataccaaggaaacacttatcaaaaaacaagtttggagctactaaaagaaacaacttttgcattttaaaaactgtcctgatgtaagtctgtctcagtcctgcctcccacccccagcccaggggttctgacacatcaaggatcacagttgcacctgagcttatagtggagccttggctctggcccttcatccactctgtccatacccagaggcagctcaaccccaaggagttctggcacatccaggatcacaggtgtggccctaaccccaaccccaatgcctggcttaactggggtcctgtgggacacagaaatccctgcccagccagaaacacacattccttctggtttttacctgatcccaaaatggagcctgagctctggatctccacatactccacctacacccagaggcagcttgttccccagaagttctgacacatccaggatcacaaatgaagccccaatcttaccccagtacctgaactaaataggaacccccagacaaagtggtcacagatacccgtggccagcctatggcacatattcggctcagtttatacctacaccagggagtggacactggactatggctctctacacaaaagctcaattcccaaaagatctgacacacccactatcacataatcaaaggaacaactagacccccaggaattctgacacaaaaatggtcacaaatcacaggctcagaggagctaaaagctccagtcagagacagcaaggcctgttaacaccagagaaaaacatgtggcaagaggcaaacactaaaacataag

SEQ ID NO: 3698 - DNA, 1000 bp, mus musculus
ccttcctttaaccatactgaaaatttgagacgtttgatccagggcaggtcctgagcagataacactgtctgctgtgagactgagagtgcctgcaacagccaagtcagcacttcacagctttctgcctccagctgcttggtatttagatctttctgcctcctctatagtgattttctctaaaccttgacttttaatgaagctcagggggaaccaagagctatttagtgaggtcctactcaatgtgaggtcccactggatgacataaacgtatcattctaagggctgttcgtctgaccttgcaatccagctctttgtagtccagggggaaaaaaaggttaaaaacaaaaacaaaacaaaacaaaaaacatgctagaaatgccctcaggagccaagattcaaggcagactgtgataactatccagagagaaacatcagagatgctgaggaggagagagaagcattgcttatcacgaccacaatggatggtgaagaggttagctcagggcatttggaaaattctaccagacccctcccctcctggaagagaggtcatggagcaattaggcacctctcccctcctgaagagagaggtttaattgcattcctcagaccatgggggaggggtcactgaccaaccactgaccatcagccaccaggaagtaggggaggcccagagcatatagatacatgctgcaaccactggccacctacagacaagggaagtccttgccacctcattccctaaagaccagtcagtttaaaagtcacactgttctgccagtcacattgtgcctaatggctgctgctctgaaaactgtataaaaactcacgaaacgtggggctgcatgaagctgttctccctcctgtgtgtgcagggcaaccccagcatgctgggacagtcctcttgcttttgcatcattcccctactttgctttgttcactcaaggggtctccggtaagttaaggctcaccagagtcttacaatggagcatacaagctt

SEQ ID NO: 3699 - DNA, 1200 bp, mus musculus
acctggtaatctctggagttagtttttatagttgtctctggttggagcttgttcctcctgtgattctgttagcctctgtcagcagtcctgggagtctagctctcccctgtgtctcagtggtcagagtactctctgcaggcaagctctcctcttgcagggaaagtgcacagatatctggtgttcggacctgcctcctggctgaagatgaaggcccaaaacagcgcttgtcccagaagctgtgtagcttctgtagtcctcactctcacctgtgcagactagtctctgagaaatccgggacccaatatggctccccaacctgctccagcagagccctcctgggtggatacctctcctctggcagagaaggtgcccagatttctggagcctgaaatggggtctgtcccagaagctgtgtctcttctgcctgtcccagaagatgtgttgcttctgtagtctgcactctcacctgtgtagactagtttctaagggatccaggacccaagttggctcccccacctgccataattttgaagtcttaccattttctgtaaactgcctttcaagtttttaatacacaatctgtgattaaaactttccttttaagatagcattggggaatcagaaaaccggcttgatctggggcacaagtcccttccagttggcgccagcactgggtcaccttggccacggagtcagcagacacccacgtggtccctagaggactctccacatgttcttaggatcactggtgagtggaatacaacagcagttccaatccaatcgtgacgggcctgtggcagcaggaacaaggacaccggagcccttcctgaccagaagctcagataccttttgatcagttctcatttaccttggtttcgaacagaccagacagctccacggtcctcaaaggagacaccatttccaggcactgtaacacggccaggatcttaggacagcaggatcccaggataacaggagctgggtcacaccagtatttcaggagcttgactgccaagaactctgacacacccagaatctcaggtttacaggagcccaaaatcaaaggatcacagagaaagctgaactccgaggagttctgaatcaactgagattataggaaggacaggcatcaatcagatatattgaggacaacaagcaattgagataatcagatggcaagaggcaagcataagaacagaa

SEQ ID NO: 3700 - DNA, 1000 bp, mus musculus
cattagagcagtaagccatacattctagtatccatgttcttttcttgttagtttttgaaagtttagagactatgtttattcattgtaattttacattttctttatttttttcaaattagattaaaatattggagcaggaaaatgaacatctgaatcaaacagtgtcttccttacggcagcgctcccagattagtgctgaggcgagagtgaaagacattgaaaaagaaaataaaattctccatgaatctatcaaagaaacatgtggaaaactaagcaagattgaatttgaaaaaagacaaatgaaaaaggaattagagctttataaagagaaaggagagcgagcagaagaacttgaaaacgagttgaatcatcttggaaaggagaatgaattgttgcagaaaaagataacgaatttaaagattacgtgtgaaaaacttgagacattagaacaggaaaattcagagctagaaagagaaaataggaaatttaaaaaaactttggacagctttaaaaaccttacttttcagttagaatctctagaaaaagagaattcccaactcgatgaagaaaacttagaactgcgaaggagcgtggagtctctgaagtgtgcgagcatgagaatggcccagctccagctagagaacaaggagctggagagtgagaaggagcagctgaggaagggcttggagctcatgagagcctctttcaagaagacagaacgcttggaagttagctaccaggggctagacacagaaaatcaaagactacaaaaagctctagaaaatagcaataaaaaaatccaacagttagagagtgagctacaagacttagagatggaaaatcaaacattacaaaaaagcctagaggaactgaaaatatctagcaaaagactggaacaactagaaaaagaaaacaagtcattagagcaagagacatctcaacttgaaaaggacaaaaaacaattggagaaggaaaataaacgactccgacaacaagcaga

SEQ ID NO: 3701 - DNA, 1000 bp, mus musculus
aacccacctactccctcttcctggtccagacattcccctatactggggcatagatccttcacaggaccaaggccctctcctcccattgatggccaactaggccatcctctgctacatatgcagctaaagccatgagtctctccgtgagttttctttgattggtggtttagtcccaagaggtcgggggttactggttagttcatattgtttttcctcctgtggggctacaaaccccttcagctccttgggtgctttctctagctccttcattggggacactgtgctccatctaatggatggctgtgagcatccacttctgtattagtcaggcactggcagagcctcgcaggagacagctatatcagtcttctttcagcaagctcttgttggcatctgcaatagtgtctgggtttggtggctgtttatggggtggatccccaggtggggcagtttctggatggtcatgccttcagtctgtgcccgaaacttgtctctgtaactccttccatgggaattttgtttccccttctaagaaggattgaagtgtccacactttcgtcttccttcttcttgagtttcatgggttttgcaaattgtatcttggttattctgaccttctgggctaatatccatttatcagagagtgcatatcatgtgtgttctattgtgattgggttacctcacttaggatgatatccttcagatccatctatttgtctaagaatttcataaattcattgtttttattggctgagtagtactacattctgtatccattcctctgttgagggacatctgtgttctttccagcttctggctattataaataaggctgctatgaacatagtagagcatgagtccttattacaagttggagcatcttctgggtatatgcccaggagtggtatagctaggtcctcaggtagtactatgtcaattttctgaggaaccaccaaactgatttccagagtggttgtacaagcttgcaattccaccagca

SEQ ID NO: 3702 - DNA, 1000 bp, mus musculus; identical to SEQ ID NO: 3701

SEQ ID NO: 3703 - DNA, 1000 bp, mus musculus
ctatagtggtacatacctttaattccagcattcaggaggcagaggcaggttcaagaccagcctggtctacaaagagagttacaaggcagccagggttatcacccagagaaaccctgtgtgactggggaggcagggaggagtatgggactggggatgttgttttgcatgaataaaataatctaggcagttatactaagtgaatcgagatctgagaaataatttggtctcatttgagacttgccaggtttgataaagcggattctaaaatgtaatgaaagccaaagagtaaagttaaggggacagaactcttgggaagtgactcagcagtacagccagactgccatccccataaacaaatggagaggattctggaaaccacatccaacaaacaagcattggcacaggatacttagagcaatgactcaggacttcctgaggctgtctgcagagctacttctctgtcccatggatgtgatgccccaaaccaaagatttcagtgtgtctctggcgcggacactctccatagtgtcaggatggttttccctttaggatctcagcagcattggctcttgcagaagtttctgggagggtggagatctagaggcacaggcaagccccaccctgtggcctcagacaatttgtctctccaaggactggtgctgctagggacctccttagtgtcatggagcccccacagctgcttttctacatgtatggccagaaggggagcgccctcgggtagggcagaaagactcctgccccagtcccggggtcccaatcctgggccctattccaacctgcaccctgctttctctgaaaccttagcatgtggtctcactatgggtcctcagcataggaatctgcattataaaccttggcaagtctcaaaggagatcaaattatttttcagaccttttgcatcatgaccagggccttttccttccctcccttaaagcgcccactgataacatcttccagcacaattgggtaagcagcctca

SEQ ID NO: 3704 - DNA, 1000 bp, mus musculus
aaacaaaaccagtctgcttttgcttagcaccttgctgctgttgccctggaagtctcgtgaccagcagagggcaggccatggccatggtgctgcacagcctctggactcaggctgttggtgtggctgcagcttccactgatgagtacttactgtctgggggatgtaaatcagcaggcagccagcatgattgccattaagagctagaaaagtgagtttccaagaattcaggagactggcagcctcccacccccagggcattaggagatgaggatgacttgggaaatgaaatcatcctatgttaattgactcctctcaaagcaaccatcattggaatgagtgattcctggatgctgtcttcagcatgctcaccctaatggagacagagacgtgggaaagcagcacctgtgcagactgacaccgcctggggactcagaacaccccctaagagagccaccctgtgtcggagggcaaacaggtctattccagaatgacatgcactaaggctggccagagtagatggcttatcagcataaggctagagagaggttgggccgaacaaggatgccaggccaaaacagccgttccctaagagctgcagagtgggaaagaaaaggctgaaatggacggaggagtcattgtacagtccatgcagcactgagagtttagaaggaaaggaaggattgcacgattttgaggcaattagcagagccttagatgctgcactcagaggcaccacatagctctgttgtacccatggtgtctattaggtctggttaacaaggacatctagcaaccatcaaaacagagcttctatgcccaatggtggcagaaaaggtcgttcaaaccaatcccagcactgaggatagctttagagtctaggcaaggacctcacaactgcctactgtagctccagtggatccaaagccttcttctggcccctgtgggtgctcacacatatgtgtacatatcaacacacacacacaataaaattaacgttgaa

SEQ ID NO: 3705 - DNA, 1000 bp, mus musculus
tttcacatatttacaacttttatttttctgtagcttaaaatgaggcctcagtgaagttatattttaaacatttttatttttaaaaaaaaatgcacaggtatgacctactcactcaaccacacttcccctcccctagcccctccccttaggaatgtatatgacagatacaaaatacaaagagattctactaagaactctaatggcgcaactacacctattgtactccaatgaacaaagcgaatcctaaaatagaaacatctgttaagcgccaggcactcaagctcacagaaacggaacgatgggcagagccatgctgatgaaaaggagggcccgtgggtgaaggacgtgaaaggaaagaacatctacagccccggtttgttgtagaaaggacagggaaagctgagggttcattagaaaaggaagggaaagacctgaagacagcaagagtctttgaaacaattgaggctgcattggaaccttatataggcgattcccgtggagcaagagagagagagggcacacaagagctcctaggtcagggtgaccctggctgaactcagaaaagacagctcacgtgggttgtgcaatgtgtctttccatcgttcagaacagtcggaaccagtcagggccagtggtctgctgctcaggcagggtaatccactcaaagtagtccagctagaaaggttgggaaaaggtaactatttaagataagctacttgtgtcccagtagtgccgcttcttatctaatagacatcactcctgcctagtcactggagcacagggataaaagctcctctttgaaggaggcagggcctttgccaccggcaaaatgttccccagcatcttggtcaacaggtcagcagagaggacaggttgacagagcactctctggtctacttggttcctagccagtatgtgagtaaaggtggctagctagtacacttgactcagcaagtcttcatggacgcattctgtattaggaatccagaacaagtttcaa

SEQ ID NO: 3706 - DNA, 1400 bp, mus musculus
tcccagacagaaacccagcactcattgccaattgttctccagctccttcctctgcccttgacaacgattggaatccactcctagcctctgaggatgtgtgtattatggctacacatcataatctttttatataagtaccattcattctcccattttacagacagagaagttgcagttcagagcagtccatgtgctctggtcaaggtcccagaggccggaggtgaagagggtaacgttttctgcactgagcaggaaagaaaggaggaaggccactcactgatagggccctcaggatcacacccttcgttgacatgttccaaggctggtctgggactgaggaggttttccagagagaaggggagaccattttggcaatactacaggccccagcaatgggaggccatctttgctgtagtggtagctggcagtccaagaccagagtagcttctgcaatcctgcctatggaggcctctagagcagcagcctctgactgccccctcctctcagtcctgacagctttgctttctggggacgctccacaagcaggctggccaggccactcctcttggagcaggagacctgcttctttctaacacaagccagtggccccaggctgcctgggggctgagggactgagggactgaggaacaattcatgaatggccttggatcagaggtacctggtcccactgagagttgtgtgaaccttttgttcccttcctgggaatgtgggagaagctgggctgacagctgcatgcccactgtgtccttaagccctgggacctttgcctcctctcagagccttacttaggctattaagggacactttctgggccttcatctaggccacagagacttgcagagcctcttgtcttacgtgtgggtttatggtgggtgtttgggtgtgttccttcattgtttctaaaacctagaggctcatggtttctttctcagactcttggtcccccactttcccagcattgccatgtagtaggaaaaacagggctcagagtgactcaacctagcctctgtggaggaccctccccttttgggcattgctttcactcagggtgtggcaccattggtcctgagggtcctcagaagggctatggttgcagcaagcagagagctccagatgggctgtgctgaagcagctgttgacagggttctgctagcccccagggcctctggaactcgatcatgacagcatctgtctgtgtctgctcccaccagatggatgagctgggaggtaaggcatgtggcttcctcctggcaatgtctgtctgtgaatgtgaccctgcagctgtctgcccacctcccccatacttcatctctctagaaggagtttccagcggtaacctgacctcacgggtgagcctactccttggggtcaggactgtg

SEQ ID NO: 3707 - DNA, 1000 bp, mus musculus
tcactgaagggacatgctagacactaccagaaagatccctgctttatattcattcttatgcccccagagcatttaatcaccatgggactgtaaagtcagggggtaactagaggctgtagccacactccatcatgtgacagaatggatgaagtctgactattaccagtgtgaatagagccattttgttggattccatcctggtggaatgaatagcctctgttctgtttattgattacaccctgagtagcgaagcagaggtggtgagcgctgcccaggaaaacactcagatgccattgtgtgcctttcactttggccaggccagataatcagtcagaaatttacttttaaactctaaacaacatgttcgatatccttacatcccacaagaataaaatctcgcagaaatagaaatgtcttaagtcactcatttccaagtccttttcactaaagcccaggctgctaccctgcctagtttacaaccccattgaacttcacctgaggagtggctcttgggtccctgccccctctgctctcttcctactcagtcaatagtattttaagaattctatctgatcatggcactgtcaaacgacttcttattgtactttgaataaaactcaaatccttgtggtcttgctagactagaagccacagagtcctggctaatcatctgaccttgatataacctgtggaggccttctaatcatctgactagctgtcactctgcctagatccctacaaagctgtcacactgctctcttcccgcacctaacaacatacttatttctcttctcctacttacctggaaacctttttcagtaaccttgaaatccttctccctctctgcccccacccccacaccatccctttatttgttccttggagattaagcgccatctctaagtatttgttgtttcatgtgtttatttgctcggtttatgtttttacaaaaccccattcaaaggatgaaggtctcatgatcatcttgcttactgagtag

SEQ ID NO: 3708 - DNA, 1200 bp, mus musculus
tatcctacaggcatttggcaatatctagttcattggtttatgatgaagtgttagagcattgcttgaaccttcttcctcttctctgagtatctatcctgatgacatttgtagtaaccacctccacactttcctttgtaacatttgcatattcacgtcccaaacactatggtttacctgtcctaatctctaaatcaattaaatcacataaaccaaccttattatattaaactactgtaacattgtaatttttattgggtattttctttatttacatttcaaatgttttcccatttccaggtctcccccttagaagccccctccccctccccctccccctgcctctatgagagtactctctcacctactcacccactcctgacttccctccctgtcattcccctatattgggactcaggcccaaagccctctcttcccagtgatgttcaacaaggccaccttctgccacagttgcggccagcaccatgggtccttccatgtgtactctttagttggtggtccagttcctgggagctctctggggtatctggcctgttgacagttgctcccttcatggggctgcaaacccccttagctccttcagtcccttctccaacacttccatcagggacccagcactcaatccaatggttggctctgtatttgtcaggctctggcagagcctctcaggagacagccttatcaggctcctgtcagcatgcacttcctcacccacaatagcatctgcgtttggtgtgtgcatgtgggatggacccctagatggagcagtctctagattgcctttccttcagtctctgctacacactttgaacatttcctcctgtgagcttttgttcactcttctaaaaagaaccgaagcacccacattttggtcttccttcttcttgggtttcatatggtctgtgaattaaattttggatattccgaacttttgggctaattttcacttttcagtgagtgtataccacatcataatttttataatttctacgatactgagtaagtttagtacaaattatataactacaatgctgttaatcgacatcatataaagaattattacttttttaacatttcgcattgatatcctcttttcctgtgaataaacatttttagattttttttttcttcttaactagtatgtcaattctagatttttcttgctttactttactggctaga

SEQ ID NO: 3709 - DNA, 1000 bp, mus musculus
tgtataaagtggcgtgtttgtgtgtgtgtgcatgtgtgtgtgagtgtgtgtgtttagttgtatttccttcagttctttttttattagatattttctttatttacatttgaaatgctatcctgaaagtcccctataccctccccccaccctgctcccctacccacccactcccacttcttggccttgccattcccctgtactggggcatataaagtttgcaagatcaaggtgcctctcttcccaatgatggctgactgggccatcttctgctacatatgcagctagagacacaaggggtactggatagtccctattgttccacctaagggttgcagaccccttcagctccttgggtactttctctagctcctccattggaggccctgtgctccatcttatagatgactgtgagcatccacttctatatttgccaggcactggcatagcctcacacgagatagctctatcagggtcctttcaggaaaatcttgctggcatatgcaatagtgtctgggtttggtggctgattgtgggatggatcctgggaagccaggagacaccatcaggttccctgaagctggagtaatcatcattagcagatcggaactctggtcttcatgattgcacaggaggggctcttaactgctgagccagctttacagcctgaagctattcgtgatagcctcatgatattgggaaatataaccccaaactcagcacttatgattttgcaaagtgcagagctaagaataaaactagtaagtaatggtcattgtgcttcagtgatatatataaactctttttatctcagttaattttcttagtaagtccatgtcagaggcaatattagttttcctcattagcaggtggaaaaactgctgcttaggaaaggtcagtagctctctaaagtcatggctgtcaaggttcaactgaatcacgggagtgatgccttttacacaatgccatattcaaacatttaaccaaattcactgaagtttgt

SEQ ID NO: 3710 - DNA, 1000 bp, mus musculus
caagctaatttgttgaagggcttgtgtccagtgtggcagtggacagaggtagctagaccatgtgatctctagtttctacaatagattaatgtattaacgggttctacttgactggactgttgaaaaatgttagaaactatagtatctatgggcaaaatacagtattagggtggacgcatatgtacctctgagggttaagtctcctctgtgaccttgcctctgctcgggcacttaggagttaggcagctttagtgcaccttatatcagccctgccccatcaggttctacctccacttgagcccacagaaatgggactgagagtttaaagctcctggacagagagcaaagcaaagctttcctttgtaagttgtttttcttcagtattttgtcacattgatggaaagctagcacatgtatacatacctgttttatgggaggggctgcacaataaatctctgccagaatattgctgctccaacacctaatacctgtaaatatcccagtaaatagcactacacatattggaaatataagctctgatgggatgacggatggaagtcaaaaatataaaaatgagagtgaagtagcggaacactgcaccacttcctcgggttggccagcactgtatgcctcacaggcattctaccagaattaaggtgaaaggcagaagaaagtgtgtgtgtgaggaggggtggggggtcagagaaaacagcacaaatgagcctgcaccaggtcaaagcttaaactgtagagttgggctggagtggctgtgttctctttttgtagatgaattcaaaacagtatctctatctagaagtgacaacattgccaagaccacctgggtcagacttggatttctgcctttgatgatctgcatatctttccatacccgtcttactactgtcagtaggataagcatctaagaagatgggttctatttctttgttttctccccacggggtactggtttattagtatattgagtctaaaagtcctatgt

SEQ ID NO: 3711 - DNA, 1000 bp, mus musculus
ctatcaccatctattgtgtgttaacaaatttgctttcaggagctcttgactctagctgcatatgtatcaaaagatggcctagtcagccatcactagaaagagaggcccattggacttgcaaactgtatatgccccagtacaggggaacgccagggccaaaaaatgggaatgggtgggtagggaagtgggtgggtgggtggggtatggggaccttttgggatagcattctaaatgtaattgaggaaaatacgtaataataaataatatatatttttttaaaaagcggaaagagtaaccctcctctttttttttttttttttttttttttggttttttcgagacagggtttctctgtgtagccctggctgtcctggaactcactctgtagaccaggctggtctcgaactcagaattccgcctgcctctgcctcccaagtgctgggattaaaggcgtgtgccaccacgcccggctaagagtaaccctcaaatcggaaaacatactgtaacactcttgaaggagagaaactgaaagtccattacctgtttagcaagctatactcttagggaaaactcgactctaccaaaaggtccaacactatgtggtggtttactgttagactgtaattcaatctccatatttcgctgtaagattgtgcactaaattgcaaaaactgttgattgctagtctcatgcatagcccaaaggtaagtatcacagggaacatttgccaatgtattcttcaaggatatactaacctaaatatcagaagttgtgagacctttttgtttttgttttgtttttagagacaggcattctctgtatagccctggctgtcctggaactcactttgtagaccaggctggccttgaagtcagaaatctgcctgcctctgcctccagagtgctgggattaaaggcgtgccccaccatgcccggcagttgtgagatttttaagtgcataacaaactgctgtgtctcataaactagacactaccaaactt

SEQ ID NO: 3712 - DNA, 1000 bp, mus musculus
aactattgaaatcagaaaaatggaagtcacttatcagtgaggtctcaaggtacacagagtagaatggaggatatcatgcaggcttcgaaggcactgtactctggaaaaccacacaaggtatggaatgctgggcggtcctcagcagctgagaaaagctagtgaacaagcagggttgtcactgatgcagctgaaaggaaattaattctgccaacaaccaatgagactgcaaaggagttctgagtcccagatgaaaattcaacttcgatcagtacattggctgttgggggatgaaattgtgagcaggggccatttagctcacagggtgacttctgacctacaggaatactcaacagggtgccttaaaatcatagactgcctcttctcattgggacccgctttgctggagagatggagcaggtcttcctctggagtgctgtacatctaatctcccatgggggggcctctctgtgctctcagacatggtccccaccaagccaacctgcctcctgagcaagacaaggactctcatccttgtgggacccaaccagagctctctcctcctgcccttttccctttggtccctgggcttaggcctggggtggggttgggggtagggagtgagggctggggggttaggggttagggagaggttggtgagagaggggcagggagggggacaattcattttcagctcttccacaacatccagagacgtttggagtgtccaagagcctgagaacctgtcatactctgtgcaggtctgggacacccaagcagaatctggtagtagagaggcacagtctgaggcctcaggaacctcagactgtgcctcccctccctctggagtggggtgctgaggcttttcacagcccgacaccagtcaaacttgcagtgtcctcctccatgtgcagtcctagccctgtggcagagcagatgccggacaccattttaacccacatacatgacctatttgaggtacagttatttggataataagatc

SEQ ID NO: 3713 - DNA, 1600 bp, mus musculus
ctcaggtgacaacacatgttgaagaggatgtggtgaaagaggaacactcctccattgctggtaggattgcaaactggttcaaccactctgaaaatcaatctagaggttcctcagaaaattggaaatatatctatctgaagacctgttataccactcttgggaatataaccaaaagatgtcccaccatgccagaggggcatgtgttccactatgtttatagcagctatatttgtgatagtcagaagctggaaacaacccaaatgtccaatgacagaagaatggatacagaaaatgtggttcatttaaacaatgaaatattactctgctactaagaacaaggacatcctaagttttgcaggcaaatgatggaactaaaaaatatcagcctgagtgaggtaactcaaacccaaaggtcatgcatggaatgtattcactaatgagtggatattagaaaaaaaaaggtttagaatagccaagatacattctacagaactccaaaagttcagcgagctgaagtacccaagtggagacacttcagtccacttgggagagagctgaaagcaatcacaagtgggaagggagagagggacctgggaggaaaagtgagaaagtgaagtggggaggagaggggaacctggtctgttactgggagagagaaaaggactgaagccctgagggctaacagaaagaatgcaaacaggtaagctcagggagataggaggttagggggaccctccagaatgcactagagacctgggaggtcagagagtctaagaactcaaaggcagggaccttaaaagacatgctagagagtaggaagagggaacttacagagcctacctccagcaggaagacaggacatcaagtgaggaatggtgttgccatcccacagtctcaactctgatccataattgttcctgtctgaaagaattacatggatgaaaatggagaggagcctgtggagaagaaggtccaacaacagacccaaagtggaatccagctcaaggggaggtcccaaagcctgacactattactgaggttatggagcactcacaaaaagggacctagcatgacagcactctggaagacccagcaagcagctgaaagagtcagatgcaaatatttgcacccaaccaatggacagaaactgctgactcctgttgttgaattagggaaggctgaaagaaactgaggagaagggcaaacctgtaggaggaccagcagtctcaattaatctgcacctctgactgagatctctcaaacactggaccaccaatcaggcagcaacaccagctaatatgaggcccccaacacacacacagtaaaggaattctgggtctctgttcattcagagatgatacacatgatgcacctaaccctgaagaaactggaggtctcagggagttcataagcatggtagggttgggagtgtgggcatccatgtagagatgggatggagaggaggtgtgggatgtggaacagttagagggtggatgtgggggagggaataaactatagttaaaaagataaattaattatttatagtataaaaagataaataaataaattaattaattaaaaatagtcaatttttactaca

SEQ ID NO: 3714 - DNA, 1000 bp, mus musculus
ctactaacatttactaggtgtcttagggttttatgactacaaaaagacaccatgacaactcttactaaggacaacatttaattggggatggcttaaagtttcagaggtttagtccattattgttatggcaggaacaatggtggcaaaaaggcagacttggtgctggagaaagagttgagagttctacattttgatcttcaggcagtaggagactttgtgtcacattgggcatagcttgagcataggataactaatttctatgcccccactgagacacactttcttcaacaaagccacacttacaccaacaaggccacaatcctatgggtcaagtattcaaatgcaggagtctatgagggcctttcctattcaaactatagtagatgacataagattgtacatggttcgttttaatgttctgcaacttttaatttttagagtactaaaattgccccactattgacattattttctactttaggtgtttaagattttattaagagaaaatcttctagattctctttactatttttcttgttctgtaagcatgagaaaaatacacatagaattgacaagctacagtgacaatgtgttgcaaagaaagggaggcagtataaaacttgaaacaatccaactgttctttatatgatacaccatttgttcccaatcagaaacattaaatgtctttttttataggtatttatttcatttacaattccaatgttatcccaaaagtcccacacacacttccccacccactccctcacacacccactcccacttcttttctaaggaacagccagactgatttccagagtggttgtacaagcttgcaatcccaccaacaatggaggagcattcctctttctccacatcctctccagcatctgctgtcacatgaatttttgaaattagccattttgactggtgtgaggtggaatctcagggttgttttgatttgcatttccctactgattaaggatgttgaacattttttcag

SEQ ID NO: 3715 - DNA, 1000 bp, mus musculus
ccatatcagacaatatatacttctaagcagtgtgtgtgtgtgtgtgtgtgtgtgtgtgtgtgtgtgtgtgtgtgtatgtgtgtgtgtgtgtgtttatgcttatgttccttccagcttacaggtattattctccatgttaccatctattgaacattataaattttctctgcataaattcactgtagaatacttgaagtaacattagtgtcttatctctctaacagaactactttttaataaatttgaatttaatttagttttcttacttaattgaaaatagtgtttttcatacaatatagatcatttttcaccttcaccaactcttcccaggtttacccctcacctccctaccatcccaacaccatgtcatttatctctctcttggaaaacaaacaaaacaacaatagaagacaagacacacacatacatacaaacaaaacagaaaccaaaatatacaggcaaaagaacaattagacaaaaaaaaaaaaagcccaaagcaaaataaagcaaagcatctataaatattaataccattgagttcactttgtgctaatcaaccactcctgggcatggggatgacaatgatgtgtggttaggcttacccaacgagactccattgaaaaaaaactaagttttccatctccagcccatatcagttccagatagtttctactgtccatctcagaactgggacttgtgcaggccctatgcacactgccaaaggctccctacagaatttttgttgtttgttttgttttgttttgttttgagacagggtttctctatgtagccctggcagtcctggaactcactttgtagaccaggctggccttgaactcagaaactcacctgcctctgcctcctgagtgctgggattaaaggcgtgtgccaccaagcccggtagaattgtttaaagacagagttctttttatgtttttacctaagttattcattgacttcaataatttttgatatatgatagatacatcaacaccttaat

SEQ ID NO: 3716 - DNA, 1400 bp, mus musculus
ctccattaccctcttatttgttttccgtccttttcccttggtttctttccaattgccagttatttccctttctggtttattgttatttgtttgcttgccttattgtgtttgctgacccattgccttttatcagagtttcttacatgattatgagtgagggatcatttataatagtatactctctctacccaagtgtctcagatagttttctgttgctgtgacaagataccctgagaaaaacaactcagggaaagatggctttactttggctcatagttcagactacagtacaatcatggtaagggaatcaaggcaggcagagcataaagcatgtcatcacatcgctcccagagtaaggaagcagaaagcaatagttgtgcttagctgaggtggaaatttctggtatctttggagactttagttgtacaggcgatgtttttctggaagctgtcttatgaaaggatgtttttgctgaagcagacgcatgggaggatgctttcttgagaacagacacgtggtgtttctctggaagcagcctggaaaaggggcatatgatgttttgccagagcagatgcttgacagaacacatgatatttggaaagggtataaatataacccaacagacagtggacaaagctgagtggtattgattccccttgtcactctttgctggtcattgtcagacttcattgagagaaatgcatgaaagaactggtgggattccagtggcttcttgtcacttccatggactcagggagattggcagagcctcaaggatttctggatcaaattgcctttgctgactcgtgaatggtgtttgtgggtggagggaactacagctactgattcctatgaaccgaactacagataccctgacaatgcagattggatactttacaacaagttatttccaagcaggtccacatcctcctttgtcccattaacattttttccactacctctggtgggtggtggcctagaagtgaggttaaagcatgttaagtacacttatgaaagaaggttttgaaaaatataagtctacactcaacccattctctccatttagtacagtacatggtctccacccaggaaatagtttactgcatagctaaaataagtcatcatctctaaccaattaaccttgtcaagacaatcccttgcaggaatggttaggggccgaataatcgcttgcaggtctccctgaaggtgtttctcttaagagattcttgatcctgtggcattggcatctgtcttggttagtttcaggtgctgtgacaaagaacatgactaaaatcaacttagggggcaaagagtttcttttagtttacaatttcacagtacagtccaccactgaggaaagtcagggaggaaaattttggaggtcaagaacctggaatcag

SEQ ID NO: 3717 - DNA, 1200 bp, mus musculus
tatatatatatatatatataatgcgcacacattttcaatatttacctatttgtactaaagttaagatactgagaacaagagaattttgtttctcttgatagtgttatgcccacagaaaattgcacacagtaaatacttattagatgtctgtgaattgacatccccagatcaacagatgttgaagtaatggggctatagaatataatgtgagtgtccaacttgacaaaccaaatccttcttatcacacacagagaagctcagctgagatctgatgagagcctgccagtgtagttgctactgtgcttagtgtaactgagatgatcaaacagtcctttgccccttagaaaatatgtaactcatcatgtctaccctactacccatcccttcacaatgttatctgcagttatatttgacactgtaaaattaatagaccaagtggctctcagaaaagatccagcctgaaaagggagcttcccactatatggtgcacagttagaaacagctggtctgtaggcagggagggatgctgactgcttccgaagcatttgctgtgtcctgttgcccatcctggagcactagcccagctcacccactcttcctggagtgacacatatgcatagcatgtgcctatggctgtacttggttattcaaaacatatctgaagcccacaataacgagcttgtgaatatggaacagaaaagttccagtcaaaaatgaatatgatggaaaaaagtgtgcctttgtgatgtgtcaaaaaagatggagcccttgacttggtgacttagagcactgggaagtccatcattccaaaaagccaagattcctgaactgaacactggccaagcaacataataaactgcctttctcaccaacatacaaaccctctgctttcatataaaattacagttaggtgacaacactgaaggtgagtttttggtggctaatatcttaaccttcatcaaaaatctactatagatcatgttagttggttttctgtgactataacaaatggcaccactacattacggcgggtcttccctcccaggtaagcttccttggactcaccctaacggacatgcccaaaggttgtttcctgaataattctaaaccatgtcaagttcacaatcaagacagacaacacaacaccacccaatgttttaatttccctctgaatgactcaaatacctcccaatcatactc

SEQ ID NO: 3718 - DNA, 1000 bp, mus musculus
tacctcactcaggatgatgccctccaggtccatccatttggctaggaatttcataaattcattctttttaatagctgagtagtactccattgtgtagatgtaccacattttctgtatccattcttctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgcaatcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactgg

SEQ ID NO: 3719 - DNA, 1000 bp, mus musculus
ctacctgtttggttgtgttttcctgtctttctttaaggagttgtaactctttagcagtgttctcctgtattactttaagtgagctattaaagtccttcttgatgtcctctaccattatcatgagatatgcttttaaatctgggtttagtttttggggtgtgttggggtggccaggactgggtgaggtgggagtgctgtgttctgatgacggtgagtggtcttgatttctgttagtaagattcttatgtttgcccttcgccatctggtaatctctggagttagttgttatagttgtctccagttagagcttgtttctttcgtgattctgttagcctctatcagcagatctgggagactagctctctcttgagtttcagtgatcagagcactctctgcaggcaagctctcctcttgcagggaaggtgcacaaatatctggcatttgggcctgcctcctggcagaaggtgaaggtccgaaacagggcctgtctcagaagctgttagcttctgtagtccacactctcacctgcagagactagtcttagagggatctgggaaccaatatggctcccccaggtgctctggcaaagccctcctgggcagggtggacacttctcctctggcagggaaggtgccctgatgtctggagcctgaaattgtgtctgcctcagaagctgtcctctagggatcttgggggtgtctgccaagtctgcacccaaggtaaccaggtgctggtgctgactggaagggacttgtgaccctggtcaggctgggttttctgcttccctaatgctgtcttaggtcctgcacgattggattggaacagaagttgtgttccactcaccagaggtcctaatatcgtgtggagagtcctctagggaccttgggggtgtccactgactgtgtgcccaaggtgacccggtgctggcactgaccggaagggccatctctttctttaggttagggaagttttcttctataatttggttgaagatatttat

SEQ ID NO: 3720 - DNA, 1400 bp, mus musculus
gcagcgtctcaccaatctctccggcacccaaagaggttccgtctggtcctgtggaaacacacaaacagaccctctcgcccacatcaacaccggatctggtgaatccccaggggggatggacacaatacctcgtggtaatgagaccataacctcaatcacctgtgtgtccatctggggagtcaatacgagagtcaagctttcactgctgaggaggcatagggaggaggagcaaaagctaattcgccttcctcctccgcctcagctcttttattttgtcctttctgtccacctgataacactgtgtctcctttctttttcctttttctttttaagcccttctccttttccgacatactttcttgttgctctgtaaggattttctgacctgtcttgactgcctctacacacagtttcaaacagtaacagagtccatatatcagaacaaacaagaccaaaactatcagacctacccacaaagggtcaatgggagaaaaaagcataactacacagcgaggatctattgatcactacactggggttatcacaattccttaacttgtcccaaagccttgaacctaaacttgtccctattatcctcttactttcactttctctcttactttcacttccttgtctccagagccggagagcctatttgtctctttaccgagagccttactgtctctttaccgagagccttactgtctctttaccgagagccttactgtctctttaccgagagccttactgtctctttaccgagagccttactgtctctttaccgagagcctaatcccaatcccgggatactgagttactttgtgcctgcttcctggcaactttatacttgcctctattttatccgaggtccttcccaaactcctgggttactttgtgcctacttcctggcaaatttatgctcacctctattttatccgaggtccttcctaaactcctggggtcgcaagtttcactcaccgtgaacttaccctgccggcaaccactgactgctgaaagttctgaactcggtgggggagtcggttccccgtacgggccaccaattgtcgcgcccactctcaaccagcaagaacgatgcgaccaccagtccttctaacagcagtttattcagtcctcatctttcttctttctcttcatcagtacctttccccagctgaatagttctgaatccacgccggatccttctcaacagtctgtttcacgggaacctttattaaccccttcttccccgttatgcagttctgaatcctccctgtagcagggggtcttcgctcttgcctgaagatgtttcttttcccgggtttcggcaccacttgttgcgcgcgctcaactggccaggaagaacgacgctgctacaggatccttctgcacacatttattca

SEQ ID NO: 3721 - DNA, 1000 bp, mus musculus
actgcgagttcctgggaaggttgccccttggagatacactgggacagggcctccctgcgtggaattgtgagcaaatttttaactatcaactcactgagccttgggacagcagaaaatgcagctaaattacatagtgtgcctctggcatgagaaacaaaccttgggccagaggaaaggcttcaaactcatagtcccatcctctgtctctacagagcagctgtcagctccgattaacttctctgctcgcaaaaatcttcagctctctgaatggttccatcctttcggtcctcctttctgctatggtctgtggcttggctgtttgatgagctgtcacagctggctgatcagaacgctgtccaatcagcttctccagtaacagcctgctgcctgaccttgttctcacattgcctctcccattcctctgatcttgctgcagttcaactcccttcccctgctgtctgatccccttcctgtctaatcagcctgatagacagtttgattacctgctccttcctctcaccctgctggcctccctgctgctaccagctgtactgtggcctgccaggaactcaccatcagttcctctgaccctccattagttctgccggctgatcgactttatacttttttcccccagcaattctgtgatcccctgttgagtccttccactagtgcttctgatcagctgcctgacattttctcctttggttcctattcgattcccttggtgttgatcaaacttgtctggtgttctatagcaggagttttctttcttagtctggcactggggatacccagatggctatctttgacaagtgacaccatctaagcttggccaaactcctcctgctccctccaaatcttcccccagagagtagcatgtggtgttgggatccagatatggccttttgtatccaatgagttatttatacatttaatttgtaattatgcacttttcttggaacaacttgactactgtcgtcttcaagttagttacaga

SEQ ID NO: 3722 - DNA, 1000 bp, mus musculus
tttctctcatgtattacaacttgaacagatatttttccttccttccctcctcccagtccctctcctgtaactttaatttttcagcccttatttttaatgatggttcttaaatgcttaaatctctcttttagcccaccacccatcagaggcagtggaaaagaaagaatatgggggaagtgggcctgtttggaaatgttcttttgagcaactcccatctgtgttttccggaaattggcagttcagttcataggagtcagcagcagcacctctagctgctcacaaatactttatgaacacattgcagatagcaaacagaaatcagcaacagtggcactatataacagaaatagccagggctcagtcttgacatgagtcagcaggagggtcccagagggtctccaggagaactttttagctgtgcctctctcagagaagcaaagatcatagaagctgcaaaacccacaagtgttgtgtagctagctctaccagcaagtcaatcttagcctttcactgtccatcacattctgtttatactccctctaaacatcatgtgtcctccatgggtcttgcctcaccacgtgtcttgcccaggtgacatcactctgccaatcaccctgagtttgcaaaagtggcaagaaattgtagcataccaccagaagatttggtgtgtttctttctatggagtcctgacaaataggactcaattatgcagtataaagtgaactaaaacatgcatatcattaacaaagaatcccttatcatgtgtcctttcatgtgcttgctctagcagaacaacctctctcttgtgtctgcttcggtgaaaatttccttcacaagtctgccttagcctttcacttgtgtccacttcaggaaaacattgtttcatgtgtttgtcccagcaaaatactgtctaacacagctgacttttcaaagaacccttcagtttccacttcattccctcctacatctacttctacttctttccttcctctgcttccct

SEQ ID NO: 3723 - DNA, 1000 bp, mus musculus
ataatacagaactcattctgtctttgccatcagttcccctgactctcgggcagtgacatgtggaatggcgtctctgtctgcagagaaggtcacactggaccaaagggactatgagaagtattcagtgtcctgccaggaggatgtcacctgcccaactgccgaggagaccctgcccattgaactggcgttggaagcacggcagcagaataaatatgagaactacagcaccagcttcttcatcagggacatcagtgagttttgcctgggagcaggtgctagggaagcaaagacgatgtctgccacgtgtccatgataccctggggcataggattggcctgcattcttttccattctcctaaaaagcatgatacagacactaccctcttcatcttacagatgaggaaattaaagggttaagctaacctttttccagatctcaaatctcacagacagcagaccagacccagacctgccccaatggtggcacctaatggattatgggttaactacatgcttagtgtaaagcagaaaccaagcacagggagggttccctgattgctgagcccagatacgagactctattaagcagaatgactcaaccagtagggacttccggtctgtgcagtgcagaaagggttctaaaatgtaggatatggccaataatggtgacttcctcgagtggaaagatcactctcagcagatccctcacaggtgctgccctgatgctcagagaagtgaaagagctattccagagactagaaggtggagggctctgtcagccaagctcaggagcctaagtcctagctccaaagcctggccaggataataaaggatgcttgtcttcttctgcagtcaaaccagacccgcccaagaacttgcagatgaagcctttgaagaactcacaggtggaggtcagctgggagtaccctgactcctggagcactccccattcctacttctccctcaagttctttgttcgaatccagcgcaagaaagaaaa

SEQ ID NO: 3724 - DNA, 1000 bp, mus musculus
aagaaaatgctactacgggtagatttttaactggttgtagaatttcttgaagcagatacatttgacaaaatccagttttagaggacagtttagtactaagaagcttcaaattgaaaatacatcaagaatacagatgatagtgaaatatttggaagttagtttagtgataaacatagtagatctgtttttgtttcacatgtatgttggttacctctatgtatgctggttacctacatataacctggttgcctacaggttatcaaaacttttgtggcttttttttattagatattttctttatttccatttcaaatgttatcccctttcctggcttcccctctgaaaacccctatcccctccctactccccctgctcactaacccacctgctccagcttcctggccctggcattcccctatactggggcatagaactttcacaggaccaagggcctctcctcccattgatgaccaactaggtcatcctctgctacatatgcagctagagccatgagtcacaccatgtgttttctttggtggtttagtcacagggagctctgggggtactggttagttcatattgttgttcctcctatggggctgcaaaccccttcagatccttgggtactttctctagctccttcatttgagatcctgtgcactgtctaatggatgactgtgagcatccacttctgtattagtcaggcactggcagagcctctcaggagacagctatatcaggctcctgtcatctagctcttgttggcatccacaatagtgtctgagtttggtggttgtatatgggatggatcgccaggtagagcagtctctggatggttattccttcagtctctgctccatactttgtctctgtaactccttccatggctattttgttcccccttctaaggaggactgaagtatccacactttggtcttccttcttcttgagtgtcatgtgttttgcaaatggtatcttgggtgttctgagcttctgggct

SEQ ID NO: 3725 - DNA, 1000 bp, mus musculus
agttttcaccaaactcctcccctcaaggctcagtgatctatgcagaggaaagtttgtaagagccagtgattctcagtgattctcgatgactccagagaaagcagtgtgcttcagactcagcgggagtgatgcacacatgaatgcacagagactgtgacagcacacgtgagacctgtgaaggtacaaaccagacaagatcccagcaccaaaaacggaaagaaacacttcctttttctttctttctttgtttctttctttgtttctttctttgcttctttctttctttcttcctttctttctttctttctttctttctttctttctttctttctttctttctttctttctttctttctttctttctttctttcttatttacacctcaaatgctgctccctgtctcagtcacctcttcacagagtcccttccccaaccagaacctcagcccctctttctctgagaaaatgccgaccctgggtgttccccatcccggcacatcaagtctctgccagattagactcatcctctcccactgaggccagaaaaggcagccacagagcctgagctgcacttctgctacatagttgtcagaggacttgttccagcccatgtatgttctttggttgctggctcagtctttgagagctctctagggtccaggacagttgagtctgttggtcttcctttggggttcctgtccccttcggggttttcaatccttcccccatctcttccataagagctccgacctccatgcaatgtttggcagtgggtatctgtgtctgctgggtggagcctctcagaggacagttatgctaaactcctgtctgcaagcatagcagagaatcattaatagtgtcatggattggtgcttacccatgaaacaggtctcaggttgaactggttattggttggacatttcttcagtctctgctccatctttgtccctgcaatttttttagacagaacaaatttggggatgaaaattttatgggtgggc

SEQ ID NO: 3726 - DNA, 1000 bp, mus musculus
ccttttatgaccttcagcatagaaggtaaagtcattttatggggcagacaaatgagccaaccaaaatcatgtcctgcttgcttacaagtcgctgctccagaacttgctaaataaactatttgtgggaagagagtgctgacctccacctacttagtttccttttctggaactacttgtgtcatgcaatgacccctgtcctctcaagaggcaaagccctgtgtcagtcacatccactcaaacctggaagcactgagacatgatttatggcaagaagttctcaacatctcccacgggaccattcagttctctgtacagaatagggaagagtcacaaacatggtggggttggagtgcagggaaagccatagacctccaattctccttcactctcccactgtaattaaacacctattctgaagaagcacgatacacttccctaccaaagagcttccaaaccctgaagaggcagatgtgaattagctggttagaatcctgagatagcagctatcaagtagggatgctctttaacaggtatcaccaaatgagaacaactctaaatcagtattgtactggataccaggaaccagtgagaagacagacagaagttgtaagaaatcactctggcaactgcaggccaaggggtgagacatacagcaggacaggagagctctgggcttgttgccagctttgtttttcacttgccttgtgaccttgggcaagatacacactctctgtggccttagtctccacatgtataagacaacactaatgacaacttctttggatgggtgcagtgactggaaagacaatttatttttaaaaacatccccggtagtgtgtgatagattggagaccagggactctacccaacacagatgcaaactttaaatgtagttcctgccctcattttacaaaaagaaaactgagggtccaggtcactgctcagtgctagcaatttcaccagcatacttacagccttaaataatagaataagtgctcca

SEQ ID NO: 3727 - DNA, 1200 bp, mus musculus
tgtaactctttagcagtgttctcctgtatttctttaagtgagctattaaagtccttcctgatgtcttctaccatcatcatgagatatgcctttaaatccaggtctaggttttcaggtgtgttggggtgcccaggactggcttaagtgggagtgctgggttctgatgaaggtgagtcgtcttggtttctgttaataatgttcttacatttgcctttcgccatctggtaatctctggagttagttgttatagttgtctctggttagtacattttcctctcgtcattctgttaatctctaccagcagacctgggagactagctctctcctgagtttcggtggtcagaccactctctgcaggcaagctcttcctctttcagggaaggtgcagagatatctggcattcgaacttgcctcctggcagaagatgaaggcctgaaatactgcttgtcccagcttctgtagtccacactctcacctgtgcaaactagtctcagtgggatccaggaaccaagatggctccctcaggtgctccagcataaccatcctgggctgggcagacacctctcctctggcagggaaggtgcccagatgtctggagccggaaacagggactgtctcagaagcactgtcgctcccacttgtcccagaagctgttagcttctgtagtccacactctcacctgtgcagactagtcttggtggaatctgggaaccaagatgtcttccaaagatgctccagcagctccttccctgtattcttctcaaagaggaggaatcttgcagtcactatcaggaaaactgtgtgcttttaagacttgtatctacatcatttacaacatcagaattatctgataggggattaaaccttgatccatgggactcaagcaataatcaatctatatacttggggggcttaagtgcaaatactctgttagacttccaatgctagatgaagcaagatttatttttctggtttctcttggaatcggggaagagttatgtagaagttaggccctctactttgggtcatgcaggctaaacccaaagtgagctttaattgcactgaaggcttagattcttctcttaagctctctggccattgacaggactctttcccttgcagctatatatcagtgaccgctttttcctttccagagtttcctgaggaccaccctcaccttttgagccttgccaccaggat

SEQ ID NO: 3728 - DNA, 1000 bp, mus musculus
gtaatttctgctctgccagaggatctgaactgaattcccagcacccatgtccagcagttcacagccatttataattccatttggacaggtgttatggtttgtatatgctcagtccagggagtagcatttttagaaagtgtagccctgttggagtaggtgtggcctcgttggagtaggtgtatcactatgagtatgggctttaagacccttatcctagctgtctggaagccagtattctgctagcagccttcagatgatgatgtagaactctcagctcctcctgcaccatgcctgcatggatgctgccatggtcctaccttgataatggactgagcctctgaagctgcaagccagccctaataaatgttgtcattacaagagttgtcttggttggtggtgtctattcactgcagtaaaaccctaactaagacaacaggtgtctaatacctctgcagacactgcacatatatgcacataacccacagagacacacacatatacataattaatagtaattagtaataatacccttttcaagaaaatggatagaaccagagagcattgtgttaaataaaataaaactaattcttcaaggccatcctggtctacagaatgagttccaggacagcctaggctacagagtgagttccaggacagccagggctacacagagaaacactgtctcgagaaaaaaaaaaaaaactaattcacaaagataaatactgcatgttacccatcatttataaaatctaaaaaccccaaaaagatggaaacagaggggagttataaagaagtggactccagggaaaagatcaaaagagaggaaagaggaaataagtatgatcaaagtacaattataaaagaattacaatgagacaccttattttatagaattgacatgtactaattaaaaaagactaagaaattagttgataaggtaggggtaccagagggatgatgggctaaaagagtcaccgtgagggacttcctggtgtgattg

SEQ ID NO: 3729 - DNA, 1200 bp, mus musculus
ggtgatgtttccaagtatcatctcacacatgtatttaaagatataatacacaggtgtggatactggagacagagcaagagtgtaggaaggatctctccatcatcattgtctcatggttggaaagttattcatagaacaaatgaatgttaatactttgtaacaactgcagaagccagatgaagatacacagtgcctaggtttagtataatggatgattaaagaaaggaagagacagtcagacagacagagacagacagtcacagagacagacagcacccatgaagttcagtgggtagagagatgggaagcatctgggacaagctgaggggaacatgaccaaaatataccatgaaaaatattaatgttttaaaaagggatgcatcaagaaagcaggatggaaagtgttgtccatggacctttgctcctaactgcaagcagcacaggcaaagatggtttccacctagagggaagagaaagaattaaatccagtccttagcctagaaacccaggacagagccaccaaggtgaagcttggtgctgtttggagccctgtgacccttgcatctccagaaaaagcccagagctacattagcacaatgagtgggggacgttgccgtacacttcctaatcttcaacaacagaggcatgacaagaccctgcctgctgggcatagaagctgcatttggctttggagctcagtgcagggctatcatggtgaatcaacaccaagaagatatcaaaggtccctcttagacaagcagtggtctgcaggagagtcttttgacctgcccccaaatcaggcagatatgtacacaactgtaataaaaagtcaagtactagcttgcattcatagccttgaatgggcctctaccctggactacacaggactcggttattataagacttgggcgggcctaggttagcatcagccttggcaggaactgtttccaccaccctcagccagcatactgcagcccagctaaaaacatggactccatcagatggagctatagacttatctcagtgatacgtagaaacctgtgccaatatgggacagattcatagtttgacctgcagtgatgtcagcacactagaaatgaggatggataaagacacttccagactctcagaagttgactaaatatagctccacacaactttcctatataaatgctgaaagttctctgctctccagaaaat

SEQ ID NO: 3730 - DNA, 1000 bp, mus musculus
ggtggctactgtcagctccttctagtcttgatgtcccaaggcctacctggctgggcactacctgtgtcctagtagggctgtgtctctttactcaatagaagttcccactccatatctgagactcaaggatttccctaaaaatgccacccaggggcaggtatttttccagaggccccaagaaggggaacctttgctttttcctgcagtccagccaatgggggccgcacctgctcgggcctggcctatgacttccagctctgcaacccccaggactgtcccaattccctggctgacttccgggaggagcagtgtcagcagtgggacctgtactttgagcacggtgatgtccagcaccactggctgcctcatgagcaccgggatggtgagcttctggggaaatgggtgggagtcagttcaggacactgggcggggcaggcaggggcatgcactgttgtacacctctgatcctgcaggaggcaaatctgtggtgatgcttggaccagaagcagggcgcagtgctggctagtgtggctccagggtcccactcctgagcaagggctctgggctggggacagggcttcagttccaagggaaccagaacaccagatgtggaatgaatgctgggatggaggttcagagggcacaaagtcctacaatacccatgcagggaacaaggctggagttgcatggcacctcaggtgttgggtaggggcagaagttgaccccgtgaggcaattaggtgacttctgataggtaactgagctggtttcttttctgttgctgtgataaagtaccccaacagaaacaacctaagggagaaagggttggttctagctaacagttccaggctacaatctattatagcagggattacattgaggccacgggcacttgatacattcagagtcacgagcagagagaaaaagaatgcatgaatgtgtgcatgcgttcagctctttctctctttgacacaatccagaacccaaacccagggactgac

SEQ ID NO: 3731 - DNA, 1000 bp, mus musculus
gtctgtggtgatctgataggatgcatgggataatttcaatatttttgtatcggttgaggcctgttttgtgaccaattacttactttacatctcaaccacagtttcccctcccttttctctctcccagtccttactccacttcactgaccccacctacccactcctcctcccactctcttcagaaaagaagagcccccctccatggataccaactgtccttggcatatcaagatgcagtaatactaggtgcaacttcccttgatgctagaagaagcatcccagtagggagaaagggtcccagataaggacaacagagtcagaggcagctcctgctcctgctgttaggattcccacatcaagaccaagatgcacaaccattacagtctgcagagggcatagggagtcccatacaggctcctggctggtcgtttggtctctgtgggcctctatgggccaggtcagttgattctgtagattttcttgtgctgcataggattcattatttgtatggctcttttttgttagcttaattgaagcaaagaacacacttacctatgcttgctccttttatactggtcctccttccttatttagttccaaggtggtcccttagaaccacatcacatcacccctttcaaagaacatctgtaccatttcttccaaggcaagtttcctagaaacaaattacctacaattttatttgtaatagcaagtatttatttcttcttttgtccaaatgcttactattcttagaataggttaatagaataaatgatttggagcagtttaactcatagcaacagtgtacagaggcttcccacacagcctctgaccaacgtgtgtacagcctctacaacaagaccacccagagcctgtaggttacactgggcttcactgtctgtttcaagtgtgtttgtaagcacaggtttaaaaaatctttgtcaaaaatcaagtccatcatttttgccactcagtttggggtgttataaataagactata

SEQ ID NO: 3732 - DNA, 1000 bp, mus musculus
gggtaaaacagggaggcattgctgtgggattctcccagacagagaatgtataccactgcatgcttgacttctctccatgggcggacaagggagcgtggagctgctgctggagagagatcaagttctttacctgcaaaaatactggcaaaggacacatggcgggatcgacggcgagtcggtcaagtcagcaggaacaagcctccgccgtcaaaatggcctgagtgcgcgcttgcgtgcgcatgagcatgactggaagcgctttgtgtgcctgtgcctccaattaggctcttatgtggcgccggagcccgtgttatgcaaatgtcagggtgtttgtgtttgggtgtagtgtgtgtgtgtgcacttgagtttggccccttagggctccctatgggaggagtggctttgcccagcattctagagagcacaagtctcttttcaaaaccaacgtgaggggccagcatgggggtcagcagataaaggtgaatctcacagcctggcaagcccataggaactctggcgtcccctgcgttgcccgccctccacatgctaattttaaagattcaatcctggcagaagctctcctggccttgtgaacctggggctattccccctaaagctctctcaggccccacccagtcctgacttctctcttcctgaggaagcccacctctgagtctacctacctcctcctctgtctctcctctcctgaccctgatacctctctataaatcttccggaaacacgcagactaatcgtttacctgggtatccatgctaggctgggggatatttacaggcatgtgcctcaggctcctccctcagggcccagcgttcactgaccctggtgggcacgatgcctttccccttcatgaagtcagaaggcagctttcctcccatgcaagcggtcggtcggtgtatttgcattgcgcgttaggagagtccacagcatcccagctacgggcgggcaggcagctcaaaagagaggatgttcagctcaaaag

SEQ ID NO: 3733 - DNA, 1000 bp, mus musculus
tctagacgtgtggttgactgtgcctcactcacaaggtctggtctccaggacaaacaagcctttcatggtgagactactctacacgcccttaggaagaccttgagaagtagagacaaccgttttttgtcagatttcctggcacccctgttggaaaactgccagagggtggagcctggactggcagagccaggaggtctgttttgttgccaggacccaatagtttctctaacaggggacccaggccacctgtcttaaaatctcagggggtgggagacatctcttgttcccatttgctgatcagcggcgggaacaggtgtttgaaagcataccgtttcccctccccccgggggggggggggcttcttgctcctgggaggcttatctggctgtctgagagggtccagtgccagcccaaggactgagaaacaaagactcgacttacaatttgttacatcctcgttactttctcccgcctgaggcttggcctcttggaaatcatccaggggctcagctgccttctgctgtgatctcagcatccttaacctccagtctttgatctgcatttcctgcttctgatgaaacacaacccgctccccacgccatcgaaagtacagtgcatcttcagccagccgcacaattactcagaagtaccgagtgactcttggaatttattttagccacctgtgtctgtgtgctgctttgtctggctcgagattaaggcttctttttatacctcagactgtgcagtcctttcttttatgcctgcacaacgaccctgtcacccagaccaggcgatgctcaggaatcccagcctgtgaggagacccccagaggtgcaagcttgtgggcggtgggtagggtgggctcccttgcctcttccctcctagagcaagcagtagctctgagccagccccactggtgatgcagagttgggaacactggtaaagtttaatctttggttaaaaacaaacaaacgttaaattaaaaacaaacaaaagttaa

SEQ ID NO: 3734 - DNA, 1000 bp, mus musculus
tttcctacctcagtgtgcggaactggggtaggggtgtattggaagaggggggaggaagagagtgcccgggtccagccagagttcctcctgtgctctgggcaggcagatgcaggaggactgtcagacgctttccacttggccctggatgggcatctggctgtgtgaagccactggaccccactagacagggggtggacaaggggcagctcctgataccaggggccctggggtgacacccttggccacggggatatgggaaagagggcagagggagaaaggttcccacacaggcgagagtccttagtccggaccatggctggagcacaggaaggctttctgacaggagattagaaacggctcattagaagaaagcctatcccatcatccaagcacagtgggccttgatgaaaagagacagtctatggttttagagctttattatagaaaggcagggagaaaggagagaaagtgaagagagagagagagaccggccatggccaagagaagggggaaagagagagagagtaagagagtgaggagagagagagtaagagagcaaggtgggcccaagcagcccctcttatggtgggctgttgctaggtaactggggaggattatagcctgaaggtcagaagcttgggacattgtctctctgactcctaccatgcttttcctgtgggggagggttgtgggggtggtaactttgacaggagccaggggctcaggagatatgaggaaatgcctactgttccatgtaggtgaattatcaccaccgggttctaccagggttcagacctcagctcaactggagaccagactgtctgggcatagcccattgccccacacctcaagcttttgcatatgtatcttcttcagtctgatgtcctctactcaacgtgcttcccaaacagtcctctctcagctttccattctagacttagtcattgttcaggggtattctcttaacctgctaagtctactgccttcatggcaacctcac

SEQ ID NO: 3735 - DNA, 1400 bp, mus musculus
cgtcaagagtacaagataagggcctttccaccggagtctcaaggttttctgcgtggagacgtctaatgtagcaggtcttctttttttgagtaggcctcctggagctgctttttcgctcgctgtctcactcactggagcaccttgagcctagagaacaaaggctgggaaagcagcatgtcagcactatgcacagaggctatttttaccagtggaggggggccccctgtagagtaatttataggggggtcagtctaaactgtccaggggtgtttctatccctgaagagcataaagggtaggagagctatctaatcatagcgccagtctccgctgtcaatttggtaaggatcccttaatggttctattaattttttttacctgtcctgagctttggggcctgcgtgcacaatgtaacttttaaccgatctctaatatcttggccagtccctgatttacctgggcaacaaaggcaggtctattaccttgggaagatttcttttagaaattctacctcatcatagcacagtccttgaagcttttgactatttcctctgccaagtcagagtcctgtaacatagcagtcaaaggacctaaccacacctttgaatttttttggcccccaggccaagtcaaatactgtccataacttgatagtgctcagcgacgtatctaaagctggtctctctgatgtcataataatctttagggctccttgactgccaggatcactgctccttgggcctcctgattggcggttagatctgccacctgaatttttttagccacagcatcttaggtctttttctgtagatgtcaacagccctctttgtatattgccccgtacagtggcaaaagcatacctgttgtcagtgtagacttttctttgccatttatagagcttgtcttaaagtcacaagttcagctttctgggccgacatccctcaggaaggctgctggcctagatcacttgctttctgttcaccaccatactgctgtccccgccttctgcttacctttaacctcgaggctactgtcctcagaccaaggctgatctgatccttcagatcatttcttttgccagaatgtcagcgcagtgatgagtaggtgcagtctcacgcagtgggacagcaggtggaatgaagcgaagatcactcatttagacaacaaaaagctctgatgtgtcacaggagcgttggtaatgctttcaagagtgtgggatgccactacagttatttgctgtctcagagtgagcttatcagcatccttgacaagcagattatggcagcaatagctttcaggcaagaaaaccacccgctggcaacagggtgtaacttcttggataggtaagtcactggcctttttcaaagtcccaaagtctgagtaaggactcctctggtgacc

SEQ ID NO: 3736 - DNA, 1000 bp, mus musculus
tttagaaacaaaaatgaaatggccatatacatttgctcatttaaaccaaacaaaattcttaatttttctagctgtaatttcaaaagaggagcaccttgtcacctgatgaatccaatttttgtaggaaaaacagccatctgttcccttaccatagaactttgagaagctgctggtccctataagaacagcatttataatcagtgcctagcagggcttctctagccacactagattcctaactacaggtgcagggttctaaagaccaattaatactgtttattttattttattttatttttttattaccaaattatctccagatagtcggagagtactgcttttctcaaaacccattttctcacatctcaggtgtaaactatctctagtcagggtataaagcacctatgagaattacctttgtttctctagattttcacatagctctaaacacgtacacaaaaacacataaaacagaaaccaacaaatctagacacactcgaccctttcttgtcctccacaagcaggcaaaagaattagacgatgttggagggggaagcttccgcttcaacagaactcggtccctctgaccgatccggagacggccaggcgtccctgactctccttacctcccagggcgtcccccagggccacagcctgtggtcctcttagcacgtctgccgaccacagtcctccggtccttacggcccaaaaggacagctgcaaatacagacgcgcgcatttcagaaaaccccatcaccccatcgtctacaaacaccgtcgtccacttctacctagacgaccaaaaccagagaatctcacttgtttctcactctgccaggtgtaaaaccaaagcacgaggaggtgggactcgaacccacgatctcgtaaccctgaaaccaaagcacgaggtgggactggaacccacgatctcgcaacccgaaaaccaaggcacgaggtgggactcgaacccacgatctcgtaaccctgaaatcaagacaca

SEQ ID NO: 3737 - DNA, 1000 bp, mus musculus
gggggagatataaacaaggaagatatataaacaagggaaatatagagaaagaagaaacaggactgaataaacgtgtgcagaaggatcctgctgtggcgtcgttcttgctggcgagttgggggcgcgctcgagagttggtgccgaaacccgggacgggacaagaaacatcttcaggcacgagcgaagaccccctgctacagggaggattcagaactgcatcacagggaacagtggtaatgaagtgttcccgtaaaacagactgttgagaaggacccggcgtggattcagaactcttcagctggggaacggtactggtaagtctcccagattgatccccgggttaaagggggatatttttaagagaaagaagaaagatgaagactgaataaactgctgttagaaggactggtggtcgtgtagttcttgctggtcgagagcggacgcgacaattggtggcccgtacggggaaccaactcccccaccgagttcagaactttcagcagtcagtggttgccggcagggtaagttcacggtgagtgaaacttgcgaccccaggagtttgggaaggacctcggataaaatagaggcaagcataaagttgccaggaagcaggcacaaggtaacgaaaggttcccggctttgggacaagttaaggttcccggctttgggacaagttaaggttcccggtttgggggcaagttaaggaactatgataacctcagtgtagtgatcaatagatcctcgctgtgtagttatgcttttttctcccattgaccctttgtgggtaggtctgatagttttggtcttgtttgttctgatatatggactctgttactgtttgaaactgtgtgtagaggcagtcaagacaggtcagaaaatccttacagagcaacaagaaagtatgtcggaaaaggagaagggcttaaaaagaaaaaggaaaaagaaaggagacacagtgttatcaggtggacagaaaggacaggacaacagagttgaggca

SEQ ID NO: 3738 - DNA, 1000 bp, mus musculus
ccatggttgggacaagattctctacaggctcaacaagttccctgccgtttcccatagacagaagccagagtctaggaatcagcaggcagaggcgagaagagtaccgtgcactcttgcctgcactggcccaacctacacagtagttcaggctcatagtcagtagcttagaaggaacactggactcaaaacttgagaccaaacacacttgggaacaggagggttgacacgctgtctggatggtagaaagagataaaggtaattgtgtctcctattaaatgtcatcagaggactctatacgtaaagtacttagcagtgtggcctttttaaagacatggcctcactatggaaccctagttggcctggaccttgcactgtaaaccatgctggtcttgaactcacaaaccacttacctctgcttcccagatgctgggcatacatgtgtgcaccaccacacccagctgctgggaccattgttcatttcccttccccatgacctcacgctccacgggcctagctgacttgtattgagaaggagccacaaccttgagtctgctcagctggagggactgattttatcgtgagcactttgctccttatgactccgaggcagtaggtgggaaggagctacagtgctggtttggctgagagtcatcttgattaccaagaggagcttagattagtcttcagtggaggtaagggaggctgttaatgacttttgtcttgctgtgaccaaataccagaaagaaaccacttaggagaggaaaaatttattttggttcattgtttcagaggtatcagtccttcatggctgtcatggcaatgatggcagatgggagtggctccgtcagtggaggtgagagtgtgaagaggagtcgctgttcacaccgtggcagacctggaacctgagagagaagtgggaaccagggcaggtataaccttccaagacaccccctttctagtctacttctaccagccagactcagcctcccaaaccttccac

SEQ ID NO: 3739 - DNA, 1000 bp, mus musculus
ggtccagcctcaggactgggtctttaactgatgttttctggtttcttgggtgtcacaatctggggtataggttatgttttggtaagcaacatctccaacttgggtgatgttccataagcaaggtgcctatcccatctgtggccacaatcacttctcagaggcgccttcttggaatttgttgatcagtgaggggaaaaaaatagaaaaccaagtgccagctgcaaaaggtagtcagaggtggcatgtcacttctgcagatgtttccttatacggtggccacgtgtatgccagcatatccatggtactctctttttagcatattgtgcttactaccttgtgtctcaaaataatggcaggaattcatttaatacccattatgactactcttgcttcagcctaccctgcacattacagtatagcagatggtaataagccaaaggggcgaccctcgagatgcaccatcttcttacagtcttggagtctttggcagatttggtgaatggccttaaccctgaacactggacacttccctagatgaggctctgactccgcaccctgatagctcctgggccattagtctccaagctcatgtctcttctttaggaacttctcattgtgtttcccaagaagttcggtcttagtgaatagtttggtgatagtgaatcaaagcttttcttatgtatcatgctcagagaacaagcagccctttccctctttcccattcacaactctcaaatgctgcttcttgtctaaaccaggtactaggtaccagctcaaaaaggccatcagagatggcagagcatgtatctccttaggcagtgtcaactagtcttgactggggaagtgagagaatggaagtgtgtattatgtcctgggtgtgtgcatgccaccttaatttgcctgtgttccaaaagaaattaggaagtgaattatgggaaaacagagatgttaccggttagcaaaaccacaggagaaaaggatcagttgattccttcccaca

SEQ ID NO: 3740 - DNA, 1000 bp, mus musculus
cttcaagatgtgggccacacccttccctcaagtccctaacaagcaccactagacctctcctatgatgctttcctaaatatgtattgaccgatgacctcccaagttcatacccctcccctcttgccaattatgttagccactttgtcatagaagccacaagctcgcaagactgtgccctgacctagatatagctctgtgtcaccacccatatagatattctcagtgtataggtcacctgcattgcaaggctggcggccattgcctgcctttctaccatgattaattatgtcaagcctgcctgccaggtggcctcaccttgcacttggagcagtgccacaactcgagtgcccgcagcctcacaagaatagatgccactgtcacagggcagggctggcctgagggtcagcctggctacggtccagtcctgctctatgatgacacggtgcccatcagcgcacacctcccgctcgttcatcttccacgtggcctgcacgggccgcgagtactggcagaggagctcagctgagccaccctcctccaccaccaggtcctgcatggcactcaccacctccactgtgggatctgtcggccaacatggcagacatgcatcagtccctgggacagtgccaccatggcccacccaccttccgctgtctgtgttagtggcttcagctgctgcaagcatggagctttggcaggcaatggcgtagcaacaggtgcctggcctgtggccaggaaggggacccatcatggctgcccaagagccctacatatcagacatgcctcattctgcccatggcagatgacaatgtcaggctgtctgtccaggctgggttcctctagcccaaggtgaacacacaggtcccatcttaaacacacctggactccagatcctgggagtctgaagctgcagcccatcttgcccctctccatgagtgtaaagatgctagctgatacccttgggccccatcccatccccacctgttgaaatcctactcaa

SEQ ID NO: 3741 - DNA, 1000 bp, mus musculus; identical to SEQ ID NO: 3740

SEQ ID NO: 3742 - DNA, 1000 bp, mus musculus
acggaaggaccatgatacaagaggatgtatggaagggccttagggcttctggaccaactggccatgcagtgcctgctagcttcaaaaccagtgttgccttggaaaccattcccaaaggctgtgcttactcagcagtgctttatgagactgtgaaccgacaaaactgctttgaaccagatctctatagaaacacactgatcttcaaaatcctggcttcacagaaagctcaatgactgacctatcagaagccataaaaaggttcatatggagctttagataagggggttctccaacagatcaccccacatttgctcttactttgaatttcggaggaaatgggacttgggtccacttctcagctcagggccatgttaactcatccgtccataaatcctgtgtgactaagtctaccaagaaaaaaaaaaaagcaccgcttcatttaagatttcccacacatggcaacccttggtcttgcagagcccttgcctctccctgcgatgcttattgttttatttgttggttgtttgctgtagtgtcccccacgtgcccagcactgaactgatccctaggtctttgcctgtgttggagacctgggttttcttgtcaaggtgtctcacttgcagcacaggagttgcaacactgtctctgtatgtgtagactattggcttgtccttggtggattttgttagaactggcaacagtgtgttgatagtctaacagagaggaaggaagtgttcgagccatagaaagaacaaagaacagattacagagggatactcacagaaccctgtgtacttcacaagagaaacactaggcctgcgggatgtctcagagggtaaaggccctcgccaccaaacccgacagcctgaatttgatgcctggggcccacttggtggctgaagagagtcaattcccaagtcttctgactctcacatgtgtgtggtggtatgcacacctatgtgtacccaaatacacaataattaaaaaaaaacctttttta

SEQ ID NO: 3743 - DNA, 1000 bp, mus musculus
tgggctcaagttttgcaaagctaagcagtcctgggcaaggtgtggccccttcattgtctgggctccagtctgttctacaaggtgttccaacaagttgcagatcttctggaagacaaatccccttggctgtccccaggcttctgtctttttcttcccccagcatgaaattcctgaagaaatctcaattcctcccgtgccttgatttcacagcctagtgaccaaagtgtagaagacgggactttagaataccctcattcctgctaggtcaggcagttacaggtctctcactggaccttgaactcacagactggccagacagcaagactcctggaatcctgctgtctctggctccccgacactgggataataggaaccaggctccatgtctagtttttatgtgggtgctgggatctgaactcaggtcctcctgcttacacagctggcacttcagggactgagccacctcctcagcctgatcttatcctgtaaaacagcctgttgtattggactctgagtaagccataaaccgacatttgtaggttttttgtttggttatttggtttggttttgagactaggttatgctatgcagcctaggctgttctcagacacctgaactgaaacaatcctcctgtttgagcctcacaactagctggggttctaggtacaccacctgcttggccccatgtttgcttcatttgctctgtgctttaacccagcactgatgagtaaccctaagatttgcctatcggtattccatatggctttgctggccagatctcctgtccatgggcaatgttatagtgaatgagaccagggagagctcaggcttatggaagaagcagaccagggtccacaggctgttagataggcagagtcaggagaggaagaagggccatcaagggcaggtgctacacctgctaagcctctttgaataggtgacatgatttgaacaggcctgagaggagccatgtgaccatgtaagaaggtgaggtgagcta

SEQ ID NO: 3744 - DNA, 1000 bp, mus musculus
atggttttgctcaactccatcacctgtttagttgtgttttcctgtacttctttaaggtatttttgtgtttcctctttaaggacttctacctattttgcagtgttctcccgtatttctttaagtgagttattaatgccattcttaaaatcctctaccagcattatgagatatgattttaaatctgaattttgcttttcgggtgtgttggggtatccaggactgactgaggtggtagtgctgggttctgatgatggtgagcagtctcggtttctgttagtaagatcttacatttgtctttcgccacctggtaatctctggcattagtttttatagttgtcttggctggagtttgttcctcctgtgattctgttagcttctgtcagtattctttggattccagctcgctcctgaatctcagtgtcagcgtactctgcaggcaagctctcctcttgcagggaatgtgcacagaggtcttgcattcagacctgcctcctgactgaaaatgaaggcctgaaacagggctgatcccacaagatgtgttgcctctgcagtctgctgtgttgcctctgcagtctgcgcactcacctgcactggtctccaagggacctgggacacaagatggttctctcacctgctcaggcaatcagagccctcccaggaggccaactctcctctggtggggaaggttcctggatgtttggagcctgaaaaggggtctgtcccagaggctctgtcacttctgcctgtcccagaagctatgctgcttctgcagtcccctagctcaccctctgcagtctgtgagctctcctgtgcagactggtctccgagggacttgggacacaagatccttttttagttttaactcatcttggggttgtttattttttgatggtggacaagtgcttgaaatcaatttgataaagtttaaattctagtttgaagttctgcaccttcagaatagctattctaactgtatggaaattcattacaaacattgggt

SEQ ID NO: 3745 - DNA, 1000 bp, mus musculus
cccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcagaagagatagcatatgtagatggagccatgagttccatcatgtgtattctttggctggtggtttagtccctgggagctctgggggtactggttagttcatattgttgttcctcctatggggctgcaaacccttttgcttcttgagtactttctctagctccttcattgtggaccctgtgctctgtccaatggttggctgtgagcatcacttctgtattttgtcagaaactggcagaacctctcaggagacagctatatcaggctcctgtcagcaaacacttgttggcatcctcagtagtgtgtgggtttggtgattgtatatgggatggatccccaggtggggcagtctctggatggtcattccttcactcttttttcctcaccttgcccgtaaatttcacgatgtcatttttaacagctgagaaatattccattgtgtaaatgttcacttctttatccattctttgattcaatgatgtctattttaccaattttaaaatcagtgtgattgcttcaaatgtttttcatttagcatgatgttagatataggttttttaattcatgaattaattaatttatttcctcattcagtggtcattgagtatagagttgttcaatttccatgagtgttttggatttttgctgtttctgtttttgttaaattccagc

SEQ ID NO: 3746 - DNA, 1400 bp, mus musculus
ataggcaaataatgcctggtctagttatctctaaccataatcacaaactagtattttcatccacttttttcacatttattaagtgttattgatgcacttaataaatgcaattatgtccaaaattgaagagaaatgcaatatatagtcacatgagccttactcatacatgcttataaacctgacagagtgatcaaatatagtaaataaaatgctcatgcaaacagtaatctagtctttaaagcatgagctactgtgatcacatcctgtgacatgggtaaaacagatatcagtccaaccttctacatgatgaagtcaacacttagactcccaacttccttgtcagtctgcctgtgggaactgaatccagagcagtgtgctgtactctgaccacgggagcagaaatgtgttttgaaatcagtagagtccataagttacctccataaactatcagaaggctcccaaggaaagggatttcaacctggaaagatgacaagcagctccttgcaggggtgacattgaagctgagtttcctagtgcttctgacttgggaccacagtatcagctgggcatggtctcacatgagggaggaagaggaagaggggcagtggaagagtttcttcagagcagccttcatgtcccggttcctcaggctgtagatgaaagggttcagcattggggtcactgccgtgtacatcacagttatcaatgcatgcttcagactgtaactggtcaggggccggaaatacatgcccatgactgtcccataatacaaggacaccactgtcaggtgagagccacaggtggacaaggccttcaggaagcccttggtagatggaacccgcaagactgtggaaaagacccggacgtaggagatgatgatgcacagcagtggcacagagaagacccccaccccaaggtacatcatcttcacattgaagcggatgtcagaacaggacagctggagcaaaggtgtaatgtcacagtagaagttggccacatccttattgccacagaaggacagtctagctgtgagtagggtgtggggcagtgcattagcatttgcaatcacccaggacccagcaaccagcaggacacaaagttgtggactcataattgttgcataatgaagtgggcgactgatagccacagctcggtcatatgccattgcagctagtatataactgtctgtatttgccaagcctatcatgaagtacatctgtgccatacatcccccaaaggagatggccttgctacctaggagatggttggccagcatcttgggaatagttacagaggagaagaagatgtcaacaagggagaggttggccaggaaaaagtacatagggttatggaggcgagtgtcagagtgaatggctaggatgatgagcatgttcccaaac

SEQ ID NO: 3747 - DNA, 1200 bp, mus musculus
tgtgtgtgtcctgaagtgattttatttttatttccttcactttaagcctatcattaaatttcacagtgctttccggggtggggtagaaggaaggcattgttcaaaatgttggagactatgggctgattggccggagaaggtgaagcaggggaggcctcactagggaagcttgaggggcacagtctgccccactggcaggtaggtgacattctgagagcgggagagttggtacgcaatgtcctcagcagcctccagcttgcgcagctcgatcaggccatcgcctgctgtggccagcgagttggcgatcagctctgccgccttagcgtccccctcagcagaaatgatggctgccaccttctgctgctcagccttttccaccacaaatctggctgtctccgcttcctgctgagccacctgtttggcttccaccgcctctgtgaactccttcccaaaggtcagatgtgtcagggacacgtcatctaggatgagcccaaatgtggctgctcgctctgtgaggtcatcgctcacctgcctggagaccagttctcgctgggtaatcaattctccagcatcgaagcgagccaccaccgacttgaggatctctgaggtgatagatggcagcacccgctcatcatagtcctggccaatgttggtgtagatatgaggaagctggctggctacgggccggaagaggatacgcagtgtgatgttgacgttctgcaaatctttgctaccagtgatgactggtatattccgtggttgagagcgacagtcaaatataactggtttctgtacccaagggatgagaaagtgagtcccttcccctaccacaatgtcctgtactccatggaatcggtcaaagatgacagctctgtgcccagcatccacgttatataaagcagagctcaccacgcctcctgcaactgctagagccaagccgaactttccgatggactcaaacactttggcagccatgattccttttgttgcattcactcacacctgccttcactcatcttcacatgaattcccctaagggcttcttaacatgcacaaagctctgggttcaacctttagcatcacagaggcaggaatgacacgagtacacgcatgtgcgagcacgcgcgagcgtgcgcgcgcgcgcgcgcgcgcacacacacacacacacacacacacacagaggcacacatgaaagcagaa

SEQ ID NO: 3748 - DNA, 1200 bp, mus musculus; identical to SEQ ID NO: 3747

SEQ ID NO: 3749 - DNA, 1000 bp, mus musculus
taaagctattccccactttacttctgatagactgtcttgaatttcgttagaaagttcaagaccagacttaccttgtaaagctatacttacgggtaccctgttccccagctgaagagttctgaattcacgcagttgaatccttctcaacagtctgtgttgcgggaacactttattaccaccattccccagctgaagagttctgaattcatgcagttgaatccttctcaacagtctgttttacgggaacacttcattaccatgacccgcagttctggttccggaatgagggatcttccttgcactggtgatggtaacctccctgggttttctcgtcccaggtcttctcgtcccgggtcttctcgtcccgggtctcagcaccaactcttacacgcgttcacgcgaccggccaggaagaatgcaacaaaccggaatcttctgcggcaaagctttattgcttacatcttcaggagccagagagcaagagagcaagagctctattgcttacatctttaggagccagagcgcaagagcaaaagcaagagagcaagaggggagaatggcgaaaccccgtcccttttaaggagaattattctccgcctaggacgtattactccttgattggctgcagcccatcggccgagttgtcgtcacagggaaggcagagcacatggggtggaaaactacccttggcacatgcgcagattatttgtttaccacttagaacacaggatgtcagcgccatcttgcaacggcgaatgtgagggcggcttcccacaaccgtcaataagacaaaaaggccaccaacagattgggaaaggatctttacctatcccaaatcggataggggactaatacccaatatatataaagaactcaagaaggtggactccagaaaatcaaataaccccattaaaaaatggggctcagagctgaacaaagaattctcacctgaggaataccgaatggcagagaagcacctgaaaaaatgttcaacatcctt

SEQ ID NO: 3750 - DNA, 1200 bp, mus musculus
atatgaaaattttcattgtttttactttgagatttttagagtttgctttttttattctatgtattaaaatgttctgttttaaacgtataatttaattatttatgattcagttcatagaatctcacgtttactcacgtcccttttccggttttttcctctttacttttaggatcctcgtcgtagtcttgcaggagaaaattgctgcctttgatagctgtactttcacaaaaaaattttttgtcacaagtatgtaccaaatccttttactttgtgtcttgtgcgtttgtgtctctgttgctgacttgatgctgtcagccatgggtttcgacactgcctcctcctgtgattcctgtgggcaccattacttataaggcagagtgctttcctggtctttctgtacacggtgtaaggttttctcctgcacttgaactgagtggttctcactggttgctgtagctgtttttatgaagctgctgtcacatcactaaatgttatgcatacttaaaaaagtgaccggtggtgctgtgggaagggttttccatttgcacttttcactctcccctgtcttgctccgtgactttcactgctgtcaggagctcagaaattagcatagcatctagtttcaagctgttttcaaacatgaattcagtgctaggttttaaagagaaggagaggattgaaatgggagggtgggaagtaagggatagatagataatattgagagctgcaatatgcaggcttgccatactcatttgtacaggacagagacaatccggacatgccaaccagggtcagctagctgtcctgtaccctagtgagtctgtgacagagcagttttttaattttgtttttcctgcagccaactaagttaacagttttccccagtgagtccgatatgtatatcttacagaaatagtttagtgggtctccattttgcagtgaacttgaaatacattacagacttacacagatgtttgccgagtagctaccctatatcaggcttcaggtagtagtgtatatcgatattgttcctttacttaatggacaatttctttgttataactgcactatatattatagataattacatgcatctggtactatattcagtaagatgtgacaattcagtacagtgcatgtgtcacattttgtagaccataaagaattgtaaaactgtcctatcccctcattcccttaatt

SEQ ID NO: 3751 - DNA, 1000 bp, mus musculus
catggagggaattcaccaccacacagtcaagcacgtctacggtaaagccatggcgacgattggcgacagaattgaaagcttctggtaccgtctggaacaacatgaggtttccattcttgtcacatttattcagcactgtactggaagtccttgtcagggcatttagtcaggagaaagaaacaaaagacatccaaagacatagtcttcaaaggaagaactgaagttgttactatttgctaagaacataaagtaatacatagaaaactctaatcctaccaccaaaaccaaatgctaaaaagtaattttaaaatgcaacgttgcaggatacaaaatcaatttgtagaagtttgtagtatagggatgaaaggtaggcagaggcaaagtttggctgcctaacatgtacaaagtcttgggttctagttcataaacacaatgaaagaaaaacatctgcagtatttctatatgccaacaatggtctattaaaacaaaaggaaggaaacaaaggaacattttactgactgaagagacagctcatagatttggaaggaaaagttatattcattacaacttaatcaaaatatgtaaccaatagcaacaacagcaacaaaacaaagagaagtaaagagggagggaagaggaaggaaaggaagcaagagaagaaaatttaaaagatgaggggaaagaaaaaagaatttgagaaagagaaatggagaagggggaaagaaatcaagcaaaaaactagagaccatcaatagacccagactggtgagacaccctcaggaaagggacctgggggatgggagatgagagtcataggatcaagtgaggaacctaggacctggttcctgcttcagtcttggttgaaagtctgggtggagagcaggtcagactcaggctggggacagcatacaaccagagcttcagtaggtggggagatgaggctctgggtgtcataaagttttagtgaagttccaagcagcctgggtgagaagtgccagga

SEQ ID NO: 3752 - DNA, 1000 bp, mus musculus
cacccctttgtagatatttatagttgatcctgggcaagttgtcttgggcctgtagtcaatgcagccgttctgctcccagcacagggctgttggctggccagagagctgtatggatgtaggttttggctaccagttcctatttgcagctgcacaaatgttatttaaaactttcactggcaaacagtggcagtgtgaagcaggcctgggaaccagacgtctgcgcagcgctcagccggtgccagggactctgcgaggagcttcacgcctcagagtgcatccaattctccgactctccctgttctcaggtaggaatcagaattacagagggatggaaatgacctaccatgtcaccctcaaatgtggtggcatcaacattaaaatccacacctaccagatgtcctcttctcccttcaatggcttctccaacttgccagcagtgttcattcgcttgaactttagtccccatgtgtgccctgctctgtgccaggtaatgcctgcctctaaccagttaccacagagccagttcgggcctgaccttcagctttggattaagattcctgccagacagctcagcgtaggtggaagacctccctatctgtgcagattgattgcaggccccacagctttgtcagaagtggttttggagagccatttgagaagacgcacatttcccccttcaggtctctgtgggctcttcctgtaagctttcattcttatacacgcggaagtcccgaggagcctcaacacattctccttgaacctgaagtcaggggcataaaacctgtcctcatctctcttcaaatgagccacagattacactagtctgtcactggcaacaacctaactcacagaaaaggaagcaaaccgatcaactcacgaggtcttggggcgggggagttctcgacaatgtctcaagtgcagctgaattaatttgccatggatttaccaagcaaatatgagtagtttcgtatttcccaccagaacccacactccccgtttc

SEQ ID NO: 3753 - DNA, 1000 bp, mus musculus
cacttaaatcaggcattattattattgtcattatttaaacttcttttatagcccagttgttatcacccccttgtctacccggcaactgttcctcatcccactcctcctccccacctccaagaggctgtccccaccacacccatgctcaccccaagaggatatccccaccacacccatgctcaacccaagagacctccccactccctgggacatcaaatctcttgagggttaagtgcatcttctcttactaaggccagaccaggcagccccttgctgtatatgagtcagggcctcggaacagctagcgtatgctgcctagttggtggctcagtgtctcagaaatctccagggtccaggctagttgagactgctagtcctcctatggggtctccctccttctcagcttcgttcaatctttccccaattaaaccacagggttacctgacttctgtccattggttgggtaaaagtacctgcatctgagtctttcagctgcttgttgggtcattgagagggcagccatgttaggctcctgtctataagcacacaatagtatcagtaatagtatcaggtcttggggcctccccttgagctgaatcccactttgggcctgtcactgaacctcctttctctcagtctcttctctgagttccctgcagttcttttagacagaaacaattctgggccaaccacatccctccacttgatgccctgcctttctcctggaggtggactctacaagtttcctctctccactgttgggcatttcatctaaggtccctccccttgagtcctgagcatcattcacataccaggtctctggtacattttagagggttcccccacatcctacctcctgatattaactgtttccattctttctgctagccctcagggctttagtccttttccccctcccagtacttgaacatgttccccttttcccttccctgtctcctctctcattcaggtctctccttccctctgcactccatgaatg

SEQ ID NO: 3754 - DNA, 1000 bp, mus musculus
tggttggttgatgtgttttcttatcttggttactctgaacaatgctgagaaaacccagggtgcagagatctctgcaacaccctgatttcacattgttttggtgaatatacagagctgtattgctgaatcgcatgagcttcattcacagatgttttactctcccttccccctttaaatagatgcttcacaataacttgtatttcagctggatgagtatcctgcttaagtgactattgaagtttcccatttcgttattcatataattttctgaatccttcagttcagaaatatctgctctgcttccttttgaagatttctctctgctgaacatcttttgtttgtatattactttccttataatgagttgtcttattttgagcaccgtgtttcctgggtgtttgtttttttaaccaaattgattgaattgtaggtatatcataagttcttatgtcattggaatgggcaacttactgtaatcattgtagcatctttttctttaattttattctcctttccatagctttgcttagattcttatataattgaagtcatttcttcatgatttatgaagtggctttgatagtaaagtaattacaggcttcacgtgtagtattctacagcgtttgtactatagttgtagcgtactacaatagttgttgtcgagtactacaacaggcttcgtctgaatacctgaggattataagggaagaacaggcccaggaagaagaaccagaccaaagatctagctgatggaggcacagcaataaaggaacatctgttagctggattgcatgtcaacaagtgcctttgtgtcctcagtgggattgcatgcagaggtctgcacatgtgacagtaaaggtggcctgggttttcagtgcagttggtgaagtcctattttccttgtgtgtgtggaaatgtccacatgtgtgcaatcatgtggaagtcagactacaaccatttatgtggattcaagtgatcaaactcaggtcttcaagcttgg

SEQ ID NO: 3755 - DNA, 1200 bp, mus musculus
tctgagcacaacagaatcttcttttgtttaagttccagagttgtattctcaacctgaaccataatatctccataaatgtacaatagatatagcatagtgaacttatgtacaatgcatgcaccaatgtttttggtaagtcgtgactcataagaagaatcatagctatgcaattggcagaaacaaataggttaatgtctccaaatacggggaagaaggacattcagagacataaacagctgcaataataattgcctcaaatcaccgggtaagcaagcagcaagttcataaaggaaaagcttgataacaatgaaacaagaggggttaggaatctgaaggattcagagagagagtgagagagagacagacagacagagacagagacagagacagagacagagacagagacagagacatggagagaaaaagagagatagagaggggagagggagagaggcagggagaaaaagaaagagggaaagagacagagacagagaggcagaaagagacagagagacagagagagggacaaagacagagagatagagaaattaactgaagcaccatgagaaactggtccagctcctgtaaatagccatttatgcacaactctgactcccacaaatgttcatagaagacaggattgccaggctaagaaactccttttaaattgtttcaaaaaaaaaaaaaaaaccacaaagcaaaacaaaaacaaaaagaaagcaccatcaccaccaccacaacagaaaaccttgtcttttttttccccctagtaatattgagtaagggatgttttctgtctctcttacttcttacaattaactactcttggcagttaggtatctcagtttaccaattgatgatgtgaggaccataaagggtgaatcattaaacagaataatgcaattagaagacttatagatgtgattttataaagaattttgaaatacagtatctagtatcaggaaactattgttttgctgattgttttaggttttagtagaagaatcaacatgcattggacatgagttttctttttctttttcttttgttttgttttgtttttgtttttgtttttgtttttgtttttgttgttttttttttgtcctcctgttctaaaatgcagtgttgatcttcagatgacattttccgtatacaatgaagaattttcataggactgtagaagaaaatacattgaagcaa

SEQ ID NO: 3756 - DNA, 1000 bp, mus musculus
gggaaggattcagtcgatcagaagaaggggggtggggcccactctcactcagaatgacatgagaagtcccaaagaagaaagtcttaaagatggaaggatttttgtgtaacaccatctctctctacaactgcacaactgagagctcctatgagagtaaagggaggcattgaaatgaaatggccctttaatgtaggccaattaagtggagagtggtaagtaagataggtgcttctcatttcaagttagctcaggccaggtgtctggctggagtggacagatgacaggacagtacaaggggatgggacagcagatgagagcagcccagacctttagtcagagtggggatgttcaatgtgtcctttacaccaggcagcctccactctcttagagaagacagctctaagagccacttactaaggaagaggccacagcacaacgtggatagtgataggtccggtgcgtatgagtggatgcactgtaataatgatatgacgttttagaaaggatattaggtaaaggatgacagtcctagtggggagaatgtaggatgagttgagttaaaaaatctctgaaaagagtctctgaagattcaagcatgaggctaatggacatggtggcctagaaaagtcctaccagagatgtttcctctaatctccctgactctaaccatacttaactgggagttaagaagcaaagacagaagcatcactatcattttagtactttcattctctttctcactacagacactcaagtcattgatgaagtatgagctgaagagcctatatgtgtctacacaggtacacacttagattcatgggatcaacaatgctaacagaccagacaaagaatatgacagctcatgtttgaaggtagtcataataagtgaaatctcccctgatctcaagatcaattccatcactggatatatatatatataatctatttacctgtttaccaatttatttagtgggaaggaattctatagatgcagatgttg

SEQ ID NO: 3757 - DNA, 1200 bp, mus musculus
ctttctttccttttttttttttttttgagacaaggttctctgtatagccctcgctgtcctagactcactctgaagacaaggctggcctcgaactcagaaatctgcctgcctctgccttctaagtgctgggattaaaaacgtgcgccaccaccaccaggcaggagttcccttctttttttttttttttttttttaggtactttcttcattcacatctccagtgctatcccaaaagtcccacaaacactccccccacattcccccacccacccactcccacttcccagccctggcgttcccctgtactgaggcatataaagtctgcatacatatgcagctagagacaggagctcggggtgggggggggagtggggggggtgggggggtgggggggcactggttagttcatattgttgttccacccatagggttgcagatcccctcagctccttgggtctctctctagctcctccattgggggccctgtgatccatccaatagctgactgtgagcatccacttctgtgtatggcagtctctagacggtccaccccttcgtctcagctccaaacttcatctctgcaactccctccatggtcgttccactcccaattctaagaaggggcaaagcttccacaccctggtcttcgttcctcctaagtctcatgtgtttcgcaatttgtatcctatatcttgggtattctaagtttctgggctaatatccacttatcagtgagtacatatcatgtgagtccttttgtgaatgggttacttcactcaggatgatgccctccaggtccatccatttgcctaggaatttcataatttcattccctttctatagcagctgaatatacagtcagcgatgacatgtgcatagaagaagcgctaaggtttggcttgaacacagagaccagaaacaatgaaaaagaaggtttgattaattctcttccaattggtcaagtgctgttctgtgagtgactgggtatagggaggaatcttgtaactagtctataataggatcacaacccctaattgtaaataatgcaagcagctgaaaaatgaaaacatctcattttaattagctgcttctcagctatctgtctttgatctacttcaataagttgacactgtctgtggttttgttgtttttccatccactgatgcttggatttaagctatataacatatttgatggagag

SEQ ID NO: 3758 - DNA, 1000 bp, mus musculus
gcaggcatggtgcaggtagagctgagagttctacatcttcatccaaaggctgctagtggaagattgacttccaggcaactagggtgaggatcttatgcccacacccacagtgacacactcattccaacaaggccacacctccagatggtgccactccctggtctaaggatatataaaccatcacaatccattccctggtccccatagacttgttcaaaaacatgagtctatggggaccatacttaaacatagcataatggaaaatgcatttagtccaaatttcaaagtcctcatagtctatagcagtctcaacaatgttaaaagtctcaaggtctcttctgagattcatccaactaattaactgtaatcccgaaagcaaggcaggaaatcagctgggcaaactccaaactctgcatctccatggctgatgtcaaagcagtcttcagatctccactcctttttcacctttgttgactgcaacaaattgctttctcctgggctggttccactccctgttagcagctttcctcagcatgtatcccatggctctggcatctttaacagctttgagtctccaaggcaatgttacaacttcttgtttcagtgtctaggattccacttgatcttttggaccctcctaagggctggcatcacttgtacaactctgccctctgtagcactctaagctcaggttgatccactccacacggctgctgttcttggtgatcatcccatggtactgacatctccaatacactggggtgttccactccaactaggcttcaccaatagcctctcataggctctcttcatggtacctgccaagcatcaaatcctttgcctgaccccttcagtcctgggcaatcaactacagctaaggctacaccttctccaatgtccttccatgacctcccacagtgccaagcctcagcttttcttcatgacaccttcgtgccttcaaaaccagtaccacctgggtgactctttcacattaccaagt

SEQ ID NO: 3759 - DNA, 1000 bp, mus musculus
gagctaggagtgagaatggatatcagtggtggacatatttgaggctagctggaaacctgggatgtgggaaactactgggagtctatggaggtgaccctagctgatgctgaaagtggccacctctagtagccaggcaagacttccaatgaaaaggagaggaacatcaactcatcccaaaattttcaacccagaatttgtcctgcatataaggggcaaatgataaagatgaagcagagacagagggaacagccaattattgtcctaacttgagacttatccagtgggagagagtcaacccctgacaccattaatgatactctgctatgcttgcagacttgagtctagcataactgtctcctgagaggcttcatccagcagcatatagaaacagatacagcgattcatatccaaactttaggcagagctcagggagtattactgtggggaatagaaataagcaagccataagtatcaaagacattgcaagaagacctacagagtcaattaatctgggttcttgggtgctcacagaaactgaaccatcaaccagggagcatgcaggaactggacctaatatttgtagcacatgtgctgcttggtcttcatgtgagtcccctaacacttagagcagcatctgtctgactctgttgcctgccattggatccccttcccctactgtgaatgctggattgggcctcggtgggtgaggaggtgattagttctggtgggactagatgtgccagggtggggttagaagtctgagaagaaggggagagggtagtggggggagggatttgctagggtgggcttggaggagtagatggctggggctacaattgagatgtaatgtgaataaaaatacattttgagaaacaaatatagtaaccttttcttttagtttagttcctacaggtaaatgtatacattaaatgattgattttctgtgcctcgctcatttcacttaacataatacctatgattccatccatgctcctatgtt

SEQ ID NO: 3760 - DNA, 1000 bp, mus musculus
aaattttgctgagttgcagcaaaatttagaatctgaacatctaattctggtgttgggctaaattctcatggaattcaaaatgagagatgaaggctgcggggaaaggaaatggatctggacaccaaatactatttggagattgatgcaaattcaataaaatacctttcacaggctgattgaccaaatttagtgccatggttgtcatgtgggaccgaacaagggtcaagaggcaatgtccccttatgaaccaatgttcctgtaacagagtcaagcacttgaataataatgactttttaatcagcttgtgttgaataaacaagaaagaagacctctgttaggtcattctgttctcaatatacagggaatatgaggaaaggaatgacattatttttatctaatttaagaatattagactctgaaattacaatggaaatatttgttcaggaaatctccttttataaataaggggatctaaaagaaaagtgatttgctcattgtctacatattgagaggcagggcagacctcaagtctctagcttagaagcctagatgcaatacctttacattggcatgtgctttctgagttaataatcttccatggtccatataacacattaccaattgccttggtgtcttagttacctttctattgctgtgaagaaatagcaataccaagacatgaccaagagtttattgaggctcatgtttccagagggttagagtccatgatactactgctggatcagaatctgagagcttatatccttattcataggcgccagacagagttaactggatatggcatggacatttgaagcctcaaagcctaccccatgggacatagttcctacaacaaggctacaactccccatccttcttaaacagtgctactaattgtcgaccagaggttcatatatgggagcacatggtcaatccaaccaccaccacacttggaaagtctctccccctctccccctccccctcccccttcccctccccc

SEQ ID NO: 3761 - DNA, 1000 bp, mus musculus
caagggtggggaggtgtactccacaacctggagctggcacagaacctacccctgtttcacaggggctctctgactctggccaggatatctgaaacgagtccattatttatagtgtgttagaaatcagaaaccttgaaccagaccaacaacttgttgtaatgaatatttgtatgtaaaggtgtatgggcaaaaatatatactgtgtgacacaccgcagtttccaaggcaatggagaggtggggaaaatggaggcgtggggctgcgcatgcgcagtggaggggagttggaactaaagactcgaaggcagtgacaggcgtggaagaaggctgaggtggacaggaggccatgtcattgccgagtagtgtcggcagggtggtatgcagcagttgaaaagattcagcacctcccctctcccctgaaatacgctgcccagcagcaccgttgccctggctctgagcaatgacaggatgtccaagatgaagaacaattcatttgctggactggaactcctcgtaagacccccatgatctgtgctgcccctggaggctatgatggtattcatggtccatgttgttgctctgcgccatgttgaagcccgaggtttatgtggctttatgtggtctgggctggtgttggagatcatgtcaatgtccaaaccctatgctactgctgaaagccaggaggatgtttgttgtctgggctacagctggaggctatgctagcatctgtggtccagcaggggccaggaaggccatgctgatgtgcacggactgtactgacacctgaggccgtgttggggtctctggtcctcctgcagctggggtccatggcttgtgttaccccctaaggccatttgggtgtctgttgtctgtactgccatctgaaaccatgttgatgcttgtggcctgtgccgccactaaggaccatgagggtgtccgtggtctgtgctacagctacaggagcctagtgatgaccacggtctgccctgtagtccgagacc

SEQ ID NO: 3762 - DNA, 1200 bp, mus musculus
gccaatacagtatgcaaaaacaggagggacggtggtgggcatatgaaaattctctgaaacttttatgtaaaacaaaataatagtgccagagactgttgacattgcctggcgaggacgccaagagaccaacggcattcaagcaggtcactggacaggtacagcctggccactgggcaccaggaggtctgtcctggtgggtcaaggacatgctaggctaatgataggcttttcggatcaccagtctatgcaacactgtgtgactgagtgacggtagtcatgctcaggcgctgtgacggcataaataaaggaacctgactcagactaaagggagaagacattttgtgttccaaacaggacagcaacgagggaattgttttctcttttccttctctcttctctcctcccctcccctcttctctgccttctccctccccggcttgagacaaggtcttatatagaccaaaccgggttcactaaatagcttaaaatgatctccatcaactcctgattctcctgccttcacctcccaagtgctaggattaaaggttcaggacactatggtttgcacatggacccagttctttctgactggggatgtggagcacagtggcagtgcaggctaagggcaggacatggagcttggaggagtcgggtcggcagtcccgactccttactcattgtgtccttgagcaagccactcactcttgtggcctcggtttcctcatccgtaaaatggagcctatcacttccatctgcccggcttgcctcccagagttgcaagcgtcacatgagacaatcatcgcaagagggcctggcgtggggcagaatcaccctggaaaaatgagcaccaaggccatcaggttgctgagtggctgtcacaccctgttctggccacaggagtcccggatgtagatctcccaggagaagttccctgagctaggccctccctaggagcccaagattgctggggggcagatgccaggccctccctgagcctctaggagataggccagagtcccccctccgtgggtgagggctgccagcggggggcctgggagagtgggccgcctgggctgggaagatgctgaggtagaaatggaggtgcctgtgagggcccaagcccaggggggaaaaaattcttactggagctgtataattaaaatcctattaagcggcgcctggcagtctcccaccaacccc

SEQ ID NO: 3763 - DNA, 1000 bp, mus musculus
gaccacccaagccctatagtctcatttctaaaccctaacacaaagcattcaccccaaggagatctgtgtgctaccttctgctaggcgacaagcaaagacaggcctcaacctccttagctggctcagtgtggtcccaccctggaatgggttccaccttcaagttctcatcccaacaataggaggtccctctgttacctgctctagctgttttgctgcaaactaagccttcccttcatctctggactccttgcccataatttcctccaggcctttgccggagctttggagaccctggtacccttggcttctcccctttgcaccttaacctctcctttcaacatttttggaggacgatcacaaagctgcaggaaaaagaagatccagtttggcactgcctcacatacctgactgtgggggacgaagggttcaatgagaaagttcttgaggaagcctttggccttgccgacctaaggaggaattgtgggagatgtcgcttagatgtgtggtacattcttcacaaaggcaaggctcaagcgcgaccacgggacaaggtaacttctccacaagtcaggacagtggggtcacagatgaacttaagagttctcaggagactccctctttacatgaatacttttactcatgtctggggagggggacaggaatgtatgcatgctgcgtcaaggagtggagacctatggctaactcaggatggttctctccctccaccctgtggatactaaggatcaaacacaggccatgacgcctggtgacaagcaccctgcccactgatcaatcccactggcccaggcagtcaagcagggagatgggaacttgggtttgatggtgatagcacactactttgctctggggtaggcctagcgactcagcctgaggacatgagtctaggcctgagaggtaggggagaggagagccaaaggttgattaggtaaaattgttcctcctttatttcctggctgaagacaacaggcctacagagcta

SEQ ID NO: 3764 - DNA, 1200 bp, mus musculus
tgagttcaattcccagcaacaacatggtggttccatccatccgtaatgggatctgatgccctcctctggtgtgtctgaagagagcaatggtgtactcctatgcagaaaataaatacatcttttaaaaaagggtgtgtgtcaaattgcccagtgattatggatttgtcagtttttccattcacctctatcaatttaaaggttttactcacatgtgtgtatacatgtgtgtgtatgtacacgtgcaggtgcccacagagaccagaagagtgtcatatctcccagatctggatttacaagttgtgagccaccctgggtggctgctggaaaatgaactccatcgctctgaaagagcagccagtgtctcaactgcctgtagctctattaagttttgctttattgtctcagatgttgaagctaggtccttgagtgcatgcttctttaagctcacagtatcttcttggtatgctgattcgtcctctattataatgtcccctatttgtctctagtaattgtcttgcactgaagtctgccttatttgacgttatcatagccactactgtctaaaaatccatgttctgctgacatcttttactctctcgactttttaagtgatgtgtgcagatcagaggacaacctcaggtgtcgttgtcactttctaccttgtttgagacatggtctttatgttgctagctctcgtgtgcaccagactaccctaccctcgagaatgtggggattctcctgtctctgcccaccagtgggctgcaattacagacacaagctaccgtgccaactttattttggctctggggatttgaactcaggtctccaagtgtgcgtggtaagtgctttagccaccgagccatgtccttagctcttcctcccttcttttaagacacagaagtggttcctccacaaatatcaagcagggcataagggggtgtggttatctctgttctgcccatctggtgccgataaagaagccaaagaggtgagagtcggttctggttccttctgtatggttggctcatcaagtcccactcccgttgttcatttccttgtttagagctgcccttggggcaggtctctacaattctacttccctcctctgagaacaccagccatccccctcattcctaagatagtctcacggaacgcaggcttcaacattaatagtcctttgtcctcagtgtttgacgtgct

SEQ ID NO: 3765 - DNA, 1000 bp, mus musculus
ctttgacaagctctagccatcatgtacagaaagatctcttcacccacacatccagttcttaaatcactccaggggtcaacaagccgcccgcctgggtgtccgggtaaaggccattagtgttttgccctgtggtctagacaaactcgcctccagcctggctcacaggaggaggccggccactctccccagaggctcgtgtatatgtcaggtgtcagacagggcgctcttcatctgtttgtccctcctgcttcctgagcaggtgatagttttaatcattgatgtctgttatgtgacaggattgaactctgctctccccttatcggggcaataaaatacaaagccatacaaagcgcgtgccagatgtgtgtctgtcctttgccctcaaaaacctaccagacacacaaaaaaatacaaagaacagctggtcctactcctgggaacatgacaaagcaactcgggtcctgaaactctgtttcgtgactgaaatacaaacacaagcaatagtgcaaaggacaactagggaccctccttttccctggactccaggtacctttccctaagcacccacccttagtctttccctaggacccaggggggaggtgtttattactggtccagtctctcttgttgctatttctttattctccagcaggtggcactctcatccttaccatccacccagacctcaggtcctaggtctttctgggtacaattcccagaaggcctatggtggtctagagctgggaccttgtcatacttcactgtctcccaggatcacttcagggaagggctatggttcaaagagggtgattcaagctcgccatctcagtgatatgaagagagcatcatgaagaaggagattggcatcagtgacctacacactcccttcctgctaccctaggtgggtctctccatccagtattaagagacactcattgcctcactcgagtgattcccagccctgagctttttgggtacaaaccttggtgacttaccaggg

SEQ ID NO: 3766 - DNA, 1800 bp, mus musculus
tttaattaaatcttgcttccagtttggctcaaagctgtgatagtggtcttgttcccaacaatggggttatcagactgttgctatgaagaacctgacatggtttttcagaaaaatgtggaagaaactttgtgtcttagaatgagaaaagtagctgaatgacgtaaacagggctcacgaggcagttctagcagaagcctgagtggcagttttgagagcaatgtggattatgaaggccaagctcaagagcttgcagagaggagccatattagtaactgagccagagaccattactgtgatattttggcaaggaatatggctaccttttatccatgccttaagaacctcctggaggccaaattgaacttgtaacagactattttggtggaagatatttcaagagagactaatattaactatgtcagatggttattagttatcatccttacacaggtttgcagtgaaggtgagcaaaaggggcagaaagaaatacaaaatgcacagtgtggagagcaaaggacactgacaagtttaatgctatacagctaaggcttatgtcagaaaagaggttgtaattggttatattagtgccattaaatatatatataatcttttttttccctttccaactcagaagcgggcacctagggggcaaaacctggaacgcttcaggagcacctcgaggcttgcaagaaacagagcgcgtgcacacaccagacgggaagggtatgcaacgccaccagccacattccccggctcggggaacatggtcaagcgagacacgactgaagtgaaacacgtaagggcaaccgggcgcctgacgcgtccacaaggaccacgcgaaccactgagaaaagtgcgcgcgggtcagcgctcgggccagagagccgcacccctgccttccacacaccaccggcatacggatgggatggagagacgaggggcccgctggcagaacgagaagagtgaccgccattcgccatgaatgtccgtccctcgcctggcgcggcttagaccctggcccgaagagaactcaggagcaccacatcgatcatattagtgccattaaggtggggtccgatctgcattggaataagagggatgccctccatgcaagacaccactcaagcaagcctccagccatgaaagacgaagagctaaggaatactctgcccctggaaaggaacaacaaacaaaagctgcagcaaatgtgtttcggggtagccaaggtccagcccatcctgggagatgaagctgccttagtgctggccttagggttaagaagaacacaaaagtaaagggggccatggaatcgtgccctgtggttacagagcgctactgaggccaggcatatagcagggaaggccctgcatgaaacacccgagaagccgttgcatgaagctgtgaagcctgggtatgtacgttggagacagcaacatatgtgggaccccaatatatggggtgcccgagctgggagacatctgccaaggagagctgcacaggaggtgggaccagcccaagagaaagagatgtatcttggaggcagcaaagctggaagggtggagccactgaaggcctttgacatcagacagagttccaggattcagagttgccctgttgggtgttggtcttgtgttggtacagcgtttccttgctattacccaattactagcttttggaatggtaatgtatgttctatgctatcgtatgttgaaagtgcatacttttttttattttatagggggttacagtacagatattgccttgaatctcagcagaaaattggacagtggagtttgttgg

SEQ ID NO: 3767 - DNA, 1200 bp, mus musculus
ggttgagggaccagctgaaaagtgtccatgtggttagtggcaaaatggggaccaatccacagccctgctgaccttctgcaatgttctccacgacctaggacccagccattctttatctggccccatcccagacactgggactcacaaatagtgatctggagttgatttctggctgagtttggttctaggcaggaggaaggatggatgcaaccatccctagcttcactacagatgttgtctttctgttgctagatgtcagtggtcacccagtttctgccttagccatccattttggggttcttagcagccacctggagctctgctgcccgcagtgatgagctggcacctatgagttccactaagggaggttccgtttcatgcatcccgagaccctggtagctaggacgctgattaggtaacctcccaggtcagctgcaacatctgggagatctatttcctatgtgaacttccaaagttcaggaattacgggaaggggaaataaacgtgataggatgcttcaagtgactacaaggcacaaggaagagccttttgcatgtttcatagcatgacattaaaacaacctcaggagctgatctcacaacacgctgatttatactgagagaatgggtgaccagagagactaatttgtctagaaacacagccaacaactggctgggcttagacttgaaccccgatctttgtgactactgtgcagggagaaagggttatctgtgatgacctgtttgggtcttgcctctgtcgctgacagtcaggaggtaaaaggttggcagcaggcgagacaggcagactgacaatttctctgcctgttcacgttttcctaggctgtgtggaagtctgctgagccaagaagcttctcaagctctctggctcgttctcagagatgaggtagcaatgaagacggcagcacagactaacaaacaacacctgcagcaggtgctcaggtgtacaggtatgcaggtgtgcaggtgtacaggtatgcaggtgtgcaaataaacaggtgtacaggtgtgcaggtgtgcagatgttcaggtgtgcaggtgtacaggtatgcaggtaaacagatgtgcaggtgtacaggtatgcaggtgtgcagatgtgcaggtattcaggtgtgcaggtgtacaggtatgcaggtgttcagctatgcaggtgtacaggtatgcaggtgtgcaggtaaac

SEQ ID NO: 3768 - DNA, 1000 bp, mus musculus
tatgggccatgtcagtttctggataaatggatcactaaaatctgaacagcccccaaggcagaaggcagaacgtgtatggccaaggagcagcttggagcaagtgtgatgtgtaagtggagaggagtaattgggatgagatgcacagagttccagagcactgatccattctccatgggaggcaagggcttggatttaactctgagtaaagggagacatgagaatgtttctccttgaagggaaaacctagctgtctgagaacaatataggaagctagctaagaagctattttgatcatgcaagtgagaaatgtcagtgggtgggaccagagtatagcagaaagtggtgagattctaggtgtattttgaaaatcgtcatcgtgatacacactgcagagtaagacatagagaagtcacccacagaaaggctcacacacatgaacatgtggaaagttatggttagatgacactttgtgtgatttttctgtctttccaaatgtatacgtattttgtaagctgaacaggactatttaggagtcactatctgttcatattgttccctgtcccaaccctgcgataacttctgcctgtttctggtctttccactcaaaatcagagagaaaagaatgtgctggccactaagctctaaggttttgccaactattatctgaagacaagcaaagtgattgtgatgtcactgtcaggcctcacccctccctggcagatgaggggtttctcagtagggtcacttgtcagggtagaggcacatcgaagaaaggcaccgtggctttgcctgtcccgtaagcttatggtgttgccatcacctctgtgatcctagtggggtctaaccttagacctccccactcccaaggaaagacatgcccggaactaacaagaataaaaagaaagaagtgtaatgccccaccagccaagcaggcagacagtatgagaccactgagggatacaggaccatcggtccccaaagaaaatatggtaagaatgag

SEQ ID NO: 3769 - DNA, 1000 bp, mus musculus; identical to SEQ ID NO: 3768

SEQ ID NO: 3770 - DNA, 1000 bp, mus musculus; identical to SEQ ID NO: 3768

SEQ ID NO: 3771 - DNA, 1600 bp, mus musculus
agggtccattaggaactggctacttgtagtagaaggaagatgctggtgacagtgacagcaagcttagtagccaagaaccttcaccatgtttcctccacagccgacaggtgccccagagttctgggcacatcatttcacccactctatgtccttgcagctatctgacatggtacatggcacatggaacaatgcaggcactatgttcactcaaggcttctgctgccaaatctctcccactccattgttacgttagctatacgcatatagttatgctatgctctcatgtgagctcagctctagctggaggctgatgacttaaatggcagtggagacttcttagaaactgagactcagtaaagcacagtgggtacatgtcccggctttgccctatgctgtctgagtatcctcggacaggccacgccccttcattgcctctgcttcttcatctccaacaggaggaggatgggaatggtcagtagctcctaggcctggatcacttatgcacagccttttatgcaacctcagtggggagaaccctcaatccatgccaggtcctgttttacctacattgttccaacatgccagaggctgttcaccttggagacctgctgcggatatgggtacggcccggagatttacaagctctcccccggattttcaagggccagcgagagctcaccggatgccgccggaaccatgacgctttccaaggcacgtgcccctctctcagggcgaacccattccagggcgccctgcccttcacaaagaaaagagaactctccccggggcttctccgggatcggtcgcgttaccgcactggacgcctcgcggcgcccatctccgccactctggatttggggatctgaacccgactccccttcaatcggccgagggcaacggaggccatcgcccatcccttcggaacggcactcacccatctctcaggactgactgacccatgtttaactgctgttcacatggaacccttctccacttcggccttcaaagttctcgaatgattatttgctactatcactcgtcggatgcctgcatgaggaccatcaccttcacgaggttctccctctaggaaggcaatcttatctgattcactgaagatgttctcttatgggctgacatggtcggtctttgctgggcttcagctttcccttgcctgaccctgtactgggggtcaggggtgcggacaacaacgctgactgtggccccaagtggaaggttcagacccagagctccatgctgcctgcccacagagcgtgcttggctttcccactatgccgctatttaagttctttgtgttggcttcctttcaccaaaagatttatttcatttttgactgtatgtttgtgtacatgtgtgggtgtctggggaggccagaaaagggctgtggatgtcctgcagcaggagtcgcaagctgttgtgagccacttaagttgggtgctaggaactgaaagcaggaaaccgtctccacagagcaagctctccaaactgagcattgattttcttaatgaaaaattccattggctgtgacagtcaaagtctcactccctttgcttagttggaattattgaatttggatcaattt

SEQ ID NO: 3772 - DNA, 1000 bp, mus musculus
gcctccaagggcccatctgtttgtgcaggtggggcagattcaccagcatgggccagggctctgagggcctccaagcaacccatggctctgccacctgctgctttggtgacctttggcatagcctgtcatcgatctgagcctgtttcctatatgtaaccgagcagccctgaagtacctcagggttgtcatgacaaatcagggcagtgttgtatcaagttcctagtgtcaaccaaagccagcgttctgttccccagcatctgctcaaagcctcccacacgggctcactggtggatgacaggcaggtagtgggtttccctacgggccactccaaagactgacctgtcatccctcaaacccaagggggggctcttttctgggagggtggtctgattggggttagtggacacctgctctgagtgcccggatgcaggcatctgtgtaaacttgcccccgatggcatgcccacaggcctgccagggtgatgactgagcccatcgcaagaaatcccgcagttcggctaacttctaagtaaaaaagacctgggtggcgcagcctagggcagagttgattattgtggcaagcagatctgcaggccctccgtggagcaaatgccatgcttctgtggggatggagcctttccggccaagagaagatcggatagcaaggagggcaagggacttctgaagcacaagacacccccctcctggcctctggaggaactgcaccctaagttgcagcctctgagctccctggcctggggtagcatgacccaggcctgaaaggggccagttgatactaactgttcatcgctgctctatagctaagagcagagactcctcattcttgtaagggtaatggggcctggctgtaatgagagtctccttacaggagctggaacaaggtaatgttctgctacaaagccggatgggagagagggagggggagggggagagggagaggaaagagaagggagagggagagcaagcacttttctggatgc

SEQ ID NO: 3773 - DNA, 1200 bp, mus musculus
catcgggagtcagtgatgactacgctgcctctatgctgtcttggaggtaaataaattaagcaagggaaaatatccagttgctaaaattgttatataaagtttatcagacacagcaaatctgtggatttcctacctcagaatcctctgggacacttggtaaaaacgcagagccctagctccgctccagctccctgcatagagagactttcagggagggagagcttcgggaagctgttgttttaaaaagcatgttgtgtctaatgtacacacaagcttcggcatacagaatccctccaagagcacttaatcccgtggttgcccagaggtgattttctcagagtctccttgaaacggagaggcatcggcagctgggacaatgcttcggaacccctgagccggagctaaacctagtcgccttctcgggagtgacacctttggctgattttgtgaatcagccagagtcccagctatgatccaattaccatgattcctgccatccgaggcaacactccattaaacatcaggatggagagactcaagctcaccacttgagtgccagctaattaaagtctttaaagtatgcagctagaacacagccaatattccagaaacagacaccgaactggggatttaaaaaagagagagagagaagataaagaaagaaactttggctcagaaacctacgtggctttctcttcaaaatgacctgagggctgggagatgggtcaatggataaagagctcgccgcacaagcatggacggcctgagatggagccataacaacaacacagaaaagccaggctcagcaacacatgcttttaattccagcactggggaggtggaggcaggaaaatcccaagaacctgctagtctagcagaattggttctgtgagagagcctgcctaaaacaacaaggtgagcagtgaagaccctcaaggtcatccgtcagcctccacacacaggcacaccccgtgtactgttactgtatacacacacacacatccatgcaccattactgccccccccacacacacacacacacaatgatcttacaattaagccacctccatttgagaggcaatggggcccagagggtggagcgaggacaaggtatcttgcagtgactctgatgcagcggtccagtttaagttcacggtgcctttctgtttcgggctctgcagaacaacaggtgaaagcaca

SEQ ID NO: 3774 - DNA, 1200 bp, mus musculus
ggaagtggcccagtaggccttcctgactgcactggaggaggacaggccttgcaaggggtatcttcctaactgtggacaccggaggtgcaggagaccaactctgttagatctggcttccaaccaatagttcggtggctaccctctcccttaggcgtgggcaaggagctcctggtgttctgggaggccggagtggatggccttcctcatggagcaagttcccaaccagttcaagttaggtttctaattgtttatgagtgccagagaccaaaacctgtccatgggcgtctaacaaggctgccaaactcttcagtcttcttggtctccactcagaagagaaagcctacagaaacaaccagccctgaccctcagctcagctggcccacaggtttggctggcacgtattagcccacagagggaaggcttctggttctttctgagagggtaagaatcgcggttacaggcgatgaggcaggtgggtggagggttgcgcatcgtcctcccttcatgtgagtaggaagtccacgagtcttgttgaagatgaccagaaggctcgtggtccagtgagggcagatggaaggcaaggacaggaggggacgcccaggtggaggtgcagatgccctcagacagccataggatcccatacacaaggcctgttctcctcagggtcctccaggctgctggaggataagcgccggcgctgggtatggcgacagttgacagtgttatcctcatgctgccaggtacctggagaaggaacaacagaggttctgggagccattccttaggccaagcatacatggtgtcccagtacagcagcacaggagtcaacacagaatctagcaggatgtgtgtgacgtgagacatctggctgcatgagccactcctgagaggaagagtgaggagcaggtgctggcaggtgccacggctgcccctccctagctaggtagtcgctgcctgtaacccatggacagatggggagactgtaggtgttcttcattcgtgaacttacctagcatccagcttgcatgttacatacttggttctggccttgggagtgttagttaggaggctgaactgggctgcttcctgcatggaaggtgggtgtacagagagcacaccctgacctatagcctgtgtctgcaggggggtaggggcgggggtggggctgcagcatagcaggggccagggaagggaagcctt

SEQ ID NO: 3775 - DNA, 1200 bp, mus musculus; identical to SEQ ID NO: 3774

SEQ ID NO: 3776 - DNA, 1000 bp, mus musculus
gcaggaggcatagagaggacccccacagcatcatctgtataagacacacactggatcctgcagcatcgtctgtataagacacacatgaccccatagcatcatctgtataagacacacactggaccccacagtattgcctgtataagacacacacttgatcctcagcctcttcctttcgttgtctcaggtgtgtggggctgtctccacgggagcgatggctaggtccgtgtctgttgactgcagatctggagtcccagaggaccttcactaatctctgctttatggaggcttcacggtatttgtgaaaggatttgagttggatcagcactgaccccaaggtcagctgatcagctatagtcacactatccctgaaggtgccctgtgccctggaagctctcccaccatgactctataagtcagtggccagtgtctcctcacgtccccccgaatctcgcacaggcttatttgcaatctgaagacgcttgcacagtctgcttgccagttttacctggctcaaccaggctgctccagcgcccctgccagggcacagcctattagatgagctaaccgaccaactgtgagtcctctccaggcctgctctgaactcatggcccagtccagccctatcgcacactggggaaactgaggctctgagggcctggggtctgtgcccactgtctcagatagcaggagaagaaaacaggagccaggcaggcagtgcctcaggactcctgaccttggcactctgtgtcccactggggcagagggacaagagacccctgaagaccagcacagatcctagcagaggtcaggcctgcttgggaggcatccttagtaggagcccagacctgccccagctaacacggctgggctgctcgcctcacgacagtctccacttcagtcagaaatggctgacattaacttttaatcccagcacttgggaggcagaggcaggcagatttctgagttcgaggccagcttggtctacagcatgatttcc

SEQ ID NO: 3777 - DNA, 1200 bp, mus musculus
gcacatgcccaagcctgaggcgtcatttctaaagcgcagttaatgcggactcggaggacgagtgtggtccctgtcttggagaggaaagactttctttcagattacaagttccagtctaccaccgaaggaggccaccatgggaaccaggagccaggacctgaaacagaaaccatggagcaatgttgatttatttccctggctttcccagctccttctcttctcttctctgacaccacccacactgagccggaccctcttacatcaattagccatcaagaacatgcccacaggccgctctgacagaggcggttcctcagttgggccttcttcttctgcagtgtgcctaggtaaagctatgtatggcaccttgacctgaaagtccaccctcaccagctctcaaattccttcaggatgatcaacccttgccctctgaatctctttggcccttaggatttctatccaggccactgaagactcccaaggacattggcttgtctcccccaacatcaaatgcctgcactccactgtagataccggaagagtagggagctccgcgccctggtgtctcacactgtgcctgacgagcaaccactgaaaggctcttttgggtcagcttgatggctatgggttgtctgggtagctgctgagctctgcttctgtctgggatgagggtttggaagatactgatgtttagtcagtctcctgaataaagatttactctcccgaatgtgtgcgtgtggaggggcaccatccaatccacagagggcctggaatggataagctggagtatgccacctgtctgtgcttgagctggggcatcaactcaacttctgccatctgacatcctggcccatctgacatacttccccatcagctccaggtcctcacggcttcagtcttaaactgggagttttatcattggtgccctgagctcttggcttacagactcagacaaaaccacgccacaagcttagagaaggcagaccatgagaacattcagcttccatagtcatgatagccagttctcatgtcatcacctctaatcatgtccatatgaatacctgtacctgctcctgcacctacatctgctccttcacctgctcctgaacctgcatctgcatctacactcactcctgcatctgtacctgctcctacacctgcttctacacctacacctgttcctgcatctgtatcttctcc

SEQ ID NO: 3778 - DNA, 1000 bp, mus musculus
tgctgctctttagcctctgagcccaagcccagcagccccttctcagtcagatcagccctgtgctcaccagctcaatatccacagttgcatcccactctgttccctccatggtggtcctgggtcagggctgggatattttcttattattgtcggtctccccgatgggctcacaatctcactccctgtcccctggaacccagatcacctctcctccaaacaccggagggagccaacgacaccccatgtatggatgaacaaacttcgtgagaagcacgtgagactttaatgatttttgatgagtgactgtgacagatggggctactgcagtaggcacaggaaatcccacaggacctcatggaacctgcttgtacctgcagtgagggccctgggactctcagtcctggagtgagtgctggctgaaaccttctagtaaattttcatttgaatacaatcagtttatgcttacaaagcagctggaggcgaaggaggggacacaggaatgtctgcgtccccaccactgagatgtaccatttacaccatgtcagtggagttagtgaggtagaaggggcgtatgaccacacggaagctgctaaaggcccctgaggcacagggaaagagggagggagtcttggaactattggtgtccagggcagtgggaataggggccttggagccttcaaagctggtgacatccaccacactgtagcctccgcagaggatcagtactctgttctcatagccaattgtcggattggagtagctggatgtggtgaggcccagtacagggagctcgttagaggtacacgagaagccatagttccagcagctctgcatggtggggaggtaggtggctgaccaggagatctgcttgtccttgaagaggaagctggggtgttgtggggtttggaaggactggtagctattgtaccgggctactgagccatagccatatgtatagagctgattgtatcgattgtattcatatctttgtgccctccag

SEQ ID NO: 3779 - DNA, 1200 bp, mus musculus
ttgcatgcttagtcaccagggggcagaattgtgtggcaagattagcaagtttgcccctactgggagaggtgtgtcactgggagtgggctttgaaagactacgtcagacccagtctctctctctctctctctctctctctctctctctctctctctctcccccacccagaggacatcaggatgtaaagctctcagctactgctccagcatcatgcctaattgcatgttgccacgccccctgccatgcccatcagggactaaccttctgaatatgtaaactggctcccaacctgaaaacgtaagccagctcccagttgaatgttttcttttgtaagcatctccttggcttgcacatctcttcacagcaacaaacagggactgagctaacagtcgataagccctgtggtaagtgactcttacaagtaggcagaaccgacctgatgagcacggtagctattttgccacagtgtatgggcacatcccacttgctaccttcagttatgcacactgcaggtgcgtcccatctgcacagcctagccaacacctgatggagaaggccacaccatagtccccaacctggatcaaggcaggacaaagctgggctcctggctccaacagctggcccctgatccacccttgtttattttcttaggttggtactcagtgccttctgtggctgtgcccttctgctgcctgcctgacctcaatgcaccttagctaagaagacatttcaagtacagagggtacaagtgggaaacagcttcactggggaatcaagagacaggtgcaagaacctaggagctctcaagctctgaggatgcttggcttcattctttcccataccgtgtttataattaactatccctccctcccgtgagctttaaatcaatgcagacactgtgtggatagtaacagctagggagtaacaggctgtggttggttacatagtttcattttctatctctgagaccttgtcaacttggacagcccagtgagcatgtgacaggagctcagaggttgagggttcccatcagacttggccagattggagcccaatgccagcgagtacaccgtcccatctgtgagttgtgtcccaggctctgggtggtcactggctgcacactccctttcagcaccgtccagcaccaaatcccattgatcctaaggttggaatctagactaggcacatggctcatgtaag

SEQ ID NO: 3780 - DNA, 1000 bp, mus musculus
cttctgctcactggcccaggcattcccctgtactggggcatagaactttcacaggactaagagtctctcctcccattaatgacctactaggccatcctctgctacatatgcagctagagccatgagtccctccatgtgttttctttgattggtggtttagtcccggggagctctggagatactggttagttcatattgttgttcctcctatggggctacaaatcctttcagctccttgggtactttctctggctccttctttggggaccctatgctcagtctaatagatgaatatgagcatccacttctgtattagttaggcactggcagagcctctcaggagacagtgatatctggctcctgtcagcaagctcttattggcagctgccgtagtgtctgggtttggaggttgtttctgagatccacagttggggcagtctctggatggtccttccttcagtctctggtgcgaaatttgtctctgtatcgcatagattcccccttctaagaaagattgaagtatccacacgttggtcttctttcttcttgagttttatgtgttttgcaaattgtaccttgagtattctgagcttctgggctaatagtcacttatcagtgagtgtatatcatgtgtgttgttttgtgattgggttacctcacttaggatgatatctcccagatccatccatttgcctaagaaattcatgaattcattgtttttaatagttgagtagtactccattgtgtaaatgtaccacattttctgtatccattcctctgttgagggacatctgggttctttacagcttctggctattataaataaggctgctatgaacatagtggagcatgtgtcctgattacaagttggagcatcttgtgggtatatgcccaggagtagtattgcaagatcttctggtagaactatccccaattatctgaggaaccgccaaactgatttccagagtggttgtaccagcttgcaatcccacaagcaatg

SEQ ID NO: 3781 - DNA, 1000 bp, mus musculus
gagcgcactagacagagtggttcctcctggcagtagcctgttatgggcttttgttcagcatgtaacagcatttggaacaaagatgagcccttataaatcacagatgcagatgaaatctgcaggcactgctggcaggagtgcacattaaataatcgagtgaagaagaacaggctcagctcactctcgctcacggtgagcaccatatttaggtcccttttaaggacttcacccaccagtgtgcttcattttaatatagggattaagcaaacaaacaaccaaactgattgcgtcctggtgcttcctgaagtagactttcaaaagttctgtactatttgaaatcaagattaggcaaaggtgctattctgtcactccacactttcacgacagaaaccctgcctttgcaagtaaaaaccagttcccaacacatttcttaaatgtactctgtaatctgctggcactggcctcgagtggaaggttctgggagcagagctctaagtgccttccattccgtgttgacaggcaggtgaatgtcatctttagaatttggctttcactgttatatgaggttgggattaattaacttccaaactgaaatgcagacatttttaggattatttgcaaaatattatagctggcttgttcttctgtgtgtgtgcctatgcatgtgtgagagggtacacaggtgtgtaagtgatgtgcatgtgtttgttgggggcaaagatagagggtacacaggtgtgtaagtgatgtgcatgtgtttgttggaggcagagatggagggtgcacaggtgtgtaagtgcatgtgcatgtgtttggggggcagagatagagggtgcacaggtgtgtaagtgcatgtgcatgtgtttggggggcagagatggagggtgcacaggtgtgtaagtgatgtgcatgtgtttgttggaggcagagatggagggtgcacaggtgtgtaagtgcatgtgcatgtgtttggggggcagagatagagggtacacaggtg

SEQ ID NO: 3782 - DNA, 1400 bp, mus musculus
tgtggtgggtattacttcatgctgtccctagactttctatgccttaagattattcttttccttgaatttaaggaaacataaagacaaaagaagaggggttgattttaaagggatgctgggagcctgttagcagtttatgccatattcctaaacacatacacacttattgaagctgttttaatgatcagaatctagtaaccaaatgaactgctcaagcactagttcttgcctcttcagggctgtttccaggactgtccatctatctcttccattttcatggaaagcatgatattcatgggcggcttgtaatctaagacatccagatacccaagccacacctgcatcagaaccaacaaaactggacaaatagactctctcatgcttcacaccaaatattggtttaaggatttgggacatgtggtcctccgtctgcttggggctcggcatgctgggagaggtggaggtgggggagtttgcatgcaaccccacggaaccaccagtcgggcattggactatgagaagccaggggattcaactctgtgggtgagggaggcacagtctggcatctccatggaactgtctgagtctggctctgactctcaggcagcacagatgatgctgggcaccacggaagagctggttctggggttcctgggttgctcagaggtcagggacaacaggttcttgctctcggctatcccagaaactgctgtatgtaaacctgaggatgggtggggaccatagggcaaactctgtcccacggcccagaggaaaggggtaggaggagagagctctggcaggttaccacagggaggagagagtctggcttgctcagtaagcagctaactcatcggggtacttggtttggctggaagctgtggctggagtacagagagggctcctgttgggaggctagatgcacaggactttagagggaaacctgctccattgctccagcacagtgattcctaatgagtagagatggtccatgggtatataaaaaagcagatcacaggccaattattactatttgacagagcaatttactttaagttgcctagaggtactagagacacaggcctcaaggataatttcttcatccctaccttgcccatatattccaagaaaaataagaaatgacacaagtcagtcaacatagacattgctctgtaaatattgcttctttgttcatttaccacactatgccatcttcccatgttcattttgccctgttgattcagaggcatggctgtctttagagaatccttaaagctgattacaatctgtgggtatttcctgactgattggatgtccattacttgagatcttgtttcatttttatgcctgatctttgggctatgagtatcattggtgaatataggtctcagcagaggagagtc

SEQ ID NO: 3783 - DNA, 1000 bp, mus musculus
agaaccggggtataaggtggtggtagagagtcgggccatttcgaaggttcctctatctctgagtagatgttagagacggccgatggctggggcggggtagatttctcgatggctcctttaggtagtagttttaatttctccttctcagcattctctcagaccgtcaagaccttggtacctggatgtaggagtgggagaaatggacgaacccaggcaggcgggaatcgcactaaatcttcccacactgtgatgtacggttgctgatctggatgggactccggtccttcctgaaagacaatggcctttacggccctaatggtggggagataaaacgttccttcgggaggccaccccactccaaaggtgggccagtccgaggtacagtaagactgccaggatttctttttaactattactgataagtttcatcctcttgccctaacgtccatccaatggtcctcagtcaaagataacggggttgagacagtctgttccatgacaaaaaccagaaacagagacaaaacgaagacagagacaagggaaaccagaacgtccaagcacaatcgtcttggacttgtacaaccagccaaacgctacctctgacggggtgggattccacgttcactcccgctccggcagaaagagcaccttatctccctcactctgccagaggacagccgggtcttcctgactgtctctgaccctgggcagttcctccagggtcgccctagaaatgtctccctagggttgcagcttttatgggctcaggacgtctccctccgcactcactgaatcctcacggatctcagcagcagctgccagaatactagaactggaaaaccgagacacaaattcagcggcgccgcactcagacacaccaaactcacacagacgtacctcccagggatattcttggggttctggtgcccccaaaatccaaccatttggagattagctgccacagtatgacgagattcacaaaaagagggaggcaggagaa

SEQ ID NO: 3784 - DNA, 1800 bp, mus musculus
agtagtaataattaggcaattttataaaagccaagaactttaatcctccacaggatgccatcagtgttcaattcaatgagaatgtaattgaccttccctgctacaaactaagcatctcccctgggcccggcttgttcgtatattagcagttcaaagatgacagtgcaggccatcatctggaacatcagacaatactttcttgtgagtccttaggcctgcataattgaaataacagttgttgggactgcatgggaagcactgggaacactgaacatgctaacatagttagcctcaaatcaaagacgtcaggtgattatcctaggagattttagtttgtcacataaaacaaaacaaaacaaacaaacaaaaaaacaacattcatgtagcctaggatatcacatagtcatgtgttgacttggcacacagctaagctgtttggatatatttctagtttggtctcggtgtccccacttctttttaaatcacttcttgtggagggaggggaagagggagccacatttaaatttaatggagatagcgttggccagaactttgaggaacatgaatgcgttcatcccacccccttccttagaagcagcctcccgtgtgaggtgggatttgagtcatattaatttgtcccagaccacaccaaaatttagctgttcacatctgaaacatcccacgatttctgtagctaggaggagtttgtttagccatgttacagcttcctatttctctcctctcccaagaaaggctggtgtccttataagggagacagcctccatttccaacagtgtggagagctaaataaatactctctcacagtcaatgcagaggtaacttttttttttttttttgatggattaaaatcactgaaaatcacggaaaatgagaaatacacactttaggacgtgaaatatggcgaggaaaactgaaaaaggtggaaaatttagaaatgtccactgtaggacatggaatatggcaagaaaactgaaaatcatggaaaatgagaaacatccacttgacgacttgaaaaatgacaaaatcactgaaaaaggtgaaaaatgagaaatgcacactgtaggacttggaatatggcgagaaaactgaaaatcacggaagtgaggggcttttgtctctctctcagtgggagctgccattttaatgggacctccagaggggcctgatttgatgatgtgaagtaggcctggaagaatctaggatttttttttaaatttcgattttggttaatttaaccatagtagctttcaaaaggactgtaatgttaaagtgaatccacagaaaatgtcgctgagaagcggctaccagataatttcagggactcctttctgaagtgctgtcctgtgaaaaccaaactcttgaagttctaataggcattatgagctccctgccctcaattgggggggggggtgtggtatgggggacttttgggatagcattggaaatgtaaatgaggaaaatacctaattaaaaaaagaaaagaaaaaagaaaaccgggagaagaattcattctcagaaatatgcatatgtatacacagacacaaacacctgccctgaaaccagatgaaacagaatcgctcttagctgactggtgaggccaagcctgaattttggatggctttgtggtaattctggggtttcccttctccctgagtcatagtcaccgcggtatgtgaagtactcttcccaggagatctctaatgccaaagctgcacaccacgcacttgacccacaaaaggatgccaaacccctgggcacacttcccaaacttttgagact

SEQ ID NO: 3785 - DNA, 1000 bp, mus musculus
cattgagagcaaaggcaattagccttcagaattggctggtattccttcctttccttctttttctaagtgaaccagcgaagccattttctagaaaatggcaaagagcagattcaggcctgcaatttccttgtctctgcccagatggatgttctgggacaggagccatgtcaccatgctctgtgctatgctgggcattctggtctctgagcctgattgtctattcatcattccagggttctgctgtgctgtgggtgagggcatctctggggtcatctgtctcttggattgtaaggctagtcgcactgcataaagggaattcaccacttgtgacactgaatgtctctaaatcctgtagctgcaaactacatggcttcaggaagggctacacagagcagacactgaaggcagcagcgtttccaaggatcccagcctggttcttattagccagttctgatcccatggtgacctgatctcttatttctatgagcagatggccttgaatgctgagagtctctctctttgtactgtggctctctcaaggatgtgacacacatttctccccacattccctgtcctttctaacttttcaagcaatttctaatatccagttcttttagcctaaccccagcatcttaaaggtctttcctatagtgagggggatttggttaatttagcctcccagctttgacaaacaaacacatctttaatacctattctacatggttgccaatcagtctacttctccgtattttgggcctgtcacgttctgtacctaacagtgacacatccctcatgtgaatgtttggccagaatccatccttttagactggattcttcttcacttgctaggggactttgcagccactgaattcctagttattccacacgcagcctattcagttgttgggatccagggcgctagcaatggcttcctgaagtgcaatctcaatatgttgctgagcttgaattttgagaattttattgagcattttgcatctct

SEQ ID NO: 3786 - DNA, 1000 bp, mus musculus
atattccttgatgttcccatggacttgatgtagcatgtgactgagtgatgatctgtcttagtgttgtgcaacccagatgaatgacagttctcaatgaaggctgattgattgatcaccagcagcctggagagcaattcccagtgacctagagggccatgtccttttctctgtactacccatcctttatatcgatgacttagatgaaaacatggaaagcatactgatcaaatttgcagatgctataaagcaaagagaggcacagccaatacagctaacctctaaaatgattttgacaggctggaacaatagccccaatctaacaagaagaaacataatagagatgaatggaaggtcctgcacttgggttcaaaagccaaattgcatatgaggtagggaggaaatggctatagagcagcatgtgaagagaaaccttagagattccactgaaagagacacagtgggtgttcaccacatgatggtaacagcaatgctgcctgtgcaggccaggcacactaatgtgatggctgtgtgcagggtaaggcaggcagcaaagttactgcaacaagtaaagatctgattgtacattcctgtagtcaggagtgctgaggggaataagcagacccagttttagtcaaggcaaagggttctaggtggaaggagacaccctaagaacatcaggattaatgaagaaagtgcaggcaatgagcattgtatacagggagctcaccatgagggaaacccaggagcagccccttgaaagtgctttttgcagctctagcaaaacttggctctcctgtgaggtttcaaggatgagtggatgattctagaaagatacgtcctctgggctaaatgatgctccaagggccctaggccagcagatcctaaaattcacttttgctttatttagtttccacagcaatgccacccatgcggcagagtaagaaatctgcatcaaataatcaaactatgtgatggctgtgtgcagggtaaggcagaatga

SEQ ID NO: 3787 - DNA, 1000 bp, mus musculus
tgtgattctgttagcctctgtcagcactcctgggagtctaactctctcctgagtttcagtggtcagagcactctctgcaggcaagctctcctcttgcatggaaggtacacaaaggtctggagctcagatccacctcttggctgaagatgaaggcctgaatgacttatgaatctgtctaagaagctctgttgctcctgcagcccaggcactctcatgagctgactggtctctgagagtactaagatacaagatggtgccctcacctgagtcccgggttcagagccctccctggaggccgactcccctctggtggggaaggtgctcagaggtctgggtctcagctatgcctcctgactcaggatgaagacttagttcccctgttctagagccatcagttgccaacagcatctcagcatgtggtaagcctatccatgctgggaatttggctggctctatcttcttctggtctgacatatgcagttatggtcacctaggaattcatgtgttcaggggctctatttcctctggaaaatgatgtttcactgtagaatgtctgcatgtctgctacctctggctctttttttttttttaagatattttctttatttacatttcaaatgctacctggaacgttccctataccctccccctgccctgctcccctacccacccactcccacttcttggtcatggtgttcccctgtactgtggcatataaagtttgcaagacctaggggcctctctttccaatgatggccgactaggccatcttctgctacatatgcagctagagacacaagctctgtgaatactggttagttcatactgctgttccacgtatggggttgcagaccccttcagctccttgggtacattctttagctcctccattgggggccctgtgttccatcctatagatgactgtgagcatccacttctgtgtttgccaggcactggcataacctcacatgagacagctacactcattctgcctcctgtt

SEQ ID NO: 3788 - DNA, 1000 bp, mus musculus
tgcaagaacttgatgaccctctgtctccaagtcctgggcattcctggggaagaggaaaagtgcaatgaatgaaaaaacagagcaaggaaggacagtcggttttggtcacatggtctgggaaagatgttgtattggcataatcttaactttgtcatttataaaatatatacagccagatgctcagcacaacccaggtttattccttgcacacattgtcttatgggtttgatggctctttttataatgcatatatgtgggtgagtgttcacatgtgtgggcatatggctacatttgcacttggatgtcagatgccatcctcagtaactctgtccaccttctttaagacagggtgtctcaattagtcatcagttaggtctggcccgtgagtcccagggaccttaccatccctcccaggcactgaaatgccaagtttgatctatgtacctggctttttacatggtgctaaggattgaactcgggtcttcaatatgagaagcagtaattttacccactaaactgtccatccttatcttctctaacagcaaatgatcaccccaacttaaaaactctggagagattcacacctgagtcctcatcagggcaccagtcccagcattttctccagaatgactacaggccttgagccatgtcacactgcctctaaaagctaatgtagagccccaaagattgagcacctcacctccacaggattctagaacatagcagttctcacaatctacagtagctcaatatgagtagaggtgggaggtgtttccccaaggcttctcattccatatgtgcttgcacaggttttccattgagagatcacgtccccaacttgacacacacacttgattcactgtgttcccgtcaaagcagccaatgtggaaagtattacgacagccaggcagccacctctgattagaagcagctttggcttcagatgggatctatgttaccagaacactgggcgtcttcaggggcttacctaactttttga

SEQ ID NO: 3789 - DNA, 1000 bp, mus musculus
cagtgcctgccctagagactcactgtaggcctgagttcagcagaatgactccctgagaaccctaaggaatggagagatctgctggactgtctttgtaagagcagggttgcactggaacagtacgggctcccctgcaaacctgttcactgactaggaaaagggaagccagcttcctccatggtcaagttctgatctctgtgccctttgatcatacacggacatgatgggaaatgtgttccctgcaacctgctagctggaatagatttacagcttcccccacccagctgcctgtaactatatttgctgctcagaaatgattttacaaggatccaaagagacaagtgacgggcagcacgtagtatgggcagagttttgataacagatgtgtcagctgtatattatgacagcttctaactcctaagatcccagattctgggtgatggtggctgctgggctggatgggagaaggcaagctcactctgaggcttgttgtagcttggtggtacttgatgatgagtggtaccaagaaaaatgtgtgcttgtctctgaagggaggagcttgaagtgtgtggttcgagtgttgctcttccccagggagatgacaaagagctctcttcacctggcagctcctaagagggaaagcactggtggcatcaaggcactggatactgatgtagattccctcttcggtggctgggataggctttaattctgattcctgtattgtgtgggcagctgcaaactgttgaagcacctggctgctggctcatgtgtaagtgtcccgtagctcatgtctaaagatcagaggatagtcagggatcagtcttcttcatgtcacatcactttacttctttgagacagggccttgtttgaagtgtatacaccaggctagctggcctatgagctcccaggaattctcccatctttttagaagagtgcagggattaaagatgtcagctatgtggtccagcttctatgtggatgctgagggtctacgctc

SEQ ID NO: 3790 - DNA, 1000 bp, mus musculus
tgtgtaaatgtaccacattttctgtatccattcctctgttgaggggcatctgggttctttccagcttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgt

SEQ ID NO: 3791 - DNA, 1000 bp, mus musculus
ggggccgccagtctcttgagggttaggtgcatcttctgtgattgaacccaaaccttgcactcctctgctgtatgtgtgttgggggcctcgtatcagcaggtgtatgctgagtggttggtggtccagtgtctgagagatctcaggagtccaggttaattgagactgctggtcctcctatagggtcacccttctcctcagcttcttccagcttttccctaattcaaccacaggggtcaccagcttctgtccattggttgggtaaaaatatgttttaatagtcagcagtagcctcagaatgctggtaactttaaagttatctttcctatgtgaacactttcacatatgggcatagagaattgtttaagttacatatgtagaacattttgtgggtggtatctatcctcaatgtttttgtgaatagtcttcttaaattttcattaacattaaatggtagagtcttgatttattcacacagaatatgggagcaatgtcatgcaatgtgtccatggtagagtagttacctacacaaattctgaatgtgcaagctttttacatatttgattttatggcatatcttctctgaatcctgagttagtcttctctgtgtggatgaagctcagaaatatggaggtcaaagggtaaccttgaccaaggattcagttttagagggcaagaattccagttaaagatgacaatgtcagggtgagaaataccatttcactgacctggaggcctctttgtatgggtccggttatgctcaagacttaagatacactgactttagtggaaacagagacttatggaaaattacatcacttgctagtgtaggattgaagttgcaatgcctggcttgaattttggccttactccacccttttcctcctccctggctgctcctgtggccatgtggcccaatcccaaagccaatacacagagtggccttctgtgcacaggatggtagcttctggcagttggctgatgtatccattatgccacaagg

SEQ ID NO: 3792 - DNA, 1000 bp, mus musculus
atgtgcaaaagtcacactggttgaatatggtcctgcaatgatatataacgagctctgctcagcaccagagatattgctcacaaaccaaacaaaacatcatgctaaagttcaacatccacattaagtaattggtcaggcagtcaaatttttgcaggtctattataaaaatattacaaaccagcttttacttaagcacctcataatggagttttagcaggaaaatattgtgcatatattttgagccagatctagactgcattgaggaactgtgtcctcaagaaggcagatttccctccaatgatgaacttagtttttttttctttactatagacactctcagtaagagaacatgatagtcctattgtctatggttttcaaaatgaatgtcatgaatttttctgtagtgcagcaaagtcatgaaaatgccattatgatttagtttaggaagtagacaatgtccctccagtctgctttccttcctgttcatctttggatccaaatgaaacaatagtccagtgcctgcaagccaaatgtgtggaaacaatggtcaaggtgagtgaaaattcctgatgctgaaaataccacaaaggagaggaaagagaagaggccaagtgcacagacaacatggacaaggtcatccagccttggtacagtgatgtcatcctgaggtacagactggagccatcagaagatgtccatggtaacacctgactatgcagacatccccatagtgagtatggaagctggcacttttcacagagctgtgaagactttaagtgcagcctttccttgggggtgtttgtttgaccatactctctgacatccagcagtgtggcctgtttagtttgcacagctatttgttgatcatggagaaaaattagaacttacgttggaaggtaacatgtaggaagccagggtcagtgtactgtctcttttgctgttctcagttggcacttggtcaaagtcagctgagctttggaccacagaggaaagctctggt

SEQ ID NO: 3793 - DNA, 1800 bp, mus musculus
tgtggtttattattttcttcactaaagtgtttgtaaaaccctctccagatctttaaccacttaaaaaaacaatcttttcctctttctattatgtgagtctggtttgaccttttagttgagaaataattaaaatttacttctgtgtgtgtgtgtgtttattcatgccctatgttgtctaattttaaagataaaaagataagcaggatatgagctatgtctgtatttaaacctttaaggtgacttttctattcaaccatgaaacattttaggttctaagatgattcttaatgctgtctaggtcactgtctgcatgtacaccatggtcacaagtcactgcctcctaagtcctttgcactgacattgtggagacccagctcaggaggtttcaaacagaaacaaggaccttaatagcagctgggttagaggttgtgcctatgatattttgggtaaagaaaaatgcgtctgccttctgcccttgtcctaagaacttgcctaaactaaatttaaaagcatttaaagacaacataatattgagtatgtggtactgtcattattgataactcttatataagtctacagtaaaaagataaagtggaacagaaagaaatacacaatgtccagttggaaagaaaaggagcaccagaaaacttaactgggaagccaaagcttatgctaaaagagaggcttctattgttaagattagtcccattaagtaggggcttctttctcttctttggaacaacaagaactgtgccccaagtgtgaggctctgcccaactaagcttccaagtgtgtgtgtgtgtgtgtgtgtgtgtgtgtgtgtgtgagagagagagagagagagagagagagagaggagaggagagtttcatttcttccagaaaacagcagcatctggtacaaatgtgatttaaaggtgccaaggtccatcccaagccaccagttggctatgttgttcacatggtgctggctttggaagcatgcaagaagaaagagtgaggtggtcatggactcttcttctggggtttcgaagagaaattggaaccaggtaaattatggcagtgttaaagtcactgtgagaagaggggcctgggaagtcattgtggtgaagctataaaaggaaagcctgaatttcaagggagattccaagctactgaagatacctgaaacatctgccaaggaatggtgcatatgtagttgagccagtcaatgtgtgttataggcagcaaagccaaagggtataagctatctgaacccttaggaactgaagtctcaaacatctgacatgaatgtgcagaatttggtgtttgctctgctgaattttggtcttgattgagtcatcattttcttaatatttcccctttcttctattttggaaagggaatgcatattttgtggcactgtacattggaagattttaatttgccttttcattttacagggtattgcagttaagagactttggatttttacatagtgttgcatctgtggggatttttaaggttatagcaaatgcattatgatattgtcatgagcctatggaggtcagagagtggaataaggtggtttgaataagaaatcttctcccataggctcagttatttgaacattggttccttattcagtgctgctgtttggggactctttaggagatacagccttgctggagaaagaacccttttccagttcagcttatctgctttgtatttgtggttaaagttgtgctctctcagcttcttaccctggcagactactgccatgcctcccttgcatctgtgatcacctttggaactataagac

SEQ ID NO: 3794 - DNA, 1000 bp, mus musculus
gatctgtaaatccatcagaggcccttatcttctgtgcccctctgccaaggactttctttcctagagttctaaaatcattattgtttatcaattgtctgcctgtttgagatatatttgctagcttgtttattttaatctgtctttttattatttatgtggaataattgctgtgtcttgatgtttttctcagatctgcagtactcaaaggatatatccaaacttaatataactggagatttaatatccttacctcaaaatagtaggcagcaggagttgaaaataatcagcaacccaaccaagaaaccaaatgttacagctaatcttatttgttaatttggctttatgtagaatctgctaagacccaaacagctgggcacacctgtaaaaaattcttctttactggatcatttgaagtagggagactacattctcttggcagcatgggagaaggaagcttttgctttttgcctgcttgaccacactcatgctggcaaggccatctgtggtgttgctggggaattccttagctgtacctacgtttgtgagattccagtgaagatgaaggaacagcagtcctccagcactctactaccacagtgggaatgctgagacatctagtcttgtaggtggaacaacaacttgattcttgacctttatgtagggagatatccactattggactactgggagtagagcctgtaaggagctttaatacatcacaagtataagctctggtcctctagagaaccctgattaatatactaaccaaacatgatccaaccaatcaaccagtaagcgagcaactaaccaatcaacaaacagttgtcggagggttgtgagtgaaggttccacaggttactgagaaactgaccatttcaggatcaaaaagtcagaaagcagcattgcttggaatatattgaatatttatttggaccaagtggtacagctgttttctttttaattattattaaaatatatatgtggaaatgatgtaaatttc

SEQ ID NO: 3795 - DNA, 1400 bp, mus musculus
ttgttttttggtttttggtttttggtgtttcaagacagggtttctctgtgtagccctggctgtccgggaactcactttgtagaccaggctggcctcaaactcagaaatccacttgcctctgcctcccgagtgctgggattaaaggcatgtgccaccacaccaagcttcccatcctttttttttatgcacccaaattatgacctcttctttttaaccacctatcagatcctattgtgctgctcaaacatttttggatgtgtgactttccactggagcacagatgacttattagggagcttataagtgactactcttagaggaaactgactcttccttgcctagacactatcaagtgctaacagcttcttacctggacgtgagacttcatgttcccctctctctgctatgctgggacttttgttggcttggttttgtataggtcttatccatgttgttacaaccactgtgcatagatgtcggagaccatccagtgagaaagtgagcccttcacaatctctctaacaggcctaatggccttgtactaagagctggttatcacccccttcctccctattccgttcctggcacctgaggctgtaaaagctgaattacagtccctcttccctatctcttcctgagttcccatgccatccaaggacatgagttacgcctgagcccagcctgacccccaaggctgtcaaggaggatcgatgttccagagataagatgcagagtgcccgctgcctggcacatgacttcggcccccatgtcagcagatgcccactttttgttctttgtataattctccctcgacccctcccatattccctgtgatgtatgctttaaaaagaaggcacctcagcataatagacgagacctcgataggtacccttcctggtctcctgctcttctttttcttcctcccatctccttccaggtttgcggcccccctcgcacccacgaataactgaatcccgcgggacgggatacataaatatgtccaactgctctgatgtatctataaaacagtttctatgtagatatccagtacctttggatgatagtgacaatttgcattcttgtttcagcattttaggagagcttcaagcattatgtcttgggaagacccacatgtggcattagaggtaaggtttcctgaaatagtggtgatccttcaattagaagaaatatctgccaggtttcaggaagcacagtgaactatgaggcacataagcctggtagaactaatgataactggaagaataatattggatttcatgtcaatgtatttgtccaaaacactaattgatttctgtaagctgaactctaggaatatggggtgagatcaagaccaatgaatcttctttattaaacagaatgaaaacaactactgaacaaga

SEQ ID NO: 3796 - DNA, 1000 bp, mus musculus
gatctaaacaggtttccaagttgttcttttggattttgggggtttgttttgttttgttttgttttgttttttgcttttctagatgcggtatctctgtgtagccctggctgtctggctgtcctggaattcactctgtagaccaggctggccttgaactcagaaatccgcctgtctctgcctcccaagtgatgggattaaaggcatgtgccagcacttgcccagccaaatttttctttcagaagatcacaatccattcctctgctttgtgtcatttgggagtagtcttgagtttccccacattgccaaccttctcctatactctcagcagcccacaagccttcagaaagtcctgcttctcatcagtgtgggactagaagataaagagaagcatcgtcggtggcgcttcaggactacacgctgttggatgctgactttgtcaccttttcaatgctgtaacaaaacagcatggtcaaagcaatttttataaaagaacacgtttaatttgaggctcacgattccatccatagggttagatacagtccgtggctgacatgatgggcagctgggtagcatgtgatcaggcatgcaaagctctggagcagtagctgagagctcatgtctcaatttaaaaacatgaggaagagagagctatctaggaatctaaagggcttttgaaacctcaaagcctacccctaatgatctacctccttcaacaagagccacacctcctaagccctccaaaaataattccaccatctaggaccaagtatcccaatacaagagcatataggggagacggggtcaactatttcactcaaaccaacacgggtatgctgtcagttctttctctgttagcagcaaggtgtgcttgggcattctctcctggtagctcctaaccaggctggtttaggtcattatggatgagaacacttgctctatttcaagctttggtgaatctgttatgcactctcattcttacagagacactgaaacttcatta

SEQ ID NO: 3797 - DNA, 1200 bp, mus musculus
caagggttatatgggaacaaaaatcaaattgacctcaggattttaaaggcaacctgcatcaaatgaaaagttagttatcctaataggaaaatctttgtaaagaaaataaatgtgcccaaccaactggtagaaaaatgttcacaaaataggaacagctgactaggggtatgactcagaataaaataattatccccaaaacttaagacttagagttcaagtctccagcactcagaaaaagctaaacaagcaaaccaacctgctaccaatcccagtgatgggggtggatatacaagggatccctaagataaactgactggtggggctagcagtactggtgcacttgaaagaacctagtggggaaacccccactcaactcctgattaggcgtgcatccaagaatcacgaacaagcagaccgtcttgatgtaaatacacgaggtagtttaatggcagagctccaggtcgaaacgtatctcacgcaggagacagtggattagaccacgagtcttcgaagctaggggtttttatggaaaaggggctggggctgggggaggaattggcatggtttcacatgattggctcatttaaacatcagcagactgtacatgcagataacatttaactaaggtcagaagggcaggagatagggaggcaccgggccagtccggacacatcattctctttatctttatgtctaagcagcctcaggaatgtcttaatgatgggcctgcctgggaatgtcctggcctgttctgctatgttcttagccccaggttttaaagctcacaaacaagtctttgggctatttgacataaattacaagaatcacagctctcaagttttcttttctttcacactctggttcactaagagccccgggttcagtaacagtagatagcaatctcaagtgacaacagtacctcaagctttagcctacacatacatgtgcacatatgtgcacaggaatgtgcacacataaatgtgagcatcatgtacacatgcatctcctacacaaataaatacatatgtaaagaaatagaaaaatccagttcaccttttgaagaaggttttgaagaagaattgtacagaaatgtaagaaataagaaagaagcctcaggagcaataaaagatgacattgaaatgacttctttctgaaccctttcattgttaaaaattcaaggttgtctgcatacccttttgg

SEQ ID NO: 3798 - DNA, 1600 bp, mus musculus
cacattccacagtctccgttccatcacgcacaagccaatttctaacttcttcagtttgataatggaatccagaacggggcagagtggggctgcgtatatacaacaggaaagaacttgtccacagttcagtccagacagcaagaaagcccaccacagcacgcatcaactcccagagctgtgctccacaagtgtcctgctgtccctccaccctcagcccgcccccatgtccccgagttcctccatagccagaaacagaaaggacagaagtggtgatgagaccagcagtggcaccgtgtcctctgtgtccctgtccatacttcctaacagctcactgggccccagggccatctcctccagctctaggcctggcctgaaacagcagttaagtttggaagacacccagcatgtggcccgcgcagtacaccttaaaatagtttaaaatgcccagtttaggattgccgtgtgtccttaggtgactacggtctcgcctggtgcgcctgtgcattcattcttgtcacaggctcactgggaacattccatgaggctgacgggaaagagagacatcagggtgcctcaccctgtgtcacagacagggatgcagagaagagtcctgacagtcaaagaccggagaggcgacctgacaccacccctgcccctaagccctgctctgagccacgctggcctttagacaccactgcagacacagacagaactcttgaccaaaatgacagaagacagtgctgaggctcacacttctgcgtgtgtggcatctatcccaggcctggcacaggagagcacagagcagcaggagaaggacaaagtgccaccatgtgggcaccaggagcaaacccagagggcctcctgccgagagcagcccatccatgcacaacacggtgtacattccagtctttagttctccaccctcttaacccaccccagccccacccctagttagccttctccatggagaataaggaagcagacccttccttgtcaatggaacaagcttctaccaatagagaattctagaaataaattagcttaaggtacagagctgtggcctggatccagagggcatgaaacctaagccggctttgcctgcaactgaacaggcacggggtgcagggccatcagatcaggtagattccatgttcttaacatggccaaccataatgggcttggcctccaaggcacaaaattgatgaagatgtggatggggccctcggtgactctgtccatgggttctagctgctgagtaagaaatgcagtctctggttccctaggaacaggaaggacgcaatggccaggtatcagtgtgtcagtgtgatactatcccatgtcaacctcagtgccagcatcagcatcagcgtggatgaaggacatcgccctcacagtcaaggcaccctcaagtcctacagagactgccctgaagacagaatgccacacgctgactacggcaccgaaagccaaccaggggctgaagagatggctcagtggagtaaagtgcttgccatgccagcgtgagggtctgcgtgggggtcaccagcatccacttaaaacccaggctcagcagctcactataataatacaatcccatggc

SEQ ID NO: 3799 - DNA, 1000 bp, mus musculus
gaggatggcttagaagttaagagcatatattgctgttgtagaggacccaggttcagcttccagcacccatggcacacagctcacaaccacctatatctctagctccaggagatccaacactttcttctggactcagagggtacctgcacatacatatacacacacatacatacacatatgtgtgtgtacagacatatacacacatgtatacacatacacacacaatttaaaaaataagtatttttaaaatggaagaaagttttaaatagatggtctcccaaagagggtatgcaaatgcccaaccaacaagctcaagaaaagataacaacattagcctttagagaattgcaaagccaaaccacagtgagcagccacttcacacccatgaggtctgaggatgacttctgtcaaaacaaaacaacacaggcactggcaacaacgtggaaaaactgggcccttcacacactgctggtgggcatggaccatgattcagtcactgtggagaaatggtttggcaagtcctacaagatataaacatagactcactagctgaccgggcaattccagtcctagaagagatgggagcatctccacatagttttcatatatgtgtgtgtgtgtgtgtgtgtgtgtgtgtgtgtgtgtgtgtgtgtgtgtgtaattggttcacagcagtattactcacaatagcaaaaaacaaaataaaacaaagaccacaaaacgcgcacgtgagtgcacgcacacacacaccaaagccaggagcaatccacatgtccataaactgctgcggggcttaacatcatgaggcttagtcaccgatgggatgtttattagtcataaaaaatggatgaatattaatatatgctacagcctgaatgaacgtcaaaagcattatgctaaaaataaaccaagcacaaaaggtcccatattgtctgtttctatttatatgaaatgtctagactagacgaatccctagactaggtgaagccctaaagacagt

SEQ ID NO: 3800 - DNA, 1000 bp, mus musculus
tatgggattggctcattcaaacattaacagtaagattacatgtcagccaaagggcatcaggaccttgttcctgtgggctgggggcttatctttgttcacatagcaaccagttgatgtatgactttaccccagcgccaaggggcagtagacagaggggaggttctggccagatggtgtcgactcagacaagatagccttgcctgcgtccttgcattctttttcatctttacagaagagtcctgccctggcatctgggctcctagacaactcttttacatgaatcacaagttacaaaatctcattttccttcattcccttcttcttctactaaataattctaatcctagaattttaaaaacctgtgtctccctttctcggtgaattttataattagggggttgcagtatttacctttgcatggtcctggggggctgtttttaagaacatgcctgttctctggatacttagaggggtccctttctccttggtttgacccatcatgatcactaccccgttgtaattgtgattaagtcccaggcagaggaagggttccaacaggcatgtcctgttgtttcacatccccatttaccgccaaaaaaaaaaaaaccaacttggtgtccctccacactcctgtcgaaaacttctgctctgaccctgaccagggcaaacatagaattctgcggctctaagattagctcggtagaactgccccgaacacccatacatgctccctatcccgctcaggacacaccgctcttcagggggtgggtcattaagatctgtatgatcggggaggtccctggtaagagatcctgccactaacttacagatgtcaggtgtgagatcaggccgccaagtccaaggggggtgcactgtggtggtcgcccatacagtgtttccctcttcaccaagcacctcccaagtctgctgaattggagtgtgagggttaaagtctggcagggttgcccctgtgcagcaggcgcagcttaaaaggattagt

SEQ ID NO: 3801 - DNA, 1600 bp, mus musculus
tttttcaattcatgaagatgagcatctcggctggtcttcagtagacactggaatcccgaagacatagaaagccagtgaagaaatgagcttgccagtgagagcaagggtaagcaggcaaagagcaaaagcttcccttttccatgttctttctataggctgccatgggaaggcatagccagattaaaggtggaccttcccacctcaaaggatctagattacaggttggtcttcccacctcagaaaacctggattataagtgggacttcccacttcaaaagaaaaaaagttctcatagatgttcccagcagcttgggttttacttcattccagatgaagtcaagttgacaaccaaaagttgccagtacaggtggctgggacattttacatccccacccacaatttatgagaaattcagtcactgtgaacctttgtcagtgtttggtgtgtcactgtttttattttaaccattttgacagataagtaatgatagttcactatggggtttatttgattaaaaacaaagagaaggggctagagagatggctcagtggttaacagcatttgatgctctttcagaggacaggagttcagttcccaacacccccatcaggcagctcccaaccaagtgtaaggccagctccaggaaaccaatcccctctttaccttccatgggcactgcacttgaaagacccccgaagggagaccctcactcaagcctcgggatatggcgcggacccaaatgtgacatggaaaccgaaatgccgtgcacacaaagctatttaatgaagcaggggggggggaaccagcgcgctggggccgagactcgtacacctctgcatagggtagaggagtctcgaccccgactcaaatttttcacaagcttttaaaggcaaaaaccacaaactgggagggggaatggggagggaataggggaagtttaacaaccacaagtttactcaaccaaagggtcatgccctacgtttggcaatgcacctggcctgttggaacattctgtggttgttccaggaaatgtttttcttaagaacattccgggaactgtttccagatgggaggggttggactctgaggtgaaaagttcatgttctcacaagaggccagtaattttccattttcacactcaattgcgtgcatctacacacacacacacaaatctttacataattaaatatcgaggaaaatttaaatgaaacattcactgatgtaaaatgcccagggaatcagtttttatacattcatgctagaggtgtacagtgcatgtgtgtctgctgcctgtggaggtcagaagagagcataaaccccatccccctcatctggaactggagttgccatggttgtgagcaggtgctgggaatcaaacctgggtcctctgcaagaaaaacaaggactttcattgatccatctctctggtcctggagagcttcttggtttttcttttctttcctcttcttttcttttcttttcttttcttttcttttcttttcttttcttctcttttcttttcttttttgtttgtttgtttgagacaaggtttctttgtgtagccctcacttttctggaactcactttgtagaccaggctg

SEQ ID NO: 3802 - DNA, 1600 bp, mus musculus
tgtttggagtttagctttacttttttcagactgtgattatgccctgggtcataatcacagtaagtaagccagtaagtgtcatttctccatagtctctacttcacttcttcccccaagttccttccttgagtcctctctacctgttcttcaacattaactttcacttcaaaagtacactctcatctgagtcatctgaatgttgtcatcataggagaatcccttgtagggacaaaaaggaagtgttccttgctgtgagcactctggagtgtcaaatgggaaaccagggccatgactgcttgtgggaagaagacagtgcagtagttactttgctattgccatggacatacactgacaagatgagtaattgtacatttacagttaaaataaatgtctaagaacaggcagagatggatgaaaaggtggatggatgacccgtccagcaggtccagttactcaagggtctcgaagggaccttctcctaagaaccaaatggggggagagagagacagacagcaagtgcaaggaacgacacgtaaacagtctgagaagcatcaaggtgtcgctgtattcagaaaggctcaaggcttaaatgcacaagcaaaaggggaagtacttttcagcaggaggggtgaggcagtagaaatgcacaaacaaaaggggaagtacaagtacttctcagcaggaggggtcgggcagtggaaatttttcttttggcagctacacagggaagcaggaacttggtgttattagggtgtggtcaggacttctggcggtgacttagggctggaacattctgtggttgttctcggaaaggtgcgtcggtgacccgcttttgacccccttttattctcggggggggggagcccaattcagagatcaggacaatagcgttgtcttaatagctccctatgtctccctcattctaatatttttataaagacatattgtataataaatttgtaaccacgtttttaacaaccgcctaaacgtctgtttgctcactgggtcattctctaaaaccacgaaggacacaaggacaagttatgaggcttgaattaacggtcccagtctgttgggtataacctgggctagtcaggggatttaggaacaaagcaagtttcgtcggtagaggtagagatctgatccccagtgtgcaaatattaggagccatgtacaggattgactctcaggcccacagattttttacccagagtaaccctgacctgctcccgtgctgtttttcatgggggaaggaccctagggcactcaaccttcatgcaatcagacatgcctctcagagactgtctaacagcttccagactattctctatgcagtgtttagcctacaactctcacgggcgacggcttcaagttccaattttttcaatgtgtctagccttggatgactgtttagtttccaatgtggcgagaatgtatattaccatgttagaagcacagactacagcaatctataaacgattcgtggcatgagactgatggctgaatttagggggaggggaaagatcttacttaagcattttatggaaattgagtctctttccctgagacgagggtgatgaagcagtatccatgtctgact

SEQ ID NO: 3803 - DNA, 1000 bp, mus musculus
aggagccctcctttcttccatgccccagctgtatcctgtgttcttgaatgtcacttaaactttcctggctccctttgcccagcaccttgtctgtgagacttgttctgatgagagaagggtcctgactttgccctgtccatgcttcttggttagctgagcaaggaccataacccaccctctgtcctccagagcacactcacagatgcccctttgcaggccatctacaagatgaagatgcctgaggacgagtccatgccctagaagtgaacagatgagatcttcaggaagatggacacaaacaatgaaggtaggaaacatggcaggagtgagcaggtggggttagaggagagaattgggagagggagtaggggtggggagagggaagtaaatgagcctatgaaactgttgattgcacagaggtgtttgggatacactctcttccctacgcatgcctgcactttccaagcccacttgattctgctctgattgagggacaagaattcagtgtctagtacacctagcctgcatcctgcacccttcctagggctctatgaccatgggcatgccagtagaccctctgacctgcaggcttcatccgcgttgtctgagttagggtttccattgccttgatgaatcaccgtggccacaagcaacttggggaggaaagggtttattcactcacagtttccatataacagttcatcatcaaaaggagtgagggcaggactcaaacaggacaggaacctgaaggcaggagctgatacagagaccatgaaagggttgctacttcctggcttgctccccatggcttgctcagcctgcttccttatagaattcaggatcactagcccagggttgtaccacctacactgggctgggctctgctccatcaatcactagttaagaaaataccctctggtcaggcatggtggcacatgtctttaatcggagctcataggagacaggaggctctctgtgagttcaaggctaacctggttaa

SEQ ID NO: 3804 - DNA, 1000 bp, mus musculus
agaagctatgaggagacagagaaactgaaccaccaggcaaatgctcggtggggacattggaggacttttactgtgaaagaccacaggcttcctcaatgagctccatctgagtacagcaccctgtgaggagggaagccaccgacctgaaaagcttctcttgcaggtcacacctagtgcagtggcattaaaaaccgtgttctgtgctggcagagagcctggggtcactgtgatctggaagcatccctgggtaggtccagtgatgtctttactccagtacttcaaagaggaaatgaggggagggaaggaaggatgtagccaggcagacatcaggacagggaccgcagaggctcctgttgctgaggggcaggtctagtacaggggcccaagcaccaagggcttgccagaaacaggggtggggtttcaggaggaaggccccttctctcatggcagcaggtaacctgggaagtccatgcctactgcttgggaataggagtgtgagggttagggaccctcaggcagtggctcacacttcataccatgcacgttgcaaagtttacagacacacatacaccccaacaccccttcaccaacacagagatgtgttacctcactgactactcagaggctcccatccctcctggctccagtgatagcccaggaggaaaagctgttaaagcaggaatcctcagagcaccacacaggactccggaagatatcccccctgggagctcgctattcttacacacaggaatacgagtgctttgctcattcattcatccagccacctttaccaagtatgcatggacttggcctgaagatatgctgagcgaatgaccctaatcttgggcagatggagaagatgctgactggtggacgggaaagatggatgctcagaggaagcctcactgtgctcagaggtgagtcactatgacacagagagagcaggaacatgtggggaaattaggtagggtgggagcaggtcattatctactaccgcaga

SEQ ID NO: 3805 - DNA, 1400 bp, mus musculus
tttattggcccaattttgtctgtgatcagtcagctgtgggttggagtagtctctgagaaccatctctacctctggttctcttgggtatcccccacttcccacagcacatcagtgcattctatgatttttctcagggtgaagcctggcctagcaccctaaaactgtcttcaggtaactgggagtgtccctaattgtacaagcttaggggacaggatgcttaataggggttggagtattcttccaattcgaaggtcatgggtttgaatttccattcggcttgtaccatggtcaactccctatgcaaaacacgtgcctttaccccttatccctggcttcttaaggctgtgagaaggagcacagacagaacatggtccctatcattgcatccccaactaactgtccctacatcttgtccctctaaagtgccctggaggatttcactgtcttgtagggggcaagctaccaacactgtctcactggcactttcctgaggttctggtgggggattcagggggttctgaggctaacgttgggattggggagcaaaagggtgggctcccttccagccgggaagctagtatccactccacgccctttgggcaatgttgctagaggtcatggcgggtgcggggtgggagccgggcatcgcagcttaggagagggcgcgccctcgaacccaagcaggtcaggaaggcagaggtaatgcagcagcccacagccactgacaggccctgagcgccgtagccctccttgctgaggcctccgcttcctggtggcgcggtagcggcgggcgacctgattggcggccaggcctgcgccccggcccgccccgccgggcgggcctccgcgccctctccagccgggccctcccctttccgcgggaggcgtccgggacagtggcttggtggcgcgcagttccccctgactgtgcgcccccgcgtctgggctcctttgcagaggactcggtagctgcagctcccggagcacagcgggcagagctgcgggctgcgcgcgcccctgctgccaccgggcgtcccgcggtggctcccgcgccccgcggcgacttccgcgcccgcgctcccctttgttcaagtccccgagcggcggcggggtcggagcccgcgccctgggcgactgaggcggccgcagtccgcgccccggcgccctggcgatgccggaccagatctccgtgtcggaattcgtggccgagacccttgaggattataaggcgcccacggcctcttgcttcaccacgggcacggcccagtgccggaacaccgcggcggccatcgaggaggtgagcggtagcatagcccgcgccctgcgggaggctagggtcgcggggatcgcgctgcgccctggccacccgctaggcttccgcgcctggtgcccgataccca

SEQ ID NO: 3806 - DNA, 1000 bp, mus musculus
tgtgaggaagtgcaaggtggtccaatcaccaccctcccaaccagcatgttcattcctctataaataagtttccaagactacttgagcagcttgcctaaccctatcatgggtgaagaccccattctgtcttggcagatggcagaccaatggctttctcagtaaggatttcatgtcacctctcattctgccttccaaaagctaagtggtgccatgcaattagttttctagtaatggttatggagtccatagaaagacccagtctaaaaaagacaattgaaatttatggaggtcctactctgttctgccccaatttagagcttcccagaagctgagtgcaagaggtgagcatcaagcagcagattctggagctggtgagctggctcagtggttaagagtgccgacagttcttccaaagttcctgagttcaaatcccagcaaccacattgtggctcacaaccatcggtaacaaaatctgatgctctcttctggagtgtctgaagacaactacagtgtacttacatataataaataaataaataaataaataaataaataaataaataaataaataaataaatattaagaagcagatgctttagcgataagtgcaaatcgttctataatggaagcttctagaacagattgagattgagatgcattgtaagttcagtgaaatgagtgctctcaccttgtctgactcagtatttgtccaaaaaccaatcacttcacatttcagtgaggatggagacaggcagagaaatgggtggtaggcgtctcactgtgcaccaagatctattagtattattcttattaataatagttcttttttctacagtccagtctatatccccctcctggtgagcacagagttactgcccacagagggtagggacagggtgctgagcagtggaagctggggtggtgagtcctctctggggctggatgggaagtataagccatatgtgagcacctgtgaggtctctcgtttgctcctcacttg

SEQ ID NO: 3807 - DNA, 1200 bp, mus musculus
atcttcacagtagagctggtctctaccactaaagcatgctggacagtgccacttttaacttggagatgataggagatcaatgcttcaagtatcagggaatgacacccagttcaaatgacatttctgcactgccaccactgcagacacaaatgaacccctactcctttgctggtctccccacttttctcctaggcctaggaacaagcaccgaaatgtctttaaactgtgaagcagtgactggagaaaaggtttattgtaagagaacttgctgctcttctggaggttccaagtttcattcccagcacccacaaccaagcaattcacagctgcctacaattctggctgcataagctctgagggcatctgcactccaagggtcacacacagatacaaaccaataaaaagtaaatcctaaagaggaaatcagaccatgggagtctgagccccaaaccctctaacagctttgcaccactccacagccaacatgcaaattctctccccaaggtaaagcccagtgctatctggacctaagccagtcctccacacaggcccctctgctctccctcacctctgaccacaggctttctgtctgccctgatactcacatctctgtccttttccaggactcctctatgcctaggtttttgcaagcaggcagcctctacattccagactgctcaaaggtcacctctgcagagatgcctgtcttgacttcagtttcctcccctccaaaaccacatccaatccccaagttatgcaaatccttgattcatcactacctggcacataacatgacataatcacctgtctatcagtgattatcaactagggaggagccttttacaaatataaaagctccaggcctcacccaaatcttgtgaaatcagaattcaggagagcagaaccaggttcttccagtccacagacaccccctcccccaccaggcaactctgaacatagccaggactcagggcagcctacaacagtactttcaaaccctggtgcaaacactgctcctgaaagtgctgttaaaatgcacactctatttccacagatctgccatggaacctgaggctctgcatgttccacaccacactgactggtgctttcaggtgaagcattttgcagttgcaagggcctatgcttatcaacaggacttcctgcaagtatgtaaaacaaagtcctgaatcacacaacaga

SEQ ID NO: 3808 - DNA, 1000 bp, mus musculus
tgggtatcgggcaccaggcgcggaagcctagcgggtggccagggcgcagcgcgatccccaggacctagcctcctgcccggcgcgggctacgctaccgctcacctcctcgatggccgccatggtgttccggcactgggccgtgcccgtggtgaagctagaggccgtgggcgccttgtagtcctcaagggtctcggccacgaattccgacacggagatctggtccggcatctccagggcgccgggacgcggactgccgccgcctcagtcgcccacggcgtgggctcctaccccgccgccgccgcttggggactcggacaaaggggagcgcgggggcggaagtcgccgcagggcgcgggagcctctgcgggacgcccggtggctgcaggggcgcgtgcagcccacagctctgcccgctgttctccgcgagctgcggctgccgcgtcctctacgatcgagccctgatgctagcgggaacagccagctgaaactgggcgccaacaggccgcttgccccggcgccttctgcggagaggggcgggacgcgctggggagggggcggtggccggccaggaggggcggggcaaaggcctggccgccaatcgggacgctcgccgcgacccagcagcccggaagcggagcccgcaggacagagggcgatgtgtgttctaggcatgttcgtgcctgtgggccgccgcattgtgtttcccttctctacgtgctgtggttcgagggcgcgccctctcctgggctgcagtgccggactcccacctcgcacccgccatgacctctagcgatattacccatgttctgtgtgtgcaccttctcacagccttaagaagccaggggtaaaggcaggtattttgcatagggagttgaccagggtacaagccgaatgggaattcaaacccatgaccttcgacttggaagaatactccaacccctagtaagcatcgtgttccctaagcttgtacaattagggacactcccagttacctgaagac

SEQ ID NO: 3809 - DNA, 1000 bp, mus musculus
gacattgtctttgctcccaactcacttaaaagagaaaagtgctgttggccagaaggtgttttagatattggacagaaatagtccctcagggccaaacatggcatgtgccttggctaatgtcacccagcaatcttgcaagccgtccagcggctcacatggacggggtacacctgagaggcaggccggcacttaaagaaagggaaactaggcgaacgagagggaaatggagccaagaccatgttctgatcaaggctcaactatttaatggcaaaggcacttataaggggggggggagaggcccattcccgctgattcatctttggagcctggaaccagctgcaggtgatgacgtgcaggatagggcatagtctccagaatagctctggggcctctcagcaggtagcagtatcttgaagagaaacagagacagtggctgaacaattgagtgatctagggaggaaggctctaccctaggtaatctccttagtggcagcaaggtcaaggtctggttcagccagcttcaggctgagggaaggttacaacttcctccctgttattaatattaaaaaaactggactgaggcataaaatttatttatgctccatagtcctgcctgggaatgatggtgactgtaagccgcacctgttttaggaaatcgtagatcttcccaaaccatccaattccgtcttgaaggctacgtgcagctagtttgtgttatatttcacacaaacatggctgtgtggtgtgttatcaacagccaaggccttttggcatgtacccctgtcttagattgggatggttctgagatctgggtgcccgtcattgagtgtccagccctcatttgcacaccttattcccaattcagaccaaagccacaatatgtacttagaatgcttcttgatgaagattaataactgccacctgcactgttggaggcgaggctgtacacctgctgcagtcacaatgacctgcttgagaaacaagggtgggacattgaaaa

SEQ ID NO: 3810 - DNA, 1000 bp, mus musculus
tcctgcttgtttgaatgtacaccatgggtgtgcagtgttgtgggccagcagagggcattggatctcctggaattgaagttgcaggtgattgtggacctcccagtgtgggtgctgggactctagctcagatctagaggcagaagggcaagagctcttcacactcagtcatctcttcagcccctcattactcaccctttatttcccccccctacagccacctttctcctcctcctcctcctcctcctcctcctcctcttcttcttcttcttctttttttcaagacagggtttctctgtgtagctctggctgtcctggaactcactttgtagaccaggctggccttgaactcagaaatctgcctgcctctgcctcccaagtgctgggattaaaggcatgcgacaccaccacctggcttctcttctttcttttcttctcttctcttctcttctcttctcttctcttctcttctcttctcttctcttctcttctcttctcttctcttctcttctcttttcttttcttttcttttcttttttttttgacagagtttctctgtgtcaccttggctgccctggaattcactttgtaggccaggctggcctcaaactcatagagatccacctgcctctgcctccttaaggctggaaacaaaggcatgttccaacatgcgcagcttcccctaataaatcctctctctttttgtaaagctaactttaaaaaaaattcttctctcatatattgcatcccaatctcagtttctctgagtttttgatcttagccattctgactgggtgggctggaatcaagagcctgctgacaggcgcctgatatagctgtctcctgtgaggctctgccagtgcctggcaaatacagaagtggatgctcacagtcatgtattggatggagcacaaggtccccaatgaaggagtcagagaaataccgagggagctgaaggggactgaagccccatagaaggaacatcaatatgaactaagcagta

SEQ ID NO: 3811 - DNA, 1000 bp, mus musculus
gagatggaagttgttgggtagaaatttagaagtcctcatttgcaatagtagtttctgccttctcaccatccctcagcagcccaagaaagtacttcaggctccagcttagcaaggcttaagcaactgctactaatatgaagaggtttatttttaaagcaaaatctcccttgtagctattaaaatcaatcatatttgagctggcatgtagcaaagttggtcaagggcttgcctaactttcatgacactctgggtagggtactcagtgctactatgtaactaggcatggttgcacacatctatagtcccagaactcagaggtggaggcaggaggatcataaatttaaggtcatcgtcatcctctgaacagcaagcatgaagtttgggtccactttgggctatatacacccaatcctggaaacaaacaaacaaacaaacaaacaaataacacttgtaaaaattcaaataagccaggcagtagtggtgcacaccttgaatcccagaacttgggaggcagaggcaggtggatttctgagttggaggccagcctggtcttcagagtgagttccaggatagccagagctatacagagaaactctgtctcaacccccgactccaaaaaatttctccagatggttccaaccccctcagcagcctcccattgctttttaataatcatatacctctctctctctctctctctctctctctctctctctctctctctctctctctctctctctctttctctctctcttcctgtcttcctttttgggatatttttttcactccatagaattccctagggactctttatggctaatctgcattccacagcaccagtgcatggcagctgaattaccaagtcactattgaaggatatctggacagcacttatggccattacacacaatcattgtgaacacttacaaaaaggtgtatctgtgaacacgagtttccagtctctgggataactgcctgggagcacgatggttggacctca

SEQ ID NO: 3812 - DNA, 1000 bp, mus musculus
ttgttctgctaatttgaatccctcctaccttatgtgtgcttggatggcatagggccccttcttagcctcttaaattttacatcactggagcagaggctatgacatttcaaaggttagtgccaggggcggaggcttgcatatctcagtccttccacccttctgttttcaacacctcctgatgtttgcatccttccaggatgatagagcttgagaaccagagctgcatgcaatcacttgctctgtgatctcatcctcttctctgcatctccaaattctgtcagtgccaagaagctgcctcacatgttgccagtctggaaggttcttcctggagccagggagatgactcaatgatcaatgagagatgactcagcgattaagatctactgccccttcaaaaatttgggttcagttcccagcattcccaactggggatcgcaaccaggggatcacactctggcttctggcttctatgggaaagtgcactcatgaatgtacctgcgggtgagcacacacacacacacacacacacacacacacacgcatgcacacacataatcaaaaattaaataaaaaatcaaagtgcatagtggcataaaatttaattccagcactttgggaggcagaagtaggcagagttgtacctatggcaacacaggagtggagatgcctaggctggacatgagaaaagacacaacattctgaacaggtggagaggggaagttttgctggactattctgtgtgttggagtttatagcccatccttggataatacttctgaaataacgtggggctgcttttgatggaatgaatcctgaagtgaccacccacatggcagttcacaactgtctgtaactctagctaaaggagatcagacattctaacacagacattcatgcatgtgaaataccagtgcactacaatgaaaatgaatattttgtttaaaaaaaaaagaaagaaaaatatagtggaaaaatgaagaaaaaatatagacgagctctc

SEQ ID NO: 3813 - DNA, 1400 bp, mus musculus
agttgttatagttgtctctgtttagagattgttcctctggtgattttgttacgctatatcagcagaccagggagactagctctcttccctgagtttcagtggtcagagcagtctctgcaggcaagctctcctctttcagggaggtgcacagttatctggtgtttggacctcctcctagccgaagatgaaggcccaaaacaggatctttcccagaagctgtgttgctttggcctgcagactgcccactgcggagtcccagaatcaaggtggcccccgtggaacgtgaggcagaagcctcacaggctgtgaggacacctgtgctctgaccaggatggtggcaagttgtctggagccgaaaatggcgccgcctcagaggctctgtggctctcgcccagtccagaagctgctggcctctgtgttccacactctcacccacagaccgcccgctgcggagtcccggaaccaaggtggcccccacggaacgtgaggctgaagcctctcgggccaggtggacccctgtgctctcaccaggaaggtggccggttgtctggagccggaaatggcaccacctcagaggctctgtggctctcgcccggtccagaagctgctggcctctgtgttccacactctcacccgcagactgtccaccgcggagtcccggaaccaaggtggcccccgcggaacgtgaggcagaagcctctcgggccgggtggacccctgtgctctcaccaggaaggtggccggttgtctggagctggaaatggcgctgcctccagtacaatgcaaacttatctcacatggtagctagttcatgtcctaagggcattagcaaaaagtctctttccactaactccaggcattgcttcaagccattatttttaaaagcttcattaagcaattcataagcttgctgtatactttcttcttcaggtccacaaattacaatatcgtccatatagtgacaaatttttaaggaggggaaaccatccctaaccggttgcaaagcttttcctatatataactgacatatgctatttgccattccttggggtaatacctgccattggtaccttttatcaggctccatatgattaatagaaggcaaggtaaatgcaaatctaggtttatctttcttatttaatgaaatagaaaagaaacaatccttaatatctactactataattctccaatccttaggtagagctgagagtaggaggagtcctttttgtacaggacccataacttgcatttgtgcattaatggctcttaggtcatgtaacaatctccaattacgtgacttcttctttacaacaaaaatagagggtattccagggtgattgtgtgggtcccacatgtcccaggtctaattgttcttgtactaattctttagctgcttttaa

SEQ ID NO: 3814 - DNA, 1200 bp, mus musculus
tagctctcctggaggcactgagacagcagcaaagatatgtgacgggctcagtggtacacaccccgttacccctctgtcattcattaagcaaccgagccagccttagtgatgtctgggggaaaaaacctgaccaaaaaaagcaatgcttatacagttacagaaaagtcactgtgtgctcccctgaagaaatacatacctagccctggccatgaaactaacccaggcttcattgatcagacagccctactttcatctttttagggggtggggaatgagggtccctggatcacacagccacctcccacttgtttaaagcacttcacattctagcagggattagatctgacagacaacagccttggagatcaggacatgtgatttcacagtaatgggaattgggggagggagctaacagctccagggtctgttatgctcttattgtccttagcacactgaattgtaaattaaggaaagagcaaacaagtagctgggaagctctgtggaaatatttaaccagagcttggtactgcgagtaaaaagctttgctaacagcacagttgtgccgtcactgggaaaggcccttgggagctccaatgtcccattaaccacagctcagtgctgtctaggaacatgcatggtacagttcagcccaccacgcagcaatatcgtcagtcagactgccaaacctcaaggactgctagacatcgaccctggagggaaggtggtgggagaggtgggtacctaatccctaggaagtcctggactcaggagagactgggtgcatcctctgtgaagttgaacttcaacagaccatctgcacttggatggtggagagcctgttccatgccaggtggaacagaaggtggcagggggaaatcagcttcaactatactcttccttacggtgaccagcagaatattgttcctcgtcctcatcctcatcctcgtcttccttgtccttgttctcgtcttcgtcctctccctcatcctcctccatccgctgtaggtgaaactcaaacagccttagcctccacttgagtgcagccctctgcagaatggccatcagctgcaggagatgcacctggagccacacaagctgcactgagtctgcacggacactagagggcgcaggctggcagattccctagccctcagcacacacccctttcaatttctaaactaggcaagaaagcatagtagg

SEQ ID NO: 3815 - DNA, 1400 bp, mus musculus
gttgtaaagaagaagtcacgtaattggagattgttacatgacctaagagccattaatgcacaaatgcaagttatgggtcctgtacaaagaggactcctcctactctcagctctacctaaggattggagaattatagtagtagatattaaggattgtttcttttctatttcattaaataagaaagataaacctagatttgcatttaccttgccttctattaatcatatggagcctgataaaaggtaccaatggcaggtattaccccaaggaatggcaaatagcatatgtcagttatatgtaggaaaagctttgcaaccggttagggatggtttcccctccttaaaaatttgtcactatatggacgatattgtaatttgtggacctgaagaagaaagtatacagcaagcttatgaattgcttaatgaagcttttaaaaataatggcttgaagcaatgcctggagtcagtggaaagagactttttgctaatgcccttaggacatgaactagctaccatgtgagataagtttgcattgtactggaggcagcgccatttccggctccagacaaccggccaccttcctggtgagagcacaggggtccacccggcccgagaggcttctgcctcacgttccgcgggggccaccttggttccaggactccgcggtggacagtctgcgggtgagagtgtggaacacagaggccagcagcttctggaccgggcgagagccacagagcttctgaggtggcgccatttccagctccagacaaccggccaccttcctggtgagagcacaggggtccacccggcccgagaggcttcagcctcacgttccgtgggggccaccttggttccgggactccgcggtgggcggtctgtgggtgagagtgtgggacacagaggccagcagcttctggactgggcgagagccacagagcctctgaggcggcgccattttcggctccagacaacctgccaccatcctggtcagagcacaggtgtccgcacagcctgtgaggcttctgcctcacgttccacgggggccaccttgattctgggactccgcagtgggcagtctgcaggccaaagcaacacagcttctgggaaagatcctgttttgggccttcatcttcggccaggaggaggtccaaacaccagataactgtgcacctccctgaaagaggagagcttgcctgcagagactgctctgaccactgaaactcagtgaagagagctagtctccctggtctgctgatatagcgtaacaaaatcaccagaggaacaatctctaaacagagacaactataacaactaactccagagatcaccagatggcgaaaggtaaacgtaagaatcttactaacagaaaccaggactactcaccatcatcagaacccagca

SEQ ID NO: 3816 - DNA, 1200 bp, mus musculus
taagaatttcatgaattcattgtttttaattgctgagtagtacttcattgtgtagatacattgtgtagatacattttctgtatccattcctctgttaagggacatctgggttctttccagcttctggctattataaataaggctactatgaacatagtggaggatgtgtccttattacaagttggaacatcttctgagtgtatatccaggagaggaattgctagaccttctggtagtaccatgtccaattttctgaggaaccaccaaactgatttcgagagtggcttactgtgaggagccgccctcacagtcactgttacaagatggcgctgacatccgttgctcatagtataatgtgcgcaggtgtcagggtatcgttccattacctgagccctgcctttctcgtgacattaactgactgatagtgggcagccaatcccagtggtgcacgtctccaaccattttttcgcagcctataaaagggaagggttttctgctctccgggtctcctctcctgaagctgatcatctatctctcgagatgtattaaagctgtactgcagaaggatccgagtggcctgcgtgtgttttgctggcgagacggtagcgtgggtcatctggttgccggaatcccgggaaattaacatcgccggtgttggggagaacccccagagacggggcagattcagaactgaagggaaaaggtgagttcggagagatgtatctgatcatgaacctcttatcccttttgatttcggtcttcaccctaagaaggggccatagaagctctagtcttggttgctgtccatcgaggccggtgctgaaatttgctatccattgatgctggtgctgaaatttgctatccatcgaggctggtgctgaaattttctgtccatcttattttgtccatcgaggctggtgttgaaatttgaggtgtggtcagtccgacatagataagcggcagcaccgaggtatctagtaagcctcccgtagataagggagcggagcaccgtgtttactttcggctttgcttaaggagtaccataagtcgggcatagatcagccgcaggtactcattctatcatgggctcttcacagtcagtgatcaccgcattacaggcagtgctaaagcaactcgatctgcaggtcacttcccgtacgctgcagaattttgttaaggaggtggatcgcgttgctccct

SEQ ID NO: 3817 - DNA, 1000 bp, mus musculus
agctgggttgtttgaatgctatacaatgtcccttgctaggtttattaaagttcataaagatacatcatgtaagtgtatgcaaatgtcaaagaataaataaaaatgttagctaaaaacaaacaaaaaaaaaccaaaaaacaaaacacttacagatgcccattgtcacatgctggcttccttaatttagagatagcccagtgcagaccctaaccacatgtctaagaaagaagcagtactttgtatagaaaatgagtggcccaatcaactctttcatgatgagggtgagcaaggcaggaaggatgctgtgtgctcctgcatggtcttcactttctcctgggtaggtgtgaaaatacttgaagaatgtcagacatctggaataccccttcgaggtactctgccttgagggtgcaggagttctattgtgtgtttagagcagatcggagattgctgccaaacttcccgctaccatactcctcttcctaagtccatctcccacatcattcatacctggacactaatgtgaccccactggactccatgctctgcatgcacgtttcctgcccttcctggtcctggactgtggtgggctgcatgcactggcatcatgcctgcctcgaggcatcctgagcattgctgctgaagaccaaaattagctgggatgggtccatttgacagtcaccagggccaaactggcacctgcaagctgagtcactgacttttaactgtttattaagtggtgacagtgacagctaaatagtgtagaggaaggaccccttctctgcgtgttccggaacgtaaggctttagagaaaaggcagaggcattaccagaacgggaggctgtgtgggggaggggcacagggcaaacacagaccaaattgctcttgtatcccttccatctgtgcagatggttccttgggagtatatccagtgaggagcatccctctacagctctggctttacgctgtcccatcactaaaagttctgagcagcactcacagt

SEQ ID NO: 3818 - DNA, 1000 bp, mus musculus
tgaagaggtgttagtgagtctgccctcagtactgtcagcccttgccttataatgctgccgcctttctgacactctctaatgtctttggtggccctaggatatgacgttctgagttacagagtctctgtccccctctcaaacctcacagtgaggtacagaactctccatgtttatcttcataacaggtctgtcttctaaagcggagacctgggactactctgtccctttaaccagagtgttattaatgtaaaccctgttagtaagcttaaaggatcaatataagagtttcatattaatgaagccagtgctgaagccaatgctgagaaatccgaaaagcactggtattcacatggtggccattgttcctcctacagaagtgaagccagttagttctagaccagcttgtggttcgaatcatggtaatggtgccatggggaaacggttctaccgacacctggtgctcagccttcaccaggctaaatagctcagttaattaccagatcaaaatgggctagattttctttgtaaagcagctcagcagtttaactgggttgtgggaaaggactctctatgacattaaatgactttcctaaaagccaatttctccaccaactgctcgtattagaatcaatttcaggactcgttcacaatgagcggtttattagcttcccaaatgcgtttactacatgccagatgtccactcgtgcacaccagtctgctgttgtctctcactgacccgtttctggatgctacggccctggatctatcaccgaggaaacacgtcacagaacagactgtagttgacatgctggatcccgaggagagaggagtcacctaccaggtgtgggcaaaagcatggggctcaagggcaaggtcatcgtgaggacagatataaatcattctgagatggattcagaagtgtattgtttatccttagactgctcggtgctgctcaagcctttaaacttttgatttgatgagaaatgattagcaatggata

SEQ ID NO: 3819 - DNA, 1200 bp, mus musculus
aagctttagccatcttctgtctgtcagaatgcacaacttggtcttctccgatatcagccacacccctggctggtcttggctttgacagtcacctctgtacttttccttgcttgctttttagtgttgacagtatcctctcctctttttgcagctttggatgggaaagagacttcaatatcaacatagccttgaccagtgggattattagtcaagcactcctagtcttggatgtagatgatgagatggcacaggacaggaatggcagaggtagggccggtctgaggggaagaggtcacacagaaatcaacaagctgtcagtgaaggtaaattttattccactgagttaaggcttgctcaggactgtgcaaacattacttcttttccagaaagataagagaagaagacccaccttccttggaggatacagactctttcaatttgttgaaggctggaagagaacaatggcacagccaatgatctttcccaagttgagactgaactctaatcttttctgacctcctcctcccagtttccaggttttgagacttaactggggttcccagtttcccaggcctcagacttagacaggaaatgaacctctagcttccctgggtgtagggtataggtgatctgttgcaggacctccaagcctccgaagtcatggaagccttgccttagaatgcatcacactccgtttgtgtatgttcccctttgtttcccgccctgcatatctctctccatcctgcaggattatgtggaaagcccagggctgctcatgaggtttctagccttttgcatcttaggcggtactgcacacagccccagctcgttcctctctccaggctcgaatgcacttttctatttagtctgttgcagttctgagacttttaggtcattgtgtcagcatggatttgcttcattagaaatgcccccaaatagtctctaaatttgctgtaccaattcgtgttcctagtagtgacatcagagagcggccatgactgtagctcacagtttctttgatttgtgtttgttctgtgcttctggagcagactctcactgttgtgcttcacatttttagggcatgagaaattgtgaactgagactctggctgcatcttgctgatatttgagtttccctgtctgtttatgctttctagttctggtgtttatcttgctggttgtggcacttcctcgaggttcc

SEQ ID NO: 3820 - DNA, 1000 bp, mus musculus
cacgcatatgcacacacacatgtacacatacatgcacacacacgtatgtgtgacagtcacatgctcacctctgttcccacaccaggtcatgtcacctaggatctctcctatgcttcaaactcaatcagaacagatgttttcctttcccaaaatggtctcattgttcatgctttgaaggtgagtgttttgtctagtggaaaccactgctttctttcaaggtaaccccgggcacattgccgttgtctgcagttttatttatttgctttggttttcattagctgctgctgtttaagatattcttgacatctgatttgtactatttcagcagatcttagctagccaaaagaaaaataattcatgtatagagtagtccaaagaaaatgtgcagagctccagctctgggcacttggaccaggataacaggggaagagctgtttagtctgtgctggggtttgggtctaacaggtacgtaatgatgctgagaagggaggcaggcactggtgatagggaagggctagcagtggggattcaaaacgaaatgatgtagttgcttttacaggaagccagccaatgtgtatgggacagaccacacaggaaaagcaaacagtgggtgatggtcatccgaagaggcaggcgttagaaatgcccatgcagggctgtgctggtgctcaaggatgaggccctagcatgcagctcagccttctcctctactccttgctagaaccctgaagagcttctgcctggatggaagattgtaaaactttgtgcttcagagtctcccgtggcaattagaaaccccataggaccctgagaaggtatgggggaagaaaggacattctgacaaactctcttggcaaggccctgttggcattcaccactgagcacactgcttttccttctcatcaatatttatgcatcgctttcggtgttgtctacaatgacatcaatagcatgttgatgtatgacctacactaatgctatacactaatatagtttaggt

SEQ ID NO: 3821 - DNA, 1400 bp, mus musculus
ccatcaaggctagtctaattacaatttcaatctcatattcaattcaaagggtttttctttcctcatgttgtcttgtgccctgtgtcctgccagcatctgggtactttcattttgagcctcctctcacttcactctggataaggaaggaccagccaaagcactcaggtggcttttgcttactggcctggtatctgtgatgcttttggtcagtcgacgatggtggtccatcacggagtattgagcaggcactgtgtgtacaacctctgagatctcctccactcctttgactttctatctgttcttagtttgctctggttgggatgagggctgagctgcttctactcctttagtaattttgtaactcaaggccagcacatttccttctgaaatctggtgaaaggaagacaattatgttgagtgaagtctgactttgttgagagtgtgtggtatgggcatctgtggtgacagaaacagtcttaagaagaccctggggtctcagaaaagagcagtgtcacatttggtggcctgtgatgagaggagcagggaggaagcctaggtgcttctgagaacttttggtccttggccacaagacatttgatcacttcacctgttccaagttcatgtgatgttcatgtaggttctcaggtagacagagcacatggtgcaactttgccatttttaaagtcaacatggaggaagtagtagctatagttaaagacttgcatgaatagttatacaaagaatagatgcaggattcaggacaaacactgcaagacaagcacccacttctgacttatttatgctggagttgtcaattcttattttcttccattacctcagatccatgcctagctgctgtctgttggcttcataggctgtcttctcacaggagaaagctgagcatgtatccctgggcctgtctgtctcaccagaggatacttccaattcccagcttctctgctggtaaaattttttctaagatgggacgctttccactaaggttgggggaacataaggattacccaacacagtcctgaaagctctagacagctcaagtgcttgacaaatacagcagtggattctcacagccattcattggactgagcacagggtccccaatggagaaaggacccaaggagctgaaggggtttgcagcctcagaggaggaacaacagtatgaaccaatcagacccccagagctcccagggactaaaccaccaaccaaagagtaaacatggagggacccatggctccagctgcatatatagcagaggatggccttgtgggacattaatgggaggagaggcccttcatcctgtgtaggctcaatgctccagtgtaagggaattccaggacaaggaagcaggagtgggtaggttagtgagcagggggaggggatg

SEQ ID NO: 3822 - DNA, 1000 bp, mus musculus
tgggattccatcatatactgagaaccagctgagatatccagtctcatggattgaataactattagattcttggacttgtccttagtagacagccattgttggacttgctgaaccacaacctgtaggctactatagtaaatcccatatatatatatatatatacgtgtacgtgtgcgtgtgcgtgtgcgtgtgtgtatgtgtttcattctatcagtctggtcttctagagaaccctgcttaatacacactctaactatgtgtatgttgaatggccctgtcagttaatactcagtggagagtcaaggagagcttgaggtctgtagcctgcaatccactttacctccaaggagaaggaaagtgtctagagtcaagctttgcatctgggcctcctacctgccaatggacattgctgctattggcagttaagagcatagccttgaggatgagctagtctggatttgaaacctggattctgacctggggaggtgtagtcatcatgctaagactccttggatgcaagagtggatgggagtgaagggcacaggattgtggaactcactggcctgctgcatgtggcgctccatgctgaatacatggtggttttcagtctgacatcactacgtatgctgtccatgcagcagttctttcatggctgggaaacgccttgagaaaagatggctggagtcaacgtgagcatgaatggattccccagtggcagcaaatgcaggctactcagagctggagagtggagtggatggtaggaaactcctggacagatggcttccaagctcttctgtttccctctcatcctgattggagtctgcttggttgcctttctctgcagggctctatgttgctgtgtgtatagataaagaaagatgatccctggtcccagatttttacaccctttggacttccatactggtcagagaatctaaggtatccctgaaagtctatggccctcctgggttcaggcatcaaagcagtagactttaagttc

SEQ ID NO: 3823 - DNA, 1000 bp, mus musculus
cttctgcctacctcttgccccataacagggaactgtgctcagtgacttaatctgcgtcctggaaattggagggataggtcagaaaggtgcagaagggcagagcagagtttcggagttaaaggtgggtgggtgactactgttcacggcctgagaggtcacaaagagaggaatttgacatagaaacgcctgagattttgacttttaaaactgtaaccttcattccttccagggaagccagtaggctgaccccagagcctcacctctccttttgctcccccagactcaatgccccaatctgactcccagctctgtaactgaatctaaggcctgctgcagtctccctttcctctctgatcccatccccaacagatccggactatctttttctccaacttctctgtccccaactcatcctagcaaccaggcctctaagccagcaggtactccctggaaacacagcagctgagcagtacagggaaacaagtaacacaaatgcggacctaatccacctgtctttcccttgaaactcaatccccaactctctctcagaactctgagacagagcacctgacgcagccttccctgcccctgctcacatcccctgtggaccccacagaactttccctcctaatctccctctggccatcctttgttttatctcaatccctaactccagcaggctctccctgcaaacccacagaccactcctgccaggaaaacaggtaggctgactgccgatccgttctatcttctcccagtcctgccgatccaatcctccagcttcacccccagctcgattctatcgattcttagagcaaacctgaagtgaactctcgtcactctctacctctatcccaagataagtagctcatggcggaacactttgctctcctcaccactgtgaaccccttacaacccctagccttaggactaaccctcaattcccacttcccagaaacgcatttttcctggaacctacagtggccacacctaccatgta

SEQ ID NO: 3824 - DNA, 1400 bp, mus musculus
cagaatttactcccagacaagctgaaaacaagcaatgggctaacattttaacgagagcaggaaatatacaaaagtcttttgctattagatgggacagcccaggccaatgcaatgatttgagaagtccaaagagagttttgtttagaaaatgcttactctacaaagttccacagatactaaaggtcttctctgaccatagaatatgcaaatgtctattttaaatcacttcacttattataatgggcagacgtttccagacaaagtcaactaataatacattttccccttttggagtgacagggaagcaagccttggtcactggccaatatagccgtgtaaatgcaactaggtcttgataacccttattttcttacaagtatctccacatgactttgtagtgacactttgccctagaaattcacatttctctttcgcatgtggtgttttctaggatgagagagaaagaagtaccaacctgaacgcttcaaggtactcaacatctcccataggggggtcgaggccacctgtccaggcaatgtttacattgtagccttctcccagacctactccaacctggggagagaaaaacacgccactgtgggtaaggatggggaagaaaggaaagaaacaaaaggagggggaacgagcacatgggagctcttgaagtaaacatcaaacacagcgtcaaatcaacccaactccgcttgacaaccagtgctctgggttatgcacttgttctgtgctggttcttggtcctgtgggacgagtgggtaatctggtgtaatttaaaacaccagcaaaggacaagaaaattaggggtaatcacgcaatgcaattacctgcgagatacaagtaaaagcagggctctaaagaaataaaccgaacctcattcggggctccactgccagggaaaaagttcccttcatcatagcgatggagtgaaatgtacaggatgctggggtcagcataaaaggcctgctgtgtaccgtttccatggtgaacatcctacagggaaaagaaaacagatgacaaattccgtcacatctgactctggagacagctctcgtgatttcttgttccctctcttcctaccccacccttcttctcattttctgtcttctcaccctgtctttctctttctccctttcaggctacttctacaccaccccctctacttcctgaactttcaggcaaattaccctttaatgctcttattttttttttttaaactggcttctaaaaatcaggaaaccacagcgagcatgccctggagactccagatgagcagtcactgagaaagcccagtccttcggtacaattagatatttatacaccggggctttgtactcttgcttcagtgatggaatcttgcatcctgttttatggaggaattttatgac

SEQ ID NO: 3825 - DNA, 1000 bp, mus musculus
aaccttcttacttctgccagctggtttatctgggttattgctctcactgcatttaaataggtcacttggtctgaccgtggatggggtttacttcctgaccgaggacaacctaacccacagcttccagtaagtatcatcccagttccccagtaaccattaacttgcctgtagctccttagaaggtctgggtggggctttatgagccccacttccatggtagtattgatgggaccacactgtaaggcttgtacaagtcaccactgccactgtgagttcatggatgcagcagaagacatcttgtcatagcaccctttcccatcctccggctcttaaatgttttcagcctcctcttctgtgatgttccctgagcactgaaggaggtaatacaaatgtcacatttaggtcttagcagtgaaccatcattctcagtatcaccagttagaagtgtgtgcattaaccacagccaactgcaaaaagcacttctctgaccaaggctgggcacagcaccaatctgtaggtaaaaacgtaagtgtttagaagccagttttccatgtccatatagcacaatgacagtagtaggttccatccagggcctgtgaccttcctggccatgtgtggggttttaatgggattagcagtacaggtgtgaattccctcgtgtggagcgcgtgcctggagtcctacaaggaagcaattggttacccctttaataggcattgccactattccaccaatgagcacatctttcctggcaggttaatactatactttcagggctcacagttttctaacaccattaatgaatttcccattagtctgtatagcatctttgagcactataaaagctatcatcagacagacaagtttccagctcagctcctgcttgatttctccatgttctgtgaccaaagtatgtggtatctttaggttgtatcttgttctagttgcaacctagaaaaagacatctacttatatgggtgtatgtgtggggtggggggtt

SEQ ID NO: 3826 - DNA, 1000 bp, mus musculus
ggagatagtgaatggatatgcaacaaggagattactgggctctgtgagaaagctctatcttaattgtaatccttataggcttcctataatggctatcccagtttctgttccaagaaatggcactgaaggacagtcttacttctacctcctcgccaacccccagtagcctgtaaacgtttgacaatgacctatctgacaggtgtgaggtcattgtggtttgctttgcctttccctggtggttaatgatgctgaacacccttttatgcacaatcagccagtgaccagggtcataagaacctgtgtcagctggagagtttactcctatatactttgattttgattcctcttgaggcatgttggctcacttggtgagacagcttgcatgaacaatgaatagcagctgtagttaggaaaggatggggtctcagcacaactaataaaagcttatcgtcctttacaattactcgttagcagaggggattaattagtgaatttcctaaacactgttttgtcggagcccactccagacaagtgtagtttgggtggatgtgtgatgctgttggactagaaaccagatctggtgtttagtttccagcatgttactgactgcatgattgtaggtaccatttgaactttcccctgcctccttagaggtagtgctttctgcattctacctcaagtacattctaactgaaatggaagtaactgcctcttttgaacttacattggtgcatacatttttgcacagtaatttaggacacaagtatgaggctttccttaatttatctttcacaaagtggtaggtacctataggggttgccaagaattctctagaattgagaaagtgtatagaacagaacttcggtcaaataataatgctttagtaactaggaggacaatccagagacagactctcccaatctacctacaaaatttcagtcattgggctgttacttaggaggtaggcagcccagagacaggaccagatgacttctcatca

SEQ ID NO: 3827 - DNA, 1200 bp, mus musculus
cttcccctaggagtcagctaaatattttgtaatcacaacatagcacttctagtcccttccatgagtgacaatgtttatgtggaattttcttttctctctttcttttcttttttcttttattttttattggatattttatgcatttacatttcaaatgttatcctctatcccagttcccactctgaaacccccctatcccattccgccaccccctgcttctatgagggtgctcattccatctacccactcctacctcactgccctggcattaccctgcactggggaatcgagccttcacaagaccaatggcctctcctcctattgatgccaaacaatgccattttctgctatgtatgtggctggagccatgagttcctccatgtgtactctttgttgatggtttagtccctgggagctggagggggcgagtctggatggttgatattgttgttcttcctatgggttgcaaaccccttcagctccttcagttctttctctaacttctccattgggtccctgcgctcagtccaatggttggctgtgagcatctgcctctgtatttgtcaggctctggcagaacctctcaggagatggttatagcagggtcccctcagcaagcacttcttggcagttgcaatagtgtctatcttggtgtttgtatatgtgatggatccccaggtggggcaatctctgcatgtcctttccttcggtctctgctccatactttgtccccatatttcctttagacaagagccattctgggttaaaaatttggatatgagttggtgatcccacccctcaatggggggccttgcctaatctaaggatgtggtctctacaggttctccctcccctttgttgggcatttcagctgatctcatccctgttgggtcctgggagccttttgctttcctggcatctgggacttgctggtggctacccctagttccctgtcccccactgccacctttattcagattcctgatcctctgtatcattattttttcaatcatttaaaatgaggattttataattaagatagcttttctcccacaagccactgttgtctagggaattttaaggatatttcagttctacagaaggcaggtgttcattccgcagcctctgaagggagctctgagtctggctcctctcactgtttctgtccaagtcagttttcatagctcctgtatggaacag

SEQ ID NO: 3828 - DNA, 1200 bp, mus musculus
ggaacgccagggccaaaaagggagagtgggcgggtaggggagtgggggtgggtgggtatgggggacttttggtatagcattggaaatgtaaatgagctaaatacctagtaaaaaatggaaaaaaaataactttaaaatacaagaacaaatacaatggaagaatgatcagaggaggtttatagagattttttagacaaagagcaaatcttgagcaaaacatggagaacctcatgtgaatttggaaatggccaatgagttggtacctcaacagcatagaactaggtaactaactgataagaaacaaaccacacagggagtctctttgtcattaataatagttcttgatgcgcggatcttagaccctcaccagcaaatgtacttagaaagttattagagatcttccttctgagtccagcagaggctgctaagtgccccatagtgctctccactctgcaggatctcaggatcacctcgggatcacaggtgagtggaactcaaagtcagctccaaagaattgcgaagggtattgtgccaggaggaaacagggacaaagtaatcccaccccaccagaggctgggatccattctggttgggaccagccccttcatcttctgtgtgaacctggcctagggtgtctatggcaccagaggactctccatgctgcaggacccctagcacacccagaacctcctgatcacctgagagcatatgggcaatagaagcaacagagcttcttggttagggtccctttgggccttcatcctcagctaggaggcagagttgagacccagacccttgggcacaatccttgccagaggagagttggcctacagggagagttctgatcccagaagtagattagagctccagactgctggacacctgcactgaaagaggagaacttgcctgcagagagtgctttgaccactgcacctcaggagagaattcgactcccaggagtgctgacagaggctaaaagaatcacaggaatatcaaatccaaccagagacagcctgaacattaacaccagagatttccagatggtgaaaggcaaacataagaatctaactaacagaaaccaagaacactgggcatcatcagaacccagtatgcccaccaaaacaggtcctggatacccaacacacccaaaaagcaagacgtggatttaaaatcatatctcatgatggtggtagaagattt

SEQ ID NO: 3829 - DNA, 1000 bp, mus musculus
ctggagactcttcttcacgatagttttattgggacaccattccatataaatcaggagcatctggtcctttactgaggtgaattatgccccccatgccccccgccgatctgaaaggatgtgctgagagataattcatgcctttccaagttaagggactttcgtagtaaatagtgcgctttcagaggtggatttaccagcagataaacctgtaaaaattctactgtcaagtcaaagatgaatttcagagaatgtgtaaactttgatagaggtaaacataatattttatttgatcgatgagaaactccactccaatgcttccgagcaaacttcctcgcctatttgtaactttgtgttatgtgttggaatttacgataattctttgaatgtactaagccttttccattactacgcacatgcaatctaactcactgcaatcctgcctgttttttctaattgctgcatcatggtgtatgtgcgcaggcacttgagcaactaggtcctattgcctttgctgacttacttattccctctctttgaaggtgaaagtgtggttccagaacaggagaatgaagtggaagcgggtcaaagggggacagcaaggagctgctgcccgagaaaaggaactggtgaatgtgaaaaagggaacgcttcttccgtcagagctgtcaggaatcggtgcagccaccctccagcagacaggggactcactagcaaacgaggacagccgcgatagtgaccacagctctgagcacgcacacttatgatacctacaaagaccagctccattctcaggaaagcaccattgtgatggcaaaccttaccgaacatcgtttacatggcagatgtctgtggcagtgtggcttagtataattaaatgcaggcatctcgagtctgtgtctcatgatggatagacggtttacactaagtgccttttattgaagatgcttccacagtgaaattggagaaagcgaacgtattccaaatacacttgttcctatat

SEQ ID NO: 3830 - DNA, 1800 bp, mus musculus
attatactgagagaagtaacaaattcaaactgaatatttaggaataaaatcttagggagggggcgttctattgatgtgataagcaaatgcagtttgggaggaatgtactgattggcttactcttcatttacccttccatgactgagggtaggtaaagctggaactcaagcagggcacggatctggacactaaaactactgaagtagaggccatggaagacatatgcttactggctcaatcccatgacctgttcagactttgctataccatccagaaacacctgcccagggaaggctcacccacagtgggctgggctccactgtagtaatcataaattaagaaaatgcatggtttgtgaattgcatcttgggtgttccaagcttctggactaatatccacttatcagtgagtacataccatgtgtgtttttttgtgactgggttacctcactcaggatgatatcctccagatccatccatttgcctaagaatttcataaattcattttttaatagctgagtagtactccattgtgtaaattttatgtatccattcctctgttgaggaacatctgggttctttccagcttctggctattataaatcaggctattatgaacatagtggagcatgtgtccttattacatgttgcagcatctgagtatattctcagaagtgatactgctgggacctccagtagtactatgtccaattttttgaagaaccaccaatgaaactcaagaaggaagaccaaagtgtggatatgttgatccttattagagggggaacaaaatacccatggaagaagttacagagacaaagtgtggagcgaagactgaaggaatgaccagccaaagattgccccacctggggatccatcccatatacaatcaccaaacacagaaactactgtggatgccaacaagcacttgctgacagaagcctgatatagcggtctactgagaggctctgccagtgcctgacaaatacagaagtggatgctcacagccatccattgtttggaacacagggtccccaatgaaggagctaaagaagggacacaaggaacagttttgcagccccattggaggaacaacaatatgaatcaaccagtaaccccagagattctaggatctaaaccaccaaccaaagagtacacatggtgggactcatggctccaactgcatatgtagcagaggatggcctagttggtcatcaatgggaagagaagcccttggtcctgtgaaagccctatgccccagtgtaggggaatggcaaggccagaaagtgggagtgggtggcttggagagcagggggaggttggaggggctttaatgcagttacttgggcactttagtgtactcacaaagcaagaacacttaagacaatcttattatttgttttgtaatttgaatattcccacttagcatagacattcagaaaaatttacataaaataaccagtaataagactttactgctattcgggtaacatgtgattcagctcagtaggtttaatgtatgatttctaaggatggattttaacaactataaccttgtttcttggttataaggaacatttaaaatgaaattgaaaactgtaagacagggatcaatcagaatatgctttcagacccctcaaaaaattcacattggtgtctgtctgtcctcatctgcatgaacagtcttgttcctgtttatttcgatagacaaagtttttttcccatgaattatgattaaatgtataagtgatcaaatctctacaaatattccataagtatgtttcggtaccttgattattaa

SEQ ID NO: 3831 - DNA, 1600 bp, mus musculus
tgtttagctctgtacccaattttttaatagtgttatttggttctctggagtctaactttttgagttctttgtatatattggatattagccctctattggatgtagtattaacaaagatctcttcccaatctgttggttgctgtttgtcctattggcagtgtcctttgccttatagaagaagtattgtagttttataaggtcccacttgtcaattattggtcttacagcataagacattggttttctgttcaggaaactttccctgtgcccttctgctggaggctcttcccactttatcttctaatattttcagtgtttctacttttatgtggaggtctctacttggacttgagctttgtacaggaaataagaatggatcaggttaacacattttatttctagggctcatttttaaaaattttactatttttttaaattaaacattccatcagtttatatctcagatgatattccacttccctgttagccctctacaaatcccccttctcacaagcccttttgcctgtatgagggttctctctcaccaacccacactctctgtcctcactcttccagcattctagccaggaccaaaggtctcccctctcattgctgtcaggcaaggccatcctctgctatgtatatctctggagtcatggatccttcgaggtacactccttgcttagtgatatagtctttgggagaactgagtggccaggccagcctatgttgttcttcctatggggttgaaatcccctccgctctacaagtccttctgccaactcccccaccaggtatcccaagctcagactaaaagttgcctcattttcaaattggcttttttttcttgatatttagcctttttttttttttttgctctttctatagcatatattctagccatatctaagctgtatgtttgataaattctgttgaaaaggaagcctgctaaatagggaatgataaaataaaagcaaagtattttgtatttgcaaattttattatctagtaggcacatattgttatttagaaatcaatatgcatagtgactctgaccagtaattctctagttatcagagatggaggatgggaaggcagggttgtgttaagagagaattaagatgtaagaacaagtcacattgggaaagggaattaacatattcctgttcaaataattgttttcatactgtcacatatccttcacgtattctgtcataagcaattcaagaataaaaatcatatgtacacacacacacacacacacacacacacacacacacacacacacacatacacacacacatctacagattctattctgttttactgttgtttctttgattttgttttttttttcctgcttctatagagtaacaaataaatgaagagatcagaacccttgttaaaaaaaaagcctagagtttaatctctgtactgctaattttttaaatactgcttgccattctctacttttgctggtataaattctactaggaaaggcaaagaaaaaaaagagaagaagaagaacatgtgtgatctcagtcttcaaacaacttataaagataagttacccatagaaataatttaataactacatgaa

SEQ ID NO: 3832 - DNA, 1000 bp, mus musculus
caattattccaaaatacaagtgtgaatacatgtttaaaacagtttttatttatcatattattaatttacatttcaaatgatttcccccttcccagttacccctccaccaacccccacattccatcccccctatttcccctcccctctacctctatgagtgtgctcctacacctgttcacccattcctgccacaccctcaagcttacccctacactaaggcaacaaccctcccttccctcccactgatgtcagataaggccatcctctgctacatatgtatctggaatcctggctcccctctatgtatgctctatggttggcactttagtccctggaagctctgggtggtccagttagttgatattgttcctcttatggagttgcaatccctttcagctccttcagtccttcccctaactctcccacttggccctgggctcagtccaatggttggctatatctgcatctctgttggtcaggttctgctagaacctctgagagaatggccatagcaagctcttgtcagcaaatgctttttggcatcagcaatagtgtgggagtttggtgtgtgcatatgggatggatccctaggtgggacagtctctggataacctttccttttccttcagatctatttttcatgatctcatgccttttgaagaaaattatagctcaattacatgataataagcaatctctattaggccaataaatcaaagtcaccataggagttatagacactagaggaatagcctgccaaatgaactgagaaacaatggtatgtggaacatggaagaaaaacaggggtgattcaggcctaattcagaggaagatggtactaaaaatactgggagaccagttgggggttcttctctgaggaagcctattttctccaactctctttatttctttcctgtagtttcctgtagttcttagttctactggacttctgttttccacgataacatgtttgttagagtcatcttttttcaagtctact

SEQ ID NO: 3833 - DNA, 1000 bp, mus musculus
tcctctgctgtatatctgttggggacctcatatcagcaaactctgaccttgtcaatgggatcatttcttgttaacctcccttaaataaaaatcaaagaaaaaattctaaggtgtttgcttgaaattgttaatatgtgcccattgacttgtatattattgtgtaggccaccactgagtataatcaagaatgaaacattattgacaatggaggtctttagtttgagaaagcttggttctgagtttaactggatggatcacacaagatccctgcaagctagatgtaggatcgattgcatgcaaaatacaaactgtggacctttctgggatccttcagaaggacaaaaagatgtcagtggacaaaatgggttacagacttaagatttccaggtttggtggctctgcacttcaccgcattaagtaacgatagctaagatgtccccgttggagggtgcgaagtagatcatggtttgggcaagaatttctgccaaggaaagcaagaacccaaggggaaaagactttaaaatagccacagcactttttccctaccgtgtaaagtaagtcagcctatcctgatgacctcgccgctcacactatgctcaaagtacctctgacattgataaggtatggagaagaaactggatcatgcaaacaacacagtgggtaggcaatgtgcggcagcatcgcctttcttcccatgctgtaaatgaactgcgttttcccactagccaaagcgtgatgaagcctctgcaccaggagtttcagtaacactggcgctttaacacataaactgaaacttgatttggggaaatgaactcgctctatagaatgccttggaaaaacaattttcaaaatgtatgtacttataattgtaaatttaaatcagttttatttaatgctactgcttgttcaaaaaatttgaagaagcaaaattgatccatttgtaaataagtatttgggcacatgggttagtgatcattttgaccacaagaagtgttatgct

SEQ ID NO: 3834 - DNA, 1200 bp, mus musculus
ggcaaaaaacaagtggatcaaagacctcaacataaaaccagatatattaaatctaatagaagagaaagtgggaaataggcttaaattcattggtacaggagaaaacttcctgaacagatgaccaatggctcaggctctaagatcaacaattaataaatggaacctcatgaaactgaaatgcttctgaaaggcaaaggacactgtcaatgtgacaaaacagcaacctacagattgagtaaagatcttcaccaaaccttgatctggcagagggctaatatccaaaatatataaagaattcaagaagttgggcaccaacagcccaaataactcaatttaaaagtggggtacagaggtaaacagaattctcctgtgaatttcattgctgttaatagctgagtagtactctattgtgtaaatatatccattcctctgttgaaggacatctgggttctttccagcttcttgctgttataaataaggttgctatgaacatagtggaacatgtgtacttattagaagttggagcatcttctgggtataagcccaggagaggtattgctagatcttcaggtaaaagtggatgctcctggttccaggactccaccgaaagagagtagtctgcacaggtgagagtgtgcactacagaagctaacagcttctgggacaggcgggagccacagagattctgaggcagcaccctttttgggctccagacatccgggcaccttcccggccagagaacaggtatccgcatggcccgggagggctttccctcagcatcagcgggagttatcttggttccgggactctgcgaaaagtagtctgcacaggtgagagtgtggactacagaagctaacagcttctgtgacaggccaaagcaacacagcttctaggaaaggtcctgttttgggccttcatcttcggccagaagggaggtccaaatgccagatatctgtgcaccttccctgtaagaggagagcttgctgcagagagtgctctgaccactgaaactcagaggagagaactagtctcccaggtctgctgatagaggctaacagaatcaccagaggaacaatctctaaacagagacaactataacaactaactccagagattaccagatggtgaaaggtaaacgtaagaatcttactaacagaaaccaagaacactcaccatcatcagaacccagcactctcactt

SEQ ID NO: 3835 - DNA, 1400 bp, mus musculus
gtgggggtgggtgggtatgggggacttttggtatagcattggaaatgtaaatgagctaaatacctaataaaaaatggaaagaaaaaaaaaacttatggacattacataatgacatgcataaatacctttacacatgtatcgtcctatacccttgttaatcttgtttaatatagaaaaccagaaccaggaagctccctctaatggagagcatgggatttcaagtaaggcttcttgagaaaaactaggctctagagactgttgtgcaaggtttcttgttattagtaacacacatcagatgtattagaaattaggatgaggatactcaggatgtaggaagaaaatagccactggaggcagggcacacagggaaggaaaacaattgaaaacaatataatgtcaggtgtatgaaatgatgaaaaaaatccattattttatatggtaccttaaaaattaatgaaaaacagataagcttggtagaaaacaaatttgatagacaaaactcccttcttcttttgagccattttaactattttctaccatgcttttccatttgttttaccgttgcaaagaagagggagatacttaactaaatcctaatgatgcattttaggcaaaataaaaatttcaccactgaaaaccatcgaagcatatttgtgatagctgacgaagtggtatcatacaaatgtctgtgttttggttacactgggtttaattttaaattgaagcctggaagactagtagaatcagagaaagagaaaaacgcttgtttttgataagatgtcattgtttaccttagagcatgaaaaatagagcaagcagttaccaagtatagaggaataaaaaataataagtgtcctgctgcctggaaatgagaggctgtgatggagcacacagctgccagctcagccatcagggacttcagcagctgaccagaagcttaagtcaatggaaaaaaaatttaactagacaatactttgatgctttgaggcctgtatctaaagacagcttctgccattgaatctgatgcagtgacaactggccatgctaatttgcactgataatagatctgaaattatttcactagcatacacattagcaatccacctgaatacacttaaaactgttccacaaacacacacttactgtacccacatagaattttgtgtgttgatttagaataaacaataaatgtgcgtatgcacgcacatttaaaccaagagagataaagatagatggtgtataaatcgatggtatagtgtttgccctgcatatatgagccttgactttgggtccccaaacttttaaaagacacataaatgattagagacaagcttttcatttaaaagcacagagtcagccttcccacctgcatcctctccttttcctcatctctgggtggg

SEQ ID NO: 3836 - DNA, 1000 bp, mus musculus
aatctgtgggttctctcagtgaaatagaccacgagaatggtcttttatccagtaggtaaaagatataggtaacgtgggacgaggacattctatttttttattggatatttgctttatttacatttcaaatgttatcccctttcctgcatcccggctcctctgcttctatgagtgtgctcccccactcaagcatccccacctccccacccttgaattcccctatactgaagcattgagccttcacagaaccaagggtctctccccccactgatgcctgaaaagcccatcctcggctacatatgcagctggagccatgggtccctccatgtgtactcaatggttggtgttttagaccctgggagctctggggtgtctggttggttgatattattgttattatcttcctatgggattccaaagcccttcagctccttcagtgctttctctaactcagaagaggacattcttataagttagccagttatgactgttgaaattttccccatgtatatcctttttattaaaaataaaaagactctgagcacggcagccagaacagcattgttggagttggaataaggatggaagggagggagggagattggttattgtccagacaatatatcaaagaaggaattgccatgaagtttgggagaaaaatgtttaaaacatccaaagatttttaagagcagagattcaaatcatggctaacaggggccatgctgagtttgttgtttggcatcgttgccaagagtcggccaaactctgatgccagaaacagcaggaaagaaaaggcaacagatcccacaattgccaaaaatatccctatcttagaagaatgagagcttcaaagggtagacacaatcaggctgcaaccaaactgtaacagatattccaagttggggatatgacaagcatatcagaaaagtagtgctgttattaacaaaatcccatagcaacctgagaaatctcctccaagaatttgattggctagaatatt

SEQ ID NO: 3837 - DNA, 1400 bp, mus musculus
ctcattcccccctttgaatctgggtttatttgtgatactgtcagtttaatgcttctaaaattgagactatataaagacttttagaaaaacagtttagtcctcctattatcctacatatttcgacaacctttgcaattactagtagtaagctctgcctaatattttggtgtgatactctgcattttctcccatcagttgttggatggtctttctggtctctctgataactattacgctaggctccagtcctagcatactttgccagcatgacaaactgtcgatttgaggtttgtttgctgagttggtatcccaatccctccacttgagagtatgcctacttgcaaaggatagtaagttcaggctctttgtcccccattactagagatcttcattagtgtcaccctcgtagattccatggagtttccattgtactaaatttctaccttgctcctgaaatgctcctgatgccagtcatctttccctgtgttctctctcctcacctccacctgagccctcctttccccatcactacccaccccagtccacccacaatatgtattctgattcgccttcctaggaagatagttgcttcctcccttgagctctcgttgttacttaccttctgtggattgtagtatgattatcttttactttatagctaatgttcacttgtaagtgagtacataacatgtttgttgttctgggtctgggttaactctagttccatccatttgccagcaaaaattcatgatgtcacttttttttaaacagcagaataacactccattgtgctaatgtactacattttctttatccattcttcagttgagtgatatctaggttgtttctagtttctggctagtatgaataaatctgcaatgaacatagttaaacaagggtcattgttgtaggatagaacatccttagggtatatgcccaggagtggtatatggctaggttgtgaggtagatcgatttcaaattttctgagaagctgccatattgattttcaaagtagctgtgcaactttgcactcccaccagcaatagaagagtgttcctcttgttccacatccttggtagcatgagctatcacttgtaattttgatcttaaccattctgatatgtgtaagatttccatcaaagtgattttgataccactcctgggcatataccctaaggatgttccatcctacaacaatgacccttgttcaactatgttcatttacatttctctgacagctaagaatgctgcacatttctttaggtgtctcttagccattttgtttgattgatggcgtcttttgccttacaagtcaatggcctttctctacacaaaggacaaacaggctgagaaagaaattagggaaacaacacccttctcaatagtcacaaataatat

SEQ ID NO: 3838 - DNA, 1000 bp, mus musculus
agagagaaagttcccagttgccatctctgactaaagattcggagcaaaccatgaaattcactgtgggagtatcacagagccctgggaggatggccctaggaacaatcaactgttctgcaatgtctctgacagcaaaagagggacagaccacgcccatgtgtgcctgtctctttactcctcctatagagaaaacgtagacacttgtttgccttcctgtccaaatcctcatgcacatttcatagtcaatgctatttatttattcatacatcattcatgtctaccctaggaagtaataaaaatgaaaacaacttgtgtcatgtaacattaagtaatattcttattaacattttactttgtcaaatgatattcaagtatttggaaatttcagtatctataccttaaattctggacacggtagccagtgcctaataggggatattcaaagtggtcagtacaacacggagaaatgtttgatttgtctctctgctcattcttcaattattatacccatgataactgctaagtttaatttgatatttttgttttgctttgtttgattttgttgttcttgttgatactataaagcttgcttgagaaacatcttgctgccatataaacttgaatatcctgaggggagcagatttgaccaaatctaagagtctgtgcttctagagaatgcatgggctgaaagagctcttctacatctctaacacaataatatttgaaatacacttaggtaatattgtcaagaacacggagttgcagattttagttcacttcggttgctacagtgcagctgactactaattcccatcatggacactacaggtttttcatcttttgagtggacgtttgctgtgcagtttagtatgtccctgtgcctgaaattattttactctttattaatctgatcttagtaccagtactaacatttctctcctgtacaacttactatgtctttctttgtcccatgatttactgattcactgtatcatatcta

SEQ ID NO: 3839 - DNA, 1000 bp, mus musculus
ggaaaaatttcctagagattgtatactgcagggtcaaaaatggagaaggacctgagggaaaggacatccagtgacaggtagagattggaatccagctcaaggggaggccccaaggcctgacactattactaatgatatggtgtgattgcaaacaggagcatagcttcatggctgccctccaaaagatccaaagagcagattcatggaaggagttacagagacaaagtttggagctgtgacaaaagaatggaccatctagagactgccatatccagggatccaccccataatcagcctccaaacgctgacaccattgcatacactagcaagattttgctgaaaggacccagatatagctctctcttgtgagactatgccggggcctagcaaacacagaagtttgctcacattcagctattggatggatcacagggcccccaatggaggagctagagaaagtacccaaggagctaaagggatctgcaaccctagaggtggaacaacattatgaactaaccagtacccaggagctcttgactctaaccgcatatgtatcaaaagatggcctagtcggccatcactggaaagagaggcccattggacacacaaactttatatgcctcagtacaggggaactccagggacaaaaaaaaaaaatgggaatgggtgggtagggaagtgggggggggagggtatgggggacttttgggatagcattgaaattataattgagggaaataggtaataaaaaagaagaagaagaaaaaaaagagtcagatgcagacatttgcacccaaccaatggacagaagctggggactcctgtggttgaattagagaaaagctggaagaagatgaagaggagggcaaccttataggaagaccagcagtctcaactaaccagggcttctgagattgttgagacactgagcaaccaactaggcagcatataccagtgaatatgaggcccctaacacatatacagcagaagattaccctgt

SEQ ID NO: 3840 - DNA, 1000 bp, mus musculus
gcaacaaaatgttgggtcctgcttatgtagctgctacatccaatcctttaaaaaaatttttcattagttatcccttatttacatttccaatgctatcccaaaagtcctccataccctcccaaccccccactcccctacccacccactcccacttcttggccctggagttcccctgtactgaggcatataaagtttgcatgaccaatgggcttctctttccattgatggtcgactaggccatcttctgatacatttgcagttagagagaagagctccagggggtactggttagttcatattgttccacctatagggttgcagatccctttagctccttgggtactttctctagctcctccattggggaccctgtattccatccaatagctgactgtgaggatccacttttgtgtttgctaggccctggcatagtctcacaagagacagctatatgagggtcctttcagcaaaatcttgctagtgtatgcaaaggtgctagtgtttggaggctgattatgctacatccactcctgtagtgacctgagtgacatgctgaaaagcctggatgcagtcccatggcataaagttcacagaaacagtctcctgaaaccatagcatcctataataatgaatgctccagatctgtccttgctttagtaggtaaatggatctgtgtgctttccctcagtattgtttcagtacaggtgtctccaagcaatgacttgccaaatacctaagcagaaccgaaactttgcttcctggccttcaccaatgtgctaggtcattcttgagctgaacgtgggctttgaattcagtaagaatgttgccttttaagtgacattaaggagctaaagagatctgcaaccctgtaggtacaacaacattatgaactaaccagtaccccggagctcttgactctagctgcatatgtatcaaaagatggcttaattggccatcactggaaagagaggcccattggacacgaaaactttatatgccc

SEQ ID NO: 3841 - DNA, 1000 bp, mus musculus
acagagaagctgctgatctgttgccctggctgcagtagatatcctgggagggctttagactattgggtctttagagaagtagtcaagctgttgtcctgtatgaaccttttctctggaggggggagctatgaagtgtggtttctgtttccctctgtgtctcagcaccccagggaggctttcagtctgttgggtcagtggccttgcatgccacagagtccatgggaggtcttcaaagtgtggtctctgttgcccagttgcctctgtacagaagtcctcctaagataccttcaagctgtggtgtagccacagctacaccaggggagcagccaagctggagatctgttgctaagttgccctatgtgcagtggctctcctgggttgtcttagactgtggtatcagatgtcctgagtgcagcagatctcctgggatgcctcaggatatggtatcttcaggggaggagattagctaacagtctgtcccagcagaaaggaccaagcagaaggggagtggtattctgcaggtgagggtcttgtggagtgatgggttccaagtcaactgggctgccagcggcagctgtgggtcttcggaacagttcttaccaaatgctctgagtgcagcgaatcttccaggttgcctcaggatatggtgtcttcagaggagcagactagctagcaatctgtcccagcagaaaggaccaggaagaaggggctttttttattccatcttaatctacttcttgctgtaacagaacacctgaggccagtcagtgttattaaaacactaagcttacagatcaacatgctaaaaagttcaagaacattacattaacatctgatttgcatcctatggggttttcttgctgcatcttaacagtgtgagacagggtaagcatggtagctctagatctgtctttcttatcctgaagagccactaatgtgctacccaggactgtgtatgtctttaatctcagcacttgggaagcagaactccatagctcct

SEQ ID NO: 3842 - DNA, 1400 bp, mus musculus
tgttgctacttcataactgtaattttcttactgttatgaatcataatgtagatatctgtgttttctgatggtcttgggtgacactcagagggtcacttgacccccaaaggagtagggacccacagtctgaaaaccactgctgtaaagactaagggatgtgtgtgtgtgtgcatgcgtgcatgcatgtgaatgtgtgtgtgtttcccttttctcataagggccgtttccagaatctgccctttgggaaatagggcttgctaccagcttcctggaaagcaagggtttccgcggctactcgttctgcatagggaaggaaatcctgtgtttctggtgcttcccggggctaataagcaagtacttctaattccattgaaagtcaacatttttggttcatctggccatagagcatatgaagactgactggtaaatgtgtgccgattcgggtggaccatagaaggtactgacaatggcagctgttggcctcatctctgacttctccgatccccagtttcttcttgatgccctgctggctaaggaaggtgcccgaccttccctcgtcagttctgtaattcagagcctgtgggaaggatgcaggtgattttactgagaatggctgcaaacacctgtattcggacatttgtatttggaggactgggttatgggctgatttgaataatactataagtttacttgttctcactctttcttacattatttgatttgaggaaaaacattattactggctggaaggaagaaagacataaaagacttaaaggacagaaattttgttgaagactgaaggattacttcaaataatcagccacaacgagatgaaggacatgtttgatgactgcacactgagtctctacccgtgtgacgtcagctctggaacactgcactgatctcttccgggggctgttttctcatcatgacgccttgtcagcttcctcttagaacagtctgttctgtctttccaaagaggtttcagcaccccttaaagttttctaatttcactcaaagtgaaaactaaagaccttgcaagtcggtgctagctctaggtcacagggcgccactcagtgccatctctggctttgcctctttctcttcccttgcccaccttctgcctcctagctgtaaactactgtcttaggtttctattgctatgaagagacaccatgaccatggcaactctcatagaagaaagcattttattagggttgacttgcagttcagaagtttagtccattatcattataggaggaagcatggcagcatgcaggcagacatggtgttgtagtggtaacagaattctacacctggatctgtaggctgcagaaagagagagtgacactgggcctggcttgagcatttgaaacatccaagccagcccccagtgacat

SEQ ID NO: 3843 - DNA, 1000 bp, mus musculus
ttattttctgtgggcttctgtctcacttgctaagaaccagtatccattagttttactaatattcatgtaaaacgcaccaagatatttatctgaaaatcagcatttcaacttaaaaaagcgttatgtgtgctcacaccctttgtgcactcctacaagtccataggatgagtgagaagggagaggcccgaccacagtgaatgtgtagaggcaagagagcagctttgtggagttggttatctcttcctccttttacgtgagttccagaatctaacaggtttggctaatggctttcatagcaagggccattaccggctgggtccccttgctacccccagtgttctggttttagtaagcatggttatattgacatcctgtgcgtctctgactttggttcttgccacttcagatttactactggaagacccagagctcctctaaaagaaacaggcgccacattgagaagaagatcctcaccttccagggcaccaagactcacggcatgctgccagggctgcagccatacagtcactatgccctcaacgtccgagtggtcaacgggaaaggggagggcccagccagcacggacagaggcttccatacaccggagggaggtaaggaatgggtgcatccctgggatcaaggagcgtgtggaacatcctgaaagggtttgcactacagcaggccctccatggagagaatcctctagaagcaaactgcatgattagaaatgatcacagcacacacgaaaactggagaaatgtcacccacacatgactggaagccacacataaaacttcagagtgcagaaagctgtctccagataaccttttcccccttaaaaatttccttttcacttagggtatctgaaacattgctaatgtagtgtgggagtcaccagctttctgagccaagtcacattccgtatcttctttaagtgtcaatagctccctctggaaagtgtgagcgatgggaggaagaagtaagaaaatacccacaaagg

SEQ ID NO: 3844 - DNA, 1800 bp, mus musculus
aagggctcctaacaccagaaaaaattcaaggccaaatataccttgtaaagccatttcccactttacttctgatagactgtcttgaatttcgttagaaagttcaagaccagacttaccttgtgaagctgtactcactggtactcccgttccccagctgaaaagttctgaattcatgcagttgaatccttctcaacagtctgtgttgtgggaacacttcataaccgtgacccgcagttctggttctggaatgagggatcttccttgtgccggtgatggtaaactctcgtcccgagttttttctcgtcccggaattcggcaccaattgttaatagcgttctcacgcccggccaggaagaacacagcaaaccagaatcttctgcggcaaaactttattgcttacatcttcaggagcaagagtgtaagaagcaagagagcgagaaaacgaaaccccgtccctattaaggagaattatccttcgcctcggacgtgtcactccctgattggctgcagcccatcggccgagttgacgtcacggggaaggcagagcacatggagtggagaaccaccctcggcacatgcgcagattatttgtttaccacttagaacacagctgtcagcgccatcttgtaacggcgaatgtgggcgcggctcccaacacctgagtgctacagggacagttctcttggtcttatgatcctgggccctactctaccgcttactgcaggtggtgagggttgaggctgggggcagtaccttcctggtgcccatgccaccgcatgacagatgcatagttgggccagctcttcaagcctcatgcccttgtggctagctcatctgagttcccactaccaaggacagctctactatgctgcccaggagagaaactctccagagtgccatagccagtgatgtgcagggtcagttctgcacatcccttggacatcaatgtgctctcaggtggcagaccagaccgggaatgtctgaatggtctttagagatgacatacatcatggacatcgacagtgacccctgcttctctatggcaatggacccagacgtgaccctcagtggcagcacaggctgggacttcaccttaacctcaggtggcaggataggttacttacagctagtcctcccatcctccagttccacctctcttcatgatgctcagattgttctgcttttcttattttatcatctgtccaccacatacttgcacaacatagtggctctggttgtgggtaggccatgaggcaggtgggcctctggaccatttgctagtgggttagcctttttcttctgattttttttttcatgtaggcaattgatggctataggcttcctttgggggaatattttaatgtgtttaagattttttttttaaattttcgcgaagttacaagaatattttcatttatttcttgaattttctttgagtcattcatcccttagtaataaattgtttaattaccatctgcatatgtacttactagagttttgtttgattttaagtttattgcatagtggtttgaattggatatgcagaattattcaatctttctgtatttgtaaagagttgctttgtgccccagtatacgatatactttagagaagctcccatatactgctgaatagaatatgtgttctttaatgtttatttgaaatacttgatagatatctattatgtccatttaatgtcagatgccatctaattctgaaagtcctatttatttcttgtccagttgacctatctattagagaaagtggcatgttgaaattacctatgattgttgagtttgt

SEQ ID NO: 3845 - DNA, 1000 bp, mus musculus
cttttttttttcagtgtgctttttcatttttattcctcccctcttccattagcccactccaggactccctcacagacctacccagagatgtgttgccaaggtgaatctagagtatgtcaagttaacgatcagcctcactcatcacagcattcgaggctgagtgaccttggaaaatattctcctgatttctaattcagggatatttctagtgcatcataattgcttaaacatttagctcatattttcaacatgtgtctcatgacgttgctacgagaatcagtgagagccagaatcactgctgtatctttagggacagcttgccatgctggacattgtggcagttctttgggctctccacaggataggtcacagctgcttcaccccttctcagcttacatggttctttctgacactgggaacacaacttctgttccaatccaatcgcacggggaacctgagacagcattaattggggaagcagaaaacccagactgaccagggtcacaagtcccttccggtcggccccagaaccatgtcaccttgggctcagagaatgcggacaccaccaaggttcccagagcactctccacaggatcttaggacctcctctggtgagtggaacacaacctctgccaggaggcaggttcgaacaccagatatctgggcaccttccctgcaagaggagagcttgcctgcagagagtgctctgaccactgaaactcaggagagagctagtctcccaggtctgctaatagagactaacagaatcacaagaggaccaagctctaaaaagagacaactataacaactgacttcagagattaccagatgacgagaggcaaatgtaagaatcttactaacagaagccaagaccactaaccaccatcagaactcagcactcccaactcacccagtcctgggcacaccaacacacccaaaaagctagacccgggtataaaagcatatctcatgatgatagtagaggatatcaaaaaggact

SEQ ID NO: 3846 - DNA, 1000 bp, mus musculus
ataataagataaacaaaaaccaaaacatcagatttggtcaagtccagcatgcagacagaaaagggcccaagagaaagcatagtaatgagagacccacttgtttgcacattcaggaataccccctaaaacactaaactgaaaaccgtaatacatatgcagaggagctgatgcagacccatgcatgctctctcagtctctgtgacttcataagagcattgatcatggtgatttagaggtcttattttgtggatatcctccattccctcaggcttttatcctcttccatgaggttccctggtccctggggaaagcatattgtacatataacttttttttttaattgcaggttccttagggaactattgaactcttctatcaattgcagatgaaaaagaaatcaattttggtccaaatgacaataactgtatcatcattttaaagcttttaaaactattgattcaatgattgcaagattgtttttatctttgacttaggttcctataaaaatgtaaactacaaaatgatattttccaatagtgcagataagctctagataaatttgaatgttcaaatattgctgagtagtggctgtgcatgcctttattcccagcacttgggagacacaggtaggcagatttctgtgggttcaaggtcaacctaaactgcaggtagaattacaggccagccagggaaacactacagtttgtgagggaacaggaacaacaaacttgagataaagctactgtgtatgcccttgtaatgtgctgcaaagcatcggctagtgctgctgccagtgtggaaggccattgcacccttagcagggagtgggaatgccagagggagcttctaagaggacgagtggcttatgcccaatacttgccaagcttggaattgaatgaggattacttcattttatttattcaagaaattaagttatgatttacacttgtgtgttattctatccaaatacaatttctagttctttaaaggttcatattca

SEQ ID NO: 3847 - DNA, 1800 bp, mus musculus
taattttattaatgtgtcactagatcattaggaagatataagctaacaagtgcaatggtaccaacattgaaaagataatgactattaagtttctagaaacagacaaaagaaactcagtgagcatagactagtaggaaaaaatgcaaacaaattgacaaaagtattgttaccaaactgctgttaattgagaatacatagaaaaattttaacaccagacagggaaaaaaacaaacaaacaaacaaaaaaacaaaaaaaaaaaccctcacatgttctttatgaagcaagattggccacctcagaaccttcagaattaaaatccaaaactcactcaacacagtgtgttcttaatgatgaaaaggcaagaataataaaatgtgggtatgttgcagaaaaaaaacctgcaggtggataactcatctgattcagcacccttattgcctacaacctgtgtttgaaatgctggtcatctagaagttctggtgttcctttacggtgcagagcctagagaaggtttaaaaaaatgtagctcaaggggacaccccaaggcctgacactattactggggctatggacatttcaagactgccctctgaaatactgaacaagcagctgaaagagtcagagggagatatttacccccaaccaacggacagaagctgctgacccctgtggttgaattagggaaaagctggaagaagctgaggaggagggtgaccctgtaggaggaccagcagtctcaattaacctgaaccactgaggtctctcaaatactggatcatcaaccaggcagcatacaccagctgatatgaggcccccaacacatatacatcagagaactgctgggtctggatcagagaagatacccctaaccctcaagagactcgaggtcccagggagtggagaggtctggtggggtaggggctgggagtgggaacattctcgtggagatggggtggagggagaggaggtatgggatatggaacagtcagagagtggaccaggagggggataaaggctggagtgtaaaaaaaaaagattaaataaagttgaaagaaagaaagaaagaaagaaagaaagaaagaaagaaagaaagaaagaaagaaagaaagaaagaaagaaagaaagaaatgcagtgggctagaaaatatcaacaatctttatgcctgcgggaggatcagtgtgtcaatcactgatgggcataccccaccccacatatacacagccactctcatgaagaataacagctctcggggcacatggatactatcctagcatgcaaacaggctgaggtacaaggggtccacattttaggtcacctgggactacactgcatggtggatgagttgaaggataaaatagtctccagagaaaatccttgtcaaaaactagattgtgagaggtgtcaagaaaggaaaagaaaaatgaccttgtgtgtgtttacttgccactgctatcctctctttagagcctctttttactatgatctattacgtcatacaattgggacacatttttccctttcatacaggttctactgtagatgacattttggattttattaaaattacccacctcatagtttgtaatgcttcttgaatgtctttcctttctcactctgtaccatcccttatacatattgccttaaatgaatgtttatctctatggaaaatgttaggtaagtttcatctaaatttcatcacaaacagcacccacaagtcagtgactttgaaaatcatgttatttgtcacttatataagatgtataaccagagtgatgtactctctgaggctggtgtcttt

SEQ ID NO: 3848 - DNA, 1400 bp, mus musculus
attttttttcaaaaatagctagcatttagttttatcaggctttttttctgatgtagttgctaggagattaagagatcattttgtgggctaatgtgcaaatatcagaggttatatctgatttttattatagctaaattatgtgtttttctaaggctcaaagccttatcaatcaactattattaaacacttgatatttaataatttcgcatggtatttcatttctcaatttttgaatgatgccagaaacatgagacaattgaacccaagtctgtcttcgtaagagacagttttgggtcttttttgctttggctctttctgtataggtgtttccatagtatatgtagatagaattgtttctttctagatgatgcatggtaagattctctcttataccctctcttcattgaaactctgttaactgttcttatactataatcccatggccaaactatcaattcaagcgctaaatctgctcctacaatcctatctgcatttttgtggcagtggttgactgttctacccttccacagtggttctcaaccttcctaatgctgtggtcctttcatactatccctcacgttgtggtgactactaactataaaattatttttgttgttacttcactataattttgctactgatttgtaatataaatatatcatgcttaggatatctggtatatgacttccatgaaaaggtcctctgacctcccaagagttgttgacctacaggttgaggaccactgacctaatacattagctccttggtttcctttaggacattatcactgtccttacaggtccatcttaaatagcatcctctcaagaaaactgttcatctttcttcaggaaatatacccatttgtcactttgagctctgtcaccctctcaagtattgacagctcgtttcatggctgcactatgaagtcacattaggcttatgctcttcattgggcttattgcctattgccaatgttgacttctacatactttttaaaaataattacacaaactgggagtgaagcatggctcacgtcataagtctaactatgtctactgctgatctaaagtcctaagtttttgccctcaagtatacttactttccatttattttacttgtcccatctaaatattctattttgttcatctttgtttctctgagtctggtagcaaagtcttaaaaatgggtaagagtctatgggtaagagtctataaaaaattaaatttaaattaatttaatataacctatgtagaatatataaaatacaatagaagcataaaattttccttataaattcctttccaaatactcagtaaggttgaaggtataggaacacaagaatatagcctcttcttcctaggaacctattatttaggaggagctagaccaataattacaag

SEQ ID NO: 3849 - DNA, 1000 bp, mus musculus
tgtgtctacttccctttttatgtctagtatgggtttgttcatttccatctcctgtttgatgtgttttcctgtttttctataaggacttgcaagtctttagcagtgttctcctgtatttctttaagtgagttattaaaacccttcttgatgtcttctaccatcatcatgagatatgcctttaaatccgggtctaggttttcaggtgtgttgaggtgccctggactggctgaggtgggagtgctgggttctgatgatggtgagtggtcttggtttctgttagtaagattcttaagtctgccttttgccatttggtaaactctggagtcagttgttatagttgtctctggttagagcttgttcctcccatgattctgtcattctctaccagcagacctgggagactagctctctcctgagtttcagtggtcagagcactctctgcaggcatgctctcctcttacagggaaggtgtagggatatctggtgttcagacttgcctcctggcaaaagatgaaggcccaaaacaggacctgtcccagaagctgttagcttctgtagtccacactctcacctgtgcagactagtctagctggagtccgggaaccaagatgtctctcgcagacgctcaggcaaaaccctgccggccgggcagacacctatcctctggcagggagggtgtcaggatatctggaccccaaaaagggggctgcctcagaagctctgtggctctcacctgtcccagaaactgttagcttctgtagtccactctctcacctgtgcagactagtctcggtggagtctggaaaccaagatgtttcctgtagatgctctggcaattccacaaagggtttctaagaacagagttgctactttgctgaacattctatatttatacctttttttaactggcaataaattgtttgactttagcatggacatgaatattggcaggatactgtactttttattgtgtctcatacagaacaattgctgaagctca

SEQ ID NO: 3850 - DNA, 1000 bp, mus musculus
caatagtccatctctaatggctgagctttccagaaaggttcattaacatatctcaaagggccacttgcaagctatggagaagcattgtccattcctgaattctgtacttaagatcagcataataaatttcgctaatgcctaaattctctctctgtgcctgagagacagagcattcaggagagattccagattgacatctggtgatttaaagttcctctatagttatataggataaaaatctggcttacattttcttttccctacatagcaactcctaatgattcatctgttgctggctgttaaagctgttggcagggctagtgagtacatagagtcggctgaagaactagcatgtattaattgtttaagaatgagagtagaaggcccaggccctgcttctgattccagctctggtttgggtcagtcagtttatctatcttccacctgtaaaatgaaaaaaggaatacagatgaacattttagagaagcaatgaggtagaagaattctctcataattaacacagaatatcatagatatagaaagggcagtgaaaaagtttaaaaccaatttgttatgaggatcatttgctataaatgtgattaaaattattctgtttgacagtcaggcattggttgttagatgtagctggtctttgtgcaatggctagaagaataccattcctgtataaattttgtagaaaaataatagcaacatgtgagaggaaaataaatagagatatactctctccactctgacacccctgcaaccatcatgaggtcatcttctcagttctgctttgtgcctcatagtctctctctgtggcactgccttcagaacacatgtctcataaatcattcaggtgagaggcattaatcataataagccataagaccaagtgaaattctgaagaaggccctgggacattacttttcagataatgtctactgtctttgatgtgtcttgtgtcgcctggacagtttcctggttacagactgttaga

SEQ ID NO: 3851 - DNA, 1800 bp, mus musculus
aggaaaggtttggaaatagaggatgaatttaacaggaatattacataggtactgaatatgcactaattttgtctgaattttaacagtctctttctgaagctaaaaatttcaataccaaaatatatggaaaatgaaattatgttaggtacataatgatgctaactatttggggatatgagcatttgtatgaggacatccctttctgatgacaacaactctctggaatttttgggtcataaaaagcttatgatgtaagatgccttttcttcctgtgtataattgataccttatccctgtagtatattatccagacatatggttaagtctttcctatggctaattgaatttcagtaactttgctcatttcaagggatcatgcaaaaagcaagcaagaggggtaaatcaatatatattattaattttaattcactatattagataaaacaagaattaagaaattacagatgcataaaatttacaagctacattaggataattaaaactttatgaatgggacaggatggaagtgttccttcaggcaaatataagcttggtaatcttttagccactattctttttttttttttttttccattttttattaggtattttgctcatttacatttgcaatgctataccaaaagtcccccatagccacccaccccctctcccctacccacccactccccttttatggccctggcgttcccctgtactggggcatataaagtttgcgtgtccaatgggcctctctttccagtgatggccgactaggccatcttttgatgcatatgcagctagagtcaagagctccggggtactggttagttcataatgttgttccacctatagggttgcagatccctttagctccttggctactttctctagctcctccattgggagccctgtgatccatccattagctgactgtgggcatccacttctgtgtttgctaggccccggcatagtctcacaagagacagctacatctgggtcctttcgataaaatcttgctagtgtatgcaatggtgtcagcgtttggatgctgattatggggtggatccctggataaggcagtctctacatggtccaccctttaatctcagctccaaactttgtctctgtaactccttccaagggtgttttgtttccacttctaaggaggggcatagtgtccacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataatgctgctatgaacatagtggagcatgtgtccttcttaccagttggggcatcttctggatatatgcccaggagaggtattgctggatcctccggtagtactatgtccaattttctgaggaaccgccagacggatttccagagtggttgtacaagcctgcaatcccaccaacaatggaggagtgttcctctttctccacatcctcgccagcatctgctgtcacctgaatttttgatcttagacattctgactggtgtgaggtggaatcttagggttgttttgatttgcatttccctgatgattaaggatgttgag

SEQ ID NO: 3852 - DNA, 1000 bp, mus musculus
agtatgcttatcatgtattttctacatcagattaaagcaagctgagcagtccagctgtgcgtcccttatgcctctacactgcgattgtgtttgatcatcagccctactcctgctgctgtcactttctaccacaatcgcttgtgctcttgaattgtgaaatggaataaaaccttccttctttatgatgctttacacgatattttgttgcaataagatatgaaactggtgtggtaggaatataaattatttctagttgcttatcatgaacattttgtcccccttaaaacaactctactcttacccttacaggtagagataaaatattctgtatgtagtaaattatttttatctctttaatttttcttctgcagctaaagatcagtatgaagaaagattagtttaattgcctattacattgtgcctttagaatattctttgaataccccattgctttttagatcaactatagctaaacattttaagaaaaattcttcacacttgttttggacttagtggggaaggggaagacacatattcatgctgatcttggttggctagtgaaataatttgtacctgaatctgagtcttaaatacaacttacagtagctctcctaatgtatacccccaagactttgacaaaagtttacattttcttgattcaaatataaatccagataagagcatgactgctttagaattaaagcaaaatttatttccatagtgtgataatgaatagtgcttcattttctcagacccatctcattcaacgttttgctcaaacaaatatttggacaataaatgtttacaaacactgacagtttttctttttcaggaacattttaaataaaaatattcaaaataggaatgatcagatgtcaactcctaagacagatagatatgtccactattgcttatacaaattttgtttctcagttacctagaagtttcaagttaatggtaagcactctggacagggactgatgatctaattccacactta

SEQ ID NO: 3853 - DNA, 1400 bp, mus musculus
agatgctccctggaacaccacacaattgacactccttaaaagacaggtgtgtactccgttattttaggagtctggctgtggctactggctactggcaagagtttattttatcttgattctatttagaggcagcctcatttattcttgatatggtgattttataacaaaaatctgacaattgaaaaaaatgtaagaagtagatacctcctgtttactgccacctgagttcaaaattcatcaacatgttcctgtctccatatttcattgttaagcaagcaaatccaattcaagaaaataaagtcacttctttgtaggaggtatgtagggggtggttttgatactaagatcctgttctccaattggttcttgatctgtcagtaaagaaaaccatgggccaattactgggcttaaggtacaggtggaacttctggatcccaggaggaaatgggggatacaagggactagaaaggaagtcaccatgctttgtagagaagagaatcaggcaaccatgtaaaatctgaaaagggggtagcccaacaggccatgcctacaggcaggtggtcaggggagtttagcaactgaagtttagggaaggtgagagaaaagaaattggtaagagcacttttccacttgggagatattaatacccagcaattgtgtcttaaggcaagaccataaggaataactgtgtgtctgtgtcttttatccgaggattcaagggaagctgaaagagagctgggagggggctggtagcatggtcatcccctggagctgaggatgggtagaatgtaaaactactcgcaacagggtggggagggtccacagtttgctgctgtctggatgtggtggtgtttctgtaattttaaaatcaggagacagacagtttgtggtcagcctggaagattggcttaaaaaaacaaacaaataaactaaaaattaatttggggatgtattctataatatatataattctttaaaattctttgttgctgaagtagtttatcataactaattagttaataatatctgtgttggtaatcaaactcagggattcatatatttgttctaaacctaaggtatattcctggacaaatcagttcttacacacatttttaagaaatttccatcttgaagtgggtgaggtgagtcttgagaaaatatttgtgatattattttgtttttattcccaccaattctgggactactaagagccaccactgagatgtccatctgatttacctctatggagatcagtttagtgtgctgtgacctgtcactgatacagggagttgctatactctcagtgacatttcatatcattctcaaaatctgagagggttaatggtagccttgaatgtctaacaaatagccaaatcaactggtaagagacttaggtgctg

SEQ ID NO: 3854 - DNA, 1000 bp, mus musculus
aataaaataaaataaaaatttgactgatgttgggaaaacatattttgggaagaagacagaaaaaaaaaaaaaaaagacaaccatgactgaaagtgttcggtcattcctgccattccacacacatgaatgcaggccagcatgtggagatccccagctcccgttacacacaagtaaacaaatacacacacacaaagacataaagacaaacagacacactgcactatatcagcaccctttctgatttttttccactttatgagtaataaaatccactgtatcatgactgcacatctacttattgcttcaactcaagacttcctcatagttaagctcactgtgaataaatctttggttgtctaatcaacctggaagttgcccttatctactagccatatgttctcatgtgagagcacacctgaaagtttattagaaactgccccacctggggatacatctcataaacaaccaccaaacccagacactattgcgggtgccaacaagagcttgctgataggagcctgatgtagctatctcctgagagactctgccagtgcctgactaatacagaagtggatgctcacagtcatcagttagacagagcacaggttccccaataaaggagctagaaaaaggacccaaggagctgaagggatttgcagccccctttgaactaatgtgaactaaccagtaacccctgggactaaaccaccagtcaaagaaaacacacagagggattcatagctctagctgcatatgtagcagaaggcctagtcgatcatcaatggaaggagaggctcttggtcctgtgaaggttctatgccccagtataggggaatgcttggggcaggaagcaggagttggtacactgggaagcagtgggaggaggagaggataggggatttttggaggggaaactaggaaaggggataacacttgaaatgtaaatgtagaaaacatctaattaaaaaaaaaaagaaaagaaaaaaaaaacacgtttatc

SEQ ID NO: 3855 - DNA, 1000 bp, mus musculus
gtgttatttcattttttttttttttgtatctactgaggatagctttacaacagactacatgatcaagtttgttgaaggttctgtgaggtgctgagaagacagtatattcttttgtatttacgtgaaatgttgtgtagacatctgttaagtcatttgatttgcgatatccgtaatttcattatttctctttttggcccctgtctcaacgacctgttcaatggtgagactgggatgttgaagtctcccactactaatatgtcaggcttgatgtgtgatttaaggtttaataatgattcttacatgaatgtgggtatccttgcatttggagaatagatgttcaaagttggtgcaccattttagtggatttttttcttcaatgactatggaatatgactccccatctcctttaataacattttcttaaaagtctatttcactaaatattagagtggtgactcaatttttgggaggtctatttgcttggacaacctttttctggatccctactctgaaataatatttatttttgtttctgaagtgctttccttctgtgcagcagaatggtggaccctgttttcagagcccttctcttagccagtgtcatttgaatagagaattgacttcattgatgttgagagatagggatgaccaatgattatttgttcctattattttcatgtggtggtggtggtggtggtggtggtggtggtgtgtgtgtgcacgagtgtgtgtgcatgtgtgtgtttgtgtgcgcgtgtgcgcacatggaaaggggggaaagtttttggtgatgtaatgctatttcctgtgtttgcttgggtgtagttagcctgcttgggtcatagttttccatctatcatcttttgtagggcagggttttagatagatatttttaaattaggttttatcatgaaatatcttgttttcttcatctatacggattgaatattttgctgcatatagtagtttggggaggtatctgtggtctcttaacgtctgc

SEQ ID NO: 3856 - DNA, 1200 bp, mus musculus
attctgttgctgatgctcgcatgtattgttcctgatttcattcctagggtttctatctccactgttgcctcagtttggcttttctttattgtgtctacttccttttttaggtctagtatggttttattcatttccatcatctgtttggatgtattttcctgtttttttttttttgttttgttttttttttgtttttgtttttgtttttgttttgtttttttgacttctacctgtttgttagtgttttcatgtttttctttaaggaaacatgtaactctttagcagtgttcttctgtatttctttaagtgagtattaaagtccttcttgatgtcctctaccattatcatgagatatgcttttaaatccgtgtctagctttttgggtgtgttggggtgcccaggactggctgaggtgggagtgctgggtttagatgatggtgagtggtcttggtttctgttagtaagagtcatatgtttgcttttcgccatctggtaatctctggagttagttgttatagttgtctctggttagagcttgttcctcttgtgattttgttagcttcttccagcagacctgcgagaatagctctctcctgagtttcagtggttagagcactctgcagtcaagctctactcttgcagggaaggtgcacagatatctgttgttcatacctgcctcctggcagaagatgaaggcccaaaacagtgcctgtcccagaagctgttagcttctgtagtccatactctcacttgcgcagactagtcttggtgggatcagggaaccaagattgctcccctaggtgctccaggtggacacctctcctctggtagggaagatacctggatgtttggagcctgaaacagggtctgcctcagaagctctgtggctcccgcctttcccagaagctgttagcttctgtagtccacaccctcacctgttcagactagtcttggtgggatctgggaaccaagatggctcctccaggtgctctggcaaagctctcctgggcggggtggacacctttcctctggcagggaaggtgcctgggtatctgaagccccaaatgaggtctgcctcagaagctgtgtggcttctgcctatcccagaaactgttagtttctgtaatacacactcttacctgcacagactagtctcagagggaccctggaacaaagatggctcccccaggtgctctggcc

SEQ ID NO: 3857 - DNA, 1000 bp, mus musculus
ttaggattgctgttttcattgcctgtttatcttatctctattttattagagtgaaacataaggccaatttcatgggtagtacattatgtaattggaacttaccaccacctcatccacaggtgaatgccattaacgtccttttcactgaagatagctttgctttgcctttcaaggtacctatacatttgttatttattatctatttaaatgagtgattctctatcacttatctagttcatctggagatctaacacaaaattatcttttaactctatcctatgcttatacatatacatcaaaaaagaagtaattggcaatactgctgagttaaaagaggagaatggcatatttactcttattggaaaatacttaatggtaatgattgtgcacatggaatttttacacattcctttttttttttggtattacacttcatttcgttggctcatagagttcagcagcagggctgtttaacagtgggctttccattgcacatggttgtttttagagatacatatgtgcaatggtgtactcagattagcataaagtgtacttttgttgaacctggccttaatcttaaaaccctagagatggaaagtagagttactcaaaactgaaaagcttagggctgttgactgtttcaattcacctgcagcaaatacaggaagtgggataccctgtttgctgagaaacactgtgccaagtatatagcatttaatggctttggcaagaagaatgattttcatcagctgtaacaaacaagttcctcatctctaaccctaccatctgtcctcctggttcccacccagaactctgtatatggctcaactgaacaggtttcagactgcctaaggtcactacacaatcaacctcagcagatggcatcgcagagaacatctaaactgtagcagtggccaagtacagaggctgatcctcttcgctgaagaagaatgccctttgcgcaaaccatcctgatgttccgattctactgaatgctgca

SEQ ID NO: 3858 - DNA, 1400 bp, mus musculus
aaccaagacaaaaaagaaaaacatagtatgtatttactgatatgtatatcttaaccaaaaagctcacagtgcctatgattcaacacacaaaccatatggaacttaggaggaagagcaaggtgtggatgctttagtagtgcattgagggagaaacagatgatcacaagtggtggaatgagggtggatctgggagggagagaggagggaaaggaaatagaggacagtattaagtactggaggagatgtgagagaggtacagagggtcaggaaatggaataaaaatatgtagcagtgggggaagaaggaggtaaggaactagtgatagctactgtagagtcccagatgccagggaaggaagaggttcccaggacccaacaggaattaccttggcaaaaaaagcacagagaaggggagatagaccctgtagagaccacctccagtagataagcatggcaccctggtagagggatggggccaaccacccatctaaaaattttcagcccagaaatgttcctgtccaaagggaagacagggacaaaaaatggaacagattctgaaggaagagccatctagggaccaccccactgtggaatccttcctgtctgcagacaccaaacacactgttgctattgacctgaggtgcttgctgacaggaacctggtgttgatgttccttgtaaggttttgctagcaagtgaccaatgtagatgtggatgctcaaagctaaccatcagactgagctcagagaccctgggggggggggagctagaggaatgacttgaggagcgcagggggattgcaaccccataggaagaaaaatgttgggtggacagaccacccagtgctcccagggagtagagtaccaaccaaggaatgtatagggagagatctacggctccaaaatcgtatgtggcagaagatatgatttttgccttgtctgacatcaatgggaggagaagtccttggacttgtggggagtttgttgccctaactaagggggatgctggagtgggtgggccaaagaggatgggtggatgggtaaacagcctcactgacataaagaggatgggggagatgaagaatgtgggatggagcatttgtgcaggcctgagcaggaagtaggatcatttgatatgcaaataaatagagtgattgaaaaaaatcaaagaataaattcataaaaaagaaaaaagaaaatgaagtatttgtctataacctaaaataggagagagaaagacagagagaaagagagaggggggggggaagaaagaaagaaagaaagaaagaaagaaagaaagaaagagagaaagaaagaaagaaagaaagaaaggagggagatagggaaggagggagggtgggagggagggacggagggaaggacggagggagggagggaggaag

SEQ ID NO: 3859 - DNA, 1600 bp, mus musculus
tacaattctttaaggggtttttgtgttttctctttaaggtcttctacctgtttagctgtgttctcctgtatttctttaagtgagttatttaagtccttcttgatgtcctctaccatcatcatgagatgtgcttttaaatccaggtctagcttttcaggtgtgttggggttccctggactgggcgaagtgggagtgctgggttctgatgatggtgagtgatcttggtttctgtaagtaagattcttacgtttacctttcaccatctggtaatctctggtgttatagttgtctctgtttagagattgttatagattgttaaacaactctgtttagagttgttatagttgtctctgtttagagattgttcctctggtgattttgttaccctctatcagcagacctgggagactagctctctcctctgagtttcagtggtcagagcagtctctgcaggcaagctctcctctttcagggacggtgtacagttatatggcgattggacctcctcctggccaaagatgaaggcccaaaagaggatctttcccagaacctgtgtcgctttggcctgtcacagaagccgttgtttcagtagtccacactctcacctgtgtagactactttccgaggattcctgaaaccaagatgtatcccgtggatcctgaggcaaaggcctcccagaggcttgtcctctggccaagaaggtggccagatgtctggagcccaaaaacggcaccgccccagaagctctgtggctctcacgtgtcccagaagctgctagcctctgtagtccacactctcacctgtgcagactgccctccgaggggtcccggaaccaaggtggcttctgcggaacctgatgcaaaagcctcccgggccaggtggacacctgtcctatggccccgaaggtggtcggatgtctggagccgaaaatggctccacctcataagctctgtggctcttgcctgtcccagaagctgctagcctctgtagtccacactctcacctgtgcagactgccctctgcggagtcccagaaccatggtggcttccgcggaacctgaggcagaagcctcctaggccgtgcggacacctgtcctctcttctttcaattttttattgatttatttcttttacgttctagtcattgcccccacctctcggtccccgctcccatagttcttcaccccatttatcctcacccttgcgtccaaaaaagtgcttccctgctccagaccttccccctccctaaggtctcaagttttaaactttaatgctgattggaagaaagtatctccagatttctgtggcaatgatccaccacaacttttcatgcctctgtctattagtgttgttgctttctgcaatgtcttttaatgagcttttttaaaataacaaccaataacccattttaccaccaatgttctaaactatttcaatcttgtaacttataaaaactctttactactctaaagtagagagatacaatttattcatcacagaagatttgtgcttaatgtgtataattaaagatgaaactcttcggtaggcataaaatgcatgggtagaactaccaaaacaaaattcattattatatagaagta

SEQ ID NO: 3860 - DNA, 1400 bp, mus musculus
tcctgaaacactgaaatgaagtattgaggatatttgatgggtcaatttaactaaaaacgttaatagtttgttgttgtttgtttgtttttgtttttttaaaaatattccttctttttatttaatatctctctttttttttttacactccagattttatttccctcctggtccaccctttgactgttccacattccatacttcctgtatgccccaccctgtctctacgagtatgtccctaccctccatcccccacccctttagacctctaaattcccctggacctcttgtctcttgagggttaggtgcatcttctctgtctgaactcagactcagcagtcctttgttgtatatgtgttggggggcctcatatcagctggtgtatgctgcctgcttggtggtccattgtctgagagatctcaggggtccaggttatttgagactggtggttctcatatagggtcactctcctcagcttcttccagcttttccctaattcaaccactggggccagcagcttgtgttcattggttgggtgcagctgcttgatgggtcttttgtagggcagtgaacacaccctagctcagtaatagtgtcaggccttggggcctctctttgagctggatctcactttgggcctgttgctggacctttttttcctcaggttcttctccatttttgtccctgaagttctttcagacagggaccgctatgggtcagagttgtgactgtgggatggcaacctcatccttcacttgatgccctgtctttctgttggaagtgggctctacaagttccctctccctactgtcagacatttcatctaaggtccttccctttgagtcccgatattctttcacctcccaggtctctggtgcattctgcagggtcctcccaacctcctacttcccaagtttgctcgttgatttttagttaaaatggttccagggattttgagtcaagaaaagagagtgtgtttcctccagggaattaatgtctatcttcctactagttaaggacaaggaagacttgcacactcaatttacagtctccacagtactccatctctcaattgcctgttgtcttcctagccatgtaatactctcccctcctctttgattatgcaagtagaagctttgtagaaaagaataccccttcagatactattaaaatatttcagaaagaaatacaattagctaagcacttacattttattagtaatatcaagcaaaattaataagtaaattcaagtaaaatggttatgtgtcaaagtctatagtttttgcattgacatttcacataatctgactttgcttagaagagaaatcactcggctgttaaaattacttctaaaaagctgtcaaaattagaaaacctgctgtcaaaaatatgatgagaaaagt

SEQ ID NO: 3861 - DNA, 1400 bp, mus musculus
tcagaatggctaagtccaggaacctcaggtgacagcacatgttggcaaggatgtggagaaagaggaacactcttccatttctggtgggattgcaaactggtacaaccactctggaaatcaatatgttggtttctgagaaaattggaaattattctacctgatgtcccagttataccactcttggccatatacccaaaagatatctcaccataccacaagaatacattctccaccttattacaaataaacagccttattgcatataaggctggaaacagcctacctgttcctcacctgaagaatggatacagaaaatgcagttcatttacaccacagaatactattcagctattaagaatgagggcattatgagttttacagacaaatggatagaactagaaaatatcatcctgagtgaggtaactcagacccaaaatggcatgtattgtactcactaataagtgggtattagtcaaaatactaccagtatttttcccatctgaataaaactacagggacaaaagatggagtagagactaagggaaaggagggccagtgactagctcaaattgggatccatctcaaggagaggttccaaggcctgacactattactgatggtgcctatagacaagagcccaccaattctgtcctccgagagctgcaacaagcagctgactgagactcgtgaagacatttacacccaaccaatggacagaagccggggagtcctgtggttgatttcaggaaaggctggaagaagctgaggcagagggctgccccttaggagacaagcagtctcaactaacctgaacaccagagaactctgttattgagccaccgaccaggcagcatacactagctgatccaaggccctgacacacatacagcagaggactgcctgatctggcctcagagagagaagatgcacataacccttgagagacctgaggctccaaagagtgggaagatctggagggttgtggggcagctggggcgtggggagagacatctttttggagacaggggagaggaagaattggatgaggaactgtgaggaattggttggaccgggctggggctatttactggactgtaatttaaaagaaaaagaatcacatgtagggaagagataattattagaagtagttttgttatttaatgaacagctaataaaaatatctattaaatctaatcacatcaaacatctttgttcctggtataacataaataattatctatgatagtgcttactttagaaaaataattgccaaaagatgacttacaatgatgaatcattcttaaaattggaagcttaaggatatttttttaaaaaaaatcatattaacaaaataccagaaggaagcattcatccaattaatttcctgtgtcattgtaagt

SEQ ID NO: 3862 - DNA, 1200 bp, mus musculus
gttctctggaagagaaggagtataacacactgcttctctatctacgcagctctgatgccttcatcatctccaaatttctaatactgtttaaatgaagtgtagtgatgatgtgtgtggtggattttgtttgttgtttttaatgatcagatagaaactaggtaagtctttttggaatgtttagaatgttgtcatttcttctcctttaatcttatcttaccagtatttttgtgaaaatatacttactgtaagggaaatcttatttaaagggagtgttacagagtccaaaattcttaacattgagcagcatgtttttgccatgtgtacagattttaagctaaaaacaaaacaaaaaataagttcctttgtgttttagtgacacctgccaaacaggaaaacttctgagtctcccctccacccctcccattcctgccaattttccaacacaccaaggtcttcaggcaggctctgctcacaaaccatatccagaagagaagccatactctgacatgatgttcaaagccttttgacaaacttctctaagcctcccaccaccactttcctgagttaattgtgtgcaggctccttcacacccccagcagaaactccctctgagttgtattcttagcaaatccccatatgcatcctgatgctttgagcacttcactgcgtcatccatacttttttggtttgggttcattcttggcttctccagtccactttaccttttacctgctgttccatgggctaggaatttccccccacccccgctcctgtcagcctcttggatagatgccaaggtgctgactcacagtgggcaggcactctgatggaaaactccttttcatggaaattttgaatccttttaaatgtgttttaatttcaaactttgttggatggctgagaatgtattactttttctcctgcttcgcagtattcttctaggtcaaaagaaaattgttttttaaattatgattaacatgaaaaaagaagtgtaccttagttacatgaaagtatcaagaaatttgtagacctcatgatgatgcacatgtttatctaattacatcctgtcatgtgaggtcatgaaagtccagtgctgaggtccaatgatatcaaaaggcagaacttaaataacctgtgctaacaatatgttttcatggatttgtgtcactttacaaatatctttaaattgtaatttttcct

SEQ ID NO: 3863 - DNA, 1000 bp, mus musculus
aagaaaaatcagtggaactttaaatcactgcactatgagacataagcaagaaccagaaacccaaatgttacattttctctctcgtgttgaacccaggatgcatctgtactcacattgatgacatgagtacagaagaggaatatttgaaaaaggactatgggtagaaacaagggcagacgttcccctggaaaagcacatagctcttctattgtctatggatcaaaaactatagtggctgaagaacactgaattaaagcttgatcctgtgaaactgtcccctttaagattccagtgcaaacaattgtatttaccaccaagtacaggctactaattcaggaggtcttacttttgagattactatacattattttttttcatttttattagatactttctttatttacattttaaatgttgtcctctttcctagtttcacttctaaccctccaccaatcccatcccctttccccctgcttatcaacccacccactcccacttccctgtcctgtcattcccctacactggagcatagagccttcacaggacctctcctcccattcatgtccaacaagaccatcctctgctactatgcagctggagccatgggtccctccatgtgtactctttagatggttgtttagtccctgggagttctggtggtactggttggttcatattgttcttcctatggggctgcaaaccacttcagctccttgggttctttctcttgctcctccattggggaccctgtgctcagtccaatggttggctgtgagcatccactatactttataataatctataactatgacatgtagcaaaaatccacagtaaagttaaaatacaacatcaccacatcccaaccaccaaaaagtgatatccaaaaaacatgacaagaataggcagcatttctcacacaaaactgaaaccttaagaacacttagagcattggacaaatcaatgacaagagtacatacaactccttttttataaagtgctc

SEQ ID NO: 3864 - DNA, 1200 bp, mus musculus
tgtgttttcctgtatttctttaaaggatttgtttcctctttaaggacttctacctgtttacctgtgttttcctgtatttctttcagtgagttatgtatatcctccttaaaggaccctattatcttcatgagatagaattttaggacagattcttgattttcaggtgtgttggtgtattcagagcttgctatggtgggagaactgggttctgatgatgcccacatatattgacttctgttgcttatggtcttgtgcttgcctttcaccatctagtcatccctggtatttgctggtctggtgactctgtctggagtctgcctcttttgtccctgggttgcttcaggtctcctggtacgccggtgaccctgactgcagcagacttcctgtggggccttccaactggggggtgggggggaggttcagaggggcagagaagctgctgatctgttgccctggctgcagtagatatctgggaggtcaacctgttgtcttgtgtaaagctgttctccagagggtcctatagactatggtttctgtttccctgtgtgcagtagggagactttccatctgttgggtcagttaccctatatgccacagagtccccaggaggtcttgagactgtggtgttggttgcccacttgctctgtgcatggaggaactcctaggatgccttcaagctatggtgtcttcagggaagcatacaagctggtgatcagttgctaagtttctcagttgaccagtatgcagcagatctcctgggatgcctcaaactgtagtgtcagttacctggagtgcagtggatctcctaggatgtctctggctgtggtgtcagattctcaaatgctctgagtgtagtggatcttctgggatgtcttaggatatggtgtcttctggggagcagacaagctagcagtctgtcctagcagaaaggacttggcagaaggggagtgggcaagggtttgcggtaatgatgggtccctgtgtcaactgggttccagcagcagctgtgggacttcaagaggattcttagcaaattctctaagttcagtggatcttctgagatgtctcaagatatgctgtcttctggggagcaaactagctagcagtctgtcccagaagaaaagactgggttgaaggcagcttatattatgtttcactgtgcacagggattaagttcaccatcacaggaaagttttcacc

SEQ ID NO: 3865 - DNA, 1000 bp, mus musculus
cgccatagattgctaacttgttcacacacgaacctatcctctgagaagaagcctggctccagtagattcactgtggccatttgcaaaccagcacagctggagaaaatcccctaagtctgtcctccatataaccctgtgcttgcacagtggtgggcagcaaggagggggagccaagtgatgaaaatgtcaataactcttccaattgcaaaatcataatctttacaataataatacccagttagtggagctttgagaaaactaatatttccataatatttttgtgagctttagtcaaatagtaaaactagtatggaaaatcaacctatgaaaatatataaatattcaaggcccttgtcagtggccagagtccttctatgtcattctgaaaagccctcccataaaggcctaagtgatgttgcttctacatgattctgttgagtccttgccttgctaacacataaatttcttggcaccatttgctctcacaaactaagctcatcctacatttaccaaacaaaacaaaacttgaagccatgcctgttgcttttgcagctggcatgaagtttttcttccttgtgcttttcggtttgtggtatatttagtcattgcttgaatgtctttgtcaaagcttgacattctgtgtgatatcttttctagccgaaaacacaaatctaggcttgatttgagaattaatcagattgaggtgtaatcagattgaactgataatgaacagcagaaaaaaatgaagtgaccttggacattggtcagctttttttttttaagtcaaataaccttccaactaaggaaaccttaaatgtgtgaaagtaaaggcttaaaggaataagcaaagacctctgatggtgtctagagaccttataaaccatttatgtcccaccctaccccctgccctgctgcttagcctctctcccaaatccagtatgaaaaacagcagctggttgctgaactacatgttctcaattgggaatgaaggcatctggct

SEQ ID NO: 3866 - DNA, 1000 bp, mus musculus
tctctctctctctctttctctgtgtgtgtgtgttccagcatgtagtctgctttagagaagcttctatgtgcatctgcacatagatgacaaaagtggactcagaagcttgtacttatacgtacatttgtgtacacataacaataataataaaaaaggagctaccactgtgaggctagaagaggcatgggatgtgtcttacatagggtttctcttgctgtaatgaaacatcatgcccaaaagccggctggaaaggaaggggtttatttgacttaaaataaaatttcccatcacagtttattatcaaaggaagtcaggacaggaactcaaacagggcaggaacctggaggcaggagctgatgcagaggccatggaggggcactgcttactggcttgctcctcctggcttgttcagcctgctttcttacagaacccaactggtcgcttgcctgtcaaccactaattaagaaactgtcctacagctggattctgtcgagatgttttttctcaattaaggttccctcccttcagataactatggctgtgtgtcaagttgacataagactagccagcaaggaggggtttgaggaagagcaggtatgaggggctggctaaagggggaagggaagtgatgcaattaattctatttcaattcaaactacatttacagggtaatcaaattccatatatatcaaaagaaaaaataggaccaagctcttatgtgacattctctctccttcttctctttgctccaacattggtttctaggtgtaaaaaagtcacagaataaggataacagcttgtttttttggctaagtatgtgcctcttctatgtggatacagagaaggtctatttgtactgggcagttaggttagctctgcaaccttcagagttgacgttaaaaccctttcctactctgctcctgggaagctgtgtgtgggcagtctcctcagcagctcaagattgcatctgttgagccagtgcaacatttatgttgctatg

SEQ ID NO: 3867 - DNA, 1000 bp, mus musculus
ccagatatttaacttccatcgtaaccagagcactgcacccagtatttgtgtcagtacacacctggggtgtattagagctggaactctgcttttgtgctctagttagcacatacttcctagaggagtgagggatgcttcactcactgttgacatccagtcaacactgaatgactgactgactgactggctgactgactgactgaatatttgcctttgtgcaaacatggaaaaagaagggaaaaaataggaccattgttgagctctatcccgggctggctattaatcacaggaagtgagtgccaccaggtgtcagacctctcaccatcctcagagatgctctctcaggctctaggagttagctgtggggagaccacaacagaatgatttcgcttctgcccgctgataatggaacaagtgcttcagagtgaaataacactgggcacctcaagtcaattccttcttacacaagtagcctcagaagcatgagcactggagtgaggtggttgtagttgccacggagaccaggatagcaacaagaggccagggttgggaggccagacttgtgtaattgtgccagtggttaataggactttttttttttttataaaaaagatatatgcatatatgtatgtatgtatttaatctgcatacacacccgcatgccagaagaaggcatcagatcccattacagatgattgtgagccaccatgtgattgctgagaactgaactcaggacctctaaaagagcagccagtgctcctaacccctgagttatctcttcagcccaacaggaatattttttaaagaatttattttcatttcatgtgcatttatgttttgcctgcatgtatgtctgagtaagagtgtcagattccctagaactggagtcagacaatcgtgagctaccatgctggtgctgggaattgaacctgggtccattcggaagagcagctggggctcttaaccactaagccccatattaggaggaatcttaatgcca

SEQ ID NO: 3868 - DNA, 1600 bp, mus musculus
acgctaagaatcattaactgttcaatataggacaaagagaacaacaatgtgaacaaagatattctgagtaagggtagctctaatgtcctcagtgtttgtctgccttcagagttacttttgtattttgtccaagtgcagagtggtttgcagtcgtattcctaaatcagacctttgagaaatggtatattcaattgttgtatgcagattattttagttttagttgtgcacaaaaagcttaatgacaatcctccattggctcatacacaaaatggaaatgaggagcaggagtttgaagatggaatctctttggaaatcctgcattttaagcagatgttctcttacagcctcctgtcaatgaatgccttgaaatagaagctcttggtttatgtacttttccaaggcaatcaatagttctttcttcccataaatagtaaaattggttattaggaagtgtaggcacacttgtcctcataaaagggaaatgggttgagcttgttgcactaatgatttaatcagcaacagcaacagcaaataacccttattaaacttaatacagcaggccctgcagcctgcgtgacattccttcttcctgacagaaccacttgttcagccttcatagctatcttctctcatgtggtgtcattctagggaggtgaatcaccttcctccgccaggcagtgaatcatggttggtctatcaaacagacaaaaccattcctttgccatgaccaactgtaattggtttgagcccgaccagctgccatacactcatctggtcagtgaactctggagagcagtctctacgatgctctggaaagatttcctttctagtagaagacaaataagaagaaagggctccctgcaaactctaggtgctttctttggagagggtgtgaagctgctgcctgcagctgctccctgtagctgttactgtcacctgagctggattaagaagttgcactcaccccatgccaagggtggcagaagggacgggtgattctttttttttttttccattttttattaggtatttagctcatttacatttccaatgctataccaaaagtcccccatacccacccacccccactcccctacccacccactccccctttttggccctggcgttctcctgtactggggcatataaagtttgcgtgtccaatgggcctctctttccagtgatggccgactaggccatcttttgatacatatgcagctagggtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcgatggtatcagcgtttggatgctgattatggggtggatccctggatatggcagtctctacatggtccatcctttcatctcagctccaaactttgtctctgtaactccttccatggatgttttgatcccaattctaaggaggggcatagtgtc

SEQ ID NO: 3869 - DNA, 1400 bp, mus musculus
tcatgattaaaaaaaatgggaaagaagtatagagtgaggactgacattttgcattaaggatgttgtttaacaaattttcacaagctggccctgacttgcagaaatgaaatgaaactggcataattatccacctaaaaactacccacccccatcttataaacagaaccactgttcttttcaggagcactcagtaatgtcattgaaaagtaccaatagccccgtagaactagttttagggagtcaggtccctgagggctctgtatttaatggaattaagtctatgttgatggcacaaggggtaggagggtgtaacaatgaatttatagtttccccactccactttgtgccatggtgaacacatatgtcaacatgggaatctttccagggagcaaggaggagtcattcaaaattagcaggaaagggtgttttcacctcgtcaatcaagtttgggaagcattttgttaatgacacatttttctccctcataaaataatgacatgctgacaaaatagctttttttctttttataagtactacaaaattctgcatttttaaataacttggtaagacatagtatttcaaactgtatagtcatcaaaagtaggttttagaaatgcacacgttcgggtggcatctccagtgtcctgcctgtgccttctgtgtcagggctgctttagcatctatgttttcttcaagatcattcacatctttctaacattaactttccccctttccccttgggtaccttctctccctgttttgctgtgtttgtttgtttgttcgttcatttttcagagaccttttaaggcttggcctctggctgtggatgagcaggttcagcctacagcatgactttccccatgactcccctttcaccttggttttatttctttcagcatcctctttggtttttctccgcagggtggaggatgtagggacgagtgcagtgatgctttggtggtttctgttagtcccatggttggtcttcaggccgcttcttctgcaaggcattaatattatctacctgggacctagaatgtggctgtggtttttatgttatcaatgaagacacatgctccctgcttagcaaagtatgccaaacaataacacaaccttttagcatacagctaaatgtatataacattttaaaaatactcatattgtggtaaaatatatgcattttaccatgatatgagtttctgtcttgaccatttaggtcaattacatcattcattgcactcaccgttctgtacaatcactttgtttacttaaaatgtaagcaataaattctcattctgctctcctacctccttttgtctgtgactgcaaatgcaattgcctgtatctgtatatttcctctgaatagatgaacttgtatttaccattctgactctgcctca

SEQ ID NO: 3870 - DNA, 1000 bp, mus musculus
ccaccagtcacactcttcctccctatcacttttgtgtctttctgtgttttgtttttgccttgtgactcaatggctttaaccagggccacttgggtggggacaggcgtgaagctgttcactagaacttgagtaactaaccagcggttatgtcactgggtgtgacccatgagccctttccccatctatgactgaatgtttactggctcattctagtgtcctatgcgggcaaccccagtaatcaagaactagtgagcgccatgaccaggtaatgtgcattagacagttgtctcagttagggttttattgccacagcaactcttataagggaaaacagttaaatggggccagcttagatagtccaaagggttagttcattattgtcatggcaggaaaacatgggacatagggccagacatggtgctggagaaggtgctgagagttctacctcttgacctgtaggtagcagaaagagaagaccacaataggtgtgtcttaatcatggtttctattcctgcataaacatcatgaccaagaagcagttggagaggaaagggtttattctgcttacacttctatactgctgttcatcaccaaggaagtcaagcaggtcaggaagctggagctgatgcagaggccatggagggatgttctttactggctggcttcccctggcttgctcagcctgctctcttatagaacccaagcctatcatcccagagatggtcccacccacaaggggcctttcccccttgatcactaattgagaaaatgccccacagatggatctcatggaggcatttcctcaactgaagctcctttctctgtgataactccagcctgtgtcaagttgacacacaaaaccagccagtacaaggtgtaatttggttttttggttttttggtttttcgagacaaggtttctctgtgtagccctggctgtcctggaactcactttgtaaaccaggctggcctcgaactcagaaatctgcctgcctctgcct

SEQ ID NO: 3871 - DNA, 1600 bp, mus musculus
tgcttgacacaaatatgctatttgtccttcttcatatgccctaagactaattatgacccctttaattgaaggtgacaggttttgtagatgggaaaaagatgtgtgtgtttgtgtgtgtgtgtgtgtgtgtgtgtgtgtgtgtgtgtgtgtatttaatgagccaacttaccttgtcacaaattcacagtcatttttctagatgtaagacttaaggattatgcctctggttaataaataataatgtaacgaaaaggagaagggaagaaaagctctatttacatacatacactatttgtctttctttgagatggtaatagattattgttatcaacaagacctcagataacattctaatgacttctatttctgtttacaatggaacattcctagcagaaaagaactgtcttttttctgccctattccatccccattcaggcccctacccatggctggctgggtggagacgctggcttcctgtcatctcacctgagcccgggaagacacagaatggaattctatgcagccctctgtgggcccccgttcctactgtctaccactgctttttggtttctcttaaattataacagttgaccgactaacaggttcccagaaacaggttcagatattggcaggcaaacccaacctctttgtccttccaaagtacataagtgctaaactgtgctccggctgagagagttagtgttccagcaaggctaaaacccgagtctcctgctccccagcagcttgctgccatctctcccccaagggatagtgtgtgaggacgcccttggcatcatttcttcggcccggattaagcacaggtgactgagagtcggccttatcttcacaaggcattagtcactctataaaagttaaatttattatgaaacgtcttgtttgtcttagcatatatcttctctgggaagttggaaacaaaggcatgtcctctaaggctcctcagggggcaagcacatcctcctttggaatttaaccttaatttgaaccaagatctgtgaaagaaaagcactttggtgtattgttccggagcgccacccttctctccccttatctaaatgcagctacttttgttttgtgggttttagacttctcctccttctccttctccttctccttctccttctccttctccttctccttctccttctccttctcctcctcctcctcctcctcctcctcctcctcctcctcctcctccttctttttgaattctcccaattccaaagcacagtgctctctctgagtttaaaatttatccttaaaaagaagtcaagacaattgtaaaattatactttggaagtgagtcattttatgtagccttaattctgatgttctcaaagttgtatccatttttgaacactttttttcatttttccttctcatatgttattttaaggcccactctgctttaggagtcgggcaaacagcacagtggcggatgctttcctagcattcacatgccctgggttggtcctcagcacaggaaaaaaaaaaaaaaaaaaaaggaaaaagatgtaatgttcttatttctccaaaatatactttctaaaagtcttttgtaaaatgtaaaaatgttcttatt

SEQ ID NO: 3872 - DNA, 1000 bp, mus musculus
agttgaccttggggtcgtgagagtgggtgagctggccctggccctcaccagctgcagcaccagggatagcagatcctgcgacttgcctgggcagcatagtagaactggccctggtgaagggggcatggtgatcgggccccgagggtgagagcattgtaaagctggccctgccacttgtctgatgtggggtggcatgggtgcaggggtgatgcatcccttgcctcctgtgatattcaggaaagctggcttcctgggcctgagagcaggagtacttgggaaagtggcctcgcacctcgcctgggcaacacagcagagctggctggccctgatggtgaaggcatgtgtgagcttgctcagagacaagctggtccagccccttacaagactcagcatttgggaacaagaacccctgggccttaactgaccagcacagtagagggggttctaaagacagaagtgtgtgtgagtcagccctagggcatgaagagtgggagagctgactccgcgtcctgtcagagctgcactgggtgaccttaccagagcagtgctggagagcttgccacggtggtgcagacggtcaagggagagctggtgaggtaaccagctcagcgaccacctagtctctgattcaggactgtgaattggtccactccaaaatgtcctgcgatcccaagcagatctctatgacacagatccacaacaggatagataacctggagaatccaatattgatggtattacagaagccagagatcttgaaacagaccaatgactttgcaatgatcttttgcaaatgaagatgtgtggacagaggaatacactgtgtgatacactgtgacatactacagcatttccatgatgagatgttttctatgctttgctctctctctctctctctctctctctctctctctctctctctctctctctctctctgtgtgtgtgtgtgtgtgtgtgtgtgtgtgtgtgtgtgtgtgtttgggaggggggaaggctgaaa

SEQ ID NO: 3873 - DNA, 1000 bp, mus musculus
gggatctgcaaccctataggtggaacaacattatgatctaaccagtaccccccagagcttgtgtctctagctgcatatgtatcagaagatggcctagtcggccatcagtggaaagagaggcccattggtcatgcaaactttatatgccccagtacaggggaatgccagggccaagaagtgggagtgggtgggtgggggagtgggtgggggagcatgtgggggacttttgggatagcattggaaatgtaaacgaaataaatacctaattaaaaaaaaacaagacaaaaaaaacaaaaaacaaaagcaaaacatttagctgcttttcctcactaattagcaatctcaggttgccatcttgggttaccccactcagacaccattacttgtcagtccagtgcccattacactgtaacttctctaccaaatcttcaccctcactggcccatcactggagaacttaaacaccatttcctaatttgacaatgacaccacttcctctatgacctcaggacctaagagtgactgactgggagacagccctttggagcactcgccaatgtctgcttctattgcaccaatgcaaattttccccactcttgctggttagaattttattttaggagctattatgtttttatggttttcatctgaagatgcctacaagtgacatccagtcttccagcagctgaatcctttgagctcagattgcagacttgagaaacaccgtcatctattaaaagaagccaagtctttgtacagaaatgctaactcaagatccgggacagcataggtacataatgagcctgaaatgccctgtagtgtccgatgcaaggaaatcatcaaacaacccaaaggcaggagaaaggaacctacagcgatggttctcaacctgtgggtcgcaactaaatagactgcatgttacatatttacattataattcatagctgtagagttatgaattcaaaattagagttatgaagtagcaacaaaataattttat

SEQ ID NO: 3874 - DNA, 1000 bp, mus musculus
tatttaaaataccctgggtaaaacagtgaagctggttatggtggcagggatatgggtgagtgaagtggccctgaggaacttgagaactgacccctctcctcatctgctttgtagtggaggctgtgagggagagattccccccccccccacctgctgacagatgacagaatgcttgagaggaagaggattaactggctctacccctcaccagctacagtactcaggagactcaccagcacttcacacttccactgggcagcacagtagaactggccctggtggcatgggcacaggtgagccagccccaatggcatgagaacaagagaggtggctccatcccttgctggatgcagcatggggctgagctagccagggcagtgtttatagctggtacagtggatgtgagagagctgggggctaaccaactcaggcccagattcatggctctgagttggcccactccaatatgtaccccatctatgaactggagtgtgtgaagatccaaagctgcaggatctcgatggcacaggacaacacagaatatctgaaaggactccaatgaggagcaggtgttagtagtataacagaagccagaagctttgaaccagaccaatggctcatgacaatgaacatttgcaagtaaagacatgtgatcaaagagatataccatgacagactgtgacacattgcagcttccacaataagatttttatttttatcttatttatttatttatattttcttttagggttggtggttgcaaggatggatggtggatatgaagggatggggagatgaatggcgttggggtgcatgatgtgaaatttacagagaatcattaaaatgtttaaatattagagatgaaaagagagatattgcaagtaatactacagaaattcagatcattaggggttactttggaagactaaatgctaataaattggtaaaaacctaaaagaaatgggtggacttttgaacacaatctttccaattgaatcaa

SEQ ID NO: 3875 - DNA, 1000 bp, mus musculus
tcattgttctattgctgtgacaagataccaggacaaaaagcaagcatgcaggaaggatatattgtggcttacaagtccatacccatagtctatcaccaaaggaatttaagcagaaactgaaggaaaggcccttcagagactgcctcacctagggatccatctcatctgctgataccaaacccagacacctttgctgctgccaagaagtgcttactgataggagccctgtatagctgtcacctgagaggttttgccagagccaggccaatacagatgcgtatgtacacagccaaacattggtcggagctggggtaccccaatggggaagttagaacaaagactgtaggagctgaaggggtttgcaacttcatgggaagaacaataatatcaaccaaccagaatccacaagctcttagggactaaaccaccaaccaaggaggacacagggtgctaccaatggctctaactagatatacagcagtggattgccttatttggcatcactgagagggacgccccttttatgttatcaaatttttcattttgggagacattagccaatggcttatgtaagtaataatgtcttgtggctgttctgtatcacttaggctaagctattgtgatatgaggatgaattctgcttccccagtatggtagtattattattttaaggccaggaggaatagaactggcagcatgtatattcttatatgaagcaccgcttcttttaggcttctgggtataatttctcaagaggacaggcactactgaagcatgtgatgcatatgccagcctctcgggataatggcagtagaaaagtgagacagaagatggggttctttccttttaatttcattttcttcaaaatgctttattaatttctgttatcaattggaaacttcatattctacaacaattccttatgaatctctttgaaatcctcatagtaaatttttaaaaaatagtattctacttctctattaccaattccattcatcat

SEQ ID NO: 3876 - DNA, 1200 bp, mus musculus
ctaaacctgatctacactctgtatgttgttgaaacatttacaggagactatttcatatcctgaaaaatcctgtcaatatctaaactcagtgttcaaaaataaaatcttcttggtacaaggcatgttcatcctcctgtatgccattccttttagcagtttcctcactaggaagtcaaaggcgaggcactgtaacagaccagaggtattgcaaaaccttaaatacttgctgatttcttttatttattattctatttatctgctttccaaatgctgctccctcccagtcctccatcacagagctcttcccctatcttccctctacttcacctctgagaggatgtctccccttggtatctccccatcctgtcgcatcaagtctcaatcaaccctcttctactgaggccagacaaggcagcctctgctacatatatgctggcagtagccttacaccagcccttgtgtgttttacaaggatggatcagtttctaggtcttggttagttgacaatgttggtttttctatgaggttgccatccacttgctgatttttttttttatacttatactgacccttgacctagtaaataaaatggtgttctctgtgggtttcaccaggcattgtatccatcacaggaaaagaagttggtctggctttagatatatttcctcaagcatcctatttcagattcatgcacatccattgtgtagcctgaatgctgacaaggacctgtgctaactaagtgacaatattagcactgtgttctctgctaggtcttgctgaatgcccttttcagttttctgagcctgcttagagatgccctgctttccgtgagactcctgggaattatctgaggctgttcattttgtgttgctgtgacactatcatgaactgagtaagtattaagaaaaatagagttgttttgactcaaagttctaaaggtcaaagcttaatttctgttgatggccttttgacatgtgatagagagaaatgagtgtgtgtgtgtgtgtgtgtgtgtgtgtgtgtgtgtgtgtgtttgtattcatgtctgtttcttaaagagccaccaattttcagtcattgggtccttcttgacagaattatttaaccctgatcatttcctgaagctctaccataaacaccatagctgaataaattaagttaccatgccgctactaccttacaatgtcagttaaactttaa

SEQ ID NO: 3877 - DNA, 1000 bp, mus musculus
ctgagctctgacttgctgaaagctgatgtggactaattgtgctgggatggttgctctctgtatttcagctggatctactatcaggtacgtctgataagtgcctcattgcccaagcattttctcgcctttcagccttcctgcatccttaagacagcatcatcttaatgtcagctggaagtagttgcagaagataattcaccattgattgtcccacctaaacaggccaaaatgctaactcaaaaagacaccccctggcatagaacctataatgccaactcacgtcctattctctttttgataatctattttcacttaaaagccagatgaaatcatggagaatcttttgaaatttgacatcattataatttgaagcagaaaatgagtagaaaatgatttctcactatctagagcaaaaacatccaattataagagagttagatcatgtaaaacaggaaaaaattgtttagtatgccacttaaaatatgattttaaaatgtcaatcctttcattaataaagcatcaagctacttcttcttgtgtgacacagtccacttgcctgacttgcctcaaggagagaacatgagttacttggctctgtgctacagtcaaggacctagattcttttctttgtaaatgaggcttgtgccaagttcacatgaattaaagcatggctctctgttgatctgagtcttcttctctgggaatgaattagaggaaaagcttgtgctgggaatacgctcaccattgtttgcaagtctggcccagcagcatgtcccatggtccaatcacagaccttatttggagtcttatgggtcaagcatgtgcctctcatagtctatcatgtgcctttcgtgaggctatcatatgccttttgtgggcctatcttgtgccactcatgggcctcttaagaggcctcacgcttgtggctaatgcacctctcacagcctctctcatgaatctcatatgcctctcatagcctctcacaggcttctcagaagcc

SEQ ID NO: 3878 - DNA, 1400 bp, mus musculus
agtgctggcttatgtctccagtcaaaacaggacatccattttttttaaaaggacagaacagcttcagcatgagaggacagaattatgttagcagatcttaatgcttcagttcattctagttaataattgtgagaggaaaagcagttccatagcagccttatttgtgatagccagaagctggaaacaacctagatgtcccacgacagaagaatggatacagaaaatgtggttcatttacacaatggaatacttctcagctattaagaacgaggacatcctgggttttgcaggcagatggatgcaactagaaaatatcatcctgagtgaggtaattcagacccaaaacgacatatatggtatgtactcacttataagtgaatattagccaattaaaaaaaaaagtacagaatacccaagatagagtccacagaactcaaaaaggtcaacaagctgaagtgcccaagtgaggatgcctcattaccacttggaagagagaagaaagcaatcacaagtggggagagagggagggacctaggagagaaagtggactggatggggggaggggattcaaggggagaggggaacctgatctggtgttgggtgagggaaatggattgaaaccatgggaccagcagaaagaatggaaacaggcaaccatgggaaataggaggttggggggcaccctccagaatgcaccagagacctgggagatgagagactctcaggactcaaaggaagggaccttagatgaaatgccggatactagggaaagcgaacttacagagcccacctccagcaggaaaacaggatatcaagtgatggatggggttgccatcccacagtcacaactctgacccataattgtttctgtctgaaagaattacagggatggaaatggaaaggaacctgaggaaaagaaggtccagcaagaggcccaaagtaggttctagtaggggaggtcccaagacctgacactattactgaggctatggagcactcacaaaaagtaacttagcataaccccactctggaagacccaccaggcagctgaaagagtcagatgcagatatttgcacccaacaaatgaacagggtcagctggcccctgttgttgaattggggaaggctgagagaagctaaggaggaggaagaccctgtaggaggaccagcagtcttaattaatttagaccccgaggtttctcaaacactggactatcataccaacagtatacaccagctgatatgaggcccccaacacacatacagtagaggacttccgggtttctgtttttttttcagagatgatgcacctaaccctcaaagactgaaagcctcagggagtttacaagttaggtgggttagggttggggatatccacatggagacaggtggatggggaag

SEQ ID NO: 3879 - DNA, 1000 bp, mus musculus
agggctttactgctgtgaacagacaccatgaccaaggcaagtcttatgaaagacaacatctaactggacctggcttacagattcagaagttcagtctggtatcattaaggcagaaacatggcagtatccaggcaggcattgctacaggaggagctgagagttctagttcttcatctgaaggctgctagcagaatactgacttccaggcagctaggacaagggtattaaagctcacacccacaatgccaggtctactccaacagggccacaccttctaattgtgccactcactgggtcaagtgtatacaaaccatcacagttaatatgaataaaacgaaagtcatccaagttgtatatcagccaaagatttcactacttcttagaaacaagatttctgaaagtatccaatgactcactactgcccactaacaagtctccttctgttagagccttgctcacatctcagaaacttgccatcatcagcacctattctgtatcttccagcttcttccagcatcttgtagcaccttccccctgttcttagcttctccccagcagtctttttagtggctaatggaccttcaggactgcctattcacaagagatacaataaaatgagtcaaaagccctcataggaggctgtaaaagagtccaaagagcaagaaaagaactcagagatacttaaacctactctcactgttcagagtcccacaaaaatacaaagcataaatcacaaagcatgaaaaacactaaaacaaaacaaaacaaaacaaaacaaaaccagctataacgtatatgcaaagtacctgctgtagatacttgcagacccccatgcttgctgcttcactctgtgaggctatgtgaatattgcttagcttatttagtgggtcatattttattgtttgctttcatcccctctgactaccatgttttctcacccactctcagagaggagcaacccaactgagacttccattcagattctcattctgcatactgt

SEQ ID NO: 3880 - DNA, 1200 bp, mus musculus
atttaagttctctttcactgaggaaaactttttaagagaaatacactgtctggtgaaatatatggtcacagtctgaggctgcacatgttggtgataagcagcataccagggaggtggcagggggaccctttagaaagtaccagggaggtgagagactctaaggactcaatgtgggtaaccatagccaacatgcccaacaatgtggagagggaacatgaagtgccaacttttagtacatagacaggacctcaatggagagactgggttactaacccagagtcaacatttctgacgcagaactgttcctgtccaaaagaactacaggaacaaaaatggagaagagactgaaggaaagatggccaatgaccagcccaacttgtgatccatctcatgggagggcactaaagcctgaccttattagtgatggtgtgatgtgcatacagagggaagtctgtcatggctctactctgagaggctctaccaagagttggctcagacagaagcgtatacttacactcaagcattaaactggagtcagggacctttaggattgaattaggggaaagataatgaagccaaaggggagagcaacctcataggaagatcagcagtctcaatttgcccagaccccaatgagctcccagagactgagccaccaaccaggaacatacatggactggtccaagaaccgtggaacaaatacatcagaggtcttcctggtcagtcctcagtgggagatgtgcttaagtgacttgaggccccagggaagctagaggcctgctgcagggggggggtaccctctaagaggcaaagtgggaggaggaatgggatgaggaactgtgggagggggaactgaaagaggggtgcacggactgaaatgtaaattaaataaaagaaagaaaacaataaagcagacctggttttcatttctagcacccagagggcagttctagttgcctgtacctccagttccaggtgatctgacaccctcacacagacacatatgctggcaaaacacgggtgcacacaaaataaaattaaacaaattattaaaaaataacataatcaaatatccaaaagcagaacattgccccataaacaatttaagtttctctaaagtaagtgttccaaacgctgtacctttttagaaagctgaagactagaaggctgaggactggcgggacaacctgctttttcttt

SEQ ID NO: 3881 - DNA, 1600 bp, mus musculus
aaatggctgcaactctaactcctatgaatctgaagtcctcttctggcctaggtaggcacctaaacatatgtacagctttacaaacatcacaaacactggaacatacatatagatacagagagagacagagagagagacagagacagagacagagagacagacagacagagagagacagagagacagagagagagagagagactgagagagagactgaaagagacagagatatattaaaatgagccaacttgccaacttgcacaagacacctatcttctatttccccctacatgaaatgtcctgtataagaaaatttggaggcatagaaagtatataagtggtttccaaactttgaggtgttaattgaagttgcctaacaatcagtattatatttcctttagagagtgataaaaatgttctaaagttatacagtgatagtggttgcatgaaactgcgtatattgttgctagcaggagagcaaaattttacagccactatgggctttcatatgactgtttcttagaaaactgggaattgatatgcctcaagttccaactataccattttggggcatacagccaaagcacatttcatcctatgaggaggacacttcaaaactatatgctttattcataatagccataaactggaaacaacctacacattcttcaacagaagatgggatcaaaaattatggttcattcacacagcgaaaagttattcaattgtaaaaaaataagacatcataacatttttaggcaaatgggtggaaatacaaagacattctgattgaggaaactcaaacccagaaagataaatatgatgtggattcactaaaagtgggtattagctgttaagtatataatggccaagttacaatgcatagattcagagagtgcagaggtccttcccatgggcctttgccagcatggaaatgagagttggagggttgtggctgacaggacagtccatagaggagataaggactcagcagggaggaaatgagtctggtttgatggtcaggggaatctcatagctgactagcaattaggtgcttcttcatttttttttttttgtttcaagaacaaaggcagatcaataatgatccaaatggtatagagtgtgtgtttgattttttattaaatgtccacggttacaagttcagttacaattagtaaatacaaacagatcagatattattattattattattattattattattattattattaattactactccaatttaaagaatttaaagaatatcttttccaaagcaaacacatttaatatatgacagactggtttcagactggcaatgtttgctctttggaagcattccagacaaaaaatatatctgaactggcctttttatgagtagcaaatattaacatctaacttcttttactctgtatttcatcatctatgctatgattagggaaagcttagtttatttaatctatctaatttattgttttattcagggatgtactccatatgactctcatcatcattgacatattgtaaagatctttaaactatatactcagagacatctaaatctatagtaaaaaataagatttgactatatataatg

SEQ ID NO: 3882 - DNA, 1000 bp, mus musculus
ataaagttactttcatccattgtatagggagaatgagacaatattctttggaatcaggaaaaggagctgaaggggtttgcaaccccatagcaagaacaatactatcaaccaatcagacactcaagagctcccagggactcaaccacctaccaaagagtacacatggagggaccaatggcttcagctgcatatgcagcaaaggatggccatgttgggcatcaatgggaggagaggcccttggtcctgtgaaatctgtatgccccagtgtaggggaatgctagggcaggaagaaaggagtgggtgggttgttaggtaagcaccctcacagaagcagggggtggggaatgggttaggggtttgcagaggggaaaccaggaagggggacaacatttggaatgtaaataaataaaataaccaattaaaagaaaagaaatggcaccacccatagtgatccaagcattcccacaattattaatcaagatgatgttccatagacttctccataggaaaattcaatggagacaaacttctgttatgatttcttcttcctagatgactccagtttgtgctacattgacaaaagaaagagagaaggacagaaagaaagaaagaaagaaagaaagaaagaaagaaagaaagaaagaaagaaagaaagaaagaaagaaaaaaagaaagaaagaaagaaggaagaaagaaagaaagaaagaaagaaatttcttaaaaatattactgtatagttttgaatttgtattggattatacagatttccttcactataagagatttaagtttttcatatgaaaattgtaaagaatgatacctgcaatattttggtcattaatttacaaattaatcatatccatcattcttatctcatagaagatatatttttctaagttctaaaatcttatctcaatagatttttctaatcgtttaattgtaaaattgatgagcagttttctcctcaagacattttttccacttaaagcaaatcctttct

SEQ ID NO: 3883 - DNA, 1200 bp, mus musculus
attgaagaatatttctatactactaggggcttgtggggagcatgctctcttggcttttcataatgtttgtgtttttgaagtgttttgaagtacatatgaacttcttttctgtgtcatgtgtctgatatgtgattacagttgcttccacctagtggaactttgtttctctacctgttgttgcctgagcttggttgatttcagatcaaggatgaacagtaaatgggtcattccttcagtacattttggacaggaatgtttttaattgcattgcagccatgatagtaaatgtgggtgactcccatataggtttgcataaacttacttatatgtgtttgacctcagagtctgaggacagagcagatcagggcattctgtggactgggctagtgaatgagcttcatgacccaagctaagcctgaaagtataaggattgcaaggagaggtggaggtcttggtcactagacagactgtgagacttgagctagaacttctgggagaatagacaggatgcagtcagataggttcctagggaactattcatgcttagctgaagcacatgccctaaaagcccagccaattctgagagtttggtctgactaagatcggtgagaatcttcattttgtttgtcataccttctggaggtacagcattcaaacaggtataaaagtacacacatacatggcaactgtctttctataattttagtcatatatttaatggtgacaggtatgtatgtctgtatgtatgttttcatgaatacaagtatgctcatatatattcatccaatattaaaataaccctattctctccctcttcctccctctctctctctgtgaattcataaggacaagagatagcataaaagttcattattattcacctcttcctcaacagatcataattcccaaacattctgaaaggtgccatgttaatgttacattttcaagatgactgtctggttagcaggactgggcaggcttcaatacctgcacacactatatttgattctgtcagagtgtacgatgtcagacagagtcagagtaatactgcaagtttgagcactttaagatttgaacttaattgtgcttagcagtaaagcctaaactaaactaaaatcagcagacttaggaacaaaaataaccttttatacaataaacaaacaaataagcaaatggtaaccgaggaggaaaatataatca

SEQ ID NO: 3884 - DNA, 1200 bp, mus musculus
ggagtctgtattaacttggaaaagcctgagtgtagaacacctatgtgtgggaaggccatcctatgctatattaaacatactttatatgttatattatacatataaatatgctttatatttatatgtcatattaaatgtactttaaataaattaaaaattattctctttaatccaaaagctttttataagtttagttaaaaaaattaaaaggataaaacaagtgaactcaatatactatgtcaaagtccagccccttggagcccaccaaatgcaggtgtactaactaaagaaataaggaaaaatatgaatgagaaccagaaaggcgtgactgagagttttaatgccacccctgtttgcacagtttaccactcctgttgcctgctaacaaacctgggagattctgtccatgcataacaagttcataagttgatttggaactttgggatttgtcctctttgtgtgtttgtttctttttttctgctttccctcttttctctttctcttttgtaattacaaatctctaggcccagaaaggaaccttaagttacataaatgtgttttatatatttcttaagcattcaagtgaaaacattcagtaagcatccaattagtttaactattatatgccaaactaccccagattatattggtttaaaaaaaggcagataaaaaccattttgattatttctcgtagttgttataatttattgatcttcatacacacaattttgtttctttttttccttttatttaaaacaggctttattctcacacatcctgattatggtttcctcccctactctatatcccagttccttgacacctgccttcccatccagatctaccccatttttgtttctagttagaaagcaatagaacttctaaataattaattagataaagccaaaactaacagctggacggtggtggcgcatgcctttaatcccagcacttgggaggcagaggcaggcagatttctgatttcaaggccagcctggtccaaaataacaaatagaagaaaatgtgtcccaaagggcatatagatgaagtgacccactcatttgcacattgtagaatcctataaaaacattaaactagaagtcattatacataaagagactatagtgtaaaaaagtgagaaaatacatacatatatacatatataataatattcaaatttaaaaatatttaaaattttat

SEQ ID NO: 3885 - DNA, 1600 bp, mus musculus
ttaccatgacatttggcaacacataaatgagaaaagtgatgtatttatatgtcaatttacgaagtcaattctgccttttatctatttgacaaaacctagagttatcaaaagaaaaggactctagatgaaaaaaatgccaccataatattggccagtagtcaagtgtgcagtgccttttcttgactggtgattaatgtagaaagctccagcttactgtgatgtagtgccacccctggctaggtggtaaaagaatgcaacctgaacaagccaaaaagaaaaagtcagtaagaagtgtttgtttgtttgtttgttttgttttgttttgttttgttttcttcatggcttctccttcagcttccaaatctaggttcctttcttgagttctgcactgacttccctctgaaatagagagtgacctgaggattacaagatttaataaaccacctgcccctagaattgtggttggtcatagtgttttatcagaggactatgtagcctcccataagcctgaagcaggctgagccagaacttgaccttgctgccactaaggagattatctagggtggagccttcctccctagatcactctattgttgagccacagtcgctgttcctcttcaagatactgctatctgctgagcagcctggagctattccagagactatgccctatcctgcctgtcatcacctgcagctggtttcaggccccaaggatgaattggctggaatggacttcctccccctcctcttttatcaagcttgtctggaattaaaaatttgaaccttgatccgaacactgtcttggttccatattcctctcttcgcctagtttccctctctttcagtgccagcctgctattcaggtgtacctgtccttgtgagccgctggacggctcacaacaggactagatatcctaaataacacagaagagaaagcatagaagtttagtctagccactggaatttctcagttgtcaatgatgggtaattgtatttttgttcagactttatcagaaaaagtaatgttcaatgtcttagggttaacagataagcgtaacacatggaaaatatgagcttattttgaaagaaaataaaacttgagacctgtgattcatgtaatgtatatcaaatagcccaaagagttgtttgtgagctttgaaacctggggctgagaacatagcagaacaggccaggacatgcccaggcaggcccttcattaaggcattcctgtggctacttggccataaagataaagagagataaagagaatgacatggcctggcgcctctctatatcccgctcttctgacctaagttaaatgttaacaggctgctgatgtttaaatgaaccaatcatgtgaaaccgcaccaattcctcccccagccccagccccttttctataaaaacctagcttccaagcctcgtggtcgaaaccactgtctcctgcatgagatatgtttctccaaggagctccgccattaaactacctcctgtttttacatcaagatggtcatctgttcgtgattcttggatgcatgctgaattgggaacagagtgggggtttccccactaggttctttcaatttctaattatagcaag

SEQ ID NO: 3886 - DNA, 1200 bp, mus musculus
gcagtgttcaccagtaattccttgtgggttttttgtgtttcctctttaagggcttctatttgtttagcagtattctcctgtaattccttgaggaatttttgtgcctaccaccatcatgagatataattttaaatcattgtctttccttttgggtatgttggggtatccaggacatgttgtggtgggcatactgggttctgattattcccagtgttcttggtttctgttagtaagattcttatgttttctttcgccatttggaaatctctggtttaatgttcaagctgtctctggctggagcttgatcctcctgtgattctgttagtctctgttagcactcctgggagtccaactctctcctgagttccagtggccagagcactctctgaaggcaatctctcctctttcagggcaagtatccagcagtctgaagctctgatccaccttctgagttctggggtcagaactctccctgtaggctgactctcctctggcaaggaatgtgcccaggggtcttggtctcagctccaccccttggctgaggatgaaggcctgatgggaccctgaccaagaagctctgctgcccaagtgctctcaggtgatcaggaggtcctgggtgtgctaggggtcctgaggcttggagagtcctctggtgacctagatacccttggctgggttcacacagaagatggcaggtttggccctgacttgaatggatgccagcctctggtcagacgggattccttcatccctgttcctgctgacacaagaccctccacaattctttggagctgctgttgctttccactcacccatgatcccgaggtcctgaggggtacagagcaatctggagcccttagtggcctcttatgggctcagaaggaatatggcaggggtggccctgactagaacagatcccagcttctggtcaggcaggattcctttgtccctgttcctgctggcacaagaccctccatgattctccggagctgatgttgtgttccactcacctgtcatcctgaggtgatcctgaggtgttctgtaggtcctgcagcgtcgagagcactctcatatgctagaattcttgtgtatattaccacagtagattaattttcatgtcaaaggcaaatctattataataagatagtgataacaaattataggccatgggtagagaagaaaatgcactgttctatattt

SEQ ID NO: 3887 - DNA, 1400 bp, mus musculus
ccttgttgtactgagactttgtcttaactttgcctatgtcctatgcatgctgtcacaactgctatgttcatgtggaaaacactcctgtaaagtctagaaagtactgtttacttggagaaatccaccatacttgactattccaagttttctaccccatattattcagtggttcttgagccttgggatgagggggttaagaatgaaaaaataaaaatgactacaaattctggcatggatgtggtgataggggagggtatgaagcattcatataaagggaactattatgactgccctctgagagaaccaactaatactgttattccctttcccagtttcccctccagaaactccctatcctatccctgctcttcctgcttatatcagggtgttcccccacccacctacccactcccaccttcttgtcctgacgtttccataaactagggcatggagccatcacaggacccaggctctcttctccctttgataccagacaaggccatcctctgctacgtatgcatttactttgatgttggctacttgtttgctgtagattgcttttatcttgtttatgtatgggcgtcgacttcctgatctttcgacaccttttatcatgaatggatgttggattttgtcaaatgttttctcggcatctaaagagatgagcatgtcgtttttgtctttgagtttgtttttatgatggattacgttgatggatttccatatattaaaccatccatccatccctgtaatgaaacataattgttcaggatagatgattattttgctgtgttcttggatttggttagggagaattttattgaggatttttgcatcgatattcataagaaaatttgtctgaagttctctatctttgttggatctttcggtggtttgggtatctgagaaattgtggcttcatagaatgagttgggtagagtaccttctgcttctattttgtgcaatagtttgtgaagaactggaattagatcttctttgaaggtctaataaaactctgcactaagcccaactggtcctggccttttattggttgggagactattaatgactgcttctatttctttaggggatatagtacagtttagatcattaacttgatcctgatttaactttggtacctggtatctgtctagaaatttgtccatttcatccaagttttccagttttgttcagtatagcgttttgtagaaggatctgattgtgttttggatttcttcaagatctcttgttatgtctcccttttcatttctgattttgttaactaggatgctgtccttgtgccctcttgtgagtctggctaagggtttatctatcttgttgattttctcaaagaaccagctcctcatttggttgattctttgaatagttcttcttgattc

SEQ ID NO: 3888 - DNA, 1000 bp, mus musculus
tactttttactattgtgaagagacatcactaccaaggcaacttctataagaaagggtttattgggtttacagtttctgggtgtgagtccatgaccatcaagcaggaagcacgaggcacgactctggagaagttgctgagacctattgtaggattgtgggtcccatggccgctcatgagagaggtggagctggttcagagtgtgccagggccttctgtttcttaggcagtttgacacccaaggcaccactgggagtggtggaagtgccaagaacatagtgttctcccctgctcccgccccaaggctggatctaacctggggctcagaaaaaaaggggagctccagctggttccaaggagattgtccttgatatggctggtgcagaaagaatgtgtgggaagggaagcttattgtctatgccctctggacctctaagtatctcatttacatttagatcattgagcctccttgcccacaggtctcctgtatttttctttttctttttctctttctttttctttttctttttctttttctttttctttttctttttctctttctctttctctttctctttctctttctctttctctttttcttcttcttttccttttccttttccttttcttttgttttctttctttttattagatattttctgtatttatatttcaaatgttattccctttcctggatttccctctgaaaatcccctatccccttccccctctccctgctcaccaagctacccactccctcttcctgaccctggcattcccctacactggggcatagaaccttcacaagactcattaatgaccaactaggccaccctctgctacatatgcagctagagccattagtcctaccatgtgttttctttggttggtggtttagtcccagagagctctgagggttactggttagttcatattgttcctcttaaggggctgcaaacccctttagctccttgggtactttctctagctccttcattgggg

SEQ ID NO: 3889 - DNA, 1400 bp, mus musculus
tgttacaccatactgcccctactcactttcaaactcatggcctctttttcatacaaacacacacacacacacacacacacacacacacacacatacactgattatttcatatagttttacttgtacaagtacggttttaggactgaaagtttaatactaactaaccatttgatatgttcttcactggggaagactatttctcctactcccaactttcctttagttgcctgcaggatttctgtgtagagttgaggcctcctgagctattgatgtcatctacgacctgtgagacatgttcttgactgctaattgatgtaagatggtccaggtactgggtgtatgtgtttgttggagtgggttgcaatctttaggcatatgtgtctgggtattataagaaaggtagcctggatcttcagccaggaagcagatctgagctccagacctctgtgctcctaaccctgccagaacagaggtggctaccctggaaggctctaccaccagagtagctgagagagtcatcttgtatcccaggtccctcagagaccagtctgtgcaggagagcctgctaactgcagaagtagcatagcttctgggacatgccccgtttcagcccttcatcttcagtcaggaagaagatctgagcaccagacacctgtgcttcttcaccattagaggagaggtggcctgcagagagtacactgaccactgagactcaggagagagttggactcccaggagtgctgacagaggctaacagaatcacagtaggaacaatatccagcgagagacatctataacagctaatgccagagattaccagatggcaaaaggcaaaggtaagaatctgactaacaaaaatctacaatgctcaccaacatcagaacccagcacgcccacctcagtgagtcctggatacccccaacacacctgaaaagcaagattctgatttaaaatcatatctcatgatgctgatagaggattttaagaaggaaattaaaaactcacttaaagaaatacaggagaaaacagctaaacaggtagaaggccttgaaggggaagcacaaaattcccttaaagaattacaggaaaacactgctaaacaaacagaagtcattgaagaagaaacacaaaaacaccttaaagaattacaggaaaacacaaacaaacaggtgatggaattgaacaaaactatccaagatctaaaaagggaagtagaaacaataaagaaaacccaaagggagacaactctggagatagaaaccctagggaagaaatctggaaccgtagatgagagcatcagcaacagaatacaagagatgaaagagagaatgtcaggtgcagaagattccatagagaacatcagcacaacaatcaaaggatatgcaaaatgcaagaagatc

SEQ ID NO: 3890 - DNA, 1000 bp, mus musculus
ccattcatttatatttcggatcatatcctacttcctggttactcttccaccaacctgccatccgacatccaccctccacctggccctttttttgtgtgagagtgctcctcctcgcacccacactttccttccccaccactctaacattcccctatgctgggtatcaaacctccccagggtcaagggactcccctcctattgctgtcaggcaaggtcatcctctgctacatatgtatctggaaccatggatccctgtatactcttgtatttctttaaggaagttattaatgtcctactttaagacctctatcatcctcatgagatggcattttaagtcagaatcttgcttcacggtgtctttggatatccagggcttatggtggtgggaggactgtattctgttggtgccaatttactttgtcttctgttgcttatgttcttgtgcttgcttctcaccatcttgttatgtctggtgttaactggtctggttatctctgactggagcctgactctccttgtaggcaggtagagctctatgacctgtgttacagcaggtttcctgggaggtagaaaattctatctctggttaggcaggcctcctttgttcctggttagggcaggtctcctgtctctctggttgtagcagacatcctcacagataggaacactatgttcctggttacaacaaatatcccaatagacagacaggcaccagttggtcaggagagctgaatctgctctagttgcaaaccagaaggaagttgaggatcaaacagatggataggtcccacatctgctgggctctatgtgggtcccagctggggcaggtattggggcaggggtcttacctgtgtccttgattatggcagagttcctaggagaaaggctaactctaggatgtggaagaaccaatcctattatttcaatctaattttttttctctattttcctctaatgcctcaaattcaaaggtagggaacaatatttaaaatagcaatat

SEQ ID NO: 3891 - DNA, 1400 bp, mus musculus
cagatgaatttgagaattgctctctctaactctatgaagaattgagttgtcattttgatgggaattgcatcgaatctgtatattgctttcgtcaagatggccacttttactatatttatcctgccaatccacagcatggaatttataggcaaatggatggaacttgagaatatcatcctgagtgaggtgactcagtcacagaggaacaaacacaatgtgtacttactgattgttagcccaaaagttcagaatacccaagattcagttcacagaacatttgaagcctacgaagaaggaacaccaaaatgtagatgcttcagtgcttttttgaagggtgaatgaaatactcacaggagaaaatatggaggaaatatggagcagaaactgaaggaaaggccatgcagagactgtgccacctggggatccatcacttatacagccaacaaacccagacattatagtggatgctgggaagtgcttgctgatagaagcctaacatgactgtctcctaagaggttctgccagagcctgacaaatacagaggaggaagcacacagccaaccattggactgagctcaggggtccctgatggaggagttggagaaggaactaaaggagctgagggggtttacagtcccatggagggtgcaacattgtcaaaaagataaaccccccagagctcccggggactggaccaccaaccaaagaatacacatggagaggcctatggcgctggccacatatgtggcagaagatggccttgttgaacatcagtgggaggagaggccctcgggcttgagtatgttcaatgccccagtgtaggggtatgctggtgtgggaggatgggagtctgtgggtgggggaccaccttcatagaggcagggggaggggtatgggatagggggttgccaaaggggacacctggaaaggggaaaccatttgaaatgtaaataaaaaaatatccaaagggggaaataagagaacaagaataacaggcaatcttctgtaaaacaatctctctttagaaatggctacataacacaacctaggcattggtaatattaatgggtatataacatagaaattgagatattttgtgtggttctaccctcaacaacgaactacagacaactaatgactgctggaagaaggatattttttctccaggataaactttcttactgattgtctaatagagagttagtcattccatgtatacacgaacagcaaaaacagactcagcaggttgcatttacatagtacatacccacacaatatgtatttatgcacaaatgtgtgcttatgtgtgtgtgtctgaaactataaaattaaattaaaagaggctatccacttgagagtgagggtgagtgagagtgaaggtgaggaataggaggggttgg

SEQ ID NO: 3892 - DNA, 1000 bp, mus musculus
ctacagaagtgtcagtgtttcttataagaattttttatcaaggtaaatcacagttttacatttatttatttaaggttttaagatgaaggttttaaaaagagcatatagctggtgactagaaggtataaacttaccctagattggttttaaaaataaatatttaaagcatcttaattttctatctctttttaaatttaatgttaatttttagttattcattttatattccgctcactgccccctcacagtcatccttcccacaatccttcatccatcccttcctccctttctccccatcctggcacttcaaggctctgtgaagctaggtgatttctctcccactgggacagacaaggcagcccagctaggagaacttatcccacatacaggcaacagctttaaggatagccctccattgtccatcttaaaatatgtatagtttggtaataggtgaggctttgtggactggtgtctgcttgagactctcatctttgctagttaatggcagtgtggtcggactctggttcctgaacttctatgcccacttcccgttttttaagtgaggctgacagaacctcgtgcatggtgcttgtatgagaatttcacacgatgtatcccataaaaactcctcggcaaaaacctgacagtgcctgttagtgctagcattatttgcttcaactttacatcaaatcatggtgtgaaacccattcactaataatgagtgctagctgtcaggtaaagcactgagtttcaaatctgttgagagtttggagcagtggttatcagtgtttcctctagaagtacacgccaggggcttttcctctacctcctctagcaagaggatgctgtgctcatttatgagtccatgcatcccagatcaagtctcttgtgtacactctgagttatgagatatatgcacacaacacatttgggacctcgggaaagtaataaacagggagtcactcaactgggaagtacttcgacttctcgtcacctcctt

SEQ ID NO: 3893 - DNA, 1000 bp, mus musculus
aaatttatattttatcatatcaaaagaaaataaagaagtaatgttaacttttaatatgttttaattatgggtttttatttttctgaaaatgactgtcctgaagttgtactgtcaccataaggaaaaaagtgcttgtgtttcttatattttcactttttctaagatttaattttaattttaaggttttgtatacctgttactattctatgtgtgtggtgatgggcagtggctgaaggattcccgcagaagcaaaaagactgcactggatccctggaactggagttacagatggtcatgaaccacccaatgtgggtactgtaagcaaacctgattataatttcccctccctctactccttcaagtccctccctaagtccccttccctctaggtctctgaatggaaaagaatggattctaaagagattaaaaacaatagataagaagatgaaatataagataaatcaaagactattacattgaagttgaacaaggcaaagcaacagcaggaaaaggcccaagaaaaggtacaggaatcagagacacactcattcacatgcgtggaataaggtaaaaacagtaaactgagagccataataaatagacagaagacctggtacagatctgtgcaggccctgtgcttgctgctgaagtctcagtgagttcaaatgagctttacttagtggattcaggtcttgttctcttgacatgctccatttcttctggctcttatactctttctgtctccacttctgttggggttccctgagcactgagcagagagacttgatggagacaaactatttagagatgcaagaggaagtttctgataatagctgaataaggcactgatctatgagtatagcagtataccattaagagttattttatctctacttctttcttaagactaaccacttgagtcatttctcccgtcctgtctttagatttttacagaagactacattaaaatatatcgaatatgcctagattaatgactgta

SEQ ID NO: 3894 - DNA, 1200 bp, mus musculus
atttaatttaatttttagttttttgagacatggtttctctgtatagccctggctgtcctggaactcactttgtagaccaggctggcctctaactcagaaatctgcctgcctctgcctcacaagtgctgggaataaaggtgtatgccaccactgtcgggcctttcctgtagttctttaagggatgtttgtttttcctctttgagatcttctacctgtttaggagtgttttcctgtagttctttaagtgattttgtgcttcctctttaagtggttctacctgtttacctgtgttctcctttatttctttaagtgagttattaatggccttcttaaaatcctctatcagcatcataagatatgattttaaattcaaattttctttttcgggcatgttggggtatccaggactcgttgtggtgggagtactagattctgatgatgccttagtgtctgtttctcagtgtctgtccataagattcttaagttggccttttgccatctggtaatctctagagttagatgttctagctgtctctggctggagcttgatcctcctgtgattctgttagcttctgtcagcactcctgggactccaactctctcctgagtcccagtggtcagagaattctctgcaggcaagctctcctctggcagggaaagtgcacagaggtctggagctcagctgtacctcctggctaaagatgaaagactgaagggacactgtccaagaagttgtgttgcttctgtggcccacaggctctcctgtgtggattgatctctgagagacccgggatacaagatggagatcttgcctgagtcccggggttggagccttccctggaggctgactctcctctggcagggaaggtgtccagagctctgcctcatgtctgaggatgaaggcctgaagggcccctgtccaagaagctctgttgcttcttatgcccacacactttcctgcatggactggtctatgagagacctgggacacaagatggagatctcacctgagtccaggagtcagacaaaaaataattttatcacaacagcaatgtatatttaattttactattgtttgttctaaattatcactacttagatgcacaaagaaagaagcaaatattcaaaatatagaagcaataggttttctttttaagaatagcattcagtaataatcataatcttcaattattgagtttt

SEQ ID NO: 3895 - DNA, 1200 bp, mus musculus
ggtctatactatgcaaagtaacattctaaagtcaataaacggaattaacgtttttcaaactataacctcatctgtacttcttttctgccagcaaagtcctcaggaatgcagggctcgccacttgtccagaggacctcgttcagggatgtatttgactccacagccatcagggatgaggcgcttggccgccaccttgtcttcaaattcatctgcgttgaacttggtaaagccccacttcttggagatgtggatcttctggcggccggggaacttgaatttggctcggcgtagggcctcgatcacgtgctccttgttctgcagcttggtgcggatggacatgatgacctggccgatgtggactctcgccaccgtaccttgtggtttcccgaaggcgcctcgcatgccggtctggagcctgtcggcacctgcgcacgacagcatcttgttgatgcggatgacatggaaggggtgcagccgcacgcggatgtggaagccgtccttgccacagctcttcaccatgtacttgttggcgcagatgcgtgcggcctccagggcttccgaggagagctgctcatactcgtccgacaccatgtggccgcagagtggaaactcatccaccttcgccttcttccgacccaggtcaaagatgcggatcttcgcatcggggacgcctcggcagaaacgggactttgggtacggcttgttcttacagtaccggtaacagcgagccggacgacgacccatggcgacagcaggaacctcagccgtgcgtgcccaccgccagccgcaaaatggaggccaaatttctgttacccatcaagccttgcgggaatcatagagactgaggaagacttgaagatagacctttccactcaatctccgggtcactctacgcctgcgcaggcctcagtggtaaatactgaaaggtttctttcaggccgaagaaagcccaccactgcccaccgaatttggaactttgaccttaagctttgtagtaggcttaaaaacaaaagtttacagctgggcggtggtggcgcacacctttaatcccagcccttgggaggcagaggcaggcgaatttctgagttcgaggccaacctggtctacagggtgagttccaggacaaccagggctgcacagagaaaccctgtctcaaaaagccaaagtgggggaaaaaaaagatttatggtcatggtgaat

SEQ ID NO: 3896 - DNA, 1600 bp, mus musculus
ctcgtaaaaactgtagaatgtggctcatttctaatcatggttgacctcatgattagttccatgtatctccttatcttagaccaatgagttatcgaaaacacacttttctctttgttgggctcagatgatttatagaggtgagcaggattctacaagtacctttaatatctagttcagaaacattatttgtcatttctccacaaagaacaaatcacacaagataaacaacttgtatgggtttgagatacattcccataatggtaaggtttcaagagaaatatatctgagattaagaaagtattcttcaagattctcagaagttttgagctgataacagagtcctcattattaaattttattaaataaaaagtatcaaaatatttaagttatttgtatctacagacatattggcacttaatgtatatttataacttctgtgtttgtgtatgcatgtgtaatgcattgggtaatagcctcaggtcatgagaaattaagccagtctgtactagaaaatagtccctagccagagagaatggcttagccccagcctgactttcactctacctaaagaatccatatatgtctgggtatcagaaacagcctaccctgttcccagtcaaatcatcaaaagcaactgtaacatacttataactatcagtgtatgtgtctctgtacgtgtgtctcctaaacactaagagcactctactcccatcccatgaaaaggatgggaccctcactgttccactaaagcagtctcagactattgagattgattttgtctgtttctgcatatgcctcacttttcttacaaaatgtatttgtgatgcatgcaaatgtgtatgtatgggtgcatacagaggccagaggagtacatcagaggtccttctctgtaactttttgtcttagttctttgacacagcatcactcagtgagcctggagttaggctggcagccaacaaccccagtggtactgttcctgaacctggcttttgatggtggttgggggcatcagaattcaagctttttacatggatgctggagatttgaactcagaatacttgcttaacaagttctcttatctgccgagccctctctacagatttgtatgtcataatccttttacacaatcaagaataaaaacacaaccattaatgtattaaaatttaaaaacctgataatctactctccattaaaatgctcccaactgtggttgagttttgcatagatacaacatgccctttttataatgtgagagaaactatttccatatttttggcaagtgataattttaaaaaatatttattagtgtttcagtgtgaactaaggaaatagcaatatcccattaagtttcaaattgatatttgtaacaaccaatgatacaatcattttgaacatttttttgaaaactccatattctatccataatcatccttacacaaaatttgtacctaaattattattctttactagcaaaatgtatttatatttggtaaatatataatctaatttcatctccagttatatctgtctacgtgtaaatatttttatatgattttctgtgccgagagtttaccttcggttgtatgcatgataggcaagt

SEQ ID NO: 3897 - DNA, 1000 bp, mus musculus
tagaaatattgataatccacaaaaataagattattcaatgaaaggagtgtgaaaacaatttgctctctgtttaatttattgattaaaagaagactaagaaaacttttgctagaaatgtaacagttcttcccttacttggcctttgctatctttaatagtaccttaagagttttttatgattttaattataatctataccttgatgctctccatcccacttaaaaacctgaagtaacaagcagagcctcaaatatccatgatgtcactgaccctcgcctttcatgctgcagagaaggcctgatatctccagggtgaagtgaggataaatgggcctcatgccagtgacttcccactgtgattaagttaaaatccaaactccttgcactgtgtcgataagtcctcctagagctggcttctgcatctctgacctcatcacatcttaccttccattaaatggaccttctttctgaccctgcttgagcatcttcctgcctgggggattttgttcctaacatctactcagcataaaatgtaaacaacttattcccatattatagatctgggctgaaaggctatttccatggcattgacttcactatcatggtcatatcttcttacagtttgttgctattctgttgaacaatcttaacttccttatggcttgttctgcggtcagaattgttttatccaactgttttatgtctgcaaatctaccttcaaagaaagcaagaactatttcgtgtacaggtgtctctttagattttgtaagaatgcctagtggattgaaggctctcagtaactaataaactccaataaaaaattaatgacataatgaaatcaagtcatgcatactttagtctgaaaggaaactcactactgatttgaaataatgaattttgtaaatatgtgccattaaatcggctatatatgtgcttacagaaaaaaaagtcattttcaataataaaacacttatttaataattaaacatatttttctatat

SEQ ID NO: 3898 - DNA, 1200 bp, mus musculus
aattttagggaaatgtatgttatgtactcactaataagtggatattaaccaaaaaaagtactgaatacccacgatacaatccacagaagtcaagaagattaacaaggtgaagggcccaagtgaggatacctcaatcgtgcttaggagggagaagaaagaaattagaggaaggggggaaaagtgagggacaggataggaaaggggacaggaaggggaagaggggaacatgatcgggcattgggtgggggaaaaactgaagccctgagagcagacagaaagaatggaaacaggaaacctcaggaggtaggaagttggggggactctctagaatgtaccagagacctgggaggtgagagactatcagaactcaaagggagggaccttggatcaaatactgtacagtagggagggggagcttatagagtctagccccagtggagggacaggcaggatagagttgccattccacagtcaaaagctctgacccagaattgttcctgtctgcgggagctgcagggacaaaaatggagaagaccccgagaaaaggagatccagtgataggcacaaattgggctccaactcaaggggagacccccaagacctgatactattactgaggctatggagtgctcacaaaatggggcctatcataactgtcttctggaagacccaacaagcagctgaaagagtcagatgctgatatttacacccaaccaatggacagaagctggtgacccctgtggttgggctgggaaaagctgagaaggagggccatcctatagaaaaaccagcagtctcaactaaactggacagccgaaatctctcagacactgagccaccaactaggcagttgatatgagaccccccaacccatatacaatagagaactgccatatctggactcagtaagagaatatgcaaccaaccctcaaggccccaaggagtgggaaaatctggtgggtgggtgacatcctcttggagaccgggggtggaagtgggagggaaggtatgtgatgtgcaagagtcagagggtggaccagaaggggaataaagtctgtactgtatatatatatatatatatatatatatatatatatatatatatatatatatatatatatgaatgaatgcatgaatgaaagaatgaataaaataaaataaatgattaagaaaaattattttatgattttttaaaaatag

SEQ ID NO: 3899 - DNA, 1400 bp, mus musculus
atgtaagaccactgtttcctttaaaaatttctcaggggttgatctagttcacatcaaacaaagatgagcaattcctacttaattaggaaaaataattacaccaggtcaagcatatgaggtctcaacatttcaaaattaattaattaattaaatcaattaattgttcattctgtgatgctgataatggaatatgttttccaataatagactatttaaaataagagaaagttctcaaacaagatttttgtggactgtgtgaataccacttaaaaactgaccataaataaactttctctctttaaaggtatttcatctaatctcttcctaccttctggtaaattagtggatgcagataccagatttcaaaagataataatgaaagtagagagattatgggtggaataactcatcaatcagccttaacatttgttttactattaaaatacttttatgtacaattaagcagagctctataactcacaaaatgtataaagagaaaaatgtaaacagtaagcaatgttttgaaacaacccatttttaacaaagagacaaagattcataatgatagttgaaaatacaattctaaaaggagacaaaggtggattgtgagcgcctgactcgccagcaaagcagacaccacaacaggatccttctgcacacgtttattgggagagcttgattgcagaggcaaaaagaccctgagcccagaactggtgctgcttatataggcctaggagaggcgtgtctcacacccgattggttatgctttcagcacctcacagaacctcattaacatgcctgggccaggcagtgacttggcaaaaaactttactgcatatgtacacattggttgtttacccaaacttatgcgtggtggccagcgccaccttgtaatggcatatgtggcttcccacagtgaataaaacaagaccagacatgagaccagcatcaagttccattcaaagaagcacaggttttttgtagatttggcttccgaacactttgaagacaatggaataaacctttaaaatattatagtaaataagatcaattgtaataggacaaatgttgtatgttttcatttactcaaatgatctgtaaagcgttttacacatgtaaaacgcttaacactggtagtatgcagctgagagtgaagaaaaaatgtattgctttttaactgtcattaaagttcttacaccttgactaagctatagaaatattacatacaatgagagaatgtccattcatataaatatatgaatgacacatgtgcaagcatgcacacacacacacacacacacacacacacacacacaaatacacccacatagatgatagtcttataatatttgacaatttcatgcaggtatgaaattcattctgtcacaatcaccacccat

SEQ ID NO: 3900 - DNA, 1000 bp, mus musculus
agggagagagtctcagttccccagcaaatgtttactgcatgtatactcaagtatagtctcagaaccttgggatcagctttgggaaccttttgtctcaccattcttggacttggaagttttgttgacttcttgagtctcaggaacaccctcttctttccaggaggttattgcagtttgctacaaaacatcctggcactcttttgagttttgtcactagcattatttgattaagccctcagaacaattacatgatcacctccactttagggatatggacgctgtgggtgagtgtcggcagctgcctgggcatatgtagctctcatggtatgaaccagagctgaagcagtcactgctggctgctgcatcaccgccactagactgacccctctcgagtcctctgagggcgcagagggtagaggctactcaagagttcacttacatttggcatgtctttcctcttacctctcaaagccttgccttatgcttctccttcccgtgtgcccctttgctctgcagacatgtctgtctcctgcttgttattcacagcagtgtcacctgtgcttttagtcacgtatgaccaaccacagtctgaaactatcagacagaagcttccagaaacaaacaattcataagctgaaaattgtctggcctgggcatggttctgtatgccggtaaacccaacactctagaagcagaagcagatgcagaaggctctctgcaaggtcaaggtcaacctagtctacagagtgagttccaggccagctagagaaatatagtaaaactctgtcttaaaaaccaaagagactgagatatatgtcctcctaatagtgtgctcacatcacagaccctcctgaccctcctccccatgagtcctccctttgcccaggttatcccatgctgtactgcccctgctcatttgtcccttagtcacctactagctgccttagatggtcagacacactgtctcaatgcagtccttctgttaaagtaggtttaattt

SEQ ID NO: 3901 - DNA, 1000 bp, mus musculus
cagtccttgcctgtcaaagcagagtccaggttaagggggtatctgctgcctttttaattattattattttttttaaggattcttaggttaggggcttaaatggggaaatggggagcactgagaagcgtgatttggagcaagagacttgtcagaattattatcaacacagaaaggcaacatggtgtggccctgaggagagttcaggcctgtgaggcaggatatgggcccttttcttcagatctcagaggaaggcaaaggtcggtggtccttggtactgtccttaggtgtctcttgtacccaagctggtaagggagggtcttgcattctgggaaagagaggaagggatcttggtactgtgtggcttagaggatgctggggtactgggtagaagtacattaggttaaggtgttcctattagatcagtagctttctgatgttttcgagcccagtagcctgggcttacacacttcctagagggagtgagaacagcccctaccattcattttcctggaattcatatgcccaggcaatcttagaaggttactcagtgaggcatctttgcccggtagcagtaggcattccagattcaactatgagtgctgagatagagagatgagatgaggcatgccctgggcagcagctcatctgaaatctaacattattttcttggaatctggatacctggtgagcttattagagggtcgcagaggcatgggagtctttggatagtgggcttggcattttctttatggcagccgagaggaggaggttcctggaatctggaatctgtagagattagaagtctgtgtagttgctcggacagcttcttcttgctgggactggcttgttaatcaaggatgaacatattttcagaaacagccctgagaggctctttgctctgcgtgtcacagtgttgcacagctcacttcagaatgcaacaataaggagatagactgccgtagaccctctgggcccctttgtctgcgtggaatgggtctct

SEQ ID NO: 3902 - DNA, 1000 bp, mus musculus
aataactttaatataaaatgtaaaactaaggcatgaatttgagggggggcactagaggagtcagcatggagagggagggtagaagtgatgtgaacacacacactcctggacgatacttccaaagcaatcaatagaaaggtcacggttcagactctgaagttcggttgctgctgaatgcatcttgcatttcagctctgctaagctgagcgactgtcagtgacccatcattgtcagtaaatcatctgtacaatgaagtttaaaagaccaaagccctttcaccaccgttcattttctttctaggccccggctttgcacatcaattttggcgtctagcttcattagattcatagtgtttccaggagccacaattgaggcttttctgctttatcactgggtgattctaaagtttatgatactcacagaattgtggaatatctaaaaataatctgaggtattatattatctatatatcactgcatgacaaacaagattcagaatggtatatagtaaacacctagcatagtattatctcttaggtcattattacaaaatcagtatatttagactcacgaaagggaagaatcgctggcttactcaaacagaagacgacctttagcatctgttgggtcattctagactttcttcagtgtttttacatgtggatgtctcgatgtggggtacatctgtgtgtgtgcatgctctcatgtgagtgtgtgtgtacgtgtatatgggtgtgtcttcttccattgggtttgcaccttgtatctaagggcagggtctcttgctgaactcagagcggctggttggttagtctggctagccatcttgctctgggatcccatagcttcaccttctgaaggttgggataaaacataggcagccacacccacattgtaggtgggggctggggatccaaatggcagcccctgtgtatcagctcactgccctgtgagccggcccctccagctcttgtttctttggtttttaaagacaaaactca

SEQ ID NO: 3903 - DNA, 1400 bp, mus musculus
acaggttcagaggttcagtccattattgtcatggcagaaacatgacagcatccaggcaagcatggtgcaggaggagctgagagttctacatcttcatttgaagtctgctagaagaatggtgcccacctggttagaaggagggtttcattgcccacccccacagtgacacacttcctacaacaaggccaaacttactccaacaaagccacatctcctaataatgctacttcctggaccaaatgtattcaaatcactacaccaagtcataccactatgagagaataaccttccctacccatgacactttgcttatttctttcagccatacatgggtacagtaaatctttcaactccctctttctataaactaaaagtttaatacactgacctaatagatattgggtgtgttagatgggaaaaatacgtgatggaaaagaacaagcaattatcagactttgctacataagtgttagtatttagttatgcatctgtctaatcccttcactcctgtttccctcttcagtatacagatcacagaaggatgtggatccagtctccatccgggaacccaactggtcaatgaatctcaataagtaacacccagcatccagagactgccccacttggggatccaccacataaacaaccaccaaacccagtcactaggcagatgccaacaagagctgctgacaggagcctgatatagctgtctactgtgaggctctgccagtgcctggcaaatatggaagtggatgctcacagtcatccattggacagagcacaaggtccccaatgaagaagccagagaaatacccatgggctgaaggggattgaagccccataggaggaatatcaatatgaactaaccaggacccccagaactccttggaactataccaccaatcaaagaaaacacatggtggaacttgtggctctagctatatatgtagcagaggatggtctagtcggtcatcaatgggagaagaggcccttggtcctgtgaagactctaagtcccagtataggggaatgccaggaccaggaatgggagtgggtgggttggggagtagggggaggatggaggggataggggatttttggaggggaaactaggaaatgggataacatttgaaatgtaaataaagaaaatgtctataaaaaattaaaatataaataacacccagatgaatgagtacatttgattatatatgatataatgttgaatttccctcaacctgaatttttgttatatgttctctcaatgtaaattttacagagcaatttgttgactaattttttgacttgataacatggttcacatgggatttagccaacaaatataccaatttcctttttctttttttaaatttattttattttatttttttctgacttttttta

SEQ ID NO: 3904 - DNA, 1000 bp, mus musculus
cttgtgcacagaacagtcagcagtgatggcttctgggacaaatgtttgggtctctgggagtttcttctggatgtggatttagttcagggttagaaaagtcagaataagctactgggctactagcctctggtaagtagtgggacttaacaagttgcagagaggagctaaaggaaatgtccccaggaagctgaggcagacctggagctgcaccgagcagctggagattaggtttcggatggtcgtccgtgttgactggtacacttcgtggcaagtgagactgccaccgagacctgctctttgacaacacagccatgtccaggagagggcacacgtggtgaagacagcaggtatacgaagagtgattggaacgtcagccccgcccttctgaccctgtgttcttccccaggtgaccctgccctcagcatgagccattggatgttccatcagcaggcgctgcaggagtacatcctgatgtgctgccagtgtccagccggggggcttctggacaagcctggcaagtaagtgctcccttggggagagggaattgccacccaggctcactaagagccaggcccatcaatcaacctgggcatccctgaccttcatctgcttattagcactaacgtgaaggggaagtgccacggttggggtgaccctcaccctttcagtaccactgagtggtcacctctgctactcaccagagagtcactcgtcagagacccccagctcataggcacctccctacttccccagagaggtaaatgggtggctgacttggtagcttttgtccccagagatagggtttgtgtgtagcccaggctgtaccagaactagctatacagaccagagaccagttcaggctgtccttgaactccgagatccacctgcctctgcctcttgagcaaaaggcatgtgccaccgtgcctggcttcctttactttttttttgttctgtgtttttcttgttaagtccatttaactagaataggatgtggatggag

SEQ ID NO: 3905 - DNA, 1000 bp, mus musculus
cctccccttctcctctgacaggagggaggtctccctgggtatcaccctaccctggcacatcaagtctctactggtgtaggcacatcctctcccactgagtccagacaagctgacttacaggaatgggatccatgggcaagcaacagatttaggaacaaccccctgttccaggggaccagcatgaagactgagctgtacatctatatatgtgtggggtgcaaggggtggggagcactaggtccagctcatgtatgtactttagttggtggttcagtctttgggagcccccaagagtccaggttagttgactctgttggtctgcttgtgaagtccttttcccctccaggtccctcagtccttccattcaatgtttggctgtgggtctctgcatctgtttcagtcagctgctgggtggagcctctcagaggactgttatgttaggctcctgtctgcaagtattacagtatcattaatagtgtcagggtagttcttgcccatgggatgggtctcactttggggcagtcattggttgggcatttcctcagtctctgttccatctttgtccctgcacatcttgtaggcaggacacattttgggtgaaaagttttgtaggtgggttggtgttcttatccctccactgggaatcttgtctggttacaagaagtacctactttaggtgccatatcccctcatgctagaaatctcagctgaagtcacctccccccaccaagactccttgggacctcccccatcccacttctccagcacaccctagagatgccaccaccactatccccaatttccattcactttcctggacctctctcctgtctctccccacattccctacccatcttctctcccacccagttccctccctccatctcccttctatgagtattttattcacctttctaagtgagatccaagcatcctctattgggccttccttgttgtttagttttttttgggtggcagacccttatttttaatcttagtc

SEQ ID NO: 3906 - DNA, 1600 bp, mus musculus
aaatttatgtatctattacatatgtgtttttgcctgcatatatatctgtatatgatttaagtgaagtacctttggagggcacaacatactaattatatatattttgattttacatattatgaatgattcataatgttaagtttatgttaaacaaaaattagacaaatacttgtatttctctgtatatatctcttaaacgtgaaaaatggtgtttgcttatatattcatgagttttaccaattttggtggtaagtttgttcttttggtatttctagaacactgccttgtccccctgagtatacttgtcatctcactgtagcctcactgattaaatgatattttggtcccttggatcatgacattaaatatgaaggaaaagacaggattgctttctgggaagcaatcatctctaaatatatactgtgcttatgtgctgatattaagacgggttgctatggtgaattgaatttcttaaaactgtcagtcagcagagggtaaacagtggcttctgaagtagtgattccccatgaagctggacattctcacactgtattttcataaaggttaaaatctagttaccatgtttaatgaattatttaggaaatttcaaagtatctttaaagtgtttattatatgaaatagaagagttttgtttgctccagggacagtgccaggtggggagtttgactggggcggtacacctgtcaaaaggtaatgcaggtgtcctaaggcgagctcagggaggacagaaacctcccgtggagcagaagggcaaaagctcgcttgatcttgattttcagtacgaatacagaccgtgaaagcggggcctcacgatccttccgaccttttgggttttaagcaggaggtgtcagaaaagttaccacagggataactggcttgtggcggccaagtgttcatagcgacgtcgctttttgatccttcgatgtcggctcttcctatttttcactttgctacccacagttttgttaattctgaaaacttactacagctgtcttgctcttggtcattttttaaaattcttttataatttggtttgatttgcatgagtgtttgtttgcattgtacatgtatgtgccatatatatgtgtgctgttcatggaaaccagaagaggatgttggttcccttgttgctggagttgtagttggctatgggctattttgtgggatctggggctcaaacttgaattagcaaacaagtgctctacttttttaaaaatcaatataagtaggtaaactggtttatttatttttttatttgtataactagtcataaagccttgctcaaactttatttctgcccataactacgtttaaaaaagattatttgtttgtttttctcttataattacatatttttattggctattttatttatttacatttcaaatgttaccccctttcctggtttcccctctggaaaacccctacctgatcttcctcccctgcttctatgagagtgctcccctactcacccacccactcccacctccccccattggcattcccatacgctgggccatctaaccttcacagcaccaagggcctctcctcccattgatgccagataaggccatcctct

SEQ ID NO: 3907 - DNA, 1600 bp, mus musculus
ctgttcgcaggttatcttgacgaatcaaattacgacccatctgagtggagccctcccttctcaagcagacctggtgtctccagctgatgatttgtccctgtctgaaggtaaaggatctgtcctggggagactgaaacttgacactgacttacagcctcctgcctcctgttgagagccgggagacatggctactgaactctggtcagttctgctggctggagcctggtgatttagacttgggcatcttgagggacagtgatctattcttgtcttttgctggctctgagtgagttccctttgaggcatcgtcatactcatccatcattgccccatggatggagtcttgttacccctctgcggtgcccccctaaccagttgctgactatttctgagactgatactccagcattgcctttattggtggtcccctgtggtgatctcaccttttctttgaaccaaacacctctagactgtctgaaagtgtgcagtggttccatgtgcaggtgatgtgacattcctgatcagctgtacagaaggaacatgacaaggtcttcacaggggcaaagctgcccattttctatgccacctcctacttgcaaaggtcagacaggcttgaattttgaaggcagcgagccttgagtagttgggggaactacatcagcagccagaaggtggtttctgatgttgttgacagtccttccttgacatttctaggctcttctagttgcagttgaatttggggcacggcgctatgggaagcacacagtccttctagcacatcttccctttctactttctaaaaattggtcatgatggaagacaggggactttcaggcctggcaaggctcctgactgcctggccaggtaggcttcctggaccactttagtctcagcctggaagccccacatgtctgcttcttggtgttgtctttggagtgaaagctaatgatgtatttgtgaacgctgtgaagggctgtgtcccttcctccctcactcagtgctctgtcaccctcctgccacctgagctgagacttgaacaagctgaaattcacctctccttcaacttctctcatcaaatcagtttcagctttctttccaaatatattcttcacaagtctcttcattttctttgtgatttgtgttgtgatcaagtgatttattaaaactcataattggctcattttaataaaccctgtaggaccttctgtttccattctactctttggcttccttccagggtgtttccctcctactcagctcgctgagggttgtctttctgaggatgtgctaaaagaagtgtgccgatttgaaaatattcagggattttgggtttattgtaacaaccatgctatacaacatggggttcagcaaatgcaaagacacccgtatctttcttctgagtggaccagttcctagaaccccactaaacaaggctaatctttcttaaccattccgggtcagctctctccttgctagtcaacctactaagtccttgaatgaagcatccgtgtcaagtatgcaatcttctcatgcccttccctcactctagagcagcgtttctctttgtccccttcccctcttcccaaggacttcaggctca

SEQ ID NO: 3908 - DNA, 1000 bp, mus musculus
cttttcctcttcctctttctcctccttttcctgtttgtttgtttgtttttgtgtacctctgactggcctggaactcatcatatagaccaggttggccttgaacttacagagctttatgggcctctgcctctccagtgctgggattaagcttgtgcgccaccatacccctctgcaggcctgaatcacataggcgtctggaagtctccttttcattcatcctgtaagaccacagggacttttgtgttcccctggggtgaggttggatgggtgattccaaatctccaggaagagaattgtaaggtctggggaagggagtggggcagacctatgcaggcttctggggtggctgtgcaagatgtcgtagtcgaggacaagtcagagagggagcagctgtccttggctgtcattgaggttcctcagcctattcactttttggcttcctgctgggacagtgacaccctcacaccataagggatgagacttgtaggaacagaagaaaggagcagccctgggctctttccctgtagaggctggctcacggtccattcttttcttttggcacagagaagacgctgtctgctcctatcagatgagacacaggtcaagagtggtgacattcataaagtttgctctgtctctagggcctcaagcccttagggatagacctggatggacccggaaagtccccaggaaagatcacagacaccaggttaagtgggggaggggaaaggtgcagccagagtccactggcccagccagtccccgtgactcattccctgtttctgtccactctggtctgaacgccttggccaaggggccttgaggaggttgtaacataggctggccccttgcccatctgggctcagcagacaaaaattaaagatctcacccctcaggaactcacacagacagcggaggcatgctcagtgtgctgcctcagagaccagacttcaggccagatgatgctggctgccaaggaggaggggaaagtctttggctc

SEQ ID NO: 3909 - DNA, 1400 bp, mus musculus
ttgtattctgttgctgatgctcgcatctgtgattcctgatttctttcctagggtttctatctccagcattgcctcactttaagttttctttattgtggctacttcccattttaggtctagtatgattttgttcatttccgtcacctgtttggatgtgttttcctctttttctttaaggacttctacctgtttggttgtgttttcctgttttttaaggacttctaactatttatcagtgttctacatttctttaagtgagttattaaagtccttctcgatgccctctaccattatcatgatatatgcttttaaatctgggtcaagcttttcgggtgtgttggggttcccaggaccatctgaggtgggagtgctgggttctgatgatggtgagtggtcttggtttctgttaggagtttgcttttcaccacctggtaatctctggagttagttgttttagttgtctctggttagagcttattcctctcatgactctgttagcctctatcagcagacttgagagattagctctctcctgagtttcagtggtcagaggactctctgcaggcaagctctcctcttgcagggaaggtggacagatatctggcatttggacctgcctcctagcagaagataaaagtcctaaactgggcatgtcccagaagctgtgtagctttggcctgtcccagaagctgttagcttctgtagcccacactctcacctgcacagactagtctcagacggatccaggaaccaggttggctcccccaggtgctctggcaatgccccctgggtggggcaaacacctctcctctggcaaggaaggtgcccagatgtctggagcccgaaacagggtctgccccaaaagttttgtggctcctccttagcttctttagtccacactctcacctgcacagactagtcttggagagatccgggaacaaagatgggtctcccaagtgcttcggcaaagccctctcaggcggggcggacacctctcctctggcagggaaggtgcccagatatctggagcctgaaacagggtctgcctcagaagctgtgtggcttctgcctgtctcagaagcttttagcttctgtagcccacactctcacctgcacagactagtctcgaagggtgttctcattttcttgcctgcagatgaaacctatcccctcatcccatacttctacatatctaattcaattgctgtaatctaattgtactagaaatgaatttcttttgcaaacattgagctgtatgggaaaccatgatctttgtgtcccattaatgagacctgttcatggcatgaaatgaaatgcacaaatctaacaatgacctaattatggtgatgaggaatgaagaaaccagacacaggtacagaaatgttgggaaagattaggct

SEQ ID NO: 3910 - DNA, 1000 bp, mus musculus
atttttctcttcaccaaggcattgtttttcactgagcatttactcatggataaatttagattcttagagcagctgcaaggaacagaaaccccaaggcaatctgatgttgctgtagcacttgaagataaatgaagaactcagactgtgcgaccttaaggttctctggactctgctctgagagatgtttgagcaccatgctaatgtcatacctggtacagtgcacatggtcaaaagcctatagctggggaggtcacaggccctggtgggtaatctgacctagtcagctcagtcagtcaacagggcctccagggaggtagtgaggactgaaaaacaaaagacagttaggcaacactataacatgactgagttcaaagcaggtttattttttcaaagtctgcttttacactattctaggtacatgcaaagaatagggtcagttcttggatcaaagacaaagcagtctaatgaggcaaaaaccaaagtgatcaaacaagacaataaacgaagtcctagtacctaggatttaatgatcaagtacctaggatctaatcaggaatgtcacatattcctctgttgggtttaccttgagctttgtttgagcccaaatgtaaatattcttatctgagcctacttctttgtctagctgggtggtccagccagttgatgttgttcttcttatagggttgcaatccccctccactcctctagtccttccatcagctcccccaacagggtccctgaactcagtataatggttgactccagcattcacaccttcacacctctctttgtcatttgctggtagaacctccatatgagcagtcataccaggttcctgacagcaagtgcctcttggcccctgcaacagtgtgaggtttggtgtctgcagacaggatagatatcgggggggggggggggatctccacatggtccttccttcggccactgatccattttttattcctgtttgttctttggacaggaacatttctgggttaaa

SEQ ID NO: 3911 - DNA, 1000 bp, mus musculus
gatacacaatgccaaggaaggctccccatcattctgccttgacttctgtatctcaatctcctttcttccctgaagtgagtgtacagcgcctcccatttcctggtctctacagtgaggtgattcagactgttttgacttgtgggagttccagctgctgccaagtgatgtctcccgcttcctttataccccgttctccactagaagccgtgctctgcttggatcaaacagaggccttactggtttatgtttttattttgtaatccctttcttttctgttttcagattcttcgagtcctgatgtggacagatccttgttctgtgattggctgtccattttgtgtgttttcctccagcccctattttcccagacctgtttgcgctcacagtgatgtctcgtgggtggaggcagcatacgtgagaaggctcattgggatttttcattttagttttcctttttagtaattttgaatatttgatatcaccagtcttcaggtcacactgaggatggagagtgtgtgaagctgccatcatgctggaactggaagggagagctgcagggatttacagggtaataagcaaaagaaagaacaaaaaaggccatgcaccatgccaccagacaaaagagaccccaatcagggagaccccaatcagggagcttgtaactccccctgccacctgcgctttgctatattacactggcagaaaaggctccattgaactaggaatctgttgactatcccaaaatgaagaggggacaatgagtgaactcacacaattattatcaaaataggacaattccatccggaaggcctcaatggataaaaatgactccctcagtaaagccccaggaggcagaaggaatctgtaagacatttctccaacacaaaatcaatcaggctcagaccagcatgggggaataaaacgccccaccaagaatcaaactttgaaagctaggagcaaaccccagcagaactaggatctctctgtgcaactctgattt

SEQ ID NO: 3912 - DNA, 1000 bp, mus musculus
atttaggcttcctgagtcagatcagtgatattttttttaacatcctttctggggacttgaccctcctctgatagagccgaccctccctgtccttttatccagagtccatccttaattactgtgtgccattatctttccctacttgggaacctaggaatggagcagtttgcattttaccagtaacaccagctcctccttactgctatgtctttttgcttgaggcgagcgagatgcatagttagttctaaaaagacagcctggctcaggcgtccaggatttgtgtttctcctttggcacagttcccccagtttgtgtctccgaacagggctttaatcacctgggctcaagcttgccactgaaagctttaggagtaccgcagaaatggtagattaggcacatttaacaaaatagaaagttttcattgtgtcataaaaagccgtattgatcttgtccaggcattgactccagggccttttaacaaaccagtgtgtctagacttgcaggctagagcccatagtgagaacaaaagagggactggcctgcgggctgtcccctctctgcaggaaagactggggagtacctaccaatacagtttttttctgtggggccattcgtaaaagactaccatcattttattctgctgtgaagaaagtaaaaaggttactaggtttgtggcaagtgcccaggtgacagacacatcccagatgctggtttgcctggcttcgggtgtttgctgtggaactattacacaatagcaagttatgtgtcttattccatctcaagacctatccatcagcatagtttctctttgccctgaaggaagtcagtctgagctctgcggtgccaaggcccccagcaaagtaggagtgctatacacagtaagcgggacactttgtggtcattgatgaattcaactgcatttctgtataattccctataactttagccctttggggcctacatggaagatttgtaaaagcgtggaaaattgatactcaca

SEQ ID NO: 3913 - DNA, 1000 bp, mus musculus
aggcaaatgtggttcattcttgtcatgatcagaactaaatgtttctgttatccttgattatatgtgtcaggagactggaacactgctcatatttaaactaagatgtcttcctcctttgaataagaaaaagacttagttatcctggtaacttaggctctctagctagacagcggaagaggtaattaccatgaaatgttactcaccaattccagtagtgaatttttcttatacatttgatctacctctattgttcaaggaagcctgtttaggtgcttgctccatacaaaataggtaagggaaggagcagaaatgtatagaaataatagtatttcctccacctaatccactaggccggcagctaaccatcttcaacacccaggcgcaaatagccatcggaggaaaggacaaaggacgtctcttccaaggtcaactctctgggctctattatgatggtttgaaagtactgaacatggcagctgagaacaaccctaatattaaaatcaatggaagtgtccggctagtgggagaagtcccatcagtctcaggaacaacacagacaacgtccatgccacctgaaatgtctaccaccgtcatggaaaccaccaccaccatggctacgaccaccacccgaaagaaccgctctacagccagcattcaggtaaacctttcttctgcgattttgttcttctttcttgactattcaacaataatgctgtgatcagtattctaggtagttagtgactttgaactactgcctttgaaggaaggatgaagatgctcatggtaatgagaactaagactagagaaagagcaagcaaagactgagcaaattagggaaaccttgtggcactcatgagctcatgagataactcttgttatcctttccatttgtcactgaaatgggaaagctattattcaaaatgagcaatggaccttacttttattacaagacatccctctcctcttcttacattaccttttcttttcgattaacagaaag

SEQ ID NO: 3914 - DNA, 1200 bp, mus musculus
ttttctaggtaacagagagggaatatagagaggaggaagaagggaaagatgtagagacagaaacagacactacactgtgaagtcccaaaacttgttttctattgagctccattttggccctggtttgggccttgaagacaagcctgagtctgggtcgagtttctgcgtccttgtgggagagcctaagcctggctcaagttttgagacttgtctcaatcacttccatcgggatgactcagcaagacctgtttggccctgcctctgccccacggttgctgatgtagagctttgccattggtcttgtctgtcactccataccctcggtcacccttgcctgcctcctgcattatcttaacccaccaaaaatcccccttcctatgttccaaacttatataagcgagaggctgatgccaaaaaattgagttgctgctttgacagactcccaacctggctgtgtttctttttgggccatagacactcaccttcccactcagccccaaagagaccccggagggatcaggacctctctcctcgtgcctggacctgccggcaaggagccagcaacttttaataaatattgctccctcaagttcaagtccaaaggcctaagagccagaagaaccaatggtataagttctaattcaataaaacagggctttaaaatcccatctaaaatcgcatgctataaaacaccagtttcagctcaattggtcaggcaggaagcatttctgtccatttagacttttggttctacgcaaggcttctattaattaggtgaggctcactgacattacaaatatgctttaagattgattctatcttagctgcgaaccaaaaccttctcataaaatatgcagaacaatgtttgacaaacatctaggcccagtcaagtcaatatgtaaaacttaacatcatttaagagttcttcattccttagccgagcagtggtggcacacacctttaatcccagcacttcggaggcagaagcaggcagatttctgagttcgaggccatcctggtctacaaagtaagttccaggacagccagggctatacagagaaaccctgtctccaaatacaaaaacaattgctctgaaaaagatcttcattccttaaccaagaagctatcgccaattgacatctgcttacaaagggaaaattattttttctccactggggtaaaaagacactgttatattaa

SEQ ID NO: 3915 - DNA, 1200 bp, mus musculus
agacacacaataataacaaattaaatttaaaaaagcagtagcaactcagtaaatcagctagaacttcataattcaaacctagccatcttgagagcaaccgtactgagaaacgaagacaaagagaagagattctgaacagcaagaggtcttcgctcatgctgaagtccaggagcatgcagcttcctcatccacatagacaccgcggtaacaacagacagcctccagcttcacccgggagcatggggccaattccatgccattgcatatgatctcacattatatcacttgccatcatgtgcatccagtgtggggctcctcaccaatctgggctcctttaggccaaaaatgctacttctctttgttgcctaacagaatatcttaaataccaaccaatcaatacattattttctctttctttacaagcctttccttaatgtcacctcttaggtgtcaagaataacagacctcaagcatgcaggaactccagcaaggagtgaggaaacaaattctctgaagccaagtaactgcttgtctttcaggaactttcttgtttgtgtttgtttgtttgtttgtttttgttgggtttttttcttttgggtgtttttttgtttttttagtttttaggtttttttttttttttttttttttttttttttttttggtttttggggtttttttcgagacagggtttctctgtgtagccctggctgtcctggaactcactctgtagatcaggctggcctcgaactcagaaatctgcctgcctctgcctcccaagtgctgggatcaaaggcgagccccaccactgcccagctcaggaagtttctttagggcattttgtcactaattaattttgagctaacatgaggtcgtgtgggtttttgtgaatatttaaacaagaaaaagaggtttctgcctcaggccccggtgggagcctccttggctccaggactccgcggagggcaggctgcactggtgagggtgtggaatacagaggccagccttttctgggacaggtgagagccagagagcttcttaggcggcgccatcttcggctcgagacaaccggccaccttcctgaccaaagcaacacaccttctgggaaagatccagttttgggccttcatcttcagccaggaggaggtccaaacaccagataactgtgcaccttccctgaaagaggagagcttgcctgcagag

SEQ ID NO: 3916 - DNA, 1000 bp, mus musculus
tcaggtgtgtttggatattcagggcttgctgtagtaggacccttgctgggttctactagtattatattacaagggcttttgttgattttgttcttgtgcttgcctttagccatctagttgtctctggtgttggtaggcctggtgggcctgggagtggtaagtctctggaactggttgtcacaggtgtcagcaggcctcccaaaggcagacagagctgtacttggggggaggggcaggaggggaaggcagatcttcagttgcagatagaggtatggactagaagatggagctggtttttcttagtgtgcacaggccttctagaatacaggcagagctatgggctgtgaagtggggtgccaaactgagttttaaggcagagatgtggactaaaaggaagatggagctctgatctcaccaggtcatatctcacaattgctgggcttgctgtgggccaagcaggtggaggattaggatgtgggtatctcacctgtttgtcctggatgtgagcaggtctcctgagaagcaggtagacctgtgggctgtggagtagggtgcttatatgagattgtaggtagaggtgtggaccagaaggaggatctgcatagttattattgatagcactgatgcaatccaaataatacgttaatggttccattcctccggctctgtcagcttgagatgtatggtggagctgaaagttctttttctgtttgatttgtttttgtttttctagacagagtttctctttatagccctggctgtcctggaactcactttgtagaccaggctggtctcgaactcagaaatccacctgcctctgcctcccgagtgctgggattaaaggtgtgcgccaccacgcctggttggagctgaaagttcttaaaagcaacccacacaggtggttctcacacttttcagatgtaagtattccttgagagaaatgacatcctgcgagtctgattctgtaggatcaggtatgactgaagattatatattcata

SEQ ID NO: 3917 - DNA, 1000 bp, mus musculus
gcttgtgagaaatgcactattgcaatggatcctgaatttgggaggtgatttttcttctgggaactgtcctaataagaaaaatgtttcctttaatccttcccttaactcatctatagggggctcctacctgagtccaatggccagctgtaggtatctgtgtctgtctcagtcagctgctgatagatcttctcagaggttcctgtctgcaagcacaacatggcatcagtaatagtgtcggggtttggtgcctgcctatgggatggatcccaagttaggccagtcactaggtggcctttccttcattctctgttccatttttgttcctgcatttcttttcaacttgaataattctgggtcaaaaactttgaaggtaggttggtgaccctatccctctacagtgggctctgtctatttactggaggcggtctcttcaggttccatctcctcactcttgggtatttctaaggtcatccccactgagccactcacatcccaggtctctgggacttactagaggttccccaaccctgccttctgtgcccccatgccctgcagttgcccttttccatttattctcctggccctctgaccttcactcctaaggggacggcaaccccataggaagaccaacagtatcaactaacctggacccctgtgagctcccagagactaagacactaaccaaagggcatatattggctagttcttgtcccacctcccacccccacacatacgcagaatctcaaatagctctactgaaaatcatagattctgagactaaatgaagcctcaaccattttgtctaggatatcccagtgacttcttacaaggctcacgtattcataaaggtgttattctgagtccaggaaatctcaaggttgcatctttgtgggttttattaactgttaatgggcaaaagatgccatattaaaggctttgcattatggtgtcagagtcatataactaggagagggttcaaggttaatgtaaaagtatcaag

SEQ ID NO: 3918 - DNA, 1000 bp, mus musculus
aataagtggatatgaacaacaacaacaaaaatacagaatacaattcacaggactcaaaaaggtcaacaagctgaagggcccaagtgaggactcctcagtcccacttgggagggagaagaaagaagccacaagaggggagggagagggacctgggtgtgtaagggaaagaggaggagtggggaacatgatctggtattgggcaggaggaaaaggactgaagccctgagggccagcagaaagaatgaaaaaaaggcaacctcgggaggtaggaggttgggggaaggcactccacaatgtatcagagaatcaggaggtgagaaactctcagaactcaaagggagggacactagatgaaatgccctatagtggggagagggaacttgtagagcccatatccaggagaaaggcagaacatctagtgagagatgggattgccatcccacagtcacatttccaactcataattgttcctgtctgaaagaactgcagggatggaaatggagaggagcctgaggaaaagaatggccagagataggcccaaagtgggatccagctgaaggggaggtcccaaggcccagcaccataacagaggctatggagtgctcacaaaaagggacctagcatgactgcactctggaagctctaagaagcagctgaaagagtcagatgcagatatttgcactcaaccaatggacaacactgagccctgtggttgaattagggaaaagctggaagaagctgaagaagagggcaaccctatgggaggaccagtggtctcaattaacctggaaccccaagatctctcagacactccatcaccaactgggcagcatacaccagctgatatgagatcccccacacatatacagcagagatttaccctggtctgggtttagtcaaagaagatgcatctaactctcaagagactggaggcccaacggagtttataggtctggtgaggtgggggtggggtggagtggggtggggacattctggtaga

SEQ ID NO: 3919 - DNA, 1600 bp, mus musculus
gcccaaaacactctcgtttaagttatgctttctgttattgagttccagttttaactgttttttcttttaatctttaaattttattgatttgtttctcttttgtttgcttctttgttttggtgatttgagacatgaattctctgaatatctcttactgtcctggaactcacactgcagaatggctggcttgtaactcaaacaccctcctacctctgcctaagtgctgagactaaagccatgcaccatcatctcctggtcctaactgcattgctcctctgtgtcttatgcttaaagagttggttttgctaagctacaatagaatgtttttgagcaaatatcttttagtttataatagcacaatattaaatgattaataatccctacttttgctagtatttgttacatggtagtatgctatatgtttaaaaatattgcccaagattggggagagtgaacatgtagagtctgcctcccgtagaaagacgagtcatcaagtggagtcatgaggatgtcattctactgtcaaaaactgaccgagaattattcctgtctacaagaattgcagggacaaagatggggaagagactgaggatatggaggtccagtgaccagcccaaattgggatccatctcaaggggaggctccaaagcatgagactattactgatgctatggtgtgcttacagacaggagcctatcatgattgtcctctgagagtttcaacaagaagctgactgagatagatgcaaatatttacacttaaccaatggataaaggccagggacccttctggttgaactagggaaagactggaagaagttgaggaggagggcaaccccataggaagaccagcaatctcaactaacctggaccccaactcccctgaatctcccagacactgagccaccaatcaggcagcatatactagctggtctgttccaggatcccccaacatatacacaggagaagactgcctcttctgcccttagtgagagaagaagcacctaacccttgagagacttgaggcctcagggagtgaggtggcctggcagggtagggtcaaggggatgggtggggtgaggtagggggtggagtgaggtggaagagtaggatgaggtagaggaaacatcctcttggagacaggggatgagaaatggagtgaggaactgtcagaggacagaacatgagggggataatgactggactataaaaaaaggctaaaaataagagtagtaataataataataataataataataataataataaaatcatttccttgactgagaaatagaattttatttactttatttcatacattatccatcactaaggagagtagcaacaaaagtaatatataggaatacataggtttgcagttaaagttctgcatgttataagcacagacccacaaataaaaacataattactgttgctttatttatcttatgtttatatagggaaatcaagcaactcttgaacatttatatttggtttggctttgtgaatacttttgactaaatttgtgctcatatgtcatttccagtgagttacttttgtagattctttatatgttttgaaatacataattttgcatataa

SEQ ID NO: 3920 - DNA, 1400 bp, mus musculus
tttcctggtgaggcgggaggcctgtgccattgggccgacccgaccctgaccctcgattcttcctcctccccgaagatgatccgatctcatccttactcgggcgcacctcttcctctccatcattttcctcctcagaatccaaaccattaaacaagtctctgggctctgataggatggggatgtagagcgttttcttcaggaagatggagtcgttagtataaaggcggtttgtacgcttaatctgttccatcgttaccccgtatttgagtgctaatccagccagggtgtctccaggctccaattgatgctccaggcgtctttccctcactggggagcaggatgattgtaccaggcttccataagaacgagcacggctcccatgcagcagccctgaccccccgaggggaggctgtctagagggagaagccatctcctcactgtcaagacctagggtcacaactgagggaagcccagctaagtaacagtgacggccgaacccaaggaatggatattcagataattcgttttctcttctctcgtctctctacagtctcccgactctcgagagactacattcgtcgtcctcctcttgctgcttcttgccgtgcctggagttactgtccgtctcttaagaagtctgccaggccggttacatttctctttccacgagctccttacccataagtatcttccctgagctgtcagtcgctgacccggttgactttcgacgccccctccccaactcctcgcaagcctgatctctgacctttgaaccctagacaccctcatcaacactcttccctcagtgtatccccacatccaacagtcgggatgccgggtgctcccacatcctctctgttccaaataaggcccaccccaggtaggttgtggctgaggagtacgagcctgaggacagcaagagtttgtagtatatagtccactgagatccctgacgcctcgctccacatcaggaaggtcccaccctgaaattccggctccacatacaggatcttgagtctccgaacacctggatccttcgagatgtgaggtcctgtgtccaggtgagcagtgtgctcttcaaaaaaataaaaaaataaaataaataaccaaaagacttcatttcccaaaaggcacagcgtctcaaagtattgtaggaaatgcaggccccctcagggcgctggaggcgggtctctcatccactcctattatccgtaggtttggtcttctcattgtgtcctggatttcctggatgttttgagctaggatctttttgcattttccattttctttgattgttgtgccgatgttctctatggaatcttctgcacctgagattctctcttccatctcttgtattctgttgctgatgctggcatctatggttccagatttctttccta

SEQ ID NO: 3921 - DNA, 1600 bp, mus musculus
caaatgttccacagtccccaaatacttggcttaggtaataatgattttgttgctattattgctaaccaatagtatggaattaaagggtttttttgtttgttttttgttttttttttgttttttttatgagcacagcataatcagctaagtcagagtgcaataacacctaaaaacattacccatgtttcataagttatcttttaaaatgcaaagaccatgtcattatttacgagtggactgccaaattgtacatttcgcaactcaatctctggcttcatttttttttttttttttctgcttgttttcaactgtcaggaagatgactaagcacacacagagatcaatatgccctggcataccgcaggagatttgcagtcacactgcaggaataaccctcagcaaaacatgctcaaaaaccaaccatcttgttagtgttcatatctgctaactgttttgctttctgtttggaaattagctgtaagaaaatcagagaagtaactggccatcgttccaaaagcaaagttgaactacaactccgagtttcaatgatacagcatccataggaatcttgaagaaaagggatgaaaacaaatgagcaagtaaccaaatgcaaaaacaaaaaataaagaagaacaaagccattcttaaaaataagaattgggccaggcagggatggcacatgcctttaagctcagcacttgggaggcagaggcaggtggatttctgagttcgaggccaccctggtctacaaagtgagttcaagagcagccagggctatacagagaaaccctgtgtacataaaaacataaaaaaacaaaaataagaattggttgtctgagatgtacctcagtgtctctgtgtgcacatggctatctgtcacacacaaagctggatttccagcacccctacaaattgagtggttatgaccattccagcactcagtaattagagtcaggaatgtcagaaatttgtagtcatgtatggctaaccctggataaacaaggcactgaaaacaacaacagaacaaataaacaaacaaaatttaaggaacaaatgctatgctatgtaaattgcattctactaaataattaagctgttttactagatagagttaccagaaaattctaacattctattggttgttctatcttccacattacaacaaactatcttttttagcattacatctttcatgaaaagaaacatgatagattagcaaattgagagagttaaggcacttaggcagtggatcaaagacattgggaaggagaccaagaaagtgagagagaaaaagaggaatgggtaaagatgggatgtatttatatagcttattcttacaattttctctgggttgctttgtgtgtgaatgtgtgtttgtgtgtgtgagagagagagagacagagagaggcacagagagagacagacatagacacagacagatggaaacacagatacagacacatacacacacacaggaaaatctgaaagaaaggctgggcttacatagaatttcagctataaaaattgtctaagactaagttggacaaaataatattaaactatatgggatctaatctttctttatgtctaaatagaaaca

SEQ ID NO: 3922 - DNA, 1200 bp, mus musculus
attaacttaagaatatcaaaccacgccagagaatctaccattatttaagtcctttaggaaaatctcaagggaaatctaaatagctggcaagacttccgttttctgtgtaagtttgaaagtagcataaatctatggagggaatgcaaaaaatagtttgtctaagtttaatctgccttgccactctaacttcctcactaacttatttaaatgtcaaatgttattctcttccccagttctccctttgcagtccccctatcccatccccttaccctgttttaatgagggtgcttctccacccacacacccactcccacctcaccaccctagcattcccctaaactagagcatcaagccttcataagaccaagtgcctcctctcccattgatgccagataaggccccttcagctccttcaggcctttccctatctgttagggctcctatgctcagtctgatggttggctgtgagaatcagcatcagtattggtcaggatttagcagagctccacaggagacagctctatcaggctcctgtcaacaggcacttcttggcatcagaaatagtgtctggtttggtgtctgcatgtgagatgggtccctacatgaagcagtttctgcatggcctttccttcagtctctgctccactctttgtccctgtattttctttagaaaggagcaattctggtttaaaattttggagatggatgggtgacctcatccctcaacccgggggggtgggggtcatgtctaacctctggatatggtctctacaggttctccctcccctttgtggggtctttcagctaatagcatctgcatggggtccatgattcttttatttaatttctttgcttatttttctctcatcaccctcagtgtgaaccttcactcacatttattccaaagagtcttccggtcactacagaagcactaagcactttcaggctctatatcctgtgcattgtctgttcctgtatggcacactgacctaacagccattcatgcttgtcaaattttttgtgtgggataatgtagggaaattttcatggtcaagatacaagaatcatataagatatgatgttaaacttctggcagggagtagaaagtaaatcattattacattaaaatgtctgctctatttagaaacttgataatgtcagtatcacagtttggaacttaataaatgtaaaagtgattac

SEQ ID NO: 3923 - DNA, 1000 bp, mus musculus
ggggggacttttggtatagcattggaaatgtaaatgagctaaatacctaataaaaaatggaaagaagaaaaaaaaaaaaaaaaaaaaaaaaaaaaataaaacacgcagataaatatttaagtttgtgcacagacatggaataacctaacaacaatttagagaatgcatctacattcctagataagagataagatgaaagtgagtcatgaatgtgtgtatgagcttcttgtctcttagttcattctatacttctaatgtgtgaaatataaaaaccaaaaagggtttttcatgcaaattactcgtgacattactgtctctccttttccccaccctagactaattattttaagatctttcctcttctaaagaaaacaaataagtatgggtgaatctgtaggagattatatatttgtcatatatcatatatctacgtctatttctatatatatgatataatatagatataatcatttatcatatatatcctattttagagaaatataagaacacagtggcattgccaaagctaattcaagaggttgttgctaacttgtctttaccagtgtaaacaaagccctgaggacaactgagtgcaggtgaacagataagggggatgttgtttgccaaaattaataatgttgagtcaagtcccagcaataactaacaaaaaacacctgccaagcacaccaagacatagctgaaggaaagtttctggagtccttgtacccttgtgggtatccctttgctctctgcagaaagggactccagctgatgagttatgacaagctcccaatgggaacccagtcagccaggaagggcatctccttatgtggcatgcacattcacatcactttgtcacttgttattatcatttcaatgtaatgatacctcagaaggaaagaaaaaaaactcaatatttgctgctgacttaatcctgacaagggaattaaaataacttattaaggcttctaaatgaacagctccagatattagaactggc

SEQ ID NO: 3924 - DNA, 1200 bp, mus musculus
tatatacctatataattttttcgcatatatattggtttttgtgttagcgattatgcatttctcatcaatggggtaactttattttgaagatttagtttggctccctttttttgtgattctaatccacagataactgttgtgggtggctttgtgcaccttgtatttttatgttaattgtgttcaacagggagaggttgtctggaatgagtcacatacacaggtggcttcttgtgaaccaagtccctaatgaagaaaggagccaatcactgggcaagtaggtgggacttccgggttggatggaggaagagggaaagctggagttaggttctttaggaactgggacagagtatgggtaagatgtagctgctagagtatcctgttatcatggcagatatgcaaggatttgccacctgaggaactggattttaataaggcttacaagattaagttttagctgttgcgcccagagattgagttaccattgtttctgaactaaatttgtgttgggttttccttcacttggaggctcatctggcttcaagagagaaaggtatagcagcaaagcgtgggtttgccaattgctcatcacaaagtatttgaagcatggggctagctggcatagtagcgacccactagttggtacttagtgagctgtgtggagatggttccgaagctctgggccagagagtctccacaaaataaaacaggttggccattgtctgccagggcatgaccggcaagggagccagggcagagagttgccagaacaagtgtgagaatgtgccagttcttcttaaatagttcccataacagataaccagtaacattgttccctgtgaagcataacaccatcacagaagcatgaaagagattgttgttcactaatttttagatgaccataaaggaaaacgacttaaaaggttggactaaatatatgcttccaagacaagcacatattaacttgtcttttccagactggccccccacttccaacatataaacgtctgtctaaatactccaaccatctgcataccaaaccttaatagtatgagcctgaataggaacttcatatatgaactacagatgtttgcatgtgttttatcccaactatactattatagatgctgactaaagaacctgggccatggcaattctcaatgtcagatagcactaatatagttgaacaaatcactaataaaa

SEQ ID NO: 3925 - DNA, 1400 bp, mus musculus
actagtttaaaggctttcagggatcatcaaaaaataaattatctgcagataatgcaggagcgaggcatctactaagcagaaataggacatgaccagactgaatggagagaggagatgacttgtattgggtgtgggaaacctacttccaacaaaggggacttggaggttgtaccactgtgagggggagtggcatgtgggaagcatgaagaatgtaaatcttaaaacacaaagtgtcagatgaaattatagagatcactatgataaaatcattaggctgtgtatgcattctttactttttcttgaatgtaagttcttcagatttagttagttagttagttagtttagtttgtttgtttgttttaggaccaatcatctaatttatttttcatgtacttttctttcattaattatatacttagttgctttatactccaagatcatatcttcctctatcttctttcttctcagtcctccatccccttctctcctgttacctctcctcctcagagaagggaaggcttctaatgagtatcaactggccttggtatatcgaactttggtaggcacaggtgcgtcttctattgaagctagacaagttagcccagttaagggaaagttttccaaagacaggcaaaagaggcagagatggcccggctctggctattatggtcttatatgaagaccttgcgacacatctgatacatagatgtagggggtctaggtccattccatgcaagctccctgattggtagcaaattctcagtagccccatatgggcccaggttagttggttttgtaatttttcttttggtgttcttgatctctctggctccatcaattactcttccccctcttccaaaagatttcctgaggtctggctcacattttgctgtgtgttctgcatttgtttccattagcagttgagtaaagcctctgcgatggcaattatgctaggctcctgcctgcatgtataggacaatatcattaatgatgtcagaggtgggatctcttttatgccataggtctcaaattgggccagtccttggttgtcttctccaccaatttctgctctatctttatccctgcacatctaaaaagtaggacaaattgcaggtcaaaagttttttgggtgggttggcgttcccattcttccattggaaatattgcctggttataagaaatagctatttcaggttccatatctcatgttgctggtagttgtagctagagttaccctcatatcacatcctaggagtttcctttcttgcagttttctagctcatctaagagatgaccctccaccaatcccagttctctctttttagtcatccccacagttgaaccctcctgttacccttctcacacactctactacccagttctctccctctatctaccac

SEQ ID NO: 3926 - DNA, 1600 bp, mus musculus
attaaccactccttccccatgatgcagttctgaattctccctgtagcagggggtcttcgctcgtgcctgaagatgtttcttgtcccgggttttcggcaccacttcttgcgcacaccggactggccagcagtaacgatgctgcaacaggatccttctgcacatgattattgggagagcttgattgtagagacgaagagaccccgagcccagaactggtgctgcttttataggcctaggagaggcgtgtctcacacccggattggttatgcactacgcctcatttgcatgttcctcatctgattggctactctctctcagtaccacacagagcctcattatcatacctcatttgcatgtctcacatctgattggttactctctcagtaccttacagaacctcattatcatacctcatttgcatgtctcacatctgattggttatactctcagtaccttacagaacctcattgtcatgcccgggccaggcagtgtctttgcaaaaactttactgcatatgtacacattggttgtttgtccaaatttatgcgtggtggccagcagtagtcagtgccactctgcaacggcacatgtggcttcccacaatgtacagagtcaggaaattgaaccgcagtgtgtagcaatggggcatgggacacaggaggttgcaaccagatagtcccagatgccaggaaacaagaacatcccatgaacccacaggaatgacattagctgaaatgccgtacaaatgggagggagaacctgtggagactatatccagagcttaggcatggccctccagttgaggaatggggccactcatgcatctccaaagttttaacccaaaaatgctcttgtctaaaggtaatacagggaaaatgagtggagcagagactgaaggaaaggacatccagaaactgccccacctcgggatccatcctacttgcagacacccaacccaaacactactactgaggccaagaagtgcttgctgacaggatcctggtgcagctgtctcctgagaggctctgccagatactgaacaatatagatgtggaagcacaatcatgtgacaaagatggttgtcacagccaaccattgtcttgagcacaggaaccccaatggaggagttaggggaaggaccgaaggagctgaaggggctttatttggcatcagtataggcccttggtcctgtgaaggcttgatgccccagtttagaggcattctagcattctagggtggtgagtgggtgggtgggtgggggagcactgccatagaagcagagtaaggggtgatgggagagaaaggaaaactagaaaggggaaacatttgaaatataaacaaaataaccaatgaaaaaaagaaatatcataccaaatgatttctagcttgattcctctatatcatacactcaaattacacagtgttttcatcagtagtcttacaatatagttatgctagacagccaagtgtaatggcaagagtctgtactatttggtaagtggctttaagtcttcttgattaataattcacaagtcactctctcaccaaatggcactatggtttgtttaataaacaatagtcttttttaagagcaggtttt

SEQ ID NO: 3927 - DNA, 1200 bp, mus musculus
atgtttgaatgcactttttaatttataagcactctttagacatattgtttcctaccgagagccagacaattagaaaggatagtatgaagcacatacctggcattatattgggacccaagaacctgtggctacacatgtcttatacccttaatgagaatctataatcattattccgtagaatgactgtcatgttaaaccaactcctaatgacttattgagctacccatagattaaggcatcactcaacactcatcaatgaagcagatgataattaacaaagacaaccgccattgctcgaggtgtggagaatgagagattgtgggatcctcagctcaaatagaacatctgtatcacacctcttccttccaaggctcaagaatatttatgaaagaataaatataaaggttttgagatccaaaggcagtggataacaataggataacttgtttggtggacacagcagggtaaattgaaaataagggtgaattcacagtaattaagatagaatgcacaatacttgagcaatctcaagttaaaaaataaatccaagcatagagaggggagggaggcatgaagtcacctaaagctaagcagttattggtcattgacagtggctgggtgaaggaaagtccattttaagcatgcattccctggtgtgttgaccatgctccaacagagggctggcatatacattcaacagtatatgggcaggacaactgtatctgatgggtcattgcaaacagaggacacagagatgggtagatatggaaaggagcatggtggtgaatatgctcaaaacaaattgtatgaaaaaatctcaaaaaactaaaaaaaaaaaaaaaaaaaaaactaaaaaaaaagagagagagaaaataaacaagaacgataccaactaattttatgaactttactagtttcaaacatgttaaaaattatgctttaaagttataaaatccatatgatcattagtttaaacactaagaaaatatttggcattaaagaagtttctcagaagaatatgttcttgttcacatctctaaaatcagatttctttaagaaatatacacaaaagtaattagacatgaaattacatgttatgtggaatttacatataaataatatatgggtggtagagcatagatgtttatgtaaatgctgtaagaatggccataaatgcataagtggagtagtggatgcaca

SEQ ID NO: 3928 - DNA, 1000 bp, mus musculus
tataataattttattttttaaatgctaatacaaggctggagaggtagatcagcaattcagagcactggcggcatttacagaggactcgaattcagtttccagcacccatgtcaaacagctcacaaccttctactcatccagctccggggtacctggcactctctttcgcctctgaagatcctcatggagcatggagacacacatacccattaaaaacatctaagaataataaaactttgtcaaaaccctacactctcttaattaataaactctatgtttatatatttacagtgctggggatccaacctagcaaaccacaaagggtaagcaaatgctcttctagtgaggcacactcctgggcttccagcttacaatgataaattgcaaaggtggacatttaaaggataagaggatcagtggggcgggagagtgtgggtggttgagggaacactctcatacaggcaaaggggaggcaggagggcagatgtgggatgggggcgtggcggggaaaccgagaagtggcatattatgggatgggggggcgggttggtggaggaggtaactgggaagtgggatatcatttgagatgtaattgaatggaatggttaatttaaaaatgtatgagaatgaacaagaatttttaattttttaaaggggtatgagaatgccaaaaaagattggattcattattatttgctgttaagtctcattaatctttctttagacaagaggactccatgacacatgaccctgcccatcactctgtagatcacgaacagtcctcaataacaaacaaacaaacaaacaaacaaaacccacccagcaccacctcctttaacgtcctgtgtagaatcatttctgccagagttcctgtatggtagttacaagtctagacaaatcatgcatcatgtcaatttaattggcagtaaagggggaatggtctcgtatgcttagacaggaatgagattgggtcaccgagctttttaagtgctgatctgtt

SEQ ID NO: 3929 - DNA, 1400 bp, mus musculus
gtttctaaatcggatatatatatataaacatatatacaatatatataatatacatattatatatatgtgtgtgtgtgtatatataaatatatatatatatatacacatgtatgatagaagaaaatcttgagatggaggatgatggagaattttctcaaagcacaaatcaaaaacaaaacaaaacaaaaaaatgttatctcacctcttcctcttttatttatttgtttgtttatttatttatatttatttttctttctcttttattagatattttctttatttatatcacaaatgttatcccctttcctggtttcccttccaaaaaccccctatcccatcctccctccccctgtttaccaacccacccattcccgcttccctgtcctggcattcccctacattgggtcattgagccttctcaggatcaagggcctcccattgatgtccagcaaagccatcctctgctacatatgcagctggagccatgggtacctccatgagtactctttggttggtggtttagtccctgggagctctggggtactggttggttcaaattgttggtcctccctcctatggggctacaggctccttcagcttcttcagtcctttctctagcttctccattggggaccatgtgctcagtccaatggttggctgagggcatctacctctgcatttgtcagacactgtcagagactctcagaagatagctctattaagctcctgtcagcaagcacttgttggcatccacaatagtgtctgggtttggtgactgtatgtgggatggatccccaggtggggcagtctctggatggtccttccttcagtctctgctccacactttgtctctgtatctcctcccatgggtattttgttcccctttctaagaagaaccagagtctccatactttgctcttctttattcttgagcttcgtttggtctgtgagttgtatcttgagtattccgagcttctgggtcaatacccacatatcagtgaatgtatgccatgtgtgttctttttttgattgattggtttacctcactcagcatccttagtcatcatggaaacgcaaatcaaaacaatactgagattccacctcacaccaatcagaatggctaagataaaaaactcaggtgacagccgatgctggtgaggatgtggagaaagaggaacactcctccattgctggtgggattgcaaactggtacaaccactctgaaaatcagtttggtgtttcctcagaaaattggacatagtaataccagaggacccagctataccactcctgggcatatatccagaaaatgctacttgtaataaggacacatgctccactatcttcatagcagccttatttataatagccagaagctggaaagaacccagatgcccctc

SEQ ID NO: 3930 - DNA, 1200 bp, mus musculus
ttctccactcctgggcatatacccagaagatgttccaaaatgtaataaggatacatgctccactgtgctcatcgcagtcttatttataatagccaggagctggaatgaacctaaaagtccctcaatagaggaattcatacagaaaatgtggtacattcgcacgatggaatactactcagctattaaaaacaatgaatttatgaaattcttaggcaaatggatggaactacaaaaatatcatcctgagtgaggtaacccagtcacaaaagaacacacatagaatgcactcactgataagttgatattagcccagaagctcggaatacccaagatacaatccacaaaccacatgaaactcaagaagaaggaagaccaaagtgtgaatacttcgttccttcttagaaggggaaacaaaatacccatggaaggagttacatagacaaagtgtggtgcagagactgaaggaatgaccatccagagactgccccatctggggatccatcccatatacaatcaccaaacccagatacttttgtggatgccaacaagtgcttactgacagaagcctgttatagctgtctccggagaggatccaccagtgcctgacagaggtagatcctcaaaacttaccattgggctgagcacaaggtccccaatgaaggagctagataaaggaccaaggagctgaaggggttagcagcccataggaggaacaacaatatgaactaaccagtatccccagagctccctggggctaaatcactaactaaagagtacacatggtaggactcatgtcttcagctgcatatataacaaaggatggcctagtcagtcatcaatgggaggagaggcccttggctctgtgaaggctcaatgccccagtgtaggggaatgccaggggcaggaagcagatataggtgggttggtgagcagggagagggcatagggggttttcagaggggaagccaggaaagggggacaacatttgaaatgcaaataaagtaaatatctaataaaaataatttatcataaaaaagatgttgagttcttttgtgatagagatttaaataatgttgtagtgataagtttttcattgatattatacattttctgggaaaattaactttatatgtttgtgtgtgtgtgtgtgtgtgtgtgtgtgctgtcttgcaattttcgaggttcttacataagatatgg

SEQ ID NO: 3931 - DNA, 1600 bp, mus musculus
tgattgtggggataagaatgccttcttacaatatttcagctctcctactggagggacaagtcaacattggaagtgtgtcaataagcccaaacctttgcctccactgtctgatggtcagtgccccagtaattgttcctttgttgatcagatgcgtgctagttgttattcttccttgtccacatgcctcaaagataggcagccttatttttgggctcttccctctaagatgctacagagtacgggggtgggggggtggattggtttcgcaacacccaggtaattggcaccaattcctatacttcaaaatatgttacagctggttgcctcgcaccccctgataaaccggcttgttggccataagccgctcctcttcatgtttcagatggtggtggtcccatggaccacgtttgagaagaatgggttcaacagataattcaagcccagattgatggcctccttctccgcctccaccaccacccaaagtccagaggcattaatttagacctctagaccatagatatacgtgttgctactcataaagccctaaatgtttccaacccctccctggccagggattgttggctgtgccttgcattgggagcctcttggccccttgtaatacccctgcttcatgaatccactatcgtcccctcccaagataattgtagttacacggaccaaggagtctaacgcatgcacgagtcaggggctcgtccgaaagccgccgtggcgcaaagaaggtgaagggccccgcccgggggcccgaggtgggatcccgaggcctctccagtccgccgagggcgcaccaccggcccgtcgcgcccgtcgcgccggggaggtggagcacgagcgtatgcgttaggacccgaaagatgacgaactatgcctgggcagggcgaagccagaggaaactctggtggaggtccgaagcggtcctgacgtgcaaatcggtcgtccgacctgggtataggggcgaaagactaatcgaatcatctagtagctggttccctctgaagtttccctcaggatagctggcgctctcactcttacccgacacacgcagttttatccggtaaagcgaatgattagaggtcttggggctgaaatgatctcaacctattctcaaactttaaatgggtaagaagcccggctcgctggcgtggagccgggcgtagaatgcgagtgcctagtgggccacttttggtaagcagaactggtgctgcgggatgaaccgaacgccgggttaaggcgcccaatgccgacgctcatcagaccccagaaaaggggtcttttaagttcttaccaaacaattttaatgtatccaccttaatgtatagctcttttaagaatgattcctttgatgcagatcttggcctagccatgtttatctcatgcaccagttatgttaccttctctgcctcaggctgtttgggtgcggggggaaaagtgtatgtatgcggtgataacgtggcttccccctttctccctgtaaattggactggttcctgtgtgccggccttactttcgccagatatagagattatacgaggagacgagcctgttcctctgcccagttttgctatgtttgtcccccagacat

SEQ ID NO: 3932 - DNA, 1000 bp, mus musculus
aaactcacccgagtccaaggagggaggtagagtcacagaagtccagagcgtttaattagcttctctgtgctcacactctttctctgatggcataatagggaatctgatgcagtaatacccccccccaaacttaggagttctttaactttttctgcctcatctagtaggtggtagggaagagtttaaacaaagaacatctgggcacatctgcaaacagccttccttcactctcagcctttgtgataggaaccaagaagatacgcccatgctcaggtgcttgtgttcaaccagtgacgggtctccaaccattccacttactaaggagccaacaagtattagggtgtcctgcatgccagatactgagatgtactttgccttcatttgatgttcaaagcaacctcacttgtttctttttgcgacaagagtcccactgcacagatcagactggtccagacctcatcttcttcccttggcctcctcaatgttggtataacaacttgtgccaccatactaggctcaaagtaacctccaatcatattcttagtcccattttacagatgaaaaatcagacccagagagttccaagggtctcccagtcattagatgccactcatgtgaccattgtttcaagtccctttggatgctcgaggggacagctgtcctgggtctccctggatttgtggatccaggtgaccgtagcatcatttgcagacctggatattgatggaagagtccttagacatttgggacagtttgctcttttttttttgctacatcacaaacagctccaaacctcaaaggcaaccaccatgtgcactgaaaagctcaagggctggaagctgctggtggcaactgcaccagactggacccagccggaggaaggtggggccatagaaaccacgtggctataggatgggtgcgggaagaatgaaaatccaggttcattcctctcctcttccctggaccaggcagcaatgggtgacattgacaagtcacagtt

SEQ ID NO: 3933 - DNA, 1000 bp, mus musculus
acacctgtgtcttcattaacagcggccagagaaacgtgggttgtcctgctctgtcactctctgtctggttgctttgggggggggggtctctcactgaccctcgagctaggctggcatccagcaagtcccagggatcctccacagtgatcctcctgcctccacagtgcttgatttacagatgtccacggtcaacttctggcatgggtgctgagagccaaactcaggtcattcgtgagtcgtactctaacccacaaagctgtcatcccagccccccttcctttacgttttgctatgatgacaatgttaaatttgtggtgatagcagtgttttacagctatattttccccaaaatgtgttgaactcaacccttaaaatgggtgaattttgtggaccataagccatcatattttttaaaaacaaagcattccagcaagtacttagcagaagaagccagtggggccatgaaggtttcacacaaggaccatatgagacaccactgcgttcttctggagtgactgagatagaacacatagacagcatcaaatgctgaagaggctcgtctgctgctggtgagactgtaagtgttcaactgcttcggaaaacagtgtctctgaaggctgtgaccacatgtccaccatacgtgcacacagtcataaaaaagcatgggactgagagtgcacaaggccttgcaggcagtagtcaatgacacagcgcacatgacaatccctgatgatggaaagacagactgtggagtgactaaatgaacactgagcatcagaagtggccccagatgcagatgggtggtagatgactatgataggacccagactagactcccagctccaccccagtcactgaaggttgatgatataaaatacagcttagctgatagcaggggtcttagatacagtctcaggacacacacactcgcccatgcacgcacacacatacacaccacatacacacacacacacacacatgcccatgcacgcacacacac

SEQ ID NO: 3934 - DNA, 1000 bp, mus musculus
agaattcttcttagaaggaggaacaaaatacccatggaaggagttacagagacaaagttcggatcagagactgaaggaaggaccatccagagactgccccacttggggatccaccccttaaacaaccactaaacccagacactatgacagatgccaacagaagcttgctgacaggagcctgatatagctgtcttctgaggggctctgccagtgcctggaaaatacagaagtggatgctcacaatcatccattgaacagagcacagggtccccaatgaaggaaagtactcaaggagctaaaggggtttgaagccccataagaggaacatcaatatgaactaaccagtacccccagagctccttggatctaaaccaccatttaaagaaaacacatggtggaacttgtggctctagttgtatatgtagcagaggatggcctaggtggtcatcaatgggaggagaggccctaggtcctgtgaaggttctatgccccagtacaggcgaatgtcaggaccaggaatgggagtgggtgggttgggaaacagggggagggaaagggggtaggggatttttggaggggaaactaggaactaggaaagtggatagcaatttgaaatgtaaataaagaaaatatctaataaaaatgttaaaaaaatcaaataaaattgggttaactagcatcatagcatgattccttgtcagttttgtgcacatttatgactatttggtagtgaggaactcattcggatttatgctggggacccttagtgagtctgcacacccaacagagagcatccatgcagcagtgaatatgggagaaaatgggaaattctgtgcacgtacagttcttcccaggcttgcaccctgtgtgcttgcttgtttttctttcagtaagttcatttgcaagtcattagttcttagtcctatttttctttcgagacagatatgaagctctccctgatggttgccttagctttagtatttggagacagaatgaccct

SEQ ID NO: 3935 - DNA, 1600 bp, mus musculus
ataagagaaaggagaatggacatacttattttaatcctgcttttagaggaaatgctttcattgtctctttttaatataacaatagctataggtttgctgtatgtagcctttattatttttaggtatgttctatccattttcaaaatctccagaacttttatcatgaaaacattgtcagatgcctattagggataattgaaatcagtatgtggtttctgtccttaagtttattttatggtgaattacatttattgaattataaatgttgaatcatctttgatttttttttttatgaaggcagctttgccttaatgtataattattcatttacttatttacatcttgatcattgcctcctttttgatcacccttcacacagtccttctgccactcccctccccttttctgagagggtgggccccctttggttatcccttccctgtgggatatcaaatctctgcaggcctaagcccactgtctcccactgagaccagccaaggtagcagagttaagggaatgggatctacaggcaggcagcagctttagggaaagctcccattccagttgttgggggaccctcgtgaagactaagctgcacatctgctacatatgtgtgagggggagactatgttcagcccatgtatcttctttggtttgtggttcagtctctgaggacgtccaggggttcatgttagttgactatgttggtcttcctgtggaattcctatccccttccggaccctcaaaccttcccctaactcttccataacactcccagtattccgttccacatttgactgtggacctctgcagctgttccagtcagcttccgggtggagcctctcagaggacagttatgataggctcctgctccaagcattaataacagagtgtcattaatagtgtcaggaactgctgcttgcccttgacatgtgtttcaatttggaccagttattggttggccattccctcaggctctgctgcatctttgtccctgcatttcgtgtacacaggatgaattttgggtcaaaagttttgtgggtggattggtgtccttatctctctactgggaatcccgcctgtgtacaggagctaggcacttcaacatccatatccccactggtatgagtctcaactaaagtcactcccatagattcctgggcgcctccactattccacatctttggcatgtcctatagataccccctaccctcacctccaatagccactgatttccattccttctcctgaccctctgactctctttcctgtctctctcaacacttgatcctggaccccattccacttccctttttctctctcatccagttccatctgtctgtctgcctcctatgcctattttattccttcttctaagtgagatttgagtattcttgcttggaccttccttcttgtttagcttctttgtgtttgtggagtgtagcgtggggattctgtactttttggctaatatccacttagcagtgaatacatatcatgcatgtcctttggttctgggttacctcagtcaggatggtattttctagttccattcacttgtctgaaaaaattcatgatgtctttgttttcaatagctgag

SEQ ID NO: 3936 - DNA, 1000 bp, mus musculus
taaactgagcatactggatccagggaagttgacagccaagattttccaggacaggtaggcaagtccattataattcctccttcatagaaatgtctgtcagatattcttggctgaagatagatgatcccatgttatagaaaacttcagggggactgtgcaggcaaccagccatctctgccacttttatagttttggaagctgcttccctgcacttcctgtttattcaggtaatatttattccttttcaagtctctgatgtggttgaagactaaatagtttctgtatctatatcaagctcaaattgtttaggacttaggaagatgtttttaggcctattcatgtcatcatgataaaaattgatttaacccttccagtgggcaccagcaccgggtcaccttgggagtcggcagacacccccaaggtcctcagaagactctccacgtgatcttaggacctctagtgagtggaacacaacttctgttccaatccatttgtgtgggacctgagacagcattaattagggaagcagaaaacctggcctgaccagggtcacaagtcccttctggtctgcaccagcactggggcaccttgtgcatggagtcatcagacaccccccaaggtccctagaggagtctccaagtgatcttaggacccctggtgagtgcaacacaacatctgccaggaggcaggtatgaacgacagatatctgggcaccttccctgcaagaggaaagcttgcctgcagagagtactctgaccactgaaactgaggagagagctagtctcccagatctgctgatagaggctaacataatcattggaggaacaagctctaaccagagacaactataaaaactaactctagagaataccagatggtgaaaggcaaatgtaagaatcttactaaccaagaccactcaccatcatcagaacccagcactcccacctcacccagtcctaggcaccccaacacacccaaaaagctaggcccggatttaaaa

SEQ ID NO: 3937 - DNA, 1000 bp, mus musculus
atgtagcaatgggggatggggagctgggggtagcaatgagaaagtcccagatgccaggaccctatgacgatgacattagctaaaatatccaacaaaggggagggagaacctgtcaagaccatatccagaggttaggcatggccccctccccagttaagggatggggccatccacccatctccaaaattttaacccagaattgctcctgtttaaaggatatacagggacaaagagtggaacagaaactacaggaaaggcaatttacagactgccccatctgggaatccatcccacatgcagacaccaaatctagacactattgcagatgctaataagtgtttgctgacagaagcctgatatagctgtctcctgagaggctctgccagatcctgaccaatacagatgcagaggcttgcagccaaccatgggactgagcacaagaactccaatggaggagttacaggaaggacgaaaggagctgaaagggccttgtctggcatcaatgggaggggaggtcctggtcctgtgaaggtttgatgtcccagtgtagaggaatgttagggcagtgaggcaggagttggtgggtgggtggataggagggggagcaccctcataaaagcaaggtaatagggggtgggttagggggtttgcaaaggggaaaccaggaaaggggataacatttaaaatgtaaataaatagaatatccaattaaaaaattaatcatcttaatcatcttataccaaaaataaaagaaaatcacacacacaaacatgagcatgtgcacacacatgtgtgtacacacatacacacatacacacaaacacacactcccacacacacaaacacatctaacaacaaaagaaaaggaacaattattggtcattaacagctctcaacatgagtggattctatgcaccaatcaaaagacacatgctaacaaactaggtatgtgaacaggatccaccgttcttctgcataaagaaacttatctcagcaaaaa

SEQ ID NO: 3938 - DNA, 1000 bp, mus musculus; identical to SEQ ID NO: 3937

SEQ ID NO: 3939 - DNA, 1000 bp, mus musculus
aaagtacatgatataccccacagacccaaataagttaaacaagtttaaaggcccaagcaaggaagcttgaatcatacttagaaagggaagcaaaataatcataggaggtagagggaaggctggttcagagtgggagagggtagggtgaacagaattgggaggcagggtcaggagttgggagagagcagaagagaggccggagggtcagaggaatgaatggaaatctgtagctgctggtggtaggagttgaggagagaatctctaggaagtgccagagacctgagagcctcctggggggctcctaaggagtccatgcgaatgaccttaagccaacagtaggaacatggaacataaaaaagtcacttcctgtagccaagcaggaactccagtagagtgataaggacaccaattcatcctccgaactttcaacccaaaatttgtcctgtctaaaagaaatgtagggatggagtagaaacttaaggaaaggcccaacaataacctgcccaactcaaaactgatccatgggcaaccaccggtctctgacactattaatgatactctgttgtgcttacagataggaacctagcataactgtcctctgagagacttcacccagcagtgagctgaaacagatacagatatctactgccaaacactggatgagggtcagagacactaatggaagagctgggggaagggttgaaggtcctgaaaaggaaagggagccccagaggaaaaccaacagagtcaactaacttggactcctagagctctttgagactgagccaacaaccaaagaacatacacgagctgcaatgaggccccggcacatatacagcagacatgtagctcattctccatggctgctgtgtctggcctcagtaggagaacatgagcctaacctggcagagacttgatgagccagggtggggaggatatccagggggttacaccatcctagaggtgaaggggagagacacactgtgagggaagggccagg

SEQ ID NO: 3940 - DNA, 1000 bp, mus musculus; identical to SEQ ID NO: 3939

SEQ ID NO: 3941 - DNA, 1200 bp, mus musculus
gaataaaatattcagaagataaatgtaaaagcagaatgaagatgacaaatgagacaccatgaacttgaaaatgggccaattattcacaaactcaaagaaaattattaagaaaaaataagagtctcagagacacatagaataatatcaaaaggttaaaacgtatataatcagaattccaaaagataaagaggatgaaacagaaagaaaatattagaataagtaatatgtatcttgatgtaggtttgaactatactattatatgtatttgtcaatatcgaacacataacatatttgaaactgaactaatacacacaaaattcaaaagtagttttagaaagtacattgtacttaagatataagtaaaaataaagttgttaatagattggtaaacttcaataaaaaatatgtacaaatatttagaaggagtatattgttggcctcagttcattcttaaatgtttcacctattcctgccaaaaacgggattaatgttggacagaaaggatggagttacatagattaatgattaaaaaaaaaccgtatagtaaaatgttaatgggacaatataagctttagatataaaagtattccttctttcaactcttttatatgcttgaaatttttcctgttttaactataccaaattttagaaaatagtgagtaaactatttctgtgtcattatttactgattaaattctttttttttctttctaggataatataactattttttaaagtcaaactggaggaactggagatatagctcaataggtaaaagcacctgttgctcttccaggggactcaagttcagttcccagcatccacacgggcagctcacaaccacttgtaactctggctccagaagatcccagtaccttcgtctggcctccacaggcatccaaatgtatgtggtatacacagacataaacatattcacatatacaaataaaaataaatcattttaagccaaactatatataaatgtgctattttatattattaccagtttctataatcggatatttcaaaaatactattcattaagctgttctacagaaaataacttataaaccttaaactgtaaatatttgtataaattttgtgtgaaagatataaaaaaagcaaaaaattaatattaatagcacttaaatggttcatgttgacttttaaatcctgatattttattgtttaccttccagt

SEQ ID NO: 3942 - DNA, 1200 bp, mus musculus; identical to SEQ ID NO: 3941

SEQ ID NO: 3943 - DNA, 1200 bp, mus musculus
tccctggagggccatgaagtacctaatgggggcctatggctgcaggagggactctgggagcaagtaggtatgggagaagctgctctcctctccagaatgcctacagtagcatccaacccaagtctgacggatgatggctgctcctgagtctcctttcaggtaggaggaccagcacctaactaccaggtgtgccccagttcacaccttacagctctgtccctaccacacaggagcccaggtaagcctgaacctctaatcccctcaaggataccctgagctgaagctgcatatctacagtgctgctaggcctgctgaggtagtatgaggacattgcccgatgcttgaggttaggccagcttttcccaggtgacaagaaatccagggcctgggggtttgggttggggagaatcaggccaaccccaggactggacagcttctaaatccccattgtctcataaggtctgagctggtccctaaccagcttcctgttcaagaacaagccgttaagtgctttacaacacttacctggaaaatcctggcttcatcaatgcaatgttgctgcctcttcccatggcagcaagagactaaagtatgtaccctatattatatgagcaaggcgttcatgttcattcctcgggaaacctgtctgcttgtgttttatgcaaatgctcagcacatacacttgggttactgtctccctcaagcttgtccatctttcaggttggcctgagtggaaaattgacagtaggtgggacaggggcagagaggcctattgaaaggatagtgtagtctcccctcccccagcctgaaacctgcatgctcaggggtggagcttcctgctcattctttctgccacgcccactgctggaccttgccgctttgctgttccgaagccatcacgtgatcaccctgctattggactccaagattaattggtgggaatcgggcccccttcccctgctttatagttgcgtgtggaacagtaaaattgagctttgatcagaatgactgtcttagctgcatttctttatcttgccacctagcccctcttctcttccaggtttccaaaatgcctttccaggctaaaacccatgttgtgatctgctggccgggcacaacaggatagaagagaggtgactcactgtgtctctagtctaggtcaacttctgcagaaagtctcaaagtccagatggagtgaca

SEQ ID NO: 3944 - DNA, 1000 bp, mus musculus
gggagcagggctggaaaagggcataaaggaaaggccagcaaagggtgggcactgtctacatggaaatggctgtgcctgcattttggcccctccacatctttgtcttctctcacctgaagatactagctatctactgggcagcttggttcaagaagggagcttaggtattgatgttcccatggcaacaagaggcctaggtgccacaggtgcaattaactttatcctgctcccagataggctgcctgcttgggaagtgcagagactcaggggcccctccaatatttcccctgggaaaaatatactcacagcttgctgtcccagagctgggtggtgaccgaggctgaggagacagagccctgtcctagtctgtatttaagcagtgggagccaagggggatatgggggagtttgctagtgaatattaaccaatgtcaccacagttattggtagagcaaacagagaggggctaagtccatcggttggacactgaggtaccacccacactgttcgggacagagctcagctctctctctggtcctaaatcaatggagtcttaagcaaagcagttagaacacccatccctcataaaaacaacaaacacaacaccggatgtccaaagtgcgtctggtgtaatgagtcacacggcctctaggaagacacaacatggctggctggtcctgcactctcctggggaatgcttgggttgcttacatgtaagcaaagtcaatatttactgagccatctgcctccagatgcctggggcagaagattcactgcctccaccaggggctcagagtaggttatgtgcccacctgacgaatggagacacaggaccaaaacaaagagattgctccttgcgcgtgtagatatgaattctttgtttcctttgcaggagaatggactgtgactgacaggaaattcctgacaggctggtgcacagtggccatgggataggctagggggcagagaatagctctgtaaggaagagctgggatgccctt

SEQ ID NO: 3945 - DNA, 1000 bp, mus musculus
cgcctaccccactatgaagtctgagactttcctgctgttcctggcagccccagcaaggtcactgctgttagaaggtgctcttgtcaaagccacagcaaacatagaccccagaggccttgaaaactattccatgttcctccaaactgggatgggagcaagggtgggaaggtgtctgcagaagcaaggggagcagacccaggctaggctcccagctaggtgaaccccacagtgctcatgccctctggacagacgaagagtgggcatagagcttccccatcaggcactcaggtgacactgaggtggcccacagtcccacagtcagagcaggttgactcctattctgatcctgttgtgacatctctctcaggttaccacacctctctggcgtctcattgtttccatctatttaatggggtatatgactgaagtaactccattgtccccttcagcagatcgttagcaatcccatcaaaggccatggcccatctaaaggaagcaaattaaaaataattagtaataatcgcagtaatggcaataataattagtaataatgagatcaagacagtgagctagctctactcacccgagtgacacactctgttctgtacacacactcctgcaagtacagtaggagtgtctggttggcctagcaaaaggacaattacattctatccaataggatatgtgctgtgaacagcaagaaggaaggctgaggtctgtatataatttggatagcactggctatcttctagctggatgatgccagaccttctgcaatacttggaagggaaggaaaagcttatctccgtgggaagaggcatcggagacacacaacccacagaaatgttccatgtacctcctagaggatcctgaaaccagggctagccactacactaaagggggcctcttgagtagggtgtggtgccacactcctttaacgccagttagaactctggaagcagaggcaggagaattgtgaatccatggctatcctgggcta

SEQ ID NO: 3946 - DNA, 1000 bp, mus musculus
aagcaccgaacccagcagtgagtactggctgtctgcagcctccccttcacaccatgcatgcagcccaccattcactacccggcaatctccgagtcttacccacgagccccatgctgtcactggcagcttacattccaatcccacgggttcctccaaagcaataaagtcagtgaagtctgcggggagccaggcgtgctggctgagttgtgggtcactttgatagggttacagtcatttgggaagagagcatcaactgagaaaatgcccccaccagttggcaagcctatggagccttttcttaagtgactgatgtgctagtgtcactgctgggcacgtgatccttaatataagaaaagggcaggctgagccagccgtgctgaagtggtaagcactgttcctctgtggcctctgcttcagttcctgcctctaggttcaggccaggtttgaactctgctctgacttccctcactgatggactgcaatgtggaactgtaaactgaaataatgcttttcaaaacctccccaagttgcttttggtcatgggatttcaccacctaacaagacaatagaagcgcatgcaagcagtcctgacttgtccacagacctctctacgtacctcttttacaacgctgtaggccttggccacgccttccctcaggtctactggctggtgggctaaccggtgatgaggaaatctctttgccttcttgggctcaatggaaagggtactcggagacaccatgtcatatgcagtctctgcggctgcctgggtcattttgtcagaaggaagaaatggattagaaaacagcctgagagctgggccccaagtgtggagggagaggctctcctgcgggggtaaagagagccccacagagacagacagagacacacacacacacacacacacacacacacacagtgcctctgcttcaacactcagaacaagagcttaggacttccctattgtgaacagggatgcaaagctagaaactggcatctg

SEQ ID NO: 3947 - DNA, 1000 bp, mus musculus
attcccccgagcgtgtccttgagtggggaggaccacaggctccccactgccctcttgcccttgctcttcctgctgcctctggccagctctagcgtggacactggttagtgcagaaaggtcaggagaagccaaaccctggggcacacaagccagacacttagggtttcagtctatatctaccaagcgtgggaagcagagcctgtatatagccttaccggtgctgatgcccgtctgtgcaaagttaattttgattcttccatggcagggggtggggatctgtctcttaagccaagtgacgcctcttacagtcaaagcttgccgggtggtggggtagagatttgctattctctatcctcagctgccccgtgggaccctagacattccagaaaagaagggaagggagagggttccccaagaatgtccagctgatagggggccctggcaacccctgacttccgttcctttctccctccccctcttcaccggaagtgtctggatcctttgagacccgggtacttatcgtcgcaggaggcaaacacagggttggctctgctgcagccaaggtgatgaagacacagggcccacgcagaaaagcgggcggtgccgaaggaggaggacacttgagggataaacaggtgtggttctggggcagagtgagggaatggcactgtaaatgggggcaacacaggaatgcctagggagagttcagcatgatccaaaattcctcaacttggagaatagagacaaacggcccagggaaacagcaggggccagagcttagtgacctccaaggtcacagccgaggtctgatatggacagtgcagacgggcctgggactggagaagcacatctggtaattgaatcgatgagaaaagtgacaataacaggctcatttgcaggcagccgccacgagggtaatggccggtggccagggaggccatatgcactgggctaacagaattaatcacgggcggcgtggcacgaaacaggagcgacaggc

SEQ ID NO: 3948 - DNA, 1200 bp, mus musculus
tttccctatagagcgtacaggaagctaggtttacattctgtttgggtaaacacttagtaattgcatagtgggctgtaaggcaaaagcccgcttcactctgaaagatgctgcctgattttctccagaatacagtttaatgatttattcttatatgtatgggtgtgtgcttgcatgtatatctgtgtaacgcgtgcctatagtgccttctggggccagaagagggtggaaccacaggtggtcatgaactgccactgtgggtcctctgccagggcagctaatgctcaacacctcagccatctctccagcacccagggcgccattttaaattcccaccagtggtacagggaagtcccagttggttcaagccctcgctagcacttggtgttatccttttcctgcttaacattagccatccaggcaggtgtgcagtgacatccccttgttgcgttaaattacatttccttagtgatgagcactgtctgccatctctcctagagcttgcttggtgtccttttaaatcttaagggaggtatcgatttaagtcttctgctaattattgaaacaagctcttctcatttgacgaggttttaggtttacagtccatctgacgtgtaccacgtacagtatctatagagaaaaataaagatttcttggtacctgcctcttgcctctaccgaggcacagcctcctccactattaatatcttccagaagggtccaagggcacgacctgtgaaattctacttgcacattctcacccggagcccatggtttttgcatcaggcctcacttcctctgaggcacatttggagggttttaggccaatgcacaatgatttgtgtctgcacacgtagtcttttcctattggctccctttgttcagcaacatggatttaaaatgctgccgtgagatgttcatgcttttgatgactcattgctttttaacaccgaataacagcccattgttcgagagcaccacattttatttacccatccgttcactaggggcgtcctagtggcttccaagttgtggcagttacgaataaagctgctataaacacgggatcttggatggacataaatttttcagttccttcgaggaaatttcaaagagcatggacacatgtggttccgagtattgtcagttgtgtaagaacgctcacgctgtcctccccagtgactcctctgttctggctttcaga

SEQ ID NO: 3949 - DNA, 1000 bp, mus musculus
cccgccaaagtcctaaagctttgtttatatgatatattttaaataaactttgtataagaaataaggaccataagttactgacactttcttgcccaaatcgccaggtcactggagagagaccagagagcagaatcatactctcacattgggcttagacatagcttatgactgtcagcaaagctcccatacctgtcactcgaggttcctataccatcatccccatccatatccactgcctagcccaagaccacacctaagacctttccatccaagactacacccatcacctaggaccatactcaccaccgaaaaccatacctgccacccaaaacatacccactgccccacccaagaacatacccatcacctaagaccctatccaccacccaagaccacacccatcacccaaagccatacccatcatccaaaacatactcacgcatcatcacccaagatcacacccatgacccaagatcatatctatcaccctaagccacacccatcacccaagactatacccatcatcccaaactacccctgcttctcaaagatcacatctgccttctgtgtacagaaacagcatcactgaataagtgaaacaaactcccagctagaggcagcagcaggaagtgtttcagtttgaactgtgttgacaaaatggctcagccctgaaaggtgtatgggcaattctaggccaagctaacaacatctcttgttcctggtgagggccagatttttgggtcatagatggtgactttttactgtgtcccagccttcagggtcacacctcaccttgccattacagtaggctttagattccaatgagaaaggggcagaaggaagcagaaaagcacctcatctggacttggggctcctttccaaggtcttccctaacacttacacagcagtcccagagaggccgctggcatagactcaatgacctctttctgggtggggaagggggatcctgggtgttagatgatggtgcttcttcttcttc

SEQ ID NO: 3950 - DNA, 1000 bp, mus musculus
ctctttctttttttaactcaaatccttagaccaagaacgaaatgagcccttgaacgtgaaggagtccacccctttccctggactctcgtatctcagctctgccacgtgcgaaagctgctggttctttctcttagtttcacagttgaggatgcctgagagtgcgtgagtcgatttctcaaggtgcacaggagggacatgttggatcttggatttggacgctacctgtggtcctgacagcacacctctcattacactagacaagtatcatcaaggggtaggcaagataaggagacaggtcccagcaggcttgaccttgtagaaaatttggaagaaggtggggagaccccgtgtatggggtgtgagggccacagagagattgcttagcttccaaaacatgttggcctgatgcctagtgtgatgtgattttgatacagggcctttggaaagacattaggtgtctcctgagtagggagagcacctttctaattaagactgcaggaacttcccttcccctttagccacagtcacagtgaaaagacctgtctgaacaggaactgggccttgccctataccaggtctgctggtattttaaccttggacttttcatcctttagaactattgggcataagccacccaggctgtgacagtatgttccagctgctcaaagggaccaaggcaggacagtgttgagaagttaggtgccattacaaccaatgccttaaatggtggaggtggtttcagacctccataatgacagcgattggaagagctttaagaatgcaccaggagaaaaggtgactggcaacagcatgtcatctctaagagcagggacctctgttcattggtgtagtccatggatcaagatgatcaatataagagttgctcaaaggggatctaatggcctcctactgcaacttgatgtcctggggtggggtggtacccaaaaggggctcccccttctctgaggagaagaagggagataataggggaaggatctgt

SEQ ID NO: 3951 - DNA, 1000 bp, mus musculus
cacatcaaattgaatggcagtagagaaactgtccaataaattatttaattttgttctttatagtgccagtattgtgaatgccacgcttagcaacactgacactcaatctcagctgtcccttacagtttaacccacctctgggccaaagacaagaatatgctgcaatttcttgtttagaagccatttaatttaaatgcaaacaaaagctttaaagtgcgggtcaacagaattcaaacatcaaatcccaacaagtccaatgtatagtatgtcccaacttaattggaggaaggaaaagacaaaacacagaaacggaagcagcgtggggcaccttggacagaactcttaccagctcctccgggaagagagaacgggtgagattcctttgccctacagtgcccatcagcgtgagatgagcgaccccgcagctaacttctccagttcaccatcagggccagttgtctgcttgggacacagtcaagttaccactgtagcaatggacacctgggatttatctgtaggctgggggctgaaaagagaagccatcttgccaggagaagcctgagagaacattgttagtctcttctttcccgccactacaggccacagctgtctacccagtgggtatcctcggcccattttatgcagccaaatctacagcaaagggcagaggcggcttcccaatacgccaagctcccccagaaaaggacattatcatatctcctggtaacacacaattgcaggatgtgggggctgttcctagagtcaccctggaaaagattctcggggtcccaagtgggggagaggctcgtttgccacgcccccctcaacattttccttccatagcatgaaagttgaattccacacagagacgcctctgtggctcaggaggacatcagtgctaactctccaatgcgatgctaagacaaagtgctacaattttaaagattgtaatccgctgtacatccacctcccggaaaaaaaaaatggttttgaaagccac

SEQ ID NO: 3952 - DNA, 1200 bp, mus musculus
ctacatgatgtcacttcagccgcattaagctggaacagctcaaaattgaataattaattacactcagcttcagttgcagtgactaattgatcaggggccgccagaagacacctggacaggattaactgggtacaataaagcctgcaggcaggtggcacaggcccccatcctccacactctgtgtgtgatttaattagggttgacttgatttctctattcttgctggaggtctcaggcagatcctatcctggcccagggtggcatctggacatggtgacaggctggggtctggaaagatacaggccccaggctacctgtgtcgtagctagctctatggcttgggccaaggtctaaccttgtggcatcttgatctccagtcaagtgggtatatcactgctgtctgtgtccagaatccagctaagccctgaagtggggtgacttttgtctttttggcccctccagagagggtgatccagctggccctcatctcttgactagctagagcagtggccccctagtcttgtatagtctggctcgctggagtaactaattgtctttcgaagctgtatttctggacctggcagctactgagtacagcttcctggatgtgtaacagtgtatgatcctttggcagcctgataaacagtcctgttcacaaaccaaactcagccaaaccgaactgtgaaagcccacagccatgtaagcggtacgtcctgctcctgagaagggctgagtgtatattgttgggctggctgtgcgtggagtaattccagcttgacgcgagtgctctgatgtggacttgtgcaatggagatggccacagagtctttatctccttcacagttgccctggtgaaaccccttggctctgtgccatctaccctcttaagtgaaccaaaatcagagctaatcagcccttggtaggtgtgtgggacagggatggagagacaaaatgaagatgcccccttggctgggattggtgatgggactgtagctccttagtggagggtcccttcgcttcctcaacctaccttatctacttctaggacaagagttcattgtcttccattagccttccttccttgatctttctcatatcctcccaacaaggggttccagctctgcgaaggcagcccttcagcagcgtctgagctttgctaagttccagaaggagcacttggacagatgtcatggtgtcgtgt

SEQ ID NO: 3953 - DNA, 1000 bp, mus musculus
caggaccaagggcctcccctcccattgctgtcaggcaaggccatcctctcctacacatgtatctgaagccatggatccctccaggaacactcctttgttgatggtctaatctctgagagaactgggtggtcagaccagcctatattgttctcccaaaggagttgcaatcttgctccactccgccactccttccagctcccccaccaggttccctgagctcagtctgatggttggctccaagcacccacatgtgcattggtcagttgctggctgaacctcccaagaaaccaccacaccaggttcctgtcagcaagcacctcttagccatggcaacaatgtctgggtttggtttctgcagacatgatggaatccccaggtggggcagttccaggttggcccttccttcagtctctgttccattttttgtcccctgttcttcctttggacaagaacatttgtgggttaaaaactttgagatgggtgggtatccccatctcttgaccaggggccatgcctttctactggaggtagtctctacaggttctatcttcccattctctgtgaatttcagctaaagtcatccctgttgggtcctgggagcctcacgtttccctggtgtctgagaccctccagtggctattcccagtacctcattccccctgatacatatgtttgttcggtttcctgaccgtctattcctctctcacatctcttctagttcctaatactgcctccttatttcctctccctcccaggccctcctctccctccacctcccatgatcatcctgttcccccacaaagtgcaggactgaagcatccacaccctagtctttcttccttctaagttccatatggtctatggattgtataatgggcattgtgagcttttgggcaaatccacttatcagcgagtacacaccatgtgtgttcttttgagtctgggttacctcactcaggatgatattttctagttccatccatttgcctgtgaatttcat

SEQ ID NO: 3954 - DNA, 1000 bp, mus musculus
gtagaatcctctggaagctctcgggccagctagcctagaatagtcagcatggtagtagaaaccagaaagcccctgcctcaacaaggtgaaggcaagaacagattccccaaagttgtcttcagacatccatactctcaccgtgatacaggtgcaattagtgcacacacacacacacacacacacacacacacacatacacacacacacacacacacacacacagactaataataacaacaataatagtaaattttacaaaaacaaatgaccttatttcttgataagaagaaaattaaaacacaatttttatatatagggtaaaatctcagacattggccaagatgctggcctcagcctagagtttaggtgggagcccgtggtacctcgagctggctcatctgaagctgaataatctctggtgtttgtgttccccccccccaagatgctctctggcacggttgctcacagacaccccacaggactcacaggccagaacattcacgggatcacaggaaggacccaagcttggaaccgttaactgctcatgttcagtagacccgctcagccacattcccagcacacagcagactgcagcatcgtcgcagtgagaacaattgtaaatcagcatgcaggaatgtgggaagacctcccacgtgtgggtgttagaacaggagaggcaagacaggagcgtgggcccgtggtgaaattccacgggtgggaagctcgtgcacaccaggtctgcgttgaagaggagcttgtggcttaccttggcgggaagttggggggcaagggggagcacaggaagcctgcagagtgtcagtctcaacgagggctgggtaaagggtcaatgggcattcaggaagccacacaaacccatgaacgttctgcgaggaccttctatttcaaaacagagatgaaaggaaggcagaactcttctggaagaaaatagcttatgtccacgggcagagtgatgtcactctgtaccctatctgcctgtcct

SEQ ID NO: 3955 - DNA, 1200 bp, mus musculus
aatgaggaaaggcatcttgtgatggtgccctctcctctcccagctcttaggaaatgctgtctgtcatgttatgacaactgatctggcacactgcagacacacacccatggccctctgcccctgagcacgtgaggctgaaggagacaccctcaagtttaggacacagcagagcccatgtctactttccctcagctacgctgctgcaggtggccgggccactaccaggagccgggagcgttctcatctatggaagggcagagtacggagtagacagctggagcccaggcgaagccggctgggcacctcagcacctcagcacacatgacaccaccagcactgactgaggttgtgcgactccaaccagcctgagtcagcccaggcaggacaagatgctggaactggccaccaaattatccaacagtggtgtttctgacacggggtgggggtgggtgtcctgtttttgaatgccatgtgcagaggctggccctcagttacctctaagatgaaaactctccagatgggaactctgggacaagtgctcttacttgctgaatatatgggggaccccacttgtgatttgtcaacaaaggacaaagttcaaatggaacgtctgaataaacacactacagatgcactggagggtatgtgctttggagacagctagacctgcaagctagggggcctctgaacctctgcctctcgagacaggactaggaggcactgcggactctgatgctgctccactctcaaagttccctaacttcttccatctctgaagctgactgggtacacatggggctgcccatggaagtggaggagggaacactgggtgtccacgctagctatgtgtaccaaggattgttaacgacaccgcacttagggacgtgtccgttccaattccaaactgggaagaaaaatgagattctggaagttaggagtgtacagcctagagcgctgcactggctgcctgcaaggaccaggagaggttatctcctatctccaaggctgcccttcccgctggcaatgcccgggcctgctgccctagcttccccggtgagggagaagggtttgagaaccactgcagcacacagactgagttgtcagccctgtcacctctgggcatctcctttggccagagagagcatcatggaggcggcctaagatgttgccagttgtccaccattatgggagcatgaagcc

SEQ ID NO: 3956 - DNA, 1000 bp, mus musculus
ctttgtcttaggattactattgctgtgacgaaacatcatgacccaaagcaagttggggaaagggtgtatttggcttatacttccacatcgctgttcatcatcaaaggaagtcagaacaggaactcaagcaggaacctggaggcaggagctgatgcagaggccatggagggtgctgcttactggtttgcttctcgtggcctgctcagcctgctctcttagaggacctaggaccaccaacccaggaatcacactacccacagtgggttgagcccttcccatcaatcactagttaagaaaatgccttacagctggagctcatggcggtctttcctcagttgaggttaccttctgtcagatagctgtagtttgtgtgtcaggttaacataaacctggccagcacagggtgtgtgtgtgtgcgcgcacctgtgagaagacattctgtataggaagcagatgagtggctgctgctgtgtccggccagcggttcacatgtctgggttctgttttgggaaggcattttggaatctggaagagaagagggagagctaggcggtgcgagagaaatatgaaaccaagacagtcagtctgatcaaggttcaattttaatgtcagcaaacacgctttataaagaagaggggaggcccatctctaggcatgtaaagttctttgaagtagataggtcatccttttagtgggaactctcgaagtcagtttggtgctaactccggaaagtcttggaagagaggcaggtagtggcacatcaaaggagcagcacagctggtggctcagcttaagccgatggatggtcacagccagccttgctaggctggaaggaggtaacaggctgccatgaggtagggaacgaataacctcatgggacacctaggagcctgacagtaaaagagatgaaggcagaggacacaggatgcatttgccccacctccgagtgtctccagatagtaatgtatggcatacacaccatacagggagttgggtcttc

SEQ ID NO: 3957 - DNA, 1200 bp, mus musculus
caaaagcaatttatatttagatatattaataagttcaggtaaacttataacataagattctatagaagtaaagtagctacactcaaatctatgatgaccctattaaaaaactgccttttcttgtttcggatacatcaaagaactatgaaagaggtttttgtttgcccacatgttgtttatttgggttttacttgccatattcataatatcgtttatttctgtctagttcagcaacaattaacaaggattaatatattattataaaatattgcaaaggcatgccatttatcttttattaagcaataacatgccaatgaagattttcactaataaagaactggtcaaaatatagtgtactctagggggatctcagatcagccccattttatttggagatgcacttgaaaagttgacaaataccatatataactgaggaggaggcagaaattgggacactcaaaatggctatttcttcagggtagtatagtctgtcatctcagttccaggcagcttcctgcactttatggtttatgacactctcaggatgtgtttgcaagactgtgtgtagtacagtaatagacggcagtgtcctcagatgtcaggctgctgagctgcaggtaggctgtgttggaggatgtgtctgcagtcatagtggccttgccctggaacttcggggcatattcagtatcaccatcctcaggatcaatccttccaatccactccaggccctgttcaggcctctgcttcacccagtgcatatagtagtctttaatgttgaagccagaagctgtgcaggacaacttgactgaggcccctggcctcacaagctctgccccagactgctgcagctgaacctctgaattgacccctggagaaagaaaaacaaagtgattgccactgtcacagagtgtgtggcccttcaagtttgggacttgcgagccccttacctgtaaccactgccatcaggaagaagatgacccagctgcatttcattgtaaggatcttgagattcagtggctgtagagaagacagggctcatatgatgtttggtgtggatatccctatattaatcatcacagtctcacatgatttgcatacaggatctttcttacataaggacattctggctggagaagaaggaagttgagtgcacctgggtcagtcaacaggatgctggggaccaaatcctgcttctgtctg

SEQ ID NO: 3958 - DNA, 1000 bp, mus musculus
ttctcattttgactctaaattgctttcactgtggggaattcacccatttctgaagtttctgtacctgcacagaaggaacaaaagttatgtaaatgaattggagtcaaagagtaatgaagataaccctatccactcttgattattaccaagaaatgtccttggcgtccagagcatgggactcattcaggatcttgcacaaaagttaatgattaatgacctggttaatgagagcagttttactaaatcattgactactctgggttcaggttgaactagccatacagccttaataagagaaagaaattacgagaaatctgtctttctattgaatcttttacatctagtctacatgattcactgacgaattttaatgcattatgtgaaccacattcattcaaatacttttttattagatattttctttatttatatttcaaatgctatcccctttcctgattcgccctctgaaaatcccctacccttacaccttttcccctcccccttctcaccaacccacccactcccactttctggctttggcatccctctatactggggcatagagccttcacaggaccaagggtctctcttcccattgatgacttactaagccatcctttgctatatatgcagctggagccatgagtcccaccatgtgtactctttgattggtggttaagtccctgggagctctgggggtactggttagttcacattgaagttcctcctatgaggctgcaaaccccttcaactccttggattctttctctagttccttccttggcaaccctgtgctcagtagaatggatggctgcgagcatccacttctgtatttgtcaggcaccggtagagccccttaggagacagctatatcaggctcctgtcagcaagctcttgttggcatccacaatagtgtctgggtttggtaagtgtatatgggatgattacccagcctgggcactctctggatggtcattccttcagtctctgctgcatagtt

SEQ ID NO: 3959 - DNA, 1000 bp, mus musculus
gagtaagacagtaatctatttttaaaggtaatctggaggtgtcatttatggtagaaattcaacacattaaattgatgcacaaggagtcgcaaaggcaacctatagttagaaacaaaacatatctgtgtttgtgtcttcaaaatttccttcttttcaaaagaaatttgcacccacatatagtttctcataaattagcaattctgttcagttgtcactttccaatgcaaacatttctttggagataaagcatggtaagttccagagaaaactccagatgttaagtagtaaaaggagaggcaatgcactctttttctctggtcatgtgcgccccctgttggtcctgagcacccctgcaaggaggtttttttctaggctcacactgaagtaccctcgctgtgtacagcttttacacagtaataagtggcactgtcctcagccctcagggtgttcatttgaagatagaggatgttttgggaattatctctggagatggtgaaccgacccttaacagatgcagtatactctgttgtgtaaccattagctttgtttctaatcaaagccaaccactcaggtgccttccctggaggctggcggacccagctcatgtagtaatcagtaaaggtgaatccagaagctgcacaggagagtctcagagaagccccaggctgtaccaagcctcctccagattccatcagcttcacctcacactggatacctgcaatagtaaagaatttgttcaggaaaatgtcacacagatccactgtccctcttacttacacgcactcacgtattcagcatcccttgttccccataaattaccatttaaaagtgctacaagtagaatccagttcacccacaacttcatggtgacaggtctgtgttcaaggctgatcactgaatctgggaactgaaggctggggaaatcaagactaggttcatatgctacagcgagagtcttcacaggattttatgagaagggggtgggttccaatttgcatgt

SEQ ID NO: 3960 - DNA, 1600 bp, mus musculus
ttacatctggccactttgctgaagttgttttattcagctggagaaattctctagtagaattctgtgggtagattatgtatgctatcatgccatctgcaaataatgaaaccttcattttttttctttctcaatttgtatccagttgatctctttttattttttttattcttctagctagcactttgagtattatattgaatagataaggagagaacagacatccttgtcttctcatttcaatgggattgcttcaagtatttctccatttgattttttatttcattttttaattaggtattttctttatttacatttcaaatgatatcccaaaagttccccagaccaccctccaccccctacccacccactcccacttcttggccctggcgtctcccgtattgaggcatataaagtttgcaagaccaaggggcctctcttcccaatgatggccgactaggctgtcttctgatacatatgcagctagagacacgagctctgggggtactggttatttcatattgttgttctacctatagggttgccgacccctttagctccttgggtactttctctagctcctccattggggagtcctgtgttccatccaatagctgactgtgagcatccacttctgtgtttgacaggccccggcatagcctcacaagaggcagctaaatcagggtcctttcagcaaatccttgctggtgtatgcaatggtgtcagcatttggaggctgattatgggatggatccccaggtatggcagtctcttgatggtccatccttttgtctcacgtgagagaccaaagtgtgggaaactaagttacacagttactctcaccctaaagatcccgctgatcctttgaagggaattatgtcaccccctccttcagtgcctccacttggtgcctgagactgccagcttcactctccttcacttggtgcaaagaactgcttagattaaggcagattcacctcctccaccatgtctccatttggtgcttgagaatgtttagtcaggacaggcactccaagataaactgcagaacgtttgaaggctgcctgggatagttttagggcccacattccaagataagttgcaagaagcctgtaatcagcatctgccccagatgtccatccctttctatatattttattatgccccttcgaaccctccctattttctctcactgtgtgcttataacctggctcttagccttcattaaacagacctagacaactctgtacttggactcgctcccctttctctgtccacttctcttgcaggcctcagtcctcctcaacccacagaataactaggtcctgctggacaggacagtctcagcttagactttttctctgtaactccttccatgggtgttttgttcccaattctaaaaaggggcaaattatctacactttggtcttagttcttcttgagtttcatgtgttttgcaaattgtatcttgtatcttgggtattctaagtttctgggctaatatccacttatcagtgagtacatatcatgtgagttcctttgtgattgggttacctcactcaggatgatgtcctccaggtccatccatttgcctaggaatttc

SEQ ID NO: 3961 - DNA, 1600 bp, mus musculus
tgtctttaatttctttctatatttcttccctgaccaagttatcattgagcaaagtgttgttcagtttccatgtgtatgtatgtgtatcttctgggtgtatgcctaagagtggtatagttggatcttctgataagaacttcaatcctacacagttatttaaaacaatgaatacttataattcttaggcaaatggggaactagaaaatatcatccagattgtgctaactcaatcacaaaagaacacacatgtttatacacttagtgataagtgtatattaacccaaaagcccggaatacccaagatacaattcacaggtcacatgcatctcaaaaagcaggaagatcaaagtgtggatacttcggtccttcttagaagggggaacaaaattcccatggaaggagatacataaacaaagtgtggagcggagactgaaggtaaggccatccagagactgccccacctaggcatccatcccatatacatttaccaatccctgactctattgtggattccagtaagttgttgctgacatgaatctgatatagttgtctcctgtaaggctctaccagtgcctgacaaatacagaggttgatgctctcagccagtcattggactgaacacagggtccccaatgtgggaactagagaaaggacataaggtgcttaaggggtttgcagccccataggaggaataacaatatgaaccaaccagtacccccaaagctcccagagactaaaccaccaatgaagtagtacacatggagggaaccatgcctccagccatatatgtagcagaggatgaccttgttggacatcaatgagaggaggggcccttgtccctgtgaaggctcgatgcctcagtgtaggggaatgccaggacaggtaagtgggagtgggtgggttgataagcagtgggaggagaaatggaatagtgtttttggtgggaaacaaggagcaggaataacatttgaaatgaaaataaagaaaatatttagttttttaaagtcacccagaaactgcctcacctagggatccatctcatctgcagtcaccaaacccagacacttttgcttatgctaacaagagcttgttgacatgaacctggtatagctgttatctgaaaggctctgccagagcctgaccaatatagatatggatgctcacagccaatcatctcactgagcattgggacactaatgaacgaattaggcaaagaactgaagcagctgaaggggtttgcaaccccataagaagaataacagaaaacaaccaaaccaccaagaactctcagagactaaacaatcaaccaatgagcacacatcgagggacccatggctccacctgcatatatagaaaagaactgccttatttggaaacaatgggaggggaggcccttggttatgtggagtgtccatgccccagcttaggaaaatcctagggtggtaagggagattctatttctgagtgggtgaaccactctctctgattggaatgggagggaagcatgagagatgtgggagggcctatgggacagagggagcagggggagaatgatagtgataggaaggaaggaaggaaggaaggaaggaaggaaagaaag

SEQ ID NO: 3962 - DNA, 1200 bp, mus musculus
accaactatttcaacagaagttctggtctctcagaatccattgttacgttatcatgcatcatcatggttttcactttttattgttttactgagtaaaaaacttgctaatggaggtaggtactattgaggccatttaaaggtaaaggtgtacagtagaagaacttaagttagtaccacttcactcttagattaccttatgcaaagttgacaaaggcactataagtctgtgtgtaggaaactaacaaacgaaaaataggcactcaaaatggttatttctgaggaagtctaaatgttagccttttctgatatttcagacccagggcagcttgctgctcctccagagtttctgacacactcaggatgtggttacaacactgtgtcttgcacagtaatagatggcagagtcctcagttgtcaggctgctgagttgcatgtaggctgtgttggaggatgtatctgcagtgaatgtggccttgcccttgaacttctcattgtagttagtactaccacttccaggtaaaatctctccaatccactcaaggccatgtccaggcctctgctttacccactctatccagtagccagtgaatgtgtagccagtagccttgcaggaaagcttcactgaggccccaggcttcatcagctcagctccagactgctgcagctgaacctgggagtggacacctgtggagagaaaggcagagtggttgtcattgtcacctcaagctctgtctcttcttcagatttgaaaatggtgagccccttacctgcagttactgacaggaggaagagaaagacccaggtccattccatggttagagtctatgttcaaggactttggagaggacactgatcatatgctgttttctgcatgtggtcacccctgtatttactgccatagactcaagtaatttgcatattcatgagcattaacttcttagataagaacctaattgagcaggagaactactggacagtaggcacatgcgtcaggtatcaggatgctctggtcaatgtcctaatcttctctgaaaaaatacttttcctacatttttggtaagctttgtgcagatgctgtggacgtagcatcaggaaataacttttcagaagatttcaggccttacactgttgcttctctttgggacaatgtattcagattgatttagagatggttgcatgatgatgatgaagatggtgata

SEQ ID NO: 3963 - DNA, 1400 bp, mus musculus
ccaaacgttgacaccattgcatacactagcaagattttgctgaaaggacccagatatagctgtctcatgggagactattctggggcctagcaaacacagaagtggatgctcacacatggatggatcactgggctcccaatggaggagctagagaaagtacccaaggagctaaagggatctgcaaccctataggtggaacaacattatgaactaaccagtaccccggagctcttgactctagctgcatatgtatcaaaagttggcctagtcggccatcactggcaagagaggcccattggacatgcaaactttatatgccccagtacaggggaatgccagggccaaaaagggggagtgggtgggtaggggaatgggggtgggtgggtatgggggacttcttggtatagcattggaaatgtaaatgagctaaatacctaataaaaatgaaaaaaaaaagaaatagacacaaaaacacactattcaaatgactgcatctaaacaagtctgcaagtgactattctctaagtcttgtcagtcccaagggagcttgctgcacctccaggatttctgacacactcaggatgtgtttgtagcactgtgtcttgcacagtaatagactgcagagtcctcagatgtcaggctgcggagctccatgtaggctgtgctggaggacttgtctacagtcaatgtggccttgcccttgaacttctggttgtagccattaccaccattgttaggataaatatatccaatccactcaaggctctttccatggctctgcttcacccagtgcatgtagtagtcagtgaatgtgtagccagaagccttgcaggacatcttcactgaagccccaggcttcaccaactcaggtccagactgttgcagctggacctcagagaggacacctgtgaagagaaagacagaatggatgtcagtgacatcccaagccatttcttttcttcagatttggaaatggtgagccccttacctgcagttcctgacaggaggaagagaaagatccagctccatcccatggttagagtcagtgtgttcagtgtctgtggagaggacattgaacatatgttgttttcagggtgttgatatccctgtttttaactaccatagacttaggtaatttgcatattcatgaccaggggactttgtatatactaaccaatccaaatggagaacagctggagaggatggacttaaaggtacataggtcaagcagcaggatggtctagtccaaacccaataactctctgaagaaatagatcccatacattttctgtgagccctgcactgctggttttcttgtaactacagggacaaatctctcaatctgtatttggcctaagtctgtttcttcactctggggctatgttcacattttgatttac

SEQ ID NO: 3964 - DNA, 1000 bp, mus musculus
atttttgtgaaaactctaacctagacagcttacacctcctaaaatcaaggacgaaaatgaggttaattaggtgcgctgctgcgtgtttacaaaatttattgaagcttcatgcttgcatggaaaagattgttacgaggtgattaattagagtgggcagtggctggctcttggcattgatggctgatgagcctagtgccctcacacctcgacctatgtatagctctaataaacaagcatggaggcagaggtggacgtcagtgctacagtgcccgcctagcatgtgcaaggtcctgggtttcatccctagcactggcaagaaataaaaaatgaattaaaaaatgaagacggaaatagtatttttctgggctagacctttcacttaatttatggacgttttgtacatatctacaaaagctacatgtgccttaatgtgtgactgttaatatgacaatcaaacagtgacccaggagacatattgaataaaagatggaaagggactgctaatcatgaatcagtcaggatggacaccaattagctgcattccaaatggtttgtgaaaagctctgtcagtctcaggccacagttgaaaataacttcacagatctaaacgacttatatgcacctaaagtattatttcaggaggtgtagcatcatgaggcagatggaagcatgcctgagtcctccattaccatgtctgatccctcagttcagttccccggtttaaaccagtgaccagatctgtagctgcaatcatgaagggaccgctgaagggagcaacgctgactctgactaaacaagcagctttgcagacccatgacctcgtacaattattgtggtgtagaatgtttggtttgacactgggggtgggggggggagtgggactctgcggactagggtttaaatcacaatgataattggtcatcctcataagcttgcttcacatacccatgagatgacctgcaagagactatctgacatgttgctgtacttaattgctttg

SEQ ID NO: 3965 - DNA, 1000 bp, mus musculus
gagaagtcatcagatagccatgtctttcgcgtttgcctgggaaggcagcataaaggaaaatgcctctagctgggtccaagcttcttgtctcagctctatgacacagagtctcatgtttaagcagaaaggcaggaaaacatcacctttcagcagtgtggaatctcaagtacatcttctagtggtccctgaccagtcataattcataacaaagccatgccttctgaggaggagttgcagtcagaaaacaaatgaggctcttcattggcaggggcagtttgagtgacaggaatcgacagaggaccaatgagaagggaattgcagtactggtaggtggtaaagatatcagaaagcaccagaataccggaaggtaggtgccagagacacaagttctgtttcgtgcctctgtggagatgagaaacactatagcctgattctgtcggtgatctgtgtgttacatcacgtgcaaaggagacaacttagggtcaggtacggaactggagggctgtaaaatcagtagatgtttatttaaaagaaatgacttaactttctcagtgataagagaacatgggagtatttggtgacacggggtcgtttcttctgaacaagttccccgagtgcagggaacaggaaagaacaccagcacggcagtagggaggggggcatttagtcccagctttggtgcgaatgggaaaatcctattaactttcagatttagatccagattggggtagggtctggctgcctgcatatgcagagtatgctgatgtgctgctggtctgcagaccagctgtgatgaacagggatctgaagacctcctagcatgaaccccagctaggagaggaggcatagggacgttttcacaggttcttgaccctctggggagtgggaccactcaaatgtttcagttccgtaccctttcatctttggttcagaggccattttctctaatgtatgagattaatcttgtaggaagtgcactagtgaactgttagctattttc

SEQ ID NO: 3966 - DNA, 1600 bp, mus musculus
tcttttgaaataattagtcaagcacaaatgcagtatgactaacatgctttatttttatttgtccatctatggatagactcttaggttgataaatgtccttactgttgtgaatagcactgcagtgaacgtggaactgtgatatttttcacacacatttttctagcccttacaacacatattcccagaggtgagatttctgtatcatatggaggttattcttttagcattttgaagaatttccatattatttccagtatcaccaccctatttatagtcccactagcattgctcaattgttccctttctctactttcctattatcaacatcatacaataatccaattgattttttacagttggtagaaattcaggaacattgacactaattttaagtatacattgacaggtcgtggaatggaaacatctgagggaattttctgtaaagtggctccagctgttgttttcagaggccaagtcttccttgtgtggtcagaccactaaagatgtgagttctggagtctgcgcaggggagagtgtggactgcagaagctaacagcttctgggtcaggtggaagccacagagcttctgggacagacagcatttcaggctccagacatcctggcaccttccctgccagaggagaggtgtcaggcccgccctggagggcttcaccaaagcatctgggggagacatcttcattcctggatcccgccaagactactctgtgcaggtgagagtgtggactacagaagctacacagattttgggacaagccctgtttcaggccttcatcttctgccaggatgcaggtccgaatgccagatatctgtccaccttccctgcaagagaagagcttgcctgcagagagtgctctaaccactgaaactcaggagagatctagtcttccaggtctgctgatagaggttaacagaatcatgagaggaacaagctctaaccagagacaactataacaactaactccagggattaccagatgacaaaaggcaaacgtaagaatcttactaacagaaaccaagaccactcaccatcatcagaacacagcactcccacctcaaccagtcctgggcaccacaacagacccgaaaagctagacctggatttaaaagcatatctcatgatgatggtagaggacatcaagaaggactttaataactcacttaaagaaatacaggagaacactgctaaagagttacaagtccttaaagaaaaacaggaaaacacataaaaacaggtgatggaaatgaacaaaaccatactagacctaaaaagggaagtagacacaataaagaaaacccaaagtgaggcaacactggagatagaaaccctaggaaagaaatctggaaccatagatgccagcatcagcaacagaatacaagagatggaagagagaatctcaggtgcagaaaattccatagagaacatcggtacaactatcaaagaaaatgcaaaatgcaaaaagatcctaactcaaaccatcctggaaatccaggacacaatgagaagaccaaacctacagataataggagtagatgagaatgaagattttcaactcaaagggccagcaaatatcttcaacaa

SEQ ID NO: 3967 - DNA, 1600 bp, mus musculus
ttctaattcaagtcaatttatatgaattgatccttcaccatgttcttgggataggaatagttagctttatttcactctgtgtgatggtttgaatatgcttggccctgggaatagcactattaggagtggccttgttggaggaagtgtgttgttgtgggtgtgggctttaagacctttgtcctagctctttgggagccagtcttctcctagcttcctttaaaacaataggtggaactctcaactattccaaccccatatctgcctggatgctgcgatgctcccaccttgatcataatggactgagcctctgaacctgtaagccagccccaattaaatgttgtccttatatcagttgccttcgttatggtttctgttcacagcagtaaaaccctaacttagatactctggtaacccactatttagataggaagccaaacaatacacatcaaatcttaatataaaatttaaccactattacaagataagaaaatgaacatgcacaatagctaaatgttggttgaggctggagggaggagaggctggcttcacagatgtcatttaagccagataaagaacacttcccttttccttcattcggagaagatgctcattaatttttttgaataatatatcttttctttttgactgaccaatatttcttgatatataaactccttcatttggtaaagaattagttattaactaaattggcttttaaaacataagcacttgccgggcggtggtggtgcacacctttaatcccagcacttgggaggcagaggcaggcgaatttctgagtttgaggccagcctggtctacaaagtgagttccaggacttccaggactatacagaaaaaccctgtcttgaaaaaaccaaaaaacaaaacaaagcaaaacaaaacaaaacaaaaacaaaaaacataagtgctctattgtgtatgtgtctttgaagaccagagttggaaatagatattcttatttttcaaatggagaatttgagtaagaaaataatacaatagcaaactagaagaaaattgacatttttgtctatacaaataaacatgatcttattcagacattttaattaataagtcaaaatatcaaagtaacaaattaaaaattctaacattcaacaaggttgtataaaatattttattacagggatagattctgagaaatgtatggctaggggatttctttatggtatatttacacaagtgaagatgattcatcactattaccttgtgacccatcattggatgaaaatgttatacaaggtgctgggaaaatagctcattgattaagagctcttatagaagaactgtgttcagtttccagcactcacatgttagatcacaaacacctataactatccccagggaatccaatgttctcttctggacccttggggcacctgcaaatatacatatgtgcacataccacatatgtggtatacttgcaaataagcagatgcacatatacacataaaataaaaattcttacaaaccttagttaacataagattgtatttgtacatggttaggcatttaactgttactgtttcattctagaagttagaatagagtcaataatttaatat

SEQ ID NO: 3968 - DNA, 1600 bp, mus musculus
agaaaattggacatagtactaccggaggatccagcgagaccctgtctttaaaacaaatatatatgtatatgtaaacattattttgtacttctacttgtgtacttttcatatatatatatatatatatatatatatatatatatatatatgtgtgtgtgtgtgtgtgtgtgtgtgtgtatcaagaaatatatttctagtcctttttgaatgtataaatgtgttcacacagttttaaaaatgagtaactcaactttctaaactgtatttcgatttagcggcaaggtatttgtaaccatgcatgtaacctctaataattaaatatggtaaggtgttggtgcctttgggttataggaaagtacgggaacagcttgatatgtttaatccttctaatttttgaacacagaatttgtgattacagtcttggtgcttagaataaaatttaggatttggctcacaagtagaagtacaagaaaaattaatgtttacttccttggaattctgggacagaaagcaattaatgattttttaaaagtactttaaaatgtaaacgcacataaaacataagccttggtgatattcttgagtagaggttgcaacaaatcaattaattcatgatcatgctggcagccctgccaggtgtcattagtgctgctagctataagctaccactgaaaacctgcctgtgcttacttcgtacgagccttagcttgagtgtgtggaatggagctggccctgactgcacattacagcacaagtaattattcataaaaacttgcttcgctgcaagcaattcattcctctctcaacagatgtctaggactctgacccaaagcagcatgaatgtggactaaaaatagcttccactgcagcaagcagccctggagaactttgaatttaagtggtttttattcccatggtagcagagcattttgctcaccagattgaccctgaaagaagacagggaaagtaaagattttttttaaaccttcttttatgtctctcttctttgagatatagaacacatttcttcatagaaatatattttgctctacctggtagaaaaatggtgggggggaggggatcaatccccttcaaaaccccttccagccttctctttgttttgtgtgtttgatgtttcttctttttttcttacttttctttctttctttcttcctttctttctttctttctttctttctttcttcctttctttcttttccttccttctgtagctacaggggagattgagtgtgtcagttatatcactaccaaagtgatcactacatgcttggtgtatcattacattttttatcacacatgctcatgagaatatattcactagtgcatcttttatgtgtatatgtatgctagacactgtagaggatataacatgtgtatccttatcacattagtggcatggaacataatagatcatcacatgactgcaatctagtgctgctggaatttgagcatacctggtatatcaagtttcagtgggtgaaatcctgaagtgagaatcacaaaatgcaagtaaatcctcttaaaaatagccaagttagttttgttactacagggtatggatcagactgcattgcctgga

SEQ ID NO: 3969 - DNA, 1200 bp, mus musculus
agtagaaataaatcgatataagtaggatatttggaagaaaagggtgataaagatcagtaatgtggtgatttttttataatatctaagtagatgatgaattacaaaataacagtaatatcaatgccttatgatccttaaacagatcattcaaaatacaatacaataattatagtaggcatccatgaacatataccttgaaaagttatataaataattatgtttttatttcaagagtaactactaatagaatagatatagtagtagtgtgggaagtgtggaaatatttttaaaatattcaatcagtagaatgtagttaagcagacaaaaataggtaaaatatgacaggtaagaatacaatcaatcgactcgagcaccggggtctcctaacaccctcaaggacccacacaggattccccacgggatcctaagacatctggtgagtggaacacagcttctgctccactctgatcatgcggaacctgagactgcattaactagggaagcagacaacccaacatgagctggggaacaagtcccttccggtccactcgagcaccggcgtgccttgccagcggagtcccaagacactcgcaaggacccacacaggattccccatgggatcctaagaccactggtgagtggaacacaacttatgccaggaggcaggttcgaacaccagatatctgggcaccttccctgcaagaagagagcttgcctgcagagaatactctgaccactgaaactaaggagagagctagcctcccaggtctgcttatagaggctaacagagttacctgaggaacaagctctaaccagagacaactataacagctagcttcagagattaccagatggcgaaaggcaaacttaagaatcctactaacagaaatcaagaccactcaccatcatcagaatgcatcacacccaccccacctagtcctaggtaccccaacacaaccgaaaacctataccaagatttaaaagcttatctcatgatgatggtagaggacatcaagaaggactttcataactcacttaaagaaatacaggagagcactgctaaagagttacaggtccttaaaaaaaaaacaaaaaacaaaacaaacaaacaaacaaaaaaaaaaccaggaaaacacaaccaaacagatagaagtccttaaagaaaaacaggaaaacacatccaaacaggtgatggaaatg

SEQ ID NO: 3970 - DNA, 1000 bp, mus musculus
agatattttctttatttacatttcaaatgttatcccgaaagtcccctataccctcccccacaccctgctcccctacccacccactcccacttcttggccttggctttcccctgtactggggcatataatgtttgcaaggccaaggggcctctctacccaatgatggctgttcatattgttgttccacctatagggttgcagaccccttcagctccttgggtactttctctagctcctccattgggggccctatgttccatccaatagctgactgtgagcacccacttctgtatttgccaggcactggcatagcctcacacaagacagcaatatcagggttctttcagcgaaatcttgctggcatatgcaatagtgactgggtttggtggctgattatgggatggatccccaggtggggtagtctctggatggtccatcctttcttcttagctccaaactttgtctctgtagctccttccataaccctgattttgaaattctttcatgttgatcatgtttccttcttcattcctgattctgttgatgttctcgttttctctctctctctctctctctctctccctctctctctctctctctctctccttctctctcctttcctctcccctgtcccctccccttttcctctctcccctctctcctcttcctctcccttcccacatttaaattagttggtatcccagcaagttactttctagaaatggacacaacacttctaaagtttatgtacctagatgaaatattcccaattgccagcataatatctatccagaacacaattaggaaaaaaaaatgttaagactgttggacttttagtcttattatatagccacagccaccaacatcaaggaaatagagtcttgtaggaaacaataggtgattgatggaggaagtagaacagagattacagacacataactcctgtaaatataatcacttactttttgacaaaggaaaagttcattaaatggagtgaaaa

SEQ ID NO: 3971 - DNA, 1400 bp, mus musculus
acctaataaaaatgcgaaaaaaaatttttttctcattaaaaattatggaaatgagggggaatgaatggaatgaggaacagtcagagggcaaacccagatgaggataatgactagactataaaaataaatttaataataataataataatgatattctaaacattgttagttttcttcctgagatagaaatgtttaattaatttttacaaattactgtggattattttattttaaattttttattggttactttattcatttgcatttcaagtgttatctccttcccagtttcccctccacaagcctctatcccaccaatcttccccctgcttctatgagggtgctcccccacccaaccaccactcccacctcactgccctagattcccctatgctgggacatcaaaccttcacaggaccaagggcctcccctctcaatgatgccagataaggccatcttctgctcatatgcagctggagtcatggatccctccatgtgttttctttggttgatggcttagtccctaggagctctggagggtctgatattgttgttaacagggatgacattagctgaaatatccaacaaaggggagagagaacctgtagaaaccatatggagaggttgggcatggcccctgcttgagggatggggccacccacccttctcgaaaaatttaacccagaattgttcctgtcttaaggaagtacagggacaaaaaggtggagtagagactgaagaaaaggccatccagaggttgccctacctgggaattcatcccatatgcagccatcaaacccaatcactattggtaatgccaagaagtgcttgctgacgggagcctgatctgtctcctgagaggctctgccagagccttactgatacagatgtggatgcttgtagacaaccattggactgagcacagggaccctaatggaggagttagggaaaaaactaaagaagctgaaggggttttcaaccccatagggagaacaacaatataacataattttaattccccaaaattaatatatcttgagttaaatttaaacataatgctctctggagctattgagatttccccatcaacatcacataacctcagtctactgggctgtatgggtttctgtttctatcatatggtttttttttgttctaattaaagatccatacaaatatatttttacaattgaaacagtctttattttgctactctcagtcaaacaattgattcagaaataatcatcactggacgtttaaaacattacaccatatcattgtatctctgtgacaatgtggaaaactagagactgccatgacatcaaatatgcctgcaggatgtagttcagtggtacagtacttgcctaagataaaaaggacctgggttcattcttaccact

SEQ ID NO: 3972 - DNA, 1400 bp, mus musculus
tcatttacttggtgttctataggcttcttgtatctttatgtccatcactttctttaggttggaaaagttttcttctattattttatttaagacattttcagatcttttgagctgggaatcttcattctcctctattctgattattcttagatttggtctttttattgtgtcctgaatttcctggatgctttgggttagaaggtttgtatattttgtattttctttgacagttttttctaccatatcttctgtacctgagattctttcttctatctcttgtattctgctggtaatacttacatttgtaattcctgacctctttcctaggtttccttttccagatttgccttcatttgtgatttttctatcgtttctactaacacttttaggttttggattgctttattcaattccttcacctatttacctgtgttttcctgtatttctttcagtgagttattgatatcctccttaaatgactctattatgttcatgagataggattttaggacagattcctgattttcaggcgtgctggtatattcaggttttgctctggtaggagaactgggttctgatgatgcccatggattttggcatctgttgcttatggtcttgtccttgccttttgccatcaggttatccctggtatttgttgatctaggtgactgtatggagtctacctcttttgtccctgggttgcttcaggtctcctggaaggcttgtggccctggctgtatcagaccacctgtggggctgtccaactggcagctcttcacagaggcagagaaactgctggtctattgcctggcagcagtagacctcctggttggccttcagactgttgagtctttaggtggagtagtcaagttgttgtccaactgagctgagggcagctgatactcaactgctctgagtgcatttggtcctctaggatatatcgggatatggaatcttcatgggagcaggccaactaggagtctgccccagcagaaaggaccagactgaaagggtggaaaggactgaaggaatggtgagcatgaaactttctaacttgagctattttatcatttttatcattttaataattttgtgtacaatatttaattcatcaactcaataatatttagctgaatactctgtgaacagaaagaaaaaattgaaagattaaagctctaggctattctgtgttctcagaagaccttgactgttaataaatgttacaatggattttgcagtctactttctctgaatatttttccaggtagtgaaaataagcaatttgcttctcttgatttttgtataagaaaatatgagtggcaactgaaaagaaattcacaaaaaatcatgaaaacccagcaagggacatctatctccacttataagaaaaccagttttcc

SEQ ID NO: 3973 - DNA, 1600 bp, mus musculus
agttattttttgtagttgcatctgtattcatgcaaacttaatgatgacagtttttttttgaggttataaaactgctttaatggaaagtcccccctcccccaatacaccatctgggatggggtagatgtggccaagactggccccaggacaatactgagcctgtagtcgttaccaaaatatacatctgtcaccataaaaaactgctgcaccgcctcaaccccacaggtataaaatcataaatatttacactcttccatgcctttcacagaaccagggtgcagggaacccctcccacagaaacaggctaggatggaggtggctgtgcaggagggacattaaggcctagaggtcagcccctcaactgggcacagtaagaggcgggcagaaagctaaactttggtccaaaattttgaaggtagaaacccacaagtctcagagctttttatccagccctggcctgggcccacctgcaagttggtcactggaaggagctcaggggacacagaagctcagagtacacacatacaattgtatcattgctataaaatgttacttaaaactatatctcttgcatataaatggaaaacaagtggaaatattgctaggcacaggtgtctgtgaccacacggaatagaatacaaaggtcacaatgagggtcggcatctgaggatggtctagaccctctgggctggccagggacatgggagaatcatgtcacttgattataggggtgtaggggagtggccccagctcttgcacaagattggggagcctatgtataggccacctggctcacctgcaggtctagagacaactggtggccttagagggtaggtgtacggccatgaggcacgttggtttgtaaggcacagaaagaggctatgtttggggcaccgctgtggcctcatgcctgagcccctcaaggcatggtgctgggattgactgggcctctgtggtccaagccatttcctgccactgcagagtgggctagatttaatttttttaaaaacaggtaaactgatctctttttaaaaaaataaaatctctggtctataaggtcacttcagctgctttttaaagtggcttttctggaatggtggaagctgacgcaggcccacagacacctagatggtggacttggaaaaggacactcacaggtggtggttctcgcccaggtcatggttgtgcagttcaatcagcgcctacacagcctcctccacagagcccatctggatcagtaccatcttgcggtccttctggaagaacttgaagcctttgaccacaccaccattgctggagaagaggctcttgaggtcgtcctctgacacaaagggcgggatgttggagaggtgcagggtagctgagggtggaaagatgttctggaagttcttggagcctggtttcttgaagcggtgcagcagggagcagcggtcctggtcctcctgaccctcccgaggcagctgcacactctgatgcttggacagtgtgatgcgcactgacttcccgtgcttgtgcccgttcatgtggctcatggccagctgggcctggctgccgtctgccatctgcacaagcgcttctccttattgaacaggatcttcac

SEQ ID NO: 3974 - DNA, 1400 bp, mus musculus
ttgttattggcaagggtaacaaaccatggatctctcttcccagaggaaaaggaatccgcctcaccattgctgaagagagagacaagaggcttgcggccaaacagagcagtgggtgaaatggtctctaggggacatgctggaaaagtgtttgtacaagcctttctaggcaacatacatgctagattaaacagcatggtgaaagtaaaaaaaaaaaaaaaagaaaaagaaaagaaaagaaaagaaaagaaaagaaaagaaaagaaaagaaaagacaaagctttgaataatatccctgagctgcagaaccaatgatccagtttcttgggggttctttttccttgagaaattctcgctcgttcactgagtcagagttgccaagcatctgttaagccctagatcctgttctaggctgttgaacaaaatacaatgtcctcatagatcctcgtggagtcagagtctaacctggaatggcaattcattaaagatgagcaaggcaaggctactctatgtaaggaagcgtgtggagcgggcacggagactaaggagacaggcttttgtatccaattgaagacagggtgggttggccttgctaaggaagaaagattacactaatactataagaaacagaaagttctttctcaggctgtcagaattctgtcttgtcagccatgctcagaaaccgtttcttcctgcattgcagtttgctcatggttctgggtgaaagagactgccattttcctctacatcctccgcatgcctctgggagcacatgctgtcatcattgctgccaaagcctgaagaccttgtttgcttttatctctgtgcttgtatttagttggttggttgtttttgagacagtcttgtcttagatactgctctattgatttgagacaccatgatcaaagcaaagtggtagttgggagcttgcttagagttgcagagggttagtctgtgatcaacacagtggggagcatggaggcagacaagcaggcaggcatggagctatagcagtaactgaggactcacgtgtgatccaagagatccaggcagagaaaaactgtgactgggcatgatatgggcttttgaaacctcaaagccgacccccaccccaacctgttcccatcatcccccacccccaaactctcaccctcacctctcatagcacacgtccaacaaggccacacctcctcagtcaaagccacactcctccaccaaggccacacctcctccaacaaggccacacctcctccaacaaggccacacctcctaatccctcccaaaaagttttactacctcgggaacaaatattcaatatatgagcctatggtggccattctcagtcaaaccataagcctcatgtatcttaaatttgcttcaaacttgaactcatcatgatgtag

SEQ ID NO: 3975 - DNA, 1600 bp, mus musculus
gtcttaacttgtgaaccagaaagtcacttgcccacgtacaagtctcttccttccaagtaagatgtcagttccgtgggaggccttgggaacttatactttactcactcacaccctactcaaaatagaagtcggattccaagtagtctgtacactgaatcagtggtgtgggtgtctctcttttgttggggggcggggggtgtccatccccagggcagcttctaagagcaaatgccagaaaagtgtatacatgggtgggtgcaggaaatactgctgggtggtcagtttggatccaagcatattgcagataactatagaacaaaggaagcagttcgattggcctctctcgtgattggtttccgaggacacatccaacgagaatatgtaatcaattctggcagtaatggcagaaactagatatgagaaagtgtccttataatagtagttaacagcaccaaatggcaggctagccaggtaagaggttacctagcccttatctaatctgacgtaagccttcacattccatctaggccttaatattttacctataccttaacagccagcagttttgccctctgagtcatcgcacatgcatgtatagatcaatgaatacctttctctgtattcatttatttatgagagaccaagtctctgtacatggtgcaaaaacatacaagacagaccaggctggcctctcaaataagttctgcctctgcctctccccagtgctgagatcaagacagtgtttttctgtgtagccctggctgtcctggaacttactctgtaaaccaggctggcctggaatgcagaaatctgtctgcctctgcctacaaagtagtaggactaaaggcgtgcggcaccactgcccgacagtctattacttttaaatgccagatgaatccattcttttacattttcgggttggtttgttagttgattttatgttgttttcctggaggtgtggttgcctaccacctacacaagctcaggcacgagaaataaataagtaaagatctctgaaacacaaatctggggttggtactagctgaccatggaaacacatatacacacatggagtattaatttgcaagcagctacatcctcacctgtcggggagagggacatgaaacagtttccacagcctttttattggtggtgatggttatgattccttgtttatttctaagaatccctgggaaatatgatttctttgatctgtgtaccctagactaacacacacacacacacacacacacacacacacatgcacacgcacacaaacatggagtgagagagagaaaaataaggaggagtgacatgaattttaggaaaaagagatattaatggattaatattacttacatacagacagacagacagacacacacacattttcttttaaagagaattagagtagagctggggcagttgtggcacacacctttaacctcaggcagatttctgcattcaaggtcaccctggcttacagagtgagttccaagtcatccagggctatacagagaaaccctatctcagaaaaaaagaaaaaaaaattgaaaaaaagaaggaaggaaggaaggaaggaaggaaggaaggaaggaag

SEQ ID NO: 3976 - DNA, 1400 bp, mus musculus
gttctgattgtgtctgaagacagctacagtgtgatgacatacataaaataaatgagtaaatctaatacctctcaaaaaaaaaaaaaaagaaaataggtttgttcaagtccagtgatggtcctggctacatccaacaatggggacaccaaaattctgagcttccagtcatcttggcctatgtctaacagaggggtctccatgaagacactgtcactctggctgtggctgtgttaagagaaaaaaaaagacaaaaaccccccaaaaaactaggcagcatgtaaatttctcagaggttataaacaatactgctgggctgaggtcattcaatgataaggtacttggcatggtgaaagcccatgttccatgccattacacagattggacaacaaagtccaggaagatcccaggctttctctccaactcccaaggaagtaatttgaaaaaatgtgtaagcacacaggccagcctgcctccttgaattgcaggcaagaggatgccactaccataaacaattatgtggtagagaaatggaagagaaggagaagtggagaggtctgcatggtgtggagatgccatggcagtgaggaccaggcagatgtgaatggcctgtgctgccacctgaagccatgttgatgtatgagggcccagctaccactgggggccatactgatctggctgtcctgcactgctctaagggtaatgtcttggtactgtccctgttgacagtcaggtctggttcttccacagttgggggctgtgaagatgtccacagtctatgctgtggcctcaggccaagttgattttgtgggcagtgtttctacttgaagccatgatgatatctgaatcaggtctgagtagatgtccatggccccttataacaccaagggatatgtggatgtccatggtctgactgcagtctaaaagcacgttgatgtcagtgggctgtgctgactctgggggccatattgatatgagtgctttgcactaccacttgaggtcaagctgatgtgcaggctgcctccaagggtcttgtctggttctatggtcctacagcagctggggtctatgccagaaagcatgtagaagccccttttttcccattatctgtaaagaacaaggaagctacttttgcagtgatagtgacaattgatgatgtactgttgagagggagggacataaattgcttctgtgatacctttctccattccaaccactttcccaggaatggataacagcctaaacaggaagccatcaaagagaactcgtagaaagtatgataagagccaggcgtggtggatcacgcctttaatcccagcacttgggaggcagaggcaggaggatttctgagttcgaggccagcctggtctacagagtgagttccaggacagccagggctttaa

SEQ ID NO: 3977 - DNA, 1000 bp, mus musculus
tcccggttcgcccgcacctccacccctggcaaccccctatcccatcctccagttccccacttgtatgagggtgtttctccacccacccactcactcccacctcgctgccctcagttccccttcactggggcttttatcaagccttcacaggaccaaggacctcttggacggatggccctaaataaaacaggagcctagtgtgaggctgagtgccacggaaactcaggccagacagaggaaagcagagagctggccagagctgcatgggcatttcttgaaaagcagtgtttgctgttccagtctcccatttgatgctgtgtgccccaacatttcaaagaggctagatttcattggtctacaacttcataaagtctcaacaatgatctgtttatccaaggacatgaatagtaaaacttacgtaaacacaacttgactataacaaatactcaaagcattaaagtggctctgtaattttgtataaaatacaactgtgtttaaaaatatgattttgtaccaatttgtacactgctgaatacatgaatgtttggatgtggtgtgcgtgcatgtacacacacacacacacacacacacacacacacactagcgctcatatgcacaccccagagaaggaaaaggaaagctgaaatacaggatgtgagtagtggaggagcaaggaaagtgttgctttctatgttctgtgtgtgcatatgcatgtctgtgggcacatgtacatgtatgagcgtacatttaagtaggggccagaggtcatcattcttaggagtcatctttctttatttttatatagggtctcatgctaagacgtcaagctcaccaatgaggctagaatagctggccagagagtctcacagatcacttagtcctgatatttcaagcatatgccaccatacctggcatttcatataggttcttgggaattgaagtcaggccctcttgcgtgtggggctagcactttactggttgagccatctaaccagctcct

SEQ ID NO: 3978 - DNA, 1400 bp, mus musculus
aacattgataaatcaaaatgaaattactcttaaatagaaagagaaatggagaagtttgtcttctacatatcaaggctgactttgaacattataaagtgtgtacagaaattaaatacattagtgctggagtgatggctcattcagaaaaatgcttgccttgaagccatgaagactggagtttgaccccagaacccacatttcaaaagccagatatgttaacacaccacttgtaaatttagtgtcagggaggcagagacaggtatatccatggcttcctagcctacttggcagattacagagcagtgagagatcatgtcaaaaaaaaaaaaaaaaaaaaaaaaatgaaagcaaaaccccaaccagaaaaatgaatagcaccttaaaaataccaactaaggcttccagtcggcatcagccctgtgccaccttaggcacaaactctgcggtcatcccaaggtccccagaggattctccacgactctccaagccacaggcgccctagcacacccaggatcttaggatcactggtgagtggaacacaacatctgttctaaaacaacccagaggggcttgtgctaataggaacaggaacaaaggaaactcacctgcccaaaacctgcctgcccagcgactggggtttctttcagttggtgccagccccgtgccacgttgggcacgatcttggccaatggtcccatggtccccagaggactctctacatcacaggtgccctagcacacccaggatcttaggatcactgaggagagtcggcctccagagagggctctgatccagggactcaggtgagagtgcaatcttgtatcccaggtctcacagagaccagtctgcacaggagagcatgtgggccccagaagcaacagagcttcttggagagggtcctttcaggccttcatcctcagccaagcggcagagctgagacccagacctctgggcaccttccctgcaagaagagagcttgcctgcagagaatgctctgaccactggactcaggagagagttggacacccaggagtgctgacagaggctaacaggatcacagaaggaataagctccagccaaagacagctagaacatctaacaccagagattaccagatggcgaaaggcaaacataagaatcttactaacagaaaccaaaaccacagggcatcatcagaacccagtacgcctaacacagaaagtcctggataccccaacacacacacgaaaagcaagattcaaatttaaaatcataattcatgatgctggtagaggattttaagaaggacattaataactcacttaaagaaatacaggagaacactgctgaaaaggtacaagtccttaaagaggaagcacaaagacccctcaaagaattataagaaaatactgctaaacagg

SEQ ID NO: 3979 - DNA, 1200 bp, mus musculus
agatgtttgtggcttatatgaggaagtcaggtgcaagtcatatgacttagctgcagtccctggcgcctttgggactgccgccacacctgctcctaacagtgcatgtcctttttttgtgtctacagttcaagaactctttcttatgtataaagagacaagattcacagaaattgtggccaagtttattggaaatattagttatgttgctgttttagtctgacaataccttctgtgtctaaaaaaaaaaaaaaagaaagaaaaaaaaaagaaatgcagggacaggggatggagcaaagagtgagacaatggccaagcaacaactggcccaactagagacccagcccacagaaaaacaccattcccttacactattaatgatactctgttatacttgcagataggaaccaagtatggctgtctctgagaggctccactcaccagatgactcagacagatgcagacacccatagcaaagcattgagcagaactctgggatcttatggaagacttagagaaaggattgaggaccccttgagggataggaactgaaagaccagagtcaactaacctggacccttgtgggctctcagagactgaacctctaaccaaatagcatacatgggctagacctaggcccttgcacatatgaagcagatgtgtggcttggtcttcatgtgggtccagaacaactggagcagggctgtccctaaagctgttgcctatctatggaatctcttcccctaactcagctgtcttgtctggcctcagtgggagaagaagcacctagccatgaaaagacttggtgtactacagtgagggaaagctagggaggggctccacactctcagaggagaagagggggtgggggatgagggtagggactgtgggaagatggtccgggaggagagacagcaatcaggatctaaagagaataataataaagacatgaagttggaaggggaacatattgagggagatacggacaggagttgtaagggaaaatggtacataattttgcttatatttcattgtatatatttatgaaattctcaagattaaagaaatatttgaattactatagttgtgtaatggtatatggattaaaagaaggaattctgactttaaatgagatgactcatgaaaaaaaatctcttacataaaatggactatattccttacttacaaatcaatactactgtg

SEQ ID NO: 3980 - DNA, 1000 bp, mus musculus
tattccactcaggccagacaaagcagcccagctagaagaacatatcccacatacaagcaacatcttttgggataacccttgctccagttattcaggactcacatgaaggtcaagctgcacatctgctacatatctgtggggaggccaaagtacagcctgtggatgctctttggctggtgattcagactctgagagccccacgtttgctaagtatatagctgctgagtcttcggaattcctgtagactcagaaatgtacctcaaattagttctcttataaaacaatatggaactcaaatggtgacattattgccccacagtggtaaaattctgtgtatatttggagttgccaggaattagagtgttgtaacctcccctcagcctgaagcaggctgagccagaccttgactttgctaccactaaggagattacctagggtggagccttcctccctagatcactctattgtgctgtttctcatcaagatactgctaactgctgagaggccccagagctattccagagactacaccctatcctgcaagttatcacctgcagctggttccaggctccaaggatgaattggtgggaatgctccccccactccataagcacattcgccattaaacatttgaaccttgatcagaaccttgtcttggctccatttttctctcgtctgtctagtttaccccctcttttcagccctggtttgcctcccaggtgtaacccagttcatgttagccgcggtccggtttccaacaagtgtgagacagataactgacatctgaagacattcatggagagatgtaggaggggtgtcatatatctaaggcttggagatgcacccgtaatgctgcctcagttcagaccatacagctggatgttgtactatgtgtcaagcagacactggatgtgtgccagagcaggaacacaagatagggcatcatggcttttcatgtgtaagcttgtgttaagtacttaatgaaagatcagtcggcaca

SEQ ID NO: 3981 - DNA, 1000 bp, mus musculus
cctctgagcactgcttccacaatatcccacaatgtgtgataactgcctcattaccatgacaaaatacttgaggaaagcaacttgaacaggaaagggggatgtgaactagaacctgaagcagattctatttgctcccaccattaggaagcagtgtgagctgagcaccacccagcctgtcttctgccctatgtccagttccccaactcatgcaatggcactgcccacatttatgctgggtcctcctaacccaaccaaatctagaaaatacttcaaagacatgcataggagctcatctcacaggtgattcttgatctggtcaagttgacaaccaatactagccgctacaacatgcatgattttaatctgcactgaaggtttcctaatactcctctaacactgctcattaattacaaaaatcaggaaacagaattaaagcttgaaatacatataatactgcttttaaatctacaaacagtctaaggatcccttaatacccttgaggcacttttccatttccatttcctctcagttcgcagcactgtcctcattctctgtggctggtaatagaactaagcctcttctgcttccttgtagtttgacacaattttttcatctttgcaataaaaagggtggggacgtctctagtgttctcaaagttgatgagtgacgtttgattgttctgctcatgtttatgaaggagggaccatatccattataaaaggttactcttttttttttcttctatacctctagggtggtctttcttcctctgccctccatgaagtgactacaagtttaacttccctagataagctctcatgtttggaaatgtcagcctgttatacaaatgtaggaaggtagcaaaaaaataaactatgctgtgtctacccatgaagaaatgaggaagggttggctctgggcagcaacaaagaacagtagcagtactcatgattcttgtgttcaactaccactgcatttatccttgagagaagggctcaca

SEQ ID NO: 3982 - DNA, 3000 bp, mus musculus
ctattagagctcagtcgatgcaatcattgcctgctgctaaaggtccaggaagaccagaatgagatcatatgtggccaatatagaacagatgttttcaggcaagaatgatgttttgcaattgtgaaaaccaggatcctgctggcatattagggctaaacataccacaagtctccaataagggtaccaattgtgcaacatataaaatatcagtaaaaatattaaaagcatcattcacagactgaaagacattcagtattgctgttaattctgctaattgagctgagagaccaggagtcttattgattacctgttgattatttatttataagagatccagggggctggtgagatggctcagtggataagagcacccgactgctcttccaaaggtcggaagttcaaatcccagcaaccacatggtggctcacaaccatccgtaacaagatctgactccctcttctggagtgtctgaggacagctacagtgtacttacatataataaataaataaataaataaataaataaataaataaataaataaataaataaaaaagagatccagctcgctgtttagaggagcaatcagtaaacaccagaacagcattgtgtaagggttgtaaagaggtcatactaggaaatatcacctcatgtatgtttaaatattttgtcatcctatcttgagggtagtggctgtctatagttccttaaaaccctatttgagcaagcaaccaatctgtactgtactgctttagccaagtgtcttgacctacactgtaaggctaaacagtaatatctggctctttgtcaaaataagttagtgcctgcttccttccaaggataatcatctcagctactgcttcataatatggcaagatattacatttaggagaaatcctcgaatgtatccacattagaggagatttttgccataacaatcctgtaggcatatgaatcatattaaaaattgacagatgtaaaggcgaagagtaatctatatacgtgacaaattgttcttcaatagctttttccacttgttgtaaggacagcaatccttctgaggttaaagatctaggggaggtaggatcaaaactccctttaaaaatatcaaataaaggtttcaacccctctgtagtaagctttaaataggggcgaagccaattaatatcacctaacaatttttgaaaatcattcaaagtcctgaagttgtctctgcaaataactatcttctggggaaaaaaaaaaaaaaacagcttgattagtaagtctaaaacccaaataattataaggatcctgagtttgtatatttttcaggaactatctataatcctttatcagctaaagctttatgtaaatctctatagcacaaaaggaaatcctgggggtcttttccaggcaacccaggacaaattcttaactgtccaaaaacagtcttcttaaaagaacagtattttttcttatgagttgcataaccaattgcaaacttgagaattaatagcatctgagggatgaacaattttaagcaattgtaagctctgagatatatattgataaatatacaaattaaagcttgattattcaccattttaaagcattatctatagtatacaatttaattatgtgtgctgaagcaggacgaaactcagaagaataagcgtgtgatccaattcacatatacttttctcccatagaagggctgtttttaaacacagtaattgggatgcatgcatgcatgaatttatatagaagatacagacgcatgcataaaaacattttttaacttatctttggaataatgattgtcaattttatttaaaatgatggtattcaataggtcaaatattaatattctataataaccaatttaaatgctgttttgaacaaggaacagacactttgtcaggttcttaagacacaatttttgttataggttttctaaaatatatgaatttatcttacaattctttattagcaccacagcagccttagtaggatgttaaaactgtgttttgagatgaacaccaccttggccttgcccacctccagccctcctcccaggccatagaggataaagcagcccaatctgttgtaggccaggaagcccgagcaggggcagcagagcacctagcaggaaaagatacggccacccaggcagatgctcatgggagcaatggagcacacgactggtgcttcaggtcctccgctaagtttgctacaaaagcgcccactttctggcggcatcccatgccaccaccactcagggaaagaagcataccccatggtccctccccgcagcagccagcaggtggccagctccatgtgagccaatggtcggccaggaggagaagaaagatgactttccaataatgctttctcttgccaaggaattgctgtgggcacatttaataaccaataactaaaataggcagctaatatttaattaccattgattataattgataacaattataaaagctttctttaatttctgcaaagcttttgttctttaccagttaatttgtgtctcacttaatagcacctaacaaaggcttaaattctcctgtggtgagtttaaggtgaggtcttagccaattaacatctcctggaagcttttgaaaataaaattttgaagcaaatcaatttttcgttcttagattttctgtaccacaattttatagtataactaaaaccctaagtattaaaaagatattgcctctgcatcttttctggagcaacagctactccccagaacttaaaagctctttgtgtgagagcaaggatttaaagttaacttcccttgagaggcattagctactaaaatactttccacttaggaaacaatatacactgaaagattcaaactcttagcttcttgtattgaagcagaaacactaagaatttttcttacatgaggtaaagctatattagccatacccagtggcaaaattttccagtgattacaagctcactagaagcaaactctttacaattttccagatgca

SEQ ID NO: 3983 - DNA, 1000 bp, mus musculus
ttctcttctgagaagtgtaacccctaccttgggtactaacccatgctggcatatcaagagactgcaggactaggcaaatcctctccaactgaggccatacaaggaagcccagttaggggaacaggatccacaggcaggaaacagagtcagggatagccccctctctagatgctggggggcccacatgaagaccaagctgtatatctgctacatatatgcagggggcctaggttcagcccatgtatattctctggttgttggttcagtctctgaaagcctccaaaggttagttgactctgttgtggagtccctatccctctgagtccctcaatccttcccctaactcttccactagactcccgagctccatctaatggctggctgtagatctctgcatctgtttcagtcagctgctcagtggagactctcagaggacagttatgctagcctcttgtcttcaagcataacagagtatcattgctagtgtcagggattgatccttgctaatggaatggatcttgagttagggattgccctttccctcagtctatgctccatttttgtctctacactcttgttggcaggacaactttctagctgaatgcattgtgggtgggttggtgttcttatctcaccacttggggtcccgcctgactacaggaggtagacacttcaggctccatattacacattactgcaagtctcgcttcagagtcatcctcatagacaccctgaggctttcctcatccctggtctcaggcatatcctagagatgtggccctcctccacccccaccacaccaccatcactgatttccattcactctatcctgctcttcctacacctgttcctccatgctccccactaccctccctgctcccctctccctcccaggtccccctctccatccacttctgatgactattttatttccctttctgaacaagattcacacattctctcctgggcctttcttgttatttagcttctttggatccgt

SEQ ID NO: 3984 - DNA, 1200 bp, mus musculus
ggatgaagcatttttagtaaaacattttatataagacaaagcatccaaattttaacagatcattctttttattttatgagtgacttagagatcacatcctcaaactcagcacaaaaccttgtgaagaaatgtgacattttattgttgtgcttttgtttcagaaaactttgttttattcattttcttatctttgtctttaacaaattatgtattcatcggagatggatggagagagggaactaggttgaagagggagtaagaaggggaacagagatgaggattaggcaagggtagggggacagaacagggccaggagtgagaatagaaattggtgggggacatctctgggacttgctggaaaccttggccatggaagtctctgaggagtctatggagccgaccctagatgatttttaccactgaggggatattggaagtaacaacctcctgtaaccaggtggagggaggggacatcaacccatctacaaaactttcaacccaaaatttttcctggctacaagatgcacagggataaagatagagcagagactgagagaacagccaaccaatgactgacccaacttgagatacaacctgtgttagaaagacaatcactgacactattaatgatactttgctatgtttgcagatagaaacctagcatagctttccccagagaggcttcatccagcagctggtggaaacagatgcagagacccacagccaaacatcaggcagtgctctgggaatattgtggaagagtggggaatagaattgaacaagctggaggtgtctaggacaccacaaggcctacagagtcaattaactttggaccatgggagctcacagagactgaacctccaaccaaagagcatgcaggggttggacctagcccccctacatatttgtagcagatgtacagcttggtcttcttatgggtcacctaacatttggagactgactgtctctgactctgttgcctgccattggattcccttcccttaactggactgcctggtttggtctcagtgggagaggatgtgcttagtcttgcagggactgaatgtcccagatggtgtggcacccaaggggggggcatcctcttcttctctaagagaaggcatagcagtaatgggggaagggacctgtaagggtgggacttagaagagagaacagaaagggtgtaaagtgaataaataa

SEQ ID NO: 3985 - DNA, 1800 bp, mus musculus
tacccatatcttcgaggcttttccctactttctcctctataagtttcagtgtctctggttttatgtggagttccttaatccacttagatttgaccttagtacaaggagataagtatggattgattcgcattcttctacatgataacaaccagttgtgccagcaccaattgttgaaaatgctgtctttcttccactggatggttttagctcccttgtcaaagatcaagtgaccataggtgtgtgggttcatttctgggtcttcaattctattccattggtctacttgtctgtctctataccagtaccatgcagtttttatcacaattgctctgtagtaaagctttaggtcaggcatggtgattccaccagaggttcttttatccttgagaagagtttttgctatcctaggttttttgttattacagatgaatctgcaaattgctccttctaattagttgaagaattgagttggaattttgatggggattgcattgaatctgtagattgcttttggcaagatagccatttttacaatgttgatcctgccaatccatgagcatgggagatccttccatcttctgagatcttctttaatttctttcttcagagacttgaagtttttatcatacagatctttcacttccttagttagagtcatgccgagatattttatattatttgtgactattgagaagggtgttgtttccctaatttcttttttttttttttttttttttttttttttttttttcaaacccttgtgtcgagggctgactttcaatagatcgcagcgagggagctgctctgctacgtacgaaacccgacccagaagcaggtcgtctacgaatggtttagcgccaggttccacacgaacgtgcgttcaacgtgacgggcgagagggcggccccctttccggccgcaccccgtttcccaagacgaacggctctccgcaccggaccctggtcccgacgcccagcggagggagaccccgcgccgccgcggggacgatccctaatttctttctcagcctgtttattctttgtatagagaaaggccattgacttgtttgagtttattttatatccagctacttcacctaagctgtttatcaggtttaggagttctctggtggaatttttggggtcacttatatatactatcatatcatctgcaaaaagtgatattttgacttcctcttttccaatttgtatccccttgatctccttttgttgtcgaattgctctggctaatacttcaagtactatgttgaaatggtagggagaaagtgggcagccttgtctagtccctgattttagtgggattgcttccagcttctctccatttactttgatgttggctactggtttgctgtagattgcttttatcatgtttaggtatgggccttgaattcctgatctttacagaacttttatcatgaatgggtgttggatcttgtcaaatgctttttctgcatctaacgagatgatcatgtggtttttgtctttgagtttgtttatataatggattaccttgatggattttcgtatattaaaccatccctgcatccctggtaaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctatcttgtgaaaaagtttgtgcagaac

SEQ ID NO: 3986 - DNA, 1000 bp, mus musculus
tggagccatggtgaggtcacagccttagctgttgttgagggccacatctgagtctgtggctatgcagttgcaggggtcagtgttgatttctgtggttcatattaccactggagaacatgggggatagccctggtcaggtagccaccagggaccatgtggatacccaagggctgtgcatagctataaccatccctgcccttcactggatgcaggcttctggagaggtggcctaatttctcactggtgggagcattcaaaggtatgggcaagccagctctgagggcttgagtatgggagagctttgaccctgacactcatctgctatagggtggtgtgggtgtggaagtgatgctccttactccggtggttgagaaagccacccacagggttacgagctcaggggagctagttctgtcccttacacttgggggagtgggccctgctccttgcgtggatagcacagcagagctgtgctcatggctgggagagcaggcaatccaatcacgagggcaagagcttgagagagctggccctgctgctcagtctggtgtgagatggtgtgggtgccctccccacttacccctaaccccctgcagcagttgggagaactggcagtggggcaagtgagctgaccttgcccctctctgactgtagcactcaggagagcaggccctgcacctgggaaatgcagtagagctggtcctgatggagaaggcattgtgaaccagcagccccaagcacatgaaaagcaagagagctgtcacagtctcttgaaagctgtgacactagtggattctgaaccttgactggaccccacagtggagctggctctggaggtgtcagtgcaggtgagctggctcctgagggcatgagagcaggagagctgaccctgccttctgctgatggtggcctagcagtgctggagagcttgtccaagtggtgtggataaaagagagctgctgggctgaccagctcagttacctcccaggcccagatcgag

SEQ ID NO: 3987 - DNA, 1000 bp, mus musculus
gccggtacaagagtcagagacccactccttctcaaggtgaagagtctcctaaaaattctaagcttgtatctataatgcccatgcagaggacctagtgtagacctatgtagccatctgtgcttgcttcttcagtctctgaaagcccatatggaccttgcttagttgattcagagggctgtgtcctcccatctggctctgagagtcttttcatctcccatttcttgacattccctgagctctgatggagacttcccatttagactcttcacaaaatgtttggctatgggtctctgcatttgttctcatctgctacccaaggaagccatcctgataatgacagggtaaggcactaacttatgagtgtagaagagtagcattaggagttactttattgatactttcttttttcaaaccaataatccttggttttaccctgggtttctgggctatctaatctctagttctaggttcctgaagcagtgtcaggcatgggttccctcttgaggaaggggtcttaactcaaatcacacattgtttggctactcccacaggctctatgccaccattgctgctgaaaactatacaagaggaacaacaaatggctttagaactcatggaatgtggcccacaggttaccacagccacatgggtgagcctagaggactgtgtggtgaggacttcatgctggtgtggagttctgctctgcttgctgccctcacttccctcttaatctaagaattgtatgaaaactctaagggcttccagactctcactgggcagtatctctggaactcataagaataatggctgatctcttttaggcattgctgctggggcagattaataattcaatcaccacctagggtagaacttcaagatgtagattatcagcaatgaccactaccctttgaaaacatcgggaaaaataaaattgttaatgaagctaggttgagatgtttttactgctggctctgatttagacaaccttatggagcaattt

SEQ ID NO: 3988 - DNA, 1000 bp, mus musculus
taaaatgtcacccacgtcaatttactggtcctttgtttacttgatgctcaattaaacacaagccataaagaatcactaagttaaatattccttatagacatatcttattttttaatcccctcaaatctcagatcagcaaaagcagtggcatatggcttgaaatccacatcccaacctcttaaccacacataggtctcaaacaaaataactaatgaaagcagtggtcctgagcgctcagatgaaaagaaacatggaaactcagaatggtccaactactcttttcctacattcaagaacccaagccatctcaagaatggctcacttagctggctgatggttgcatgggagttgctacactgtgcccttctgcagccttgagcaggctgaacaggccttgagtgcttgccacaatgggctcaacgacgacccaggtggagtcatctgccttgatgcacctgcaacttcctacaggaacttagaagaatagactgtccactgagcttgtccaacataaaacagctgaaacaaaggatggattttgtggttttccctttataagctggcgctgcagaattaaattttgagcttgatcagaaccttgtcttggtttcatccttctctcccaccctttctgttcatttccagtccccctttcagataaactcagttctccatgaccactggatgactgcaccacacaagtatccacacctcaatttagatcctcacacaagtatccacacctcaatttagatcctcagaagtcatgcgcacccaggtgcagaaatgtgtgtctatgatccgaatattcctatgatgagatgagaggcagagcctggagaatctatagagattgggggactgctggtttggcacacaagctgaataacaaagggctcttttacaacaagggtgaggaaagggccaaagattggcctctgatctctacacatgtggtagcatgcattccccagtacgcaaagatacacaggcacattct

SEQ ID NO: 3989 - DNA, 1000 bp, mus musculus
gtagatttagcttttaaataagattacatttagttgctgtcttagttagggttttactgctgtgaacagacaccatgaccaaggcaagtcttataaaaaacaacatttacttggggctggcttacaggttcagaagttcagtcctttatcatcaaggtgggagcatggcagcatctaggcaggcatggcacaggcagagttgagagttctacatcttcatccaaaggctgctactggaagactgacttccaggcaactggggtgagagtcttaagcccacacccacagtggcacacctactccaaccaggtcacacctagtccaacaaggccacacctccaaatggttccactacctggtccaagaatatacaaaccatcacattccaagcctggccctaatagacttgttcaaaaacatgagtctatgggggccatacttaaacatagcataatgcaaatgcatttagtccaacttctaaagtcctcatagtctatatcagtctcaataatgttaaaagtccaaagttcaagggctcttctgagattcattcaacgtattaactgtaatctccaaagcaaggcaggaaagcagctgggcaaactccaaactctgcatctccatggctgatgtcaaagcagtcttcagatctccattcctttttcatctttgttgactgcaacaaactgctttttcctgggctagttctactccctgttagcagctttcctcagcatgtatcccatggctctggcatcttcaatacactggggttttccactccaactaggcttcaccaatagcctctcataggctctcttcatggtgccaagcatcaaatcctttgtctgaccccttcagtcctgggccatcaactacagcggaggttacaccttctccaatggccttcgattacctctcacagtgccaagcctcagctgttcttcatgaccccttcatgccttcaaaaccagtacctcctgtgtgactcttacacatt

SEQ ID NO: 3990 - DNA, 1000 bp, mus musculus
aaagaagactatgggagagtacaatggtagatttagcttttaaacaggattacatttagttgctgtctcagttagggttttactgctgtgaacagacaccatgaccaaggcaagtcttataaaaaacaacatttacttggggctgacttacaggttcagaagttcagtcctttatcatcaaggtaggagcatggcagcatccaggcaggcatggcgcaggcagagctgagagttctacaacttcatccaaaggctgcttctggaaggctgacttccaggcaactggggtgagagtcttaagcccacacccacggtggcacacctactccaaccaggtcacacctattccaacaaggccacacctccaaatggtgctactacctggtccaagaatatacaaaccatcacattccaagcctggccctaatagacttgttcaaaaacatgagtctatgggggccatacttaaacatagcataatgcaaatgcatttagtccaacttctaaagtcctcatagtctatagcagtctcaacaatgttaaaagtccaaagttcaagggctcttctgagattcattcaacgtattaactgtaatctccaaagcaagacaggaaagcagctgggcaaactccaaactctgcatctccatggctgatgtcaaagcagtcttcagatctccattcctttttcatctttgttgactgcaacaaactgctttctcctgggctagttccactccctgttagcagctttcctcagcatgtatcccatggctctggcatctttaatacactggggttttccactccaactaggcttcaccaatagcctctcataggctctcctcatggtgccaaacatcaaatcctttgtctgacctcttcagtcctgggccatcaactacagcagaggttacaacttctccagtggccttcgatcacctctcacagtgccaagcctcagcttttcttcatgaccccttcatgccttcaaaaccag

SEQ ID NO: 3991 - DNA, 1000 bp, mus musculus
tatttctttaagtgagttattaatgcccctcttaaaacttctgccaccatcctgagatatgatttcaaatctgtgtcttgctttttgggtgtgttggagtatccaggacctggcatactgggttctgatgatgcccagtgctcttggtttctgttagtaagatccatatgcttgccgttctccatctggaaatctctggtgttaatgttcaagctgtctctggctgacacttgatcctcctgtgattctgttagtctctgtcagcactcctgcgagtccaactctcacctgagttccagtggtcagagcactctttgcaggcaaactttcctctttcagggaaggtgtccagcagtctggagctctgatccaccacctgagtcctggggtcattgccctccctgtaggccgactctcatctggcaaggaaggtgcccaggggtctgggcctcagctgtgcctcctcattgaggatgaaggcccgacgggaccctgaacaagaagctctgttgcttcgattgcccatgtgctctcgtgtgatcaggaggtcctggttgtgctagggctcctgcggcatggagagtcctctggtgccctagacaccctcagccaggttcacacagaagatggggaggctggttccgatctgaatggatcccagcctcaggtcaggggggttcctctgcccctgttcctgctggtacaagaccctctgcgattctttggagctgatgttgcgttccactcacctgtgatcccgacgtcctttggcatagagagcactgtggagcccttggcggcctccgctgggttcagaaggaagatggtaggcatatcacattttctaaagtgagaattttaggcctaaaatgtacttctgtctctcaagcaaaacacagaaaatggattggacatgttgggaggtggaggcataggaaaatgttgattgaattaaatcatctttagatgatttatggaagaaaatcagacatgtttgaca

SEQ ID NO: 3992 - DNA, 1000 bp, mus musculus
ttggttctttaagaaaatcaacaagcagctaaaagagtctgatgtagatatttgtacccaaccaatggacagaagctgctgacaactgtggttgaattagagaaaagctggaaagagctgaggagaagagggtgaccttgtaggaggaccagcagtctcaattaacctggatctctgagatctctcagacactggaccaccaaccaggtgatatgaggcccccaactcatatacattagagggctgctgagtctttgttcagtcagagaagatgtacctaatcctcaagagactgtaggcctcagggagtttagaggtctggtggtatggagatggggacattctcatggagacaggggtggggtggggagtgggtgaactaagagggaataaaatctggagtgtaaaatagataaatacaataaaatatttttaaaagataaaatcaacaagactgacagattattatgaaaactaattaaaaggcagagaaaaagtatcaaaattggcaaaatcagaaaggaaaagtgaggcataacaatagacactgggtaaatccaaagaatcattttgtcatagttcaaaaacctgtactctacaaaactagaaaatctaaaagaaatggtttattttctcaatagatactacttaccaaagttaaatcaagaccagagaaataatttaaataaagatatagctattaaaaaatagaagcagtataaaaagtctccccctcaaaaagaaataaagaagaagaaagaaaaagaaagaaaaaaatcccagtacagaattcaacgagacattcaaggaagacctaatatctatactcctcacattgcactacaaaatagaaacaaggaaccattgttaaattcattatgtgcccacattcaccctcacaggtaaaccacacaaagattcaataaaggaaaaaatatatagaacaatttctctcatggaccttgatgtaaaattactcaacaaaatacttgccaacaga

SEQ ID NO: 3993 - DNA, 1400 bp, mus musculus
aacacaaccaaacaggagaaagaattgaacaagactatccaggataaaaaaatggaaatagaaacaattaagaaatcaaaaggaggagacaaccaggatatagaaaacctaggaaagctcctaacacaaaacgtccaggaaatcgaggacaaaatgaaaagatgaaaccaaaggataataggtatagaacagagggaagatacctaacttagatggccagtaaatatcttgaacaaaattatagaagaaaacttccctaacctaaagaaagagatgcccatgaacatacaagaagccctcagaactccaaatagactagactaggaaagaaattcctcccagcaataaaatcaaaataccaaatgcacaaaaaaaagaaaggatattaaaaggttataggaaaaaggtaaagtaaaatacaaaggcagacctatcagattacaccagacttctcaccagaaactataaaagccagaatatcctgggcaaatgtcatactgtgaggaagcgcccttgcaatcgccattacaagatggcgctgatttccggtgttctaactagtaaacaagtagtctgcgcatgtactggggtatttttccattccttgtaccatgcctgtcccgtggcgtcatctgggctgatagtgagcagccggtcagggtgaaatatgtccccaaacgctcttgtgagctatttaaggaccgagtttcctgtgtcctgggcctcctccccagaagctgatgacctttctctcaagatgcattaaagctatgctgcagaagaacccgtgtgtgtccttgctggcgagactcccttatcacacagatacatctggtgccgagaacccgggaacgccacaacatcgctggcattgagaagttcccctggaaacggggcaggtccagaactgcagtggaaggtaagtccggagagacatgtctggccttgagaaagcatgccagaaactgaacggagcaagataataggagctcatgaaaaaaaaaagacatgtctaaggaaaaagaaggaaaaaggacctacctggacattagaaaaaaaagggggagtgaaaaaggagaaaagagaaaaactaaaagataatataaaatataaagatacaaaggataatataaattataaagataaaaagaataatataaattaagccaatttaccctcctctcgaggactttgactaaagaggcagccttcattaaaggcttaaagatagctgtcaaggtcactatgcctcctctctatttcctggcagtattccctgaagaaggagataaggaagtagagtctgaacatgagggagagaaaataagttttaaaaaagcagttatcccctgtttgagatcttttagcaaaaaagagaaaaaatgaaaataagctatttt

SEQ ID NO: 3994 - DNA, 1400 bp, mus musculus
tctcagcctgtttgtaattggtacaaaggaacattactgatttatttgaggtaattttatgtctctcaacagaaaaacgtatacagaaaatacacatttacataatggagtactactcagtgattaaaaagaatgactccatgaaattcttaggcaaatgaatggaactagaaactatcctgagtgaggcaacccagacacaaaagaatatacatggtatctactcactgataagtggatattagacccaaacctcacaatgcctatgatacaacccacttagaagaaaggaagaactgtatggatgcttcagtcctttattgaggggggaacagaatgattgtgggaggtgaagggaaagggggtcctgggaaggagggaggagggggaggcagtatcaggcactggaggggatgtgagagaggtacagagggtcaggaaatagaataaaaatatctagcaggaaagatgaggaactggggatagccactggagggttccagacaccagggaaatgtgaggttcctaggagccaatggggatgactttagcctaaatgtgcagagaacatgtagattgaacctatagtgactacctcctatagataagcatggcccctggttgagggatggggccacccacccatctcagtttttaatccagaaatgttcctgtccaaaggaagaacagggagaaaaaaatggaacagagagtaaggaagggccatccagggactgccccacctggatattcatcatgtccacagactccaaacccggcatttttgatgtggtcaagaggtgcttgctgacaggaacctggtgtggtggtttcttgggaggtccaaccagcaactgactaattcagatgtggatgcttcaagtcccccatcagactgagctcaggaaacctcatgggagagctggcagaagaactggaggagcgggggtagggggtttgttgcaatcccattggaagaacaacataggcttccctgaccacccagttctcccagagagtagaccaccaacaatagctctagatacagatgcagcagaggatgatcttgcctgacagcaataggagtggaggcccttggtcctggggaggtttgagagcccagtgtagggggatactggagcagtggggcaggagagggtggatgggtgagggatcaccctcatacaggtaaagggaaagggtgaggggggatgttggatgaggcattggtggagggataaccgggaagtgggatatcatttgagatgtacagattggaatgattaatatatgtatataaaatcgggtcaatttccacccaagccaaggttaaaggcccactcatctacggatgacaaaatcatttgatcacctcagttaagtgttgccttatttaactt

SEQ ID NO: 3995 - DNA, 1000 bp, mus musculus
tctgaccactacaaatgaaagctagacaccattgtggcatcattgagatatgagaacaagatattgaggttatccactctcaagtatgtactcactgataagtggattttagccccaaagctcagaatacagcccacaaaaactatatgcagtttaagaagaaggaagaccaatattgtatatgcttcaatcctacatagaacggggaacaaaataatcacaagagctagagggatggaaggacctgggacagagagaggaagggaagggaaaaaaagggtcaggaacaggtattggtagatacaggagagaagtacagagggtcgggaaattgaaacatgtagccatgggggatggggaactgggagtagccactagaaagtcccagacttcagggaagcaggaggcttccaggacccaatggtgatgacttcagctgaaattcccaataaaggggagaaacaacctgtagagaccacctctagttgataggcatgatcccagttgagggatggggtcacccacacatctaaaaaattttaactcagaaatgttcctgtccaaagaaaggatagggacaaaaatggaacagagactgaaggataatctatccagagacttccctacctagggatccatcccatctgtagacaccaaaccccatcactatttctgatgccaagaagcacttgcagacagtagccggatatggctgtttcctgagaggttctaccagcacctgactaatacagatgcatatactcacagccagccattggcctgagcctggggaccccaatggaggagctagggaaaggactgaagaagctaaagtaaattgcaccccaataagaggaataatagcaacagacaaagagaaaactagattatgatgataaataggaaagagatggacaagaaggtgggaatattggatggacaaatatcactaaaggccacttgaaaagccacatgaaaacctattacctctctgaagaaa

SEQ ID NO: 3996 - DNA, 1400 bp, mus musculus
tttcagatcttggatggttttgttcaattccatcacctgtttggttatgttttcttgtatttcattaaggacttctacctctttagcaacattctgctgtatttctttattgagttattaaagcccttcttgatatcctctaccagcatcatgagatatgattttagatttgagtcttgcttttcgggtgtgtcggggtatccagaactagctgaggtgggagtgctgggttctgatgatggtgagtggtcttggtttcttttagtaaaattcttacatttgcctttcatcatctggaaatctctggagttagttgttatagttgtctctgttcggagcgtgttcctcctgtgattctgttagcctctgtcagcagacctgggagtctagctctctcttcattctcagtggtcatagtactctctgcaggcaagctctcctcttgcagggaaggtgcacaaatatctggcattcagacctgactcctggctgaagatgaaggcctgaaacagggcctttcccagaggatgtgttgcctctgcagtctgcacactcacctgtacagactggtctccaagggacatgggacacaagatggctttctcacctgctctggtggtcaggcccctccctggcagacacctctcctctggcggggaaggtacctggatgtctgtagctttaaatggggtctgtcccagaagctgtgtagcttctgcctgtcccagaaactgtgttgcttctgtagtctgctagctcaccctttgcagtctgtgagctgattgcacagactggtctctgaggaacccaggacccaagatggctcccccaggtgctctggcaaagccctcctgggcaaggcggactggaagggaaggttcccagatgtctggagcccgaaaagaggtctgtcccagaagctgtgttgcttctgcctgtcccagaagctgtttcacttctgtggtctgcactctcacctgcgcagactagtttctgaagggtccgggtcccaagattgctccctcacctgctcaggcagagacctcctgggcagacacctctcctctggcaaggaaggtgcccggatgtctggagcccgaaagggggtctgtcccagaagctgtgtagcttctgcctgtcccagaagctttgttgcttctgcagtccacttgctcacccttagcagtctgtgagcttacctgcgcagactggtctctgagtgatccgggacccaagatggctccctcacctgctctaaggctgttctttttaaatgaaagacagaaggggagtggatccagatgagacaggaggtggggaaaaactgggagaaatagagggagaagaaactgtgttcaaattatattgtattagaaaaaaaccctatgtttaacaaaggg

SEQ ID NO: 3997 - DNA, 1000 bp, mus musculus
actctccagagtgctgcaaccaatgaggggcagggatagttttctacgtctcataatcttggggccagctctccagactactaaacgtgatgaggggcatgggtaggagtaggaggaaggtatcacccaaacccatgcacctcatagcagatgagtgttggagctagctctcgtgtggtcctgcccttggggccagcttacctgtgcccctgtcactagggccaactctactgtgttgcccagggaaggtgcagggcacactcaccagagtgctgcagccagtgaggaacatggacctctcttctgctctcatgacccaggggccaggtctcctgatgtctgcagatggagagggctgaggagaggatggagatcaccacttctgtgcctcttggcagttgagtgggggagggagcagctctcacaagctcacacctttagggccagctctccaaatgtgctgttcaggcaaggtgcagggtctgctctccaaagtgatgcagatggggagaggtgggaccagctatgaacaacccttgtacatctatgtggttctagacagcagcccagaccagggatgtccacacggtctttggtggtaatatgaaccacagacattaagacagacccattttgctgcatgacaatggtcccagacatgacccttagcagcagcactggctgggacttcatcatgacctcaaaaggcaagggttaatactcataacaggcaattcctctctaccctcgctccagttcatctctcttcataatgctcagactgtcctgcctttctttctctcccatctgttcatcacatacttgcacattgtagtggctcctactgcaggcctctaggtgtcttttgatcacctgcaccactgtgtggcctgggatggatccccgggtatggtagtctctagatggtccatccttttgcctcagctccaaactttgtctctgtaactccttccatgggtgttttgttcccaattctaag

SEQ ID NO: 3998 - DNA, 3400 bp, mus musculus
ggattcctagcttaaagtctcagctagagctataagacagctgaaggaggtcaaggaaatacagataggaaagtaagaagtcaaagtaatcttatttttagatggtattattttataaataaaaaaacccaaaagattataccaggaaacttatacagatgatcatacttttagcaaagtagcaacacacaagatgtacacacaaaagtgagtagcttttcgtatatacaaattacaaacatactgagaagaaaaccagggagtctgtacttttataatagcctcaaaaatatatcttggagtaacactaactacacaaaggaaagacatatggaataaaaactttaaaacactaaagaaaaactaaagaaataattgcccaataaaatacatgtgatcataagaagaaatgagattgaagggaaaataaatgaattcagaagaacatcaagttaatgaaacagatgatgtcatatttgaacacattctgtgcctttttgttttgtcctatgttcatctctaagataaacagggtcctgttgcttgcccagaaaccacagtactgggcaagatgacggttcacactgtacaaagcaacccaactgtcagtaatagtgacaaagttagaaacactgttcctctggatccaggcccacaatttctgactcttgcttcctgctttaactgatgtgatttccagaaatggaaaaattcccagtcatgaggccacagccatgaacagaggccagctttcattactgttggagtcagttctaatgttcatgctgcgtttacccttgagccagtaataaagatggagctgtggtcttgggttgggtgtgtgaagtaggatgctaagtggtgtcttatattatacattagactataaatcaagacatctgggagcagcaggggtcccaaaatctatacagtcctcagagaagaaagaacatttaagataatcccttacagaagagaaaaacattaaatacattgaacacaattaatgtttgttttgacttacttgatgtcttgtgaattttgtactggggactaagaatcacgtgtaaccatgtagaggacagacacataaaccctcatgcaaaagttatgtaactatgagcattttgacaatgtcattttatatctcatccacatgctttcgtggaagataattagagtatttttaacaatctcatatttataacatgttccaataaaacatgcactagtgaaagaaccacatttcagtaacattatttggtaaaatcaaacatttcctagcatcacctgataagtttaggttttttgtgctcttgattatactaaaaatattacatggatagtttattgaaatcaaacctcagtaagttcaacatatttagtttatgaatctctaaggtttcctttagtttctattattgttctctccctcattttctcttatacaatctattaaatgcatttcctaaaataatcaggtgatgagttctactacccttccaagttggctggttctgactctcgggtatcgtttaacatagtcttgaacttcctgtatttactctaaggtgataatcagagggagctttattagatttcatcttaccttttgccattaatatataatgagcatcccttctaagcaatgctacacagtgggagtaaggcaaaagatagcaactaaaccacattgctatcaatcattataaaagtccccatggatatacatttgatggctttagcatgcaacatttattattttctaaatccagtttctcattggggttgtaaaactcctatctaattctctcattccttctgcgtttagtaggtggaattctgaaatacatgtcactttgaaataaacttcatgctctacctaaaatggttccatttctttattagcccttttcccataataataacatgatagaagtttctaaaagagtacagtgttgttagacatcacgtagctttgcataatgaagatatttcaagatgtccatcattatttcacatactaaaatgatcccacatttagcaggaacatctatacagactaatgtgactattgatgtcttctcatagtgatccagacctctgtcctgtattctagatggacactttcaacactagagtctaatctgaaagaggtgattaccccaggagtccttggtaacccttgtatgagaaacagtattttgtgaatactatctagatagatcctcacattgtatcttaaaataaaacaaagcaaaacaaaactggttgtttctagactatcttggaaatttatgctgatcttacctaaaattgtctattaaaacacaaatatgtagaaagaaatggcttcacacatcctcgccagcatctactgtcacctgaattttcgatctggcaaatacagaagtagatgctcacagtcatctattgggtggaacacagagcccctaatggaagagctagagaaagtatccaaggagttgaaaaggtctgcaaccctataggtggaacaacaatatgaactaaccagtaccctcagagctcctgtctctagctgcatgtgtagcaaaagatggcctagtcagccatcactgggaagagaggccccttggtcttgcaaacgttatataccccagtagaggggaatgccagggccaagaagtgggagtgggtgggtaggggagcagggctgggggcagggtagaggggacttttgaaatagcatttgaaatgtaaatgaagaaaatatctaataaaatttgaaaaaaaaaaagaaatggctttgtggaaacaatataaaccttgatcctcttgtaatgttattcctaaaaagaagtcaaaactgttgaacacttgacaatagaaaacagaagtcaatgaactgctgctttacagcatataaaaaaactgccttgttatgaaaaactgacaaaattgtataattagccacaaatgcacagctggaagagaagggggcatgagccagagtgaacagcagttatatatgaggatactacaggaccaggctctactggacctaacttgaggactccctctccttcatcagcccttcatttccaagcatgtgccattccctgaggagtggattacagactgaccttgaaggtgctggcaaagctccttttccttctttcttttggcagtgtagcttgatacactgtttgtatggaaaacatagatgtcacttaaatttatctctttttggtttttgttttttcagttttatatagttaaacttttcctacaataagaaaggttttcatgggtgacttaggcagaaaagaaaacataaatttgggtcatatgtagctgccagattaaatattaaaattatttaagttataaattctttgaaaccatgattactcctcaa

SEQ ID NO: 3999 - DNA, 1400 bp, mus musculus
tcccaaagagaagaagcggtccatgattttaaggcatttattgtagaaaggcagaaagagggagagagtagaaaagtagaggccatggccacgtggaggtgggagaggaatgtgaagagaaaggagagcaagggatcgagagacaagagtaagagcaagggagtaagagaaggaagaggggccaagcagctccttttatagtgttgccaggtaactgtgcgaagcatacctggctattgccaggtaactgtggggtggattccagacagaataccaggagcttggggcattgccctatatgactgatggccacacaactctctctgaggttggggggagctgtgggaggctgtagctgcagcaggagtcaggggcccaaggagcgtggccaaacacttgccattccttgcctgcagaagtcacctaccaggtctctggggctcaaagcctgtactcaaccagggaccatgctgcctgttcaaagctcaccgccccatgataaagtgcctgaaacttaacacaaacatgttgcttctagtaaatttcttgctgaataagactaattttagatatacgcttaatatattaaatgttgccagtctgtgctggtgccctgagcagatcatgggtactagtaccacacccagtcccacaacacctagaagaagctgactcccaggcaacccaacatgcccaggatcataggggaggaggccacatcatctgccccaacacagggaataactgggactatctggatccagggacacaggaaccctggcctggccagtggcaagggttccttccagtctgaacacatgcactgagcagacactgggtgctagctccacacacagtcccacaactcagaggaagctggattcctagttactctaacacacccagggtcataggatcacaagatcttgggagcttggccacaccaagatctcaggatcccagaagcagcttgacacccagaagctcttacacacccaagatatcaggatcacaggattcccagaatcacgggatcacagagataactggactctgaggagttctgacacaaccaggatcacaggagggaaaggctccagtcagagacagtgagggcaggtagcactagagataaccatatggtgagaggcaagcataagaatataagcaacagaagccaaggttgcttggcattatcagaacccaattctcctaccatagcaagtcctggatataccatcacaccaagaaggcaagattcagatctaaaatcacttctcataatgatgatagaggactttaagaaggacataaatataagtatatacaagtagaagcccttaaaaaggaaacacaaaaattccataaagaattatagaaaaacacaaccagacaggaga

SEQ ID NO: 4000 - DNA, 1000 bp, mus musculus
gtaataggataaatttgactttttgaaaaggatgctaatgtctttcatccagaactcttgccttccccaaattaatgcattctgtacaatttttccccttaactctttatacaactgctctcaatttccccttttcttgaagcactcccctccatgtcactttgacaattttttgacttttatgagcattccaaatgaaacacacatatctgaagattcaaagctaatacccacaaatgagaaaagacatgagatagttgtctttctaagtctgggttacctcactcagggagatagtctccagttccatccatgaaaacataggaatttcattattttacttttcttaacagctgaatgatatattcaattgtataaatatatcacaatttcataatctattcatcaggtcatgggcatatatactgtttcaatttcctgattattaagaatgaactaaaatgaacttgataagaaggtttctatgatgtagagtccagtagtgtcacagctctttggaaggtttttatctagaatattaaaataactaaaaaataaaaaataagagtccacaccaatacaaaaacaaatcatacagtcaaaatgggggatagagacaaagaacaaaagcagaatacagaagagtgagaaacaatgaaaaaaaatgtttaagaccctcagccacaagaaaaatgcaaatcaaaactactttgagatttttatcttatcccagtttgaatggctaagatcacaaacaagccaaaacaaatggatggcaaatggatgtgataaaagggggcacttagttatggttgctgcgagtacaaactagtggagccactatgaaagtcagtgtggacattcctcaaaaagctggaggtaaatctaggaagaaaaaatgaaaaatcatgttctctaaggcaaacatgagatagaaaaaaaagtccttcttctattctgcagttctcctgaatctagagtgcagtggatttctaggtct

SEQ ID NO: 4001 - DNA, 1200 bp, mus musculus
ggatgggcagcagcaaccacagcaggagaaagcagagcctgtcctggacggggctgctgcccgggctttctatgaggctctaatcgcagatgacagtagttcctctaagccccagagagctgaacctatgagggagaggaagaagaagagaagagtgactagggagcctgcagcagcaggagtccccagacaaggaagagcacttgaggatgaagacaggatagcccagcggatcctgctggcagcccagaatggggatctgacagaactccggaggctgctagaaccccaagaggcagtgggagctggagggaatatcaatgctcgtgatgccttctggtggactcccttgatgtgtgctgcccgagcaggccagggcgccgctgtgcgctatctcctgggcggaggagctgcctgggtcagagtctgtgacctgggaggcagagatgctgcccagctggctgaagaagcaggcttccctgaggtagcccgtatggtcagagagagtcatggagagacaaggagccctgagaaccagaaccgatctaccccctcctcgtcccagttctgtgaggactgtggtgcccactttgaagactccaaccactgcacatctactgctcacctgctgtcactgtccaggagaccccagccctccaaccttccccttggggtgcccacttccagtcctggcttcaggctactgctgagaggtggctgggaacccggaatggggctaggaccccggggtgaaggccttgccaaccctatccccactatcctcaagagggaccaggaaggattgggttatagatccccaccccaaccctgagtcacacactttgcagcgcgggatacccgggctgtgtctggaagagacagagtccctcgagttgccactctgagtcagagggagaacagaaatcgagaagaaaagggcagagcctgggagcgagatctaagactgtacatgaacctcaagttctgactgatacagactggccctggtctgtcactcgctgggcttgggcctctgacttggacacttggacttccgaacccttaggccttggctgttgggctctgattttagagagaagggcggagagttgggagataaaaaaaacttccttccttgtgaaaaaaaaaaaaaaataagtaaaacagataaagccaaaagccaaaacagtacaagtgtag

SEQ ID NO: 4002 - DNA, 1000 bp, mus musculus
tcttggtccatattcctgagaacctacctatacttttaaaactacaaatatttattgtgatgaccaataattttttgtgggactgataaagtattcacattacttgaagtattaatatatatcctttcaggacaatacactaacatttaagattttgaaaacacacaggaaaatctccactgttgtgttccagatataaaggaatgcaagaacttattgaaaagtgaccactgggacctggaagagcaaacaagttgcaaagctccctgcttcatattctctgcccatcctcacgtggcataccaggtcttggggatatccagacgtctgaatgcaagctgcatttgaaatgatccaaaagacttgggcttgcccagaataagaggggacattcctgcacacttccccatattgttccataaaacctggactcccaaacaaattgctttactgaaaccctgcgactgagagatgagatgttctggacattggtgagttgtcatatctgcgaccttcaagcctccatgtgaagggagagcacagggaacagatacacctggaaggatagtccacaaatgcctgacgttaatgtttagaggccctggtgagagccagaaggctaggattcctcagtattacttatgactttctcattgtccataactcttagactccactatccaacaaggagcaaggtgaggcctctaagctcagcctaagtaccctgcagcagttctctttctggttttctgtccttgttccttatcccaaatctatcaaggcagactcttaggagctcccaatactccctattaccctaaacgtagatcccagtttaagcaaagtttaagcaattgttcaagaccatttcagtgtccttcccattacaggcaagataatgttctcttccaatgctgtccatgttctaatccctgaatcagtggattctggaggtgaaaaggtacttgcagaagtcataatgctaaaggtcttgagatgg

SEQ ID NO: 4003 - DNA, 1000 bp, mus musculus
acattttcagagagttctaagcatattacaaaaagcagtcatgaatctgttaccaattctcctggccagtgagagtttgtcaagtatctctatgtttatcctgtcccattcatactgtttcagtttgcttgggggaagataccctgagaagattcctagactcgtggcctcatctgtgcttatcacagtctccagggcatgaggatgacttgcaagtagggccagataaagttatttccctaaaagcagaagagatagtaatttcacgactcttcaaaaagaactcagacataattttcttaggaagagacataaaatgaatcataatgcagaatgccccccaaaatgcagcacacagagaccaaagcataaaagtgagagtggacatttggctcatcgctgctggaactatgtcaaacctctgtgctggctttatagctttcgccatttccagtggatatggctgtgccaaagacccacactgcaaacagagataatgtcaacattaagcaagctcgtggataacaaagtgtataaagtgctgctgtgcaaaatgaggaaggcaaatggactaagagtcccacccctggatcaatgcagcagcaggagaagacctgctcaggaatagcaggttaccagcctggttcccagagacaggaaggaagggcctagcagcctccatttggagctggggaaacccatgcagtcctgggcagaaaagaaccaaaaaagtaactggcagcatggagtcctacaaaggtggggcgtgggaagggaaggatgggagaacagggaagagtttagcgaattcagaaaatgggacagcccctctggcacttattcttgcagaaacttttaacgcaataaagtgtcgttaatacatactatgccctgtgcttagagccaagttaacaacaacaaaaataaatgcattgactttgtcatctctgcagatgattttttcaaggaagatgtggagctaattctaacagttattgcc

SEQ ID NO: 4004 - DNA, 1000 bp, mus musculus
gttactctatctataatgattccagaagctcatgaaagacaaacaatatgccaagaaaatgtgtagcagaaaagtgaggaagagcatgaaaacacagcacagaaaacaaagagacagagtagggaggaggaaagactgaggggtccctgacaggagggctgctgtcacccggaagcttggagtcacctatggctgctttctacatccagggaaggctgcaaactgatttacatacatagctggctgatgtttaataaaacataaactgtttgccaacaaggtagctgatcctgtcgacctcgtggaaaataagggatgtcatttctgcttccctggtagaagcagccatggcaactgcctgacggcatgagcaaaagttactggagttcttctgacgtctcacctatgcctttccatcacacttcctcttctgcaggagtccacctctcctatgttcctgtgtatcctctgggtcatttcttcagaaacccttgcttgttgctgtatgcattcttggagcttctcgaatgatttatgcatatctgatagccatcctttccttggttcgttaatcctcaatttcactccgtacttttgttatttgtatacttgtttttaactttgattgcttttaacatagctttagtgctctaatagtggatatgagttgttagctaagcgggtgaaataaagctgaagaattcagtgaccttattgcacgttgtcttgataggctccggatttactctagaccagatgtgaggaacacagaagcaatctctggcccctgagaaagctctctcagggtgcttagcatcctctctgtctgtgcagcaattaccggtcctggcctgggaccccttctctgtctctgattggtcctaaaggaccagcaagaagccttgtctcaaactccaatccccttacctctcttattttcctacttgaaaactcttctttgatctcttttggtcagacccagagtgctttccctgttctg

SEQ ID NO: 4005 - DNA, 1200 bp, mus musculus
aaaaggacaggcatggtatgcactcactgttaagtggattttagccaaaaagtaaagaatacccacaatacacctcacaaaccctaagaggttagacaagaagccagacccaagtgaggatgcttcaatcacatttagaaggaggaactaaatatcatggggtgagaagagggagaaagggccctgagtaggagaggggagagggaggagaaaatggggacaagatcagatttggtgggagtcaggagagaagcccacagggccaggagaatgaatggaaatatgtggctgctagagtcggggaatggaaggaacctccagaaaatcccagagacccagaatgggggaggctcccaggactcactgtgggtgactttagctgaaatgcccaacagtgaggagatggaacctgaaaaaaacacctccagtagttagacagtgcccccagtggagggatggagacaccaacctaccttcaaatttttcgacccaaatttgttcctgtctaaaggaaattcagggacaaaaatggagtaccaactgaaaatatgaccgaccagtgactagctcaacttggaatccatcccatgagcaggcaccaaaccatgagaacttactgatacaatgctgtgctgtaggcaggaacctaagctgccctctgagaccagcagctgcctaagacagatgcagatacttaacagtcaatcgttgaactgaggtcagagacccctatgaaagaggtaggggaaggattgaaggaactttagtggatggcaatcccataggaagaccaacagtgtcaactaacctggacccctgggagctcccagagactaatccaccaaccaaaaagtgtatgcgggctggtcggaggtcccccgcacatacggagcggaggactgcctcgtccggcctcagtggaagaggatgcacctaattctgtagagctgatgtcccaaggactgggaatgtgggcagcatcctctcagagatgcaggggagaagggatgggggaagaactctgggagcaaggactgggatgtaaataaataaaatagttaataaaaaattttaaaatcatagatgccatgttaaagtttaaaacaaactaaactggaagtcattctataaacatagagcattttgtttattcttgtttttcagaattcttgagttacatcaagtcacttatttgtgacc

SEQ ID NO: 4006 - DNA, 1000 bp, mus musculus
ggttttacaacaaatgtctaggtagctacaaagcaatttacttatatgttcttcttcatatttatgctgactgcagacattttaggcttagagttcacattaaatgaagaaaccatagcagtgtaaacagaacagaacagaactaatgactgctaaagagataacattagaactggagctcttctaagccaaaaatgcagagggtgggtataaaaagttatgtttgctccgctcccttgtgatacaatgagacaagaagtctcttcattgctcccttcatgtccttgttcctcaaagtatagataaaagggttaagcataggagtcaccaaactgtagaacagagacagaagtttgttcttgtcctgggaattagaagatgagggttgtacgtacatgctaattactggtccatagaaaagagtcacgacaacaacatgagaaccacatgtattaaaggctttcttcttgccctctgaggaacgaatcctaagcacagttgctacaataaacccataggaaataagaataagtgacaagggaaccagagagtagaaagtccctacaatggagagcatagctatattgaatgcagtgttagcacaggacatcttgatcatcaccgggacctcgcagagaaagttgtctactttgttgtttccacaaaatggcagcttgacggtgagggttgattgaagcaaagagttagccaagccactcagccaagccatggacacgaggaggatacagagttgctggtgcatgatcgctgggtaccttaggggcttgcatatggcaatgtaacgatccaaagacatcacagccaggaggatgcactcggtagcccccaggaagtgaaaaatataaaactgtgtcacacagcctccataactgatggatttatctgggccccaaagattccgaagcagctgagggatggtggttgtggtgaaacacaggtccaagaaggagaggttggaaaggaagaagtacatcgggct

SEQ ID NO: 4007 - DNA, 1400 bp, mus musculus
gatgcagaggaggaggaagagataaacagaagatagagagatctcctatgctcatagatgggtagaattaatatagtaaaaaaaaaaatcctactctggaggatatcatcttgagtgagataacccaatcacaaaagaacacacatgatatgcactcactgataagtggatattagcccagagactcagaatacccaagatacaatttgcaaaacacatgaaactcaaggagaaggaaaaccaaagtgtagacactttgatccttcttagaagggggaaacaaaatacccatggaaggaattacagagacaaagttcagagcagagactgaaggaaggaccatccagagactgccccaccgggggatccatcccataaataaccaccaaacgcagacacgattgcagatgccaataagagcttgctgacaggagcctgatatagctgtctcctaagaggctctgccagtgcctgactaatacagaagtggatgctcacaatcatccattagacagagcacagggtccccaatgaaggagctagagaaagtatccaaggagctgaaggggtttgcagccctataggaggaacaacaatatgaactaaccagtaaccccagagctccctgggactaaaccaccaatcaaagaaaacacataatgggactcatggctctagctgcatatgtagcagaggatggcctcgccggtcatcaatgggaggagaggctcttggtcctgtgaaggttctacgcctcagtataggggaattcctgggctaggaagtgggagtgagtgggttggcgatcagaggggcgggggagaggatagggaattttcagaggggaaactaaaaaaggggacaacatttgaaatgtaaataaagaaaatatctacttttttaaaaaagccatcctacataaaatcatcaatagattcaataaaatccctttcaaacatccaacacaatctttcacagattttgaaaggacagttttaatatggcgggcgggggggggggggaggtgtaggggaaggaatagtttaaacagtcctaaataataaaagagctgctggaggatcgccagcattagtttttttgttttggggggttttcaggggggttgtttggttgtttggttggattttttttgtttgtttgtttgtttgttcatttgctatgttgggtttttattttggttttggtttggtttttggttttttggtttggttttgtttggttggtttttgtttgtttggtttgttggtttggtttgatttggtttgctctgctctgctctgctctgctctgctctgctctgctctgctctgctctgctctgctctgctctgctctgctctgctttggtttttttcgagacagggtttctctgtatagtcc

SEQ ID NO: 4008 - DNA, 1200 bp, mus musculus
ttcctctgattctcgttccattcatttatatatgcccagccaattcacaaagcccaaggtttgcactgaccccgtctaccttccccacatcatatgtagaagctgggaaaccctgcaggtcaacacctgcagcatttttcacacatatttactttaactttcatatctctcctcctttgtttggtattcctttcttattagcaacttgagtagtacaatttctagaatttcatttgacagcaaagctttataactccaatttctacatcttgatatgttaagtttttgtagtaaccattatgtgatttccatctaaatgaatgtttacttggtatatttaaagatattcctcagtgttgagtcaaattgtgtaacctttcccaataaagcctgcagttaaaggtgaataaccaaaagatgtcctgaaaaaatagtcctgtgtgaaaaatttatgtaactaccaggttgcagccagggtcaatgccctgtagaactctgggatgtttcctaggagagtgagtagcaggggactgtgatcccattggatgacttagagcctctgtgaccacaacatgggacctcagcacatctaatagagcatgcagcaaacttgtactagctgttgcttcagagagagatgggagaaggtgattaatgagttgttaagtgctgccctgaaatgaatgaagtttttgagttattggttcttaatctgtctgtatgcagtagcatacaataggttggcacacacagttgtgaggagggactctctgatctaagaggtcatggtgtcatttgcctctgtgaggccttgtgagcagcagttgtcagtttgctttacaacctcctttttgattttcttttccaacctgtttgtcaggcagaataatttgttctacatcagtccaagctgattccaggactcagacctcttctggatgttgctatttatgtttaaaagctccttttttatttctcaagtatttatggtaaggtaagctttgggcactttttctagaatctgaggaatctggatgcttcagtggctccttcctgctaacctcacaggattgccttaaatgtctttgtccttctgatctcatacctgatctttaggaaactagccttgttgctggatttcttttaggtggcttcatgactccagaaatttcagttattccttttcaactgcccctgcac

SEQ ID NO: 4009 - DNA, 1000 bp, mus musculus
acctggacagtcccttatacttaaaaaggttgatatcccttcccatcggtgccagcaccaacccaccttgggcacagagtctgctgacacccccaaggtcctcacaggactctccacgggatgttaggacctctggtgagtggaacacaactgctgctccaatccaattgcatgggacctgagacagcattaattagggaagcagaaaacctggcctgaccagggtcacaagtcccttccactaggcaccagcaccagcaccagcaccagcaccagcaccagcaccagcaccagggcaccttgggtgtggagtctgcgaacacccccaaggtccccagaggactctccacgggatcttaggacctctagtgagtagaacacaacttctgccaggaggcaggttcgaacaccagatatctgggcaccttccctgcaagagaagagcttgcctgcagagagtactctgaacactgaaactcaggagagagctagtctcccaggtctgctgatagaggctaacataatcacctaaggaacaagctctaaccagagacaactataacaactaattccagagattaccagatggggaaaggcaaacataagaatcttactaacagaaaccaaccactcaccatcatcagaacgcagcactcccaccccacccagtcctgggcacgccaacacacccgaaaagatagatccggatataaaagcatatctaatgatgatggtagaggacatcaagaaggactttaataactcacttaaagaaatacaggagaacactgctaaacaggtagaagatattaaagaggaagcacaaaaatcccttaaagaattgcaggaaaacacgaccaaacaggtgacggaattgaataaaaccatccaagacctaaaaagggaagtagacacaatgaagaaaacccaaagtgaggcaacactggagatagaaaccctaggaaagaaacctggaaccatagatacgagcatcagcaac

SEQ ID NO: 4010 - DNA, 1000 bp, mus musculus
agggcaccgtacatggtcagcaagcccactgccaactcagctgtagcccagaaccccaattttctgtatcagtggcttttcctagttctgaagtcaagggctcaacaagaagcaccttaagggaaaaagtgttggcttgaagttcgaagttactgtctatcttgatggggaaggcatggaggcaggactgtgaggtggatagtcatggcatgttgctatttaggaagcagaaaatggacatcaagtgatcaacttcctcccacaaggctctactccctaaagtgtccacggccttctaaaacagcgccaccagctggagatcaggtgttcaaacatttgaacctgttgggaacatttcacatccaaaacacaattatcacagaactccagaacaacctcagggtgagatggcttaatcccagctcttgggaggtgaaggcagcaggaccagtattcatgaacatcctaagctacaccaggttaggaactgggctgggctagataagaatctgtctcaaaatctgaaaaagaaaaaccccaggaactgagacttaagttatcgctgagtgggaagcaggtgtgaaggagcgagggggaaagcgtctgatgacacagactggctattcaattcctctccacctcgcactgtcccctgctgttcttagttgcctaactttggaggtgaactccaaaaccacctagtcagaagcagatgaggtaaaggccagaggtcacaagcaggcactgagagctgcttttctgagggctggagcaatgactaggtgattaagagtgcttttccagaggaccggagttccaggtctgtcagcttacaactgcttggaactccaggcctcgtctagcctggagcactcctcttaacgcaaccacctgcactcatgtgcacatgctcacacgcagatgtccataactgaaaataaccacgaagctgcttttgctgaagagcccaaggtgactcaagcaggaccagagcctgcaa

SEQ ID NO: 4011 - DNA, 1200 bp, mus musculus
ttagccttttctttaacttgtggaaaaatttaaacataaatttaaacctcaagtgtattttgttattttattgggtagcttgtgcttctgagactagactgataatgaatggagagtaattaaaataaaccataacattcttattaaaagttcaatggtaatgactcatactataagtcctggagcaatggcaccatccaggaattttttgtgtgggcaactggaagatgaatgaaaggaggaagtgcctgggagaactcatctgcacctagagcactgccaaggtgtgggcagacagcaaggtagtatgcacacatcccatcccctacctcgacttctctaggcaatcaagattgctgtggcaatgcagaactggtacagagtgaccaatgggaccttcactggggagaccagccctggcatgaccaaagagatttagcagtcacctgggtagtgctgggccactcggagacaaggcacatctttggggagtcagatggtagaaagtgatctatgcagtgattgcctgcatctgggagaactaggtgaaaggaaacctggcatcaccaagatggttgtttttgagcaaaccaaggtcaccacagataatgtgaagatggactggaacaaagtcatcctggcctatgaaccatatgggccattggtattggcaagactgccacacctcagcaggcccaggaagtacacgagaagctacagggatggtaggattccaatgcctgatgcagtgactcagaacaaccacatcttttatggaagttctgtgactggagcaacctgcaaagagttagcaagccagcctgatgtggacagcttcctcctgggtggtataccttttaagcctgaattggtagacgtcatccatgacaaacactaagcaccacccatcttccctactcacctgctaagccaggttacccagaggcttagtaaccgctcccatcagtcacatgcttctgaagatgtcatctgccctgtcgtgtgacccaatccacattgtgccttcctgaaccttttataagtccctgtaatggttcctgactccctcccctccatgacagggtgttgataagcccaatttatatcttgatgtcttgcttggagtctggaagtatctctgtaggctttggttcctgccaggttttcagctcacttgaatgctgtgcagatttctttcca

SEQ ID NO: 4012 - DNA, 1000 bp, mus musculus
cagtttccaggtcaatgtggagtacagaggaagttcaaggtcagctttacatagagagagccagtcacaaaaaaagggcttctgatgtagcgcagtggttggatgcttgcttagcctgaacacggtcctgggtttgatccttcacacctcctgtgtgccgagattatgtctagcttgagtttgtgcgggtcttgtgcatgctaccacagtctctgtgaggtcatacgtgcatctgctctgctatgtctggaagacattctttctttgaaaccatccattgcttctgattcttacaatctttctgcctcctcttctatgtagacacgttagcttcgaaatgagggatataatataaacatgtcacgtaggattcagggtctcaaggtctccttttctctgagtgttgatgagctgtgggtttcagtgttgactgacgtctaccacaagaagcctctgtgcaggaggagcatcacactgatctaaagttctgcttccaactccaggttcagattccaagtctcagattgtcgtggtgggtggggcagctccagctaagaattctaaatcacagcacactcgatggaaacaaacaaataaaaaaaattgaagaactatggtttacaagtttggaaagttattttcatgtgtgtgtgtctgtttgtctgtctatagggtacatgcaggctgaggcagatctacctggagctggattaagctgtaggatttggctgctgggaaccgttcatggatcctctgcaagagcagcttgtgcttgcacccatggggccacctctctagctcaggagaagccgttttaatgaccattggcaacattagtctcaggacacacaccatggagagaggtggaaatttggatctgtttggctatgtttctttttttttttttttttttcatttttttttattaggtatttagctcatttacatttccaatgctataccaaaagtcccccttacccacccacccccactcccctac

SEQ ID NO: 4013 - DNA, 1000 bp, mus musculus
atttcaaatgttatcacctttcctggtttctcctcgggaaagcccctattccatccccctccccctgcttctatgagggtgttctcccaccactcccacctccccacactggtattcccctacactggggcatcaagccttctcaggaccaagggcctctcctgagatatttttaacctttaatttttttgtttggtccatatccataaggttgtgagagttggctgctgctattcatataagaatattttaaagtattccaggtcatgaaatatgcccatttatagacactggctgtcttgattaattaacaagactggtactatattgactagtagtctgcctccattctctcatcatttttgtgtttatgcctctgtttgtgtatgtgtttgcatttgtgtgtatgtacatatatgtgtatctgtctgcctgtctgtggatatgtcgtatgtgcacctgtgtatgcaactctatatgtatgtgtatatatgtgtagctctatgtagcctcccccagcctgaagtgggctggtacagacctagtcaccactgaggtggggccacctgcggtgcagctttccaacttggctggtttcttttgactggctccttttgaagtgacaactgctatgagattctgccacttagagtctgaacctgtcttcctgagatgttcctgagatagctgactacctgtggaactggcgacttactgctaacagctctggcagactagtgctaacaacttggcaacaataaggaagcctggcaaccgagtgctgatggaatggctccaggcaccaagagtggactggcagagggatgggccttccccccttataggcacagtctcttaataaacttgagagccttgaacagggaatcattatctctctcgcagtctaagtctttttcagccccagcctgcctcccaggtatacctggttcaagtaggccgcggcatacgacagctgtatatgtgcttgtgtatgtgtatg

SEQ ID NO: 4014 - DNA, 1400 bp, mus musculus
atctagcatttctcaagagtacacccccaaactacctatgtcttttaacagtcattgtaagttgtgtgtaccttgaatatacttgaggcaacagggactccaggtagcttacatatttgctcctgtagcttacatatacacacaacggcatgccatcctactctttctaaaatggcatggttattgagacatttgttagatctcacttccaggaagtaaggacagaggaaactagaaaatttcatcctgtgtgaggtatcctagatccaaaaggacatgcatggtatatattcacttataagagcctataaccagaaatcacatgatacccatgcgaccctctacagattcaagttaatcaaaaaggaaggtccaaaggaggatcgtaaatctcactcagaaggcagaataacatagatgtatgaagtgtatggatggagtgaactgggtaggcaaggggatgggaaggggaatgggaggaggccttcagggttaagtgctgtgagggtcaggagagatggccaaatggccatgtgaatgtaaatctgtaactggtgagtaggaaggtagggacacctccaggacatgaaagagacctgggatagggaaggtacccaagaatcaatgagggtgacattatctgggcctcccagcatttcggatatggaacttaaatggccacctcctgtactcaggcaggaaccacagtggaggtatagggacaccaacccacccacaaaacttttaaccccaaatttatcctatttacaagaaatgcaggcatgcgagatggagccaagatgtagggactaatcaagcaattagtggcccaactagagacccaccccatgaacaagcacctgacactattaataatgctttattatgataatgacaggagtctagcatgggaatcctttaagaagctctacccagcagcgcagacagattcagagacccacggccaaacagtggatcgagattggcaactcatgtagaagagttgtgggaaggactgaggtcccgaaggggattggaactccaaaggaagaccaacagagtcaactatcctggacagttgggactctcagagattgtaccacaatctaaagagcatacatgggccggacataggccccgcagacataagtagcagatgtgcagtttggtcttcatgtgggtcctgaacaactgacgcaggggctatccaaaaagctgttgcctgtaagtgttctgactaggctaacttgtctggcctcagtgggagaggatgtgactatcccctcaagacttgatttttcagagctgggggttactcagaggataaggggaggaggagaggaagagaagagaaggaatatgggaaggggggacctgaaagtgagtagtgattggatgta

SEQ ID NO: 4015 - DNA, 1400 bp, mus musculus
attccaaacatgatgacatgagatttacagacaaatggatgaaactgattgaggtaacccagacctcaatggatatgtattgtctgcactctcttataagtggatattagcctgaaagatctggatataatacaatccacagactcaaagaagctaaataacaaggaaaacccaaggaaggatgttagaatctcactcagaagaagaaatattgtaactgtaggaggtggatggatggatggatggatggagccaggaaattgggtgtggaaggctcaaacacaaggcctaggataaagaatagaaatccatgtggagggacatctcaaggatgtaacagagagttgggatgagaggctgcagggagtctacgagggtgactccagctcagaatcatagaagtgaggatatggatcctgaactggttacttcttgttcccagttaggaatcccactgcaggaataagggcactaccctacccaaaaaaccttggacccaaaatttgtcctaccaacaagaattacagggataaagatgtgcagagaatgaaaaaatgatcaacaagtgactggcataaattgagatgcatcacataggcaagaatcaatccctcacactacttttgatattctgttatgttacagacaatagcctagcataactgccctatgagagacactgtccagcagctgatggaatcagatacagagacccacagccaaacattagatggatttcaagaagtcccatggaagatttggagaaaggttgaggaaggtggaggggataagaactccacaggaactataacagagttagctaacttggacctgtggggaatcccagagtttgaataaccaaccaaagagcacacacaggctggacctagccccccactgcaggaatgtgggaaatgtgcagcttggtctttgtgagggtctcacaaatattggagttgaggttgtctctgattctgttgcctgtctgtggatcctcttcaccttactgggctcccttgtctggtaaaagtggaagaggaagtgccgagacctccagtgacttgaggtgccattttacattggcacccaaggctttatcccttttaagaggagatgaggaggggaataggaagggccttcttaggtagggactgctaagaggaaactactgtaatatggatttaaggtgaataaataaattgaagacaaaaaagaaacaatactttcatttcaaaaataaaataattactatgataagtaatgcataccttacaagcacattcccagtagaattcacgttaccactagcagactcaagggaacctaatgactctgataccacatatacattcatgagcatacattcacatttgacacacatacatattcctacaaacaca

SEQ ID NO: 4016 - DNA, 1200 bp, mus musculus
gcttttccagtgtgttgggcaatccaggacttgctgtggtaggataaatagattttggtgatgccaagcagtcttggtttctgttttttattttcttgtgctcgcatcttgccatcttatctctaatgctacctgcccttgctgtctctgactgtatattgtgcatcctgtgatcttcattgtgtcataactcctcagagtccagctatctctgtgatcctatgattctggactcctgtgatcctgggtatgtcagagctccttggattcaagctctctctgggatcctgaaatcctggtatgaacaagcacctaagatcctgtgatcctgggcaagttagagcacctggaagttgatcttcctctgggtgttgagggactcagtgagaagccagtgcccaaggtttacttggggcaccagctcagagtagaaggaaatcatgtactggccaagctgtggttcctgattccctgggtcttggggggcccagttactcctggatttggggaagatgttttggcttcctcccctgtgaccctgggcatgtaagagcatctgggaattgagcttcctctgggtgttgtgggactgggtgtagagccagcacccaaggtcttggcaatattctttcataacctcagtcttaacaacaggagcagcaagtccctactgaatagaaacagtacccactaaaaatagttgattcacatttctgaggtttcaagactcatcatctgaaggaaggggagtagcaatgtttctttggctatatgaattgttccacttaagctaatgtggtaatgaaaacttctataatgtgaaaatttaaatgaatgtcttgctctgtagttgagagaagtagcaaaacccctcattcttttctttcctttcctttcctttcctttcctttccttttcttttcttttcttttcttttcttttcttttcctttctttctttctttctttctttcttcttttttttgttattccctccatgtttgtggaatatcacagatatcagacaattaagttcattctcagtactctgcagatggtttcatgtattgagagtttataactattcttccattcccaggtgctgcaagtgtttataatgatttagctgaatatctcaatatctcctagttgcagtttgaacactgtcttgacaagaacaacacagttcatttctatgctt

SEQ ID NO: 4017 - DNA, 1000 bp, mus musculus
agtatgtgtgacatacagtttttatttgtacacattaggcatgaatcaagagtaatatacaaggactctccacaagatttaggaccacctgtgagtggaacacaacttctgttccaatccaatcacatgggacctgagacagcattagggaagcagaaaacctggactgaccagggtcacaaatcccttccagtcagcaccagcaccgggtcaccttgtgtgcagagttggcagacacccccaaggtcctctagaggactcaccacactatcttaggaccaccggtgagtggaacacaaattttcttcaaatcaaatcacacgggaactgagacagcactagggaagcagaaaacccagcctgacaagggtccaaatcccttctggtcggtgccagcaccaggtcacctgggctcagaggcggcggaaacccccaattccctagaggacagcttctgaggcagaccccatttcggactccatacatctgggcaccttccctggcagagaagaggtgtctttgccagagcaactgggggagccattttggttctcagatcctctgagactagtctgctctggtgagagtgtggactacagaagctaacagctactgtgacaggctgaagcgaaacagcttctgggacacttctgtttcaggccttcatcttctgccagaaggcaggtccgaacaccagatatctgtgcaccttccctgtaagaggagagcttgtctgcagagagtgctctgaccactgaaactcagagaagacagctagtcttccaggtctgctgatagaggctaacagaatcagaggaacaatctctaaccagagacaactataacaactaactccaaagattaccagatggtgaaaggcaaacataagaatcttactaacagaaaccaagaccactcaccttcatcagaacacagcactcccacctcgcccagtcctggggaccccaacacaagcgaaaagctagacacagatttaaaa

SEQ ID NO: 4018 - DNA, 1000 bp, mus musculus
caacccacccactcctgcttcctggccttggcattcccctatactggggcatataaccttaacaggaccaagggcctcttctcccattgatgaccgactaggccattctctgcgacatatgcaactagagccatgagctttttcattgtgtcctggatttcttaaatgttttgagttatgaacttttccctttttgtaatttccttgactcttatgttgatgccttctatggtattttctacacctaagattctctcttctatctcttttattcttttgaatctttgcatccttgcatctgttactctctttcctacatttttccatctccagggccatctcctttcatgttttctttaatgtttctatttcaatttttatatcctgggatgttttgttcaactccttcccctatttgattgtgttctcctgtatttctttaagggagctatttatgtccttttaaaaagtcctctatcatctttataacatgagaatttagatctgaatctttccttataggtgtgttggggtatccagaacttgctatggtgggagaactgggttctgtggttgccaagttgtattggtttctgttgcttatgttcttgcacttacctctcaccatctggttatctctggagttaactggcctctctgtctttgactggagcctgtccttcctgtgagcctgtgatgcctggtcctggatgtgtcagaacccctatgaaggcgagctgcaattgggttgtgtgctgtgtgtgttttgattcagagcagagtctctgctcgaagcacaggtgcaaaccagaaggcacaagggactttgactgggccaggtatctgggccctggggtcccaggagacccagtacaccagatattgggatggggtttgaggtataacctgtgatccaggatgtgtctgaatacctgggaagtcaagctacatctggggtgtgagccatgtatgtttggatccagagcagaggtctgctcca

SEQ ID NO: 4019 - DNA, 1400 bp, mus musculus
ttaataggaaaaaaggacaaaattttacatgatccccaaaagtaatacagaataaaataaccaaaaatcaatatccaatgtccttcttgacaaaaacactccatataccaggcagcaaagggaatcaccacaacataattaaaaccctagacagaccactgcaaccaatggcaaaaagaatgaaaagaatcttcctttcagagctagactacaggcccatgagctagcactcagagtgacaggcaggaagatgtcaagtgtgaatctagactgagaaacatagtgaaaccctattttaaaaataaataaattaaattaattaattagaacttccagagcagcaataagcaaaggagaaaatgatgacagctccaggcactttattctatatggtgctgagaagcttggcaggagggctgcaaagcagcattccagccaggaaagcagggagcagcattgagagtcttcctctctctccctcttcttgtctaattcaatcccccattctcctcctcagctcctaggctgaccaccatcccagcctttcctccctttcattcccccacctccaggagaccacacagatcttcctttccaaacactcgtttctcctcgaggaaatctggccgaagccacttatcatttttccccagccccaactccagcaggcactccatgggaacttactcgacactctggccaagcaaataggtaagttaactgcaaaccctcctattttccctcctttcctctgaatccaatctcctgctctcgccccacagctgtgtagcaggccactgctgtggcttcctcctcctctcagcccccatctgcagtgaagaataactgatcttctcttctaaccttccttgccacacatctttgttatcccagcttccagctctagcataaaatccctgggcacctgccagctaaatgtgccacagaagcagagaggccagcccaaggccctaatgtcacccttagatctatgacagactagctgttgtgacctctcctcactttctggttccattcccaggggtctaagcagatcctgggagaacatactgttctcttcttacctgaggaaaccctcaccactgccaaagcccatcccttttcctcactgtcaacccccaatactcagaaacacatttgacccaaaacatccaatgacctcacctaacaggatcccaaaatatctccccaatagactttgtgcttacaatgcccccactacctcctaagaatcagagaagtcaacagaaagagaggaacaaaacagcctcccaaaacaggcacaaccagatatcaacatctagaattacaatctttccaagtcaagatgccaaaacaaaagtatatacacaatacaagtaggacagaatgtctctact

SEQ ID NO: 4020 - DNA, 1000 bp, mus musculus
gcgcctccctatcttctgcccttctgacatgggttaaatgttaaccagatgctctgctgttacctcgatctgcacgtatagtttgctgatgtttaaacggtccaattgtgtgaagccacgccaattcttcccctacccccactcttttcctatataaacccctaacttttgagcctcgtggtcaatatctctgtctctagcgtgagatacatgtcagcctggagctccgtcattaaactaccttgtgtgtttgcatcaagatggtctctcgtgattctctggtgtgtgttatctcatgactcgggtgggggtatccccacggaggtctttcaagatcaagtcaggatccagggactggattcaattcttaaaggtctgcttctagtgacctattttggccacctatatctggtctaccttgtaaagatttggcaaacctcaaaatagcaccccaactgggggaacaagtactgaaaatactaggttgggtggaacattttggattcataactggaccctagcactttccctccctgtctgcttcctgactgccatgggctgagtccctttcctatcataagctcttccatgatgggctgcattgtcacaggagaaacaggcccctgatgtgtactgaaatctccaaaactgtgagccaaattcaaccttcacacttcttaccccacttcttttcttcagtgttgaaacatagctgaaacccaggtttcgctgtcctgactagtatcatattttgacccatgagcaaatcaagtgttggtcccccttcagcaatgtggcatattggctctttgtctatgcttctcaggtctcttatctggctcccccagacttcccgtaacaccttgaatgtgtagtcaatgacaagatcccccatgttctcactctcagctttcccagtgcacactgcttcacacgagcctggatcttcacttatacgactatatgtgttttctccacgatgattcataaattaactggt

SEQ ID NO: 4021 - DNA, 1200 bp, mus musculus
ccccccatcccataatatcccacttcccggttactcctccaccaaccccgatcccacatctgccctccccccttcctcttgcctgtatgagagtgctcccccactaacccacactctcctgccccatggctccagcatttccctactctggggcatcaaatatccccgggaccaaggacctcccttcccattgctgtcaggcaaggccatcctctgctacatatgtatctggagctatggatctctccaggtataatccttggttggtggtctagacttcgggagaaacaggtagtcaggccagtttatgttgttcttctaatggggttgcaatcccgctctgctactccagtccttctgctagcacccccaccatttcctgagttcagtctgatggttggctctaagcattcttatttgtattggtcagttgctggcctgacctccccaggaactgccacacttggtttctgttcacaaccgagcgccccttgaccacagcaacagtgttgggtttggtgtctgtagacctgatgtatctccaagtgagccattctcagttgggccttcctccagtatctgttccatttttgtccctgttcttcctttggacaggaacatttctgggttaaacaaactttgaggctgggcggtggtggcacactgctttaatcccagcacttgggaggcagaggcaggtagatttctgagtttgaggccagcttggtctataaagtgagttccaggacagccagggctatagagagaaaccctgccaaacaaacaaacaaacaaacaaacaaacaaacccaaaaactttgagatgggtgggtggccccatcccttgaccaggggcagactgtctactggaggcagtctccacaggttctatctcccccttctctgcacgttttggctaaagtcaatcccgttgggttctgggagcctcatgtttctctggtgtctggaaccctccagtggctatccccagttcctcatcctccttgttacttattgttatttgatttcctgactttgtgcacccatctcacatctcctccagtttctgacactgccatccttatttcttcctcctcctctctccctgtcttgtgtccccctccttccacctctcacaatcattcttttcccccctcaatggaggactgaagcatccacccctttgtcttccttcttcct

SEQ ID NO: 4022 - DNA, 1600 bp, mus musculus
tactgatgagaaaaacatttgatcacctcagttaagcatggccttatttaaccttaattaataggggggggggagaggttggagaccatacctttagaagtgcaagcccttcacagcctcccaccctaaaaagccaattggccttgtactacggtgccagttgtcaccccctcctccctattccctgcctgtcatccaagaatgctgaggaacatccacatactcttcttcagtgttattcataataaagtgcctttcaaatttgtacactcagtcttcgacagggttccaacaccctaaaaagacagtgtagctgactacttggtattcagtaaaaatttcaacaaggaagttacctattcagtactaattagcattataaaagtcagagccaacagctcagggctagtctgctagttgtttagtaggacagaaaggacaatcttatctagatatgatttaccataagaaaagttaagaaatcccatggagacaggtttcttcattaagctctaagaattcaggcagaactaaaagacaaataaattttatgcctgagcctagccttttcttttttatattaacaacaggaaggagatataacctcccctccccagcctgaaacctgtttgctcaggtttcagtgttagagaacatgggggggggggcagagcttgctgcgctattgtcctgccactcccactgcctgcctcttagctgttccggagccatcatgtgttcacctgcaaccttactccaagatgatttggtgagaatcctcctgggaattctcaactcaaagatatggcttctggtttctatctgcacacctgaactaaccttgtgccaaggctctctgcaacacaattctgcccagagtataaacttatgcccaaggagtgctgacaaacctaatctcagggtcacaggctcacaggacttaaaaactccagtcagagacagcaagatcacctaacaccagagacaaccagattgtaagaggaaagcctaaaaacataaacaacagaatccaaggctacgtggcatcattagaacccaattctcccaccacaggaaaccctggatactcaaacacacctgaaaaacaagattttgatttaaaaatcacatctgatgattatgatagtggactttaagaagtacataattcccataaagagatacaggagaacacaagaaaacaggaagcagcccttaaagtagaaacacacaaatccatttaaaaaaataccagaaaatatacacaaacaggtgaaggaattggagaaaaccatccagaatctaaaagtgaaaataaaaccattaaagagatcagaaaataagacaacactgtatatagaaaaccatggaaagagaacaggagtcataaatgaaagcatcaccaacagaatacaagagatagaagagagaatctcaggtgtagaaggtaccatataagacattgacacaacagttaaacaaaatgtaaaatgcaaaaagctcctatcccaaaacatccaggaaatccaggatataatgaaaagaccaaacctaagaataaatgaaatagagaagaacgaagattcccagctcaaaggac

SEQ ID NO: 4023 - DNA, 1000 bp, mus musculus
aaatgttgctctaagtaacctaaaggcttgctaccattatgcttagcatcaagggaccagggctagataatgtgggaagtgggacatagtcaggtgtagtgatgcaggccagatgtcccagcatgagtcaggaggatcaggagctcaagatcaacatcagctagagttctaggccagcttgagctttccttccttaacagaggcaggatggtctgctgtgcacttgtctctcagaggctctgcttagataccctttaggtgaaggcagcacagcaggtggccccgccgacccatatccttggactccttggcagttgcaagcaaggagcagtgcctactgaactgtccaccctgagagagctaggactagaaggacacgctctgtttttgtttctgggcaggcctgacaaggagcagagcgagctccagcaaggcacagcgggccaggggcgggacttcgagcttagcacttgaagggtggcatccagccgggcgcatgcgcgttccatggagcttgtgcgacctggagctatggcgaccgcaacagttcgcccggcggcccagcggttgcggctgctcctctcgcccctgaaatcccggatctgcgtaccccaggccgaacccgtagccaccttcgggtaatggcgtgctcggggcagcgagggccactggccggggagggatacggacgcctggcgttgtcggcccttccttgctcaaaccccacgtccagatcccgcagaactggtgtgcgagcactttgatgcctggggttaggttctacgtgctgggtggtggtccagcctcctcagtgcacagggaaggaactggggaggaaggaaggggtggggggcttgctggcctcttagccatttgctgggaacagtaattattcctgccaaatcagaaatctgcctaacctgcttcagtggcaggcagggcccaagtttcctgagtccttttgcttgctaattttaaacttaagtgtgcaagacaatct

SEQ ID NO: 4024 - DNA, 1600 bp, mus musculus
ggatgttgattttgattttttttaaaaaaaacatttgattcaagacaaaatactgggctagcaccagaattttttctgcctttattgaatatcatgtgatgtctctcagtctctcctagcattgtggaataaataaataaataagcagcacaagtttgggggcttgttggtttgtgacaggttaactcatggaatggccagagaagccaagtaatcttatctgattcttaagtattaagcaaagaactgatttgggtatgcctgtaactttaattttttcaaaccttatttttaatgatggtcctcaaatgctttaacctcgcttctagtctaccactccccagaggtagtggaaaagaaaggatacaaggggaagtagacctgttcagaaatggttctttggagcaaatctcatttgtgtcaggaaatcagcaggtcagtttacaggagttagtagcagcagctccgtctactcttagacacttcctgatataccagcagtccagcttggcagaggcaggatagcacacaggaatcagcagcagtggcactacctagcagagattgccaggccaagcatcagtatgagtcagcaggagggaccaaggccaacaggaatgtcggggaagttctcagctatgcctctctcatcaaagcacagatcagtccaataagcattgcacagctagctctataagcaagccaaactcagcctctaccactgtccatcgagtcctttacattatgttatattatattttatttattaatcactttatttgtttatttatttcaaatgttatcccccttcccagtctaccctccacaaacactccacccctctccctcccctttgcctctaagagggtgctcccccaaacccagtcctgcctcacccctctcacatcccccttccctggggcatcaagcctccacaggactaagcacctcccttcccactgatgctagatgaggcaatcctctgctatgtatgtagcaggagccatggaccggcccaggtatactctttggttggtagcatagtccctgggatctctgaggggtccaattaattgatactgttgttcttcctatggggttgcaatcccttcagctcctttagcccttcccctaatttttcctagactcagtccaatggttggctgtgagtatttgcatctgtcttagtcaggtgctggcagagcctctcagaggacaattatgtcttttttatactccctccaaacatcacatgtcctccacaggccttgcctcagcatgtgagtctatctcagctgacttcactctgccaataagcccaaatccacagaagtgacaagaaactgcagcacaccaccagaagttttttggtgtgctttctctctgtagagtctcaactacacaatgtaaatggatcaatacatgcatatgattagcaaagaatcctttttttacctgccctttcatgtgcttgttttagcagaacatcctttctcctgtgtctgcttcagcaaaaacattccttaatgagtctgccttagtctttcacctgtctgcttcagtgaaatatgcttcacgtgtttgccttagcaaaacacca

SEQ ID NO: 4025 - DNA, 1400 bp, mus musculus
cttttgaagataccagttagaaaactggaagcatggtcagaataatgagatttccatctaattcattcagacaatccataatagaatttattgactgttcattataactttactgtattgtgctatccaagacgcaatttaatcctatgttttaattatatgttaatagtctacaatttttaaaaagttaggcttactctgaaaaattaacagaaatagaatttaaaagaattaagtccaaagtttcttttgttccttcctgttgactcaagttttatcccatatttccaggtatgggagaacacatgcttttaattccagcaatcgggaggcagaagctaggtgattgtttgtgagttcaaggctagcctgctctacaaagcaagttccaggccagctaggttacataatgaaaccctgtcttaaacaaacaaacacatattactaatagcttcattgaactacctctaactagattcctcctaaaatagtaccagtgacaaacaaaacaaaacaaaacaaaacaaaacaaaaaacaaaaaaacccttgtatttctaaatacaacttttgagtttgttttatttgtcaatgactttgaattcatcacaggactggttatgtaacctgatagcagtgggactatctatctacatctgttgggaatcaaacccagcatttcgcatatgcagcacaaacacaaatgctcatcctgcattccatacctgcatccccagccagcctggcaccatcttggaatgcttccactgttgtgctctgctttgaggggctggcccagccatccaaatgccttgctagttggcttattaagcaagaactactcttgaccattctcttctgtttgctcaaagtaaggtacatctttctgttgccatggtgatttagcacagttaaattactgtcaacttggtgttgtaaacagtttctatacgaagatttaaggattaccaacaatgcaattaactttgaattaattaggactcacagtcctgcttctgctagcttctgttccttttgcccagaaaatgtctgtcttctttttatttctcttttagtccgtgtgaaagaataattatgtaaacatcaaagcttggatctgcaggacagttaacaaatgttttgacagagaacaaaatggcacattggaatatggaaagctgtgcaaagattaattgcattttagtcatatttaattttttcttgccattttgggtggcattttccaatgtaaagctccatggtgtgttgttaatgagtcaatttacaaacctttattagttttctggatattttacagctctataaatccagttttcacaaacaagaaaaagacactttgtggttgtatatgtagataaaaataaataaagagaaaattcct

SEQ ID NO: 4026 - DNA, 1000 bp, mus musculus
caaagcagagagaggctcctatgaccgcatcacagagtgaactgccattaagacatccaaggttttatccaaagctgtttgctggtattagacagaaggcagtgtcgagcagcccttctggaaatgttgcatggccagtgctctagacgtgggtgggaaggtacagattcctaccgctaatctgagaagtgatgtggagggggggactgaggttacagttagagcttaaccagtttatttcacacatttgttacagaggcacaagatttacgtgatagaaatactttagaacatggaataaatgcaaaataaaacatgtttctgtgataccaggcacatgccatagcttaatgggcgatgctttcttcgtagacacacatggtgcatcctaatagatggttatttagattaagtaaaagtgataatatgtaaatttacttttcaagatagcagttatttattggagaatttaagtataaatcttacagtgttaacagttattttttatgaaatacttttaggttaaacctattggggaaaagttttagcgttgtagttaggaatctaagagctgtcttctcctttatggagaatgttatcagtccctcctttatatgaggacttatgttctgggcttctgttgtggagaaagtacttcacgaacagcaattcatcgacaagacctcaagagtactagggcttgagaaagtactggttgaaaatacctgcttggctgtgtaaaatgcctcttgccaggagtccatgtttgttctacccgaactttggactgttaactagagaagtgatagactgatgaaccttctagtgttgtctgctccatacgggaaatgagcttcaaggccaagctccttcctcatccttgttctttacagccctgtttaacctcagttgttacctcatccttcgctctggcagaggctggttgttaatcgtctactggcactgcccaaggtgagttcctgaagatgtagacagcgca

SEQ ID NO: 4027 - DNA, 1000 bp, mus musculus
taaacaatgaaacccatgtgacctttcctctgtgcctcctgtggaagtccagctgtcctctcatttgtcacactgagagatggcaatggactatttaaatgctgtagttaattttaagctttttcaattgtgtgtgtgtgtgtgtgtgtgtgtgctcatgcaccttcttgttataaattttaattctctcctgccttggaggacccatggactatgcagaacagtgacgagtcaccgtgtttgaatggtgccactgtctagattgtcgggcatggcaggggccatgtgtccagtgtggtgctagggacagtgctgagaaacactgcctggccttgtcccttcaggactttgggtccggtgtgtgtctttgcagtaaagtgaaatgaccactgtgtaaaagagaccccaggtctcaggcccgtggggatgaacacctgagcactggtctcagctttgtctcagagagctctagcacagtgactgcaggtccccacacatcagtcacatcaatagttgatgtctgaaactgttgacccacttcgttgttttcagccttggtttcccacttccaccacctacactcagtgtttcacatcctctctgactctcaatggttggagggggtcatcactggaaaatatgccagctgggttttgttaaagtaaatgaacatagttcttaatggactttggaatgttgattgacattctgactaaattaaaagaatatcttacaatatttataatagtattatgacggctagcattgttaacttgatggagtttagagtctccatggaaacaaacatgggcacttgtatatgggatttgctagatgaggttaattgaggcagccctacccacaataaatgtgggtggcatcagcctgtggtctgggcttgaggactgaggaaggagaaagggagctgggcgccagcgtttgtctgtgccacctcccactcctcctgccaggcttcctgccatgctctcatcttgacaca

SEQ ID NO: 4028 - DNA, 1200 bp, mus musculus
tgaaaggtattgcaggttttgaagggggctctctgggaggagttggggtacaaaagggaaagatgaatgtgaagtaagactatttactcaaaatatgctactaaatgttaacaaattcagatataaaataaaagagtttataaatcctactctcataatgttaaatactacaaatcaaccatgtttccttataaagttgctagttccttcatttcaagaaatgttgattttcgtatcagcattctttgtctatgtgtttggaagcttcaaagaaaggcacaagtctgaactgaagggagccctcaggcttatacccaggccttcctgcatgaagacaccgcactgctgaagagccgttcagtctgggagactgcctgacaaactgccccaggacaacagtagcaggtgtccacagtcttcccatgtgcactctacacagacttcttacatacactgcacacagtcttcccatgtgcactgtacacagacttctcacatacactgcacacagacttctcatgtgcactgcacacagacttctcatgtacactgcacacagtcttcccatgtgtactgtacacagacttctcatgtgcactgcacacagacttcccatgtgcactgtacacagacttctcatgtgcactgcacacagacttctcatgtacactgcacacagtcttcccatgtgtactgtacacagacttctcatgtacactgcacacagacttctcatgtacactgcacacagacttctcacgtacactacacacagacttctcacgtacactgcacacagtcttcccatgtgtattgtacacagacttctcatgtacactgcacacaaacttctcatgtgcactgcacacagacttctcatgtacactgcacacagacttctcacgtacactgcacacagtcttcccatgtgcactgcacacagacttctcatgtgcactgcacacagacttctcatgtgcactatccagataacttacatgtgtcctgcaaagattttcaattggaaaatcaggctcaggacctgtcctcctgtataaaatacaatgcagtaatcctgggttacagtaatattactcttagtttatctgtgccagatttctaaaagtatcatacgtgaattctgtcaataattttttatttgaaagtgacaagcttcatatgaccagtgcaggtgagccg

SEQ ID NO: 4029 - DNA, 1400 bp, mus musculus
tctattcgtcaacaagtagagtcactgaagaaattaggaagaaaaaagtcaaaagacacagaagttgtataataaatggaaacgttttagaagaatgtaatatataacttggtatcaattttatgattttaaaggaaataggttactagaaaagggtacctaaacgaaatggagctgagaatactaaagtagtctgcaaatttcaaatgaactaagtcaatatgtaaaatcagtatgatcttgtagtttaggtgtaaaatgagctcagaggttcacaagcaaaagcgcaggtccctggctggtggtgcttccggccattcggatgcttacatcatcactgaatgacctagctcattggtgagttctgagctgaaggagctgttaggagatggggcctggtgagaggaaatatgtggctttaggcacaccttggaagctcacatcctgctcctggtcccttcctcctcaccacgaggtaagccactctgttctcctacatcatccctcccaggtgttgtgccttacacgggcccagaagccatgaagccaggtgaccacagacatgatgagccagatagccttccctcaagttgtttctcaagaacgttttgtgaataacgaacccttaccaacacaaaacaatacctctcacacagaaaagcagcccttgccaaaccttcaagaaatagaaacaatgtcattttaaccagttccctccagaggaggacaaagacataatgacatatcccaccttgctcctttagataaaaggagaaaatatacatggtcactccagcaaactcagaaaaaaataggttacaaaatttagcataccgggactggagaaatggctcagggattaagagaaactactcttgctgaggacccaggttcccttcctagcacccacatcaggcaactcacaacctcctcttactccgttctagggactttattgccctctgacccctgtgggcgcctgcatatgcatggtacatatgaactgttgttggcatacaggcacaaaggtataagataaattctttcataaaaattaggtgctggggagatggctcagtggttaagtgcacatactgttcttgcgaagggcctaagttcagttcccagcaccaatattggaaactcacaagcacctgtgactttagctccatagattcaataccttcttctggcctctgtgagcacctacaggcccaggcacatacctacacagacacacacacacacacatacacatacacgcacacaattatgaatcatctataggcccaggaacgtacctacagatacacagacacacacacataattatgaatcacctacaggcccaggcacatacctacacagacacacacacacataattatgaatcacctaca

SEQ ID NO: 4030 - DNA, 1400 bp, mus musculus; identical to SEQ ID NO: 4029

SEQ ID NO: 4031 - DNA, 1000 bp, mus musculus
ggtcgtgagaacgcgtctaataacagaatgactccatttaagttggatcataggaagcctggtcatgtataataaccatgaaatacggaaacgatgtgaaaaatgagtcccagggaaagatgagtgccaccccttgtgtagggtgacccaaaggtgacctgtgtggcagcagatgagctgccattggctccttggctctctgctgagccttgtgactcactgttatgtaactttttttggaagctacgaggcaattctgtgccttctgtgggtggccatatggcctgggttttcatctcatctcagttgggggggggggggcgatttcctccctgaatcagtagagctggcttctcatccccagaggtgagcaggccaatgtcctctggcatttaggaacagtaaagacactcctgagagccctactacagcagatgacagcatttaccagcctcaagcatgacacaggagtccaacacctctgtgactacagccattatcaggtgtctgacctgggtgaggctgcaaccaatgaccaactcctgatctgctcagatcttctttggcaaaagcacgttgttcctccgtccagtggagcccatgcttaatgaggatctaacagagacaatgctaacatatctccaacacctattgtgctgataaatctatgcccagaagctatacagaaccccactgagctgccaagtcaggcagtcggtgggagcggctatacccacatatatgtgttcttggcagtgtgcttaaagaaatccaaaaataccctgagggcacaacacatgtgggttggtgcacacatatgtgtgcacatacatgcatgcatatacatacaaagcacacacacacacagttctagcaagcaacatttccactaagccctgtgaatttgctctaggaattcatctccctcacagagagggaaggtcgcattctggtacagagcagaactgtagtgtgtttatataaagaattaaaaaagcag

SEQ ID NO: 4032 - DNA, 1000 bp, mus musculus
acacacacacactccctccctccagctactggaggccagttggatgcctgcctttttcacccctctcagcagctgccaggctacagagcctgttttgtgaaagatcaagaaacaatgagggaaaacagcttcagcttgattagattagatcaatttatgtgcctggggaggggcctaggcagggctgggggaggggtgtcctgtgctggcagtggcccatgcctgcccattcggtcacttcataagtaatgaagctcccgtggtggctggaattgcaggaagggggagggaggaggtggaggaggagcatgtgaagagagatttctgcagtctgtctggagagctgcccagggttcccagccaaaaaaacaaacaaaaataaataaaagccaagtgctgaatgacacagattatgatattaaaaagggatactattgaaacattgccctgtttcctactgttgttggaaatgggtgtgtgcagaagcgaggggcggttagtgcactgtacaacaggccattccttggacacaaaagtccgtacaattaaattgtgaatgcccctcgccaacgtcccctcccccacctcatgccagaaattctgtaattttgatttgtctgcattgcaggtcatggaaatagcaggatggaaagctagtttcttttgccttttctcattttaattcatcaaaatggtaaaaagcggggagggggaaagtcagccagatgccccctccttttcagtgttcaattctcttccaggcacataaataatcttctctcccgactgtctcccctcccccttggcccccgctggtgttcggctgtcctattgccgcgcggaatctgcactgccgcttgcttattacgtacaggggaggattgttgacaagtgctccggagcctgcctcactgcgctctcccttcctccctcccttcctctgtccttcttcctctgtctctgcaatgatccggctctgaggatggctgctccacgggtc

SEQ ID NO: 4033 - DNA, 1000 bp, mus musculus
cctttctctttacaaagaataaacaggctgagaaagaaattagggaaacaacacccttctcaatagtcacaaatagtataaaatatcttggcgtgactctaactaaggaggtgaaagatcagtatgataaaaacttcaaatctatatcaaccaacaccttttctggggtctgatgagcgtcgacatcgggcgccttaacccggcgttcggttcatcccgcagcgccagttctgcttaccaaaagtggcccactggcactcgcattccacgcccggctccacgccagcgagccaggcttcttacccatttaaagtttgagaacaggttgagatcgtttcggccccaagacctctaatcattcgctttaccggataaaactgcgtacgtcgggaaagagcgagagcgccagctatcctgagggaaacttcggagggaaccagctactagatggttcgattagtcttttgcccctatacccaggtcggacgaccgatttgcacgtcaggaccgctacggacctccaccagagtttcctctggcttcgccctgcccaggcatagttcaccatctttcgggtcctaacgcgtacgctccacctccccggcgcggcggcggctttcggacgagcccctgactcgcgcatgcgttagactcccaaaggtccatttaggtgccagtctttgctttatgttttgagacagtatctacacacacacacacacacacacacacacacacacacacacacacacacacacatctcccaaaggtccatttaggtgccagtctttgctttatgttttgagacagtatcttatagaacttggatcttattgattgagttaggctggctgactgtcagcccctaggattcttatgtctctgccttctggagtgctgggattccaggttggagtcctggttctcagtccaactatttacatggatttgttggctcagcctcagggaagacctcatcatgcttgtgcagcaaactctg

SEQ ID NO: 4034 - DNA, 1200 bp, mus musculus
ttgggttttgtgtgcttgtttaccaggactgaaaagccttgaacccaatctgagcacctttcaaggaatgatagaaagtagagcaggaagacggggccattctgcaagatgtacaagtactggaggttcatactgactccccgcaagcacaaagccatggaggttacagaacatcagagaggtggggactagtcctccgccccaagagtcttcagccagactcctcacttagacaaggaaattgtgtcccacccaggaaaagtgccttggccaaagttgcacattggcatggctgactctaaaggtttctgacatcttaccagtgagcagccaaaactctaagaagaagaatgagagtgtgaactgcaggggaagctaaaggcggctctggtgatgccaagcgatgcgagagagtcaaatactctgattgaaactgaagtcatatgtgcttctatgtaaaaccagctcttatgggtctcccggggtggggggaatccatcacctggaattacttgaaggcttgtcaagtgctttacggctctacaaggagaggtgtgatactgagagacagggaaagggggctaacctttccccacagattgagttctgagttcctttcggatgtcttgtgggtgagggagttgagggggggcggctgcttccggaagggaggccctgtgcacactcattagcatacactctccacagttgattcagatgagatttcatcacagaaacctacttatgcattccttaatataaatctaaattgctctcttcaaatagcagagagcgctaagcttcagcaagggaaggagaagcggtggcattaggagtcaggctgcagtttcatcctgccttccaccctgtcgtcatcctgtcttgacagccttaacttacacacttcactgagctcaccccgggactcaggggaaaaaggctttctccaaggcagacaccaagttgtactcaatgctctggagcagtagggggcagtcattggtaagtgctaggagggccctggtgtattgccagaagagagagacacttcaggaccactcagttggcaaatgaccccatgctctgcaaacatgaggacctgagttcacccaagaacacatgtttctaggtgtggtggcatgtgcttgtaacaccagcattggggaggccaggcaggagattccctggggctcactgggc

SEQ ID NO: 4035 - DNA, 1000 bp, mus musculus
tgagagtatgctctatgtagtctctgtgtaaaggatcttgcctatttgaatatacttaagaaccaacaatgctgaacatttacttcaaggtaattgatatgcgtttttatccttaacatttatcatcctatggctattttcatttcgcacccaggaaagctgcatcataaagatgatgcatcacaagttcaaggtcacagagtgagagagcggcaacagcagactatgattcaggtagacagatgcaagtgggcgttgcaattatcattactctgtatcccttccaatgactactttatcagcgatttatactggctccatagtgattcttcttacagcaccactaactacaagcctgactccaaaaaggatgacaattaaaagaagattgctcaagggctaatgtaacagattgtaagcagagatgccttgggctccatttagggatagatttcagaggctccggagtgtcagttctcaacagggcaccgtttccattcaccgagacctggttacgggaaacagcaagttgtacatttcactgttgcgatgccttccaagggggctcaggacgtaaaggaattatatctataatgtgcctcggacagtcatagcgatcgtgggaattacttctgaaaagcttctgtaggagatgtggtggttaaccttcactgggaacgtgactggatttagaatctcccaggagacgccattctggcatgcctgaaagggtgtttgcacagaggctgaactgaggaagacccaccctgaatgggagtggcatcatcccaggggtcccagactgagacaaggaaggcaacaggcagagtaacagaatccattgctctctgtttagtgtctgtgagtgccacatgaccctcaaggggaccctcatcagagcttcagtgtccttccccgcattgatgaactgaagcttcaagccatgaatttgcccttctttaattgtgagagaagcaataaattcaagggcatagcttaa

SEQ ID NO: 4036 - DNA, 1000 bp, mus musculus
gaccttgtctcagaaaaggagaacaggggaggaagaggagctgagagcagtgaagacgggtgctcgttcagaccctgtgtttgtgtcgaccctgttcatagcagcagccaagacatggaagctgccgtgtaggtgcatggggaacgtaatccatcttaaaatgtgtgtgggcggccttatttggtttcttcctgaaccttggagatgcctgttgagaatagctgttgtccatatagctgccatataggtgccctactctgggtctgtagttgcttccctaagggaggtttgatgccattgggactttccccatggcaacagtgagtcagtggggcattagggggttttggacagatgttgcaaacataactcttgactgtgtgcacacatgcacaccactcccatacttacatactttgtcttgttcttgtcatgttttatataaaacgtgggcttagcctatagcagtgcttctgtgacttcctgcacctgtgggggcagtttttgaatgaaccacaaagatccttagaagtgatccgtggaaaccggtggcgtgccacgctctgtagtggaagtttaagtttccgtacgcttttctttcctgaggcagtttgtcagtgtcaaagaggtttgatgcctatgcatttgctctaggcttccagggatggtgccctccagcgaggttttaccgaggggacacagatacatgcatcttcttagtaatagttttaaggcaacttaattgttcatcagttgacttgttagaagtggtttgtgatatcttgatttaaaaaaatcagtggtggcatatgaaagtgtcaggggccagggatctggctaagtggagagcgagagagatattcatgttctactgcacaggatgatggtcacagtgttacatgtgcacgtgctgtaagagcccctagagggtccgctttgcttgttagaagatgaagagaagctagtgtgtgtgtgtgtgtgtgtgtgtgtgtgtgtgtgt

SEQ ID NO: 4037 - DNA, 1000 bp, mus musculus
ttaattttaaataatctgtccttatcaagtgttgtcagcaaaatccccaagcaacttgcaggcaagggaagggaggaggtgacgatgcagctagagctggaggccagcccccctgaagaggtgaccctcaccgatcattacatgatcctcaggaccctgggcaaaggcagttttgctgaggtgaagctggcctgccacctccacacaggggtttgggttgctgtcaaggtcctggaaaggggcgagaagaacgactctgttatcatgactgaaatcgacattattaagtccctggaccacccaaatatcatcaagctgttccatatcattgaaaccagagagcacacctacatggtgatggagcacgctgctgggggagacctggtgagccacatcgagaaggtgggctgtctgcaggaggaagagacccaccgcatcttcacacagatggtgtgtgccgtcaactactgccacgagaacagcatcgcacacagggacatcaaaccggacaacatcctgctggatggcagagggagtgtcaagctgtgtgactttggcctggccatcaaagtcacatccgggcagaggttcaaggggttctgcggcaccctggagtattgtgctccggagattttcactgacgtggaatacgacgcgcaggcaaacgacatctggagcttgggggtggttttgtacacgatggtgacagggcgcttcccttttgaggcaaagacctattcccagatgaaggagaagatgctgaaccccaagtactccatcccacccatgctctcgccacacattgcaaacctcatcgtgcagttgttcaccgtggacccagaccagaggcccaagatctgtgacattatgcagcaccggtggctcaggggtggtgaagacctttccaaactggcatcttctttggaggcatgccctagcaacccagcccccagcattgtagtggctatgtgggctatgggttacagtgccaaggacatcc

SEQ ID NO: 4038 - DNA, 1600 bp, mus musculus
ccccaatgaccatttatgcaaacttattcaagaaaatacttgcaaactgaatccaagaaaacatcaaagaaagcatccaccatgatcaagtaggcttcgtcccaaggatacaggttaaatatatgaaaatccttcaatacattgtaatccactaaataaacaaactgaaaggaaaaaaaaaacatgattatctcactagatgtctaaaaagcatctgacaaacaaatatcccttcctgataaacgtcttggagagagcaggagagaggcccagagggccaggagaatgaatggaaaaagcagtggtctcagttggagagggtgggcctaatcctgcagagactacaggggtgaggggatactgggacatgggggagagtgctgctgcctcaaaggctaaagggaggggatgggggaggaactctgtaagggatgatgggggcagtatttgggataaataactgaaaataaaaaagtctttagtgtacctgggtagatctataggctgatctataggctattccaagacagaattatacagagaaaccctgtttggggccaggagggaggcgacagttgttgtataaacacaatggcaagtaagctgcagtttaaaaagtcaaatcactctacctcagtcttcttcctcttccatcagcctggcctggtgcagcttccctgaccgtcctagggccttaaataccccactcaagggccgcccgcgcaggttcctgcagcctggacaatggccctggggcagcagagtctgagcattgctgagcttctctgtcagcagcagcaactaaacggggagcaagaagaaactgccactccaacgtctgtgaccatcggactcaacaaccaacttctgcacaggagatcaactgcttgaagacctagaaccctttcacctgaggatccaacttcacagtctgtccatgcccctacagaaccaccttcacagtcctgccctctgctctgagcccctccctaaataagaaagctccgcccacttgcccagttcttaagctctgggatcctgtgaaggggtggggatcactagccagggcagtggctctgtgaagggtctgcctcccagggactacgcctcctactggaggcagactagcaatgtacaactgaagctgcactcctgcaggatctagttctccagattctcagatctcagctgacaggtaacttcaggcctggtggtcccaggagtcattcgcctagctgcttgccccacgactaaaacacattggcatcgacctttaaaagctgggtttaacctgtaaatctctaggcagcctctgcagcactgtctgtttattcatctccaactgcaacaggtcaactgcttaaaccactacagaaaattattcagacggcagcttagtctcatatatacataaaaaaatgaaaatatacttcttctatggaccacatgaaatatggaacagtggtatacatagctatttacacacacacacacacacacacacacacacacacacacacacacacagagactgagacagagagagagagagaaagagagagagagagaaacgtgtatatgtatgcatatgtatatgtta

SEQ ID NO: 4039 - DNA, 1000 bp, mus musculus
gcatggtcagactgtgaagttggatcctcaggtgacagggttctatgtcttcaagcagttgatttcctgtgcagcacttcgttgttgagtccagtggtcacagatgttcgagcagcagtttcttcttgctccccacttagttgctgccactgacagagcagcttagcaaagctcaggctttgctgctccagggccattgtccaggccgcccgaacctgcggcgggtactgaagggccaaggccggtcagggaagctgcaccaggccaggctgatggaagaggaagaagactgaggtggggtgatttgactttttaaactgcagcttacttgccattgtgtttataaaacagctgttgcctccctcctggccccaaacagggtttctctgtataattctgtcttggaatagcctatagatcagcctatagatctacccaggtacactaaagacttttttattttcagttatttatcccaaatgctgcccccatcatcgctcacagagtcccttccccatcccctccctttagcctttgaggcagcagcactctccccccatgtcccagtatcccctcacccctgtagtctctgcaggattaggcccaccctctcccactgagaccagataatgcagccctctgctacatgtaagctgggggccttggaccagcccctgtataccctggctggtggctcagtcttctgggagtttcaggggtccaagttggttgacactgttcgtcttcctgtggggttgccatttcattaagatcctgcagtcgttcccctaacacttctaaagggtccccaacctccatccaaggttttccaatgttttgtgagtatctgcatctgtctcaggtgctggggagagcctctcagaggagctgctaggatagactcctgtctgcaagcacattgtagcatcactaatagtgtgcctgactatagaatgggtccaaaaataggcaggtcactggtcagccattcctttcatct

SEQ ID NO: 4040 - DNA, 1400 bp, mus musculus
agagcaggagcaaggcccagagggccaggagaatgaatggaaatacatagctgctgagccgggatggggtttgggagagagttctctaggaagctccagagacctgggataaggaagctcccaggagtcagtgtaggtgaccttagcagaaatcccccacagtaggaatatggaacctgaagcaaccacttccagtagccagacaggaccctcagtggaaggttggggacatcaacccacttgtaaaacgtttgatccccagattggtcctatctaaaagaaatgcaggcacagagatggagaagagatgaaaggaatggctgaccagtgacctgcctatttttggacccattctatggtcaggcacactattagtgatgctacaatgtgcttgcagacaggagtctatcctagcagctcctctgagaggctctccccagcacctgagacagatgcagatactcacaaaacattggaaaaccttggatggaggttggggaccctttagaagtgttaggggaacgactgcaggatcttaatgaaatggcaaccccacaggaagacgaacagtgtcaaccaacttgaacccctggaaactcccagaagactgagccaccagccagggtatacaggggctggtccaaggcccccagcttacatgtagcagagggctgcattatctggtctcagtgggagagggtgggcctaatcctgcagagactacaggggtgaggggatactgggacatggggggagaatgctgctgcctcaaaggctaaagggaggggatggggaagggactctgtgagcgatgatgggggcagcatttgggataaataactgaaaataaaaaagtctttagtgtacctgggtagatctataggctgatctataggctattccaagacagaattatacagagaaaccctgtttggggccaggagggaggcaacagctgttttataaacacaatggcaagtaagctgcagtttaaaaagtcaaatcaccccacctcagtcttcttcctcttccatcagcctggcctggtgcagcttccctgaccggccttggcccttcagtacccgccgcaggttcgggcggcctggacaatggccctggagcagcaaagcctgagctttgctaagctgctctgtcagtggcagcaactaagtggggagcaagaagaaactgctgctcgaacatctgtgaccactggactcaacaacgaagtgctgcacaggaaatcaactgcttgaagacatagaaccctgtcacctgaggatccaacttcacagtctgaccatgcccctacagaaccaccttcacagacctgccccccgctctgagccccaccccaaataagaaagctctgcccacttgccaagttcttaagctctggg

SEQ ID NO: 4041 - DNA, 1200 bp, mus musculus
tcgtggggcaagcagctaggcaaatgactcctgggaccaccaggcctgaagttacctgtcagctgagatctgggaatctggagaactagatcctgcaggagtgcagcttcagttgtacattgctcctctgcctccagtaggaggcatagtccctgggaggcagactcttcacagagccactgccctggctagtgatccccaccccttcacaggatcccagagcttaagaactgggcaagtgggtggagctttcttatttagggaggggctcagagcagagggcaggactgtgaaggtggttctgtaggggcatggacagactgtgaagttggatcctcaggtgaaagggttctaggtcttcaagcagttgatctcctgtgcaaaagttggttgttgagtccgatggtcacagacgttggagtggcagtttcttcttgctccccgcttagttgctgctgctgacagagaagctcagcaatgctcagactctgctgccccagggccattgtccaggctgcaggaacctgcgtgggcggcccttgagtggggtatttaagggcctaggacggtcagggaagctgcaccaggccaggctgatggaagaggaagaagagtgaggtagagtgatttgactttttaaactgcagcttacttgccattgtgtttatacaacaactgtcgcctccctcctggccccaaacagggtttctctgtataattctgtcttggaatagcctatagatcagcctatagatctacccaggtacactaaagacttttttattttcagttatttatcccaaatactgcccccatcatccctcacagagttcctcccctatcccctccctttagcctttgaggcagcagcactctcccccatgtcccagtatcccctcagccctgtagtctctgcaggattaggcccaccctctccaactgagaccactgctttttccattcattctcctggccctctgggcctctctcctgctctctccaagacgtttatcgggaagggatatttgtttgtcagatgctttttagacatctagtgagataatcatgtttttttttcctttcagtttgtttatttagtggattacaatgtattgaaggattttcatatatttaacctgtatccttgggacgaagcctacttgatcatggtggatgctttctttgatgttttcttggatt

SEQ ID NO: 4042 - DNA, 1000 bp, mus musculus
gtatattcactatatacatgtttagtatttaagtgtgtgtgtgtagcatgtgtgtgcctgtatgggtgtctgtatgtgtgtgtgtgtgtgtgtgtgtgtttgtctatgtgggcattataagcacttatctgagcaactcaaaacatctgggtccatggtaagagcagtaagtgctctggctgctgggccataccttcacccccttcccacattttctcctggccgttcctctgttgctggacaccaggtaaaacataaggtaaagggaaagcattatagacagcaggtttcagcaaacccagctgcttcccagggatggcccccaggcacatctggtctctctggctgtgctgtcatggggtctgcaaactggtgtgaatggcaggaggcaggggctggagggctggagggctggagggtgggagggtgggtgtagagctgctctttagggtctggagcagaaaggaaaagcaggtcgtgccttagttgcctagagcagccctagtctgtgtgcctgctcagggtatgatcaaagcaaggctcatggggaattcttgggcacacaggcctggctgcagcccggtgaacatccagctactctgaaagccggatacaggaactgggaggccaggcctcttgtccactgcttcctacagctgtctggtccttctcccttctcaggatgtgatggtgatgaacactccatgagaggtgagaataaaactagcaaaaccagcacagtctgtatcagagacgaattagcaccaagaacacagagcagatgacttggaaggccttttgcatgggctcacaacccacgcaggcttagggctgtactcacagaggtctgcacatggccccgtgctgctctaatcctgacggtctctgcaatgttaactactctttcatttagcgctggaaccaccaattagctagccatctctaataagaagggtaggcaaatgtatgctctttaattccaggcagctggcttggagcc

SEQ ID NO: 4043 - DNA, 1000 bp, mus musculus
gggtgcccaggagtcattagaatacgcaataatgacaggaaatctcttgtagtcttgcctttctgagctcacccatcacaggccatgcaaaaaatggtggcccactccaggaaagagacaggaggatcttgggatttgccaacccgccagactagagtatctggcaagctccaggtccaataagaggactgtttcataaaaaaggagagtgattgaaaacagcctctgaagttgacctctggcctctaaatgtaaacatgcagaagcatccacatgaactagcatgtgtgcacacatacatttccatactcctaaggtcttgcatgcataatttacatcctacaaggcctcaaaagagtgagagatttactgtgttctgatggctccccatatacctcacggcagcagagctacctgtaaggtgtgtgcagaggtaagtactggccaactctgggcacaggtacagtgaggtggagtagggggttgctttgtcaggactggggtcttactactttcctcaagttaatgcttttacaaagtggcttcacacacttgtcaatgtcaaactgcgcaaagatagtgttgcactgagaaggaagagcaagtgtctcaggactgttgagggtgataacagcattgtgagctatgaactctctctgccgtcagaagaggggagctcagatgtgacatgcaagccacagtggttggtacaatgagttcagtggtgcctggaggagcacacgtgtcaggacaccatgttacctgtgcccacatgacatctttgagttgtgcagccacatgggggaggatgactttcagagagaaggctgttcatctaactccatgtggcatgagttacacagcatatacacatacctcacatacacacaccaccgtgtgcctatgtgttcacacggtggtgtgtgtatgtgaggtatgtgtgtatgctgtgttaagtgtgttcagtgtgaggtgtgcttgtgtgttctgggtacatgca

SEQ ID NO: 4044 - DNA, 1000 bp, mus musculus
ggggaaggggagggctggtcaatctgaccaccgactgactgctcgttttctctgtctatgttcatctaacgagcagaggaagacctcacgtggacaacagcaacccctgaggccagatacacagatatcatcctgtatgtatcaggctcactggttctgcttgtgctcctgctgctggccggggtgtatcatcggcaagtcatccgtggccactactctcgccagcctgtcactatacaaaagctgtcccgtttccctttggcccgacaggtactgtgcctgttccccagcccccacccactgtacggctctcagcctgaccccagcaggcagaacgaatctctcactttgcagttctctttggagtcgaggtcctctggcaagtcaagtttgtccctggtgcgaggtgtccgtctctcctccagcggcccgcccttgctcacgggccttgtgaatctagacctgcctctcgatccgctttgggaattcccccgggacaggtacactgaggaggctaggactgagggtgccagctcaggagtggtacccacagtctgaggcacgggtcttcttggcctctaggttggtgctcggaaagcccctgggtgagggctgctttgggcaagtggttcgtgcagaggcctttggtatggatccctcccggcccgaccaaaccagcaccgtggctgtgaagatgctgaaaggtacacatggcaacctgggcaaggtgtgctggggccacgcaaggggtttacacggactgcccgtgctggggccacgcagtgggctatagggatagccggtgctagggccacacaaggggctacacagactgcccatgctgggaccacacaaggggctacacggactacatgtgctagggccacgcagcaggctgtagggatagcccatgctggggccacgcaagaggctatacatgagaaaggccccaggttttccacccttgggcctgaagcccaaccctgttgctggccctggc

SEQ ID NO: 4045 - DNA, 1000 bp, mus musculus
ttctaaattgattttcaaaccaaaattggaacagttctcgaatgctcccaggacctggggctattaatactatggaagcagaaggagaaactgagtgtgcaggcgctgatttatgagcaaaaggaagttgcaagctcggaaacttgtacgtaacccaatcatagcccctctggagatgtgccagggaggagttggagactgtaaaggaagagggtttctcagggctgtggatgcgttggggcgtgggggtggggtgggggtgatgctggaatgagcaagatgctgaccgagttgaacttctcataaacccagcttcgttcgggacagctgtcagcaatgcctgagaccggccacttatcctcaccttttctttctttcttttatttatctctcacattattttctgtcactgagtaggctaaatgacaggaagagagtcttcccatcagagtgtgggaccgtggccaccgccgcagcagcccgtggtcttgcctctggtgtcaagttctgaagtgttagggtcatagatccagctgctaaccgctgagaccagccacggttgggttggagtggtgtgacatgggaaagtgaggttggccagtcggatcccggcaggtgtgctgggggtggacacccgatctcattctttgtttcttatggctttttgaaagttatccttacttaaacaactttattgggatagatgtgcactcgatacttgtatttaaagtatttggtgtatgtgtagctctgtgaggaccacaactacaaccaagataataaacacaggcgttagagagatggctcattggttaagagcactcactgctcatcagagggtctagatgtgctcaacatccgggtaactcacaactcttgcaccctctgctggcctttgcgtgcatctgcatgaaagtaatacacaaactcatatgccggcacacatacgtggaaacttaagggtttttttttggagagtcagttgtgctgcatggtgttt

SEQ ID NO: 4046 - DNA, 1000 bp, mus musculus
ttctttgagaagatccagaagatagacaaacccttagcaaaactaaccaaagacagagagatactatacaaataaacagcctctaggaagtcagtgatatgctgtggatagagcagccctctgtaccaccaacactgaagtctgtaaaccttactcaccacacccctcaacagaggctctgagtcaggtcttctggtgggaaaaccatgacacttaaggtcatgcagagagcgatgcgcttcagatggcctcaggagccatggcaccagcagatgtgcctgaaacaaggcagcctccacagcagcgaaggacaaggggtcccagctgggcagtggtgacccaacatccccttactgtgagtcataccatgaccctctttcgctctcccaggagctgtgtatttctaatctgttcactaaatcttcctctgctcaggcacctggagtggcttctgcccttttggttgagttatgacttggtccccaccctgtcatttgctttaattctgactgacgctgggccggtgaatggagctgtcatccatgtgtgatgtgcagctcaagggctttctgtggaaatgcagctcatagaaggatgttctagaatgcatatctacattaggatggcatcccttcctaatgtgtgtgtgtgtgtgtgtgtgtgtgtgtgtgtgtgtgtgtatgttcatgtgggtgtgtgcacagccttgagtgacattcctcaggcagtttcctctttgctgctgagacagggtctcttgatgccctgcagtgtccaagtaggttatggtgactaggcaggctctgagggaaaccaaggtgctcttccctctccttagcccctttgttccaaatcatctctttcctctcttcttctcctttcttttctctccttctccctccctccttcttttcttttcttctttatttatttttagcagactctgctatgtgatccaggctgtcattgaacttgtgatcggttaccacatctcctaagt

SEQ ID NO: 4047 - DNA, 1000 bp, mus musculus
ttgatactgacacaaagaaatgatattctgaattttctctttttctctcaccaaaaatatctaaatgtaacttcttttggagggcagattggcaactgtgctgaaattttgagatgcatcctctgcctctggggatatatctgacaaccctgtgagtgtgcacatgaaattactcttccctgaatgttcttagcagtgtctacatttttgataggtgtcctggtgtctctgtgcacatgcataaacattgtgagatttgaatgctattagtagacagacagacagatttctgctccactgggtacaccccccagggggcagggacagaagtaaaagccagacagagaaggtgacccacccacaggaaggcggagcagggcctctgggtagaatgctggggcaggctggctccctttcctgactttgggtgacaggagtcactctgggatcctttcttcctatattccttagaccctgtgtagttcatgatctgtcatttgtttacaagcaaaacataaataagaagaattcacgggaaatgggaaataggatcctcttacatgtgtatagtacttttcatattgagaatctcattgattggtggctgtgtctctctgtgcacagatccctgatgtcctccctgcccgtggctgcctggcttttggagcgagtccaccttacccgctggcttctggaagcagtaacaccactcattgttggagagtttgccgtccttgaaggagtcgcacgagttgaagagaggcttgatgcagggctcatatttgtctaggtagatggcattgatctctgagtggtccagcaacaggtcatagttcatgtccaacttgttgaacatccaacccaaggagtccttgcaaatgggtaagatgctggtgtcaaaccctgtgagagaaaggaacatctcagcctgccagacatggcgcataccctgccactccctaactgggtgcctcagaggggtcagggtacatccaactgt

SEQ ID NO: 4048 - DNA, 1000 bp, mus musculus; identical to SEQ ID NO: 4047

SEQ ID NO: 4049 - DNA, 1000 bp, mus musculus
ccccacacacagggagggtgacaataacctagggtagtgctgacttcccaccaggacctctaccagacattttacacagcacacgatgtgtaaaagccaagggaagccactccacccctcggcttcccggtgggcaaagtggaagccagcatctcacgggaatcgagggtggaggaggaggtctggggagagtcagaagatcgcactactaattgcatggactagaggtgaagtgtggaccctgctggatgataaatacctagagtacatggaagttttactgccctagacaccagatcctgaagcaaagaaatcctcctccctgtcacaggaagaacctggcaccggctgctcttctgtgactccgggaaagcagcaaggcctccgtccagggctgaaggctacacgagggcttagtgtagggcatggtagtctgagcactcagccattagaagcagctttgccatcatccctgtcatctctttaaaggattcagaggataacgggcttcccttttttgtttgtttgtttgcttgcttgcttgcttatttaagtaaggttcgtgttatcccagggggctccacagtaccttctcttctgaggagaccgtcagcttgtcgctggatatcaagctgcacacctggtccagacttaagctcagaaactcttcccccagcatcacctctgggaagtgctgctctgctccaagacaagaagttaagacaacaaggttaggcctcgagtgaccatgggcaacctttgggggggggggcagaagctgaggagaaaggcagaggtctgaaggcgaggaggagctggagggcagaggagaaaaagacagacatccaggctgtgggggagaaggacttttagtccccaagtgaaggtgtgtgccaccctgtgttgtctcgtcctgaacaatggtggagaggaaagtggagcagagagacctgggtttatatttggtctgctatctgtgagacggatccaggcactgcag

SEQ ID NO: 4050 - DNA, 1000 bp, mus musculus
ccagggccaaaaagggggagtgggtgggcaggggagtgggggtgggtggatatgggggacttttggtatagcattggaaatgtaaatgagttaaatacctaataaaaaatggaaaaaaaaaaaagaaaaatagctgatttaaatactgcaatgaacttccaattgtagaattctacttaataaatgtcaaatagaaacaacaccttcaagtacttcagctgtagtgtgtaaagaccacaaataaaacagttacattaaatttgatgggacaacaagaaggaacttcatttaccatgataatagaactgaaagggcatatgactggtgtcagttgcaacagagatgggactcatctataccacagtgatcaaaggggaatctccagtccctgggatttgttcaacatctgttcctggcatcatacctacaggtgcagatgctcacagccaaccgtcggactgaatggaccgaatggaagagcgaggggaaggactgaaggagctgaaggggattgcaaccccataggaagaatatcaactaactggaccacccagagctcccagtgactaaaccatcaaccaaagagggatccatggcttcagctacatatatatcagaggatggccttatctgacatgagtgggaggggaggcccttggtccggtggaggtgctatgccccaacgtagggggatgctggagaggtgaggtgggagtgggtgagtgggtgggggagcaccctcattgagacaaaggggaagaggaatggggtggggtgtctatggaggggaaactgggaaggggatatcatttgaaatgtaaacaaataaaatgattactaaagttaaaggagaagaaattcagttattgccgtccatctcatacaggatataagttagaaccacagcactcagcatattgcagatgaggatatctaagttctcttattgaacatcactgaaaggacaatgatactggaaaatctgagacggaaacacttc

SEQ ID NO: 4051 - DNA, 3400 bp, mus musculus
acaatcattatcagggattatggaatcaccagtttgtcagaacacaattattacatgaaagtacatctttatattggtctttgaataatttttttccaaaagagtggggagatacccatgtcattaggctatgtaatagcattagtaaaggcatattagcactcataagccattatggaatgtaatctgtggggttcatacctctcaaagcatacccatcacagtcatgcaaaacagtgggccatctacagaagactcacttgctttccatagtatttctgcatggtttatgccaaataagtgtgttccataagtttatgtatgtggtgtattcattttcattcattattttattttttatttttgattattctatttatttacatgccaaatgttgtcctccttcccagcctctcctttacaaccccctcttccattccccttcccatttgcctcaagttgggtttttctctaccaacccacttgtgcctcatgcctctagcatctcccttcactgaggcaaaaagccccacagaaccaacagccttccctcccattgaagctagttaaggcagtcctctgctacacatgtagcaagagccatgggcccatccatgtatgctttttggctggtgatttaatccctgggagctctgaggggtccagttagttgatattactgttcatcatatggggttgcatttctctttagctcatttagtcctaccctaagtcttctattggggtccccaggctcagtcaaagggttgggtgagtgtctgcatctgacttagtcaggggctggtaaaggctctcagaggacaaccaaactaagctcctgtaggcaagcacttcttagcatcagaaatagagtcaggatttggtgtttgcaaatggaatggatcccaaggtggggcagtctctggatggcatttccttcagtctctgttccatttttatacatttgaagatgactctgatatgcaaaggctttaccacagtgagaccattcataaggtttctctccaatatatgttgttttctgcatttggtgataactttgatgtgcaaagggtttaccaccttgcttatgttcacagcgttttactctagtatgaataatttcatgatcatgaaggctacagaaatgtccaaaggctttacaatattaaatgcattcataagaggatgattctttgcatgcctttgaagataactgtgccataaaaaggctttatcacactgattgcacttggagggttttgctccagtatatattcttttacatagttgaagttttcctgaatatgaaaaagttttatcacattgcttacattcacagggtttctcttcagtatgtgttctttgatgtattcaactgtgtcataacaactggattatcatgtcaattatatttgtcaggtttatttctagcagtgtgtgtgtgtgtgtgtgtgtgtgtgtgtgtgtgtgtgtgtgtgtatctggagactactgtgacatgcaaagaattaaccatattgaataccatcctagtgtttgcctacagtatgaatggtttcacatctttactatgacgatcatatccatagtgtttctcaccagtatttttctttaaagtattcagagactgttttgtgaaaaggttttctcacttctatcatacttgtaggatttctctctaatgtctgttcttttctacattaagagataactgtgatgtgtaaaagatttaccacatttcttctgttcatatggtttctctacagtataattacttccatgatgatgaagactacagaaatgtgtgaagaccttaccatttcaaataccttcatagggtttctctcccagataattccttttatgtttctggagactattgtgattttccaagactacaatgattacatccgtagagtttcttcagcgtgattccttttatggtattggagagtactgtaatgtgcaaaggctttatcactttgattacattcaaagggtttctctccagtatgtgcccttgtatgtattatgagactattgtgttgtgaataggatttatcacattaattatatttgtaagtgtttttttctagtaagtgttcttttctatatttggagatgactctatcatggaaagggtttatcacattgattacatttgtagagtttctctcgagtatgtattactttatgtatttgaagatgactactttttgcaaagactttaccacattgattacattcataaggtttccttccagtatgtgttctttcaagtatttgaagatactggtattgtgaatacgctctatcacattgattatatttgtaaagtttctttctaatatctgttcttttatgtatttggagactactatgacatgcaaggacttccctatgttgaaagtcttcagaggcaccttcatctcagtcctttctgctggggcagagtcttggctggtctgctcccatgaagacaccatatcatgacccatcctagaggactcactgcactcagaagagttggtaagaagcaccactatccccggagtctcagagctgccactggaagacaggtggacttgggacccatcacacagcaaaacccccaccctcccaaataccactcctcttctgtcccttctgccacttcctcctggtactttctgctgaggcagactcctagctgctttgttcccatgaagacttcatatcctgactcatcctagaggactagctgcactcagagcagttgatgacctgctacattcagagtagttgaggattcactacactcagagcagtgaggatcaactaccctcagagcagttggacaacagcttgactgctccactgaagactaaacagtctgaggacctcccaggatatctactgcaaccagagcaacagatcaggagcttcactgcccctgtgaagagcccccagttggaaggccccacaggtggtctgctacagtcaaagctgcaggcctaccaggagacctgagcaacccagggacaaaagaggcagatttcagacagccacccaaaccaacaatcatcagggatgtccagatggcaaaaggcaggcacaagaccataagtaatagaagccaatatacatgggagtcatcacaaaccagttctcccaccatagcaagcaatgaatataccaacacacctcaaaatcaggaatctgtcctaaaatcttatctcatgaagataatagagtttttgagaaggatatcaaaaactcactgaaagaaatacaggaaaacacagaaaaacaggtgaaggaattgaataaagtaatccaagacctaaaagtggaagtagaaacaataaagaaaacacaaatggaggcaaacctggaaatggaaaacctaggaaagagg

SEQ ID NO: 4052 - DNA, 1000 bp, mus musculus
gagctcttgactctagctgcatatatatcaaaagatggcctagtcggccatcactgggaagagaggcccattggacacgcaaaattgatatgccccagtacaggggaacaccagggccaaaaagggggagtgggtgggcaggggagtgggggtgggtggatatgggggacttttggtatagcattggaaatgtaaatgagttaaatacctaataaaaaatggaaaaaaaaacacacatggtaagtagtcactgataataagtagatatcaggcaaaaggctcagaatacctaccatacaattcacataccatatgatgctgaagaggaaacaagaccaaagtgtgcatgctttagtcctactttgaaggggaaacaatataataaccagatgtagagggtgggagggacttgggaggaagagaagagggggagagggaagaggggcaggatcaagtgtgggaggaaacaggggagatgtcctgaacagaggttcaggaatttgaacagaggtgtgttgctaaagggggtatagggaactgagagtagccaccaggaagtcccagatgccaggaaagcaagagggtgccaggacccaacagggatgacattagataaatactcaacaaaggggaaagagaacctgtagagaccatattcagatgttagctatagccccaagctgaggcatggggccacctactcatctcaaaaattttaacccagaattgctccattctaaaggaaatacagagacaaagagtagagcaaagcctgaaggaaaggccatccagagaatgccctgcctggggatccatctgatatgcagccatcaaactgagacattatggctgatgccaagaagtacttgctgagagaagcttgatatagctgtctcctgagaagctctgtcagagcctaagcaatacagatgcagatgcttgcagctgaccatcagactgagcatggggagcacaatggaggagttagaggaaggactga

SEQ ID NO: 4053 - DNA, 1400 bp, mus musculus
taagtccatgaaataactcattcagttgtgaaacactgttggtgagtattagtgccttttctgttgttgtgataaactgtctaaggtattgtagaaaactgcaatcccaaaccaggttttccaccccagttttggccatttcttttctaggtaaaacacacacaacttttatatttgtaataaaccttaatcaacacccaatattggctgatatctatcctctattctatcacatctatttcccagccagtaattttgtcatataattttgccatatttcatctgggctatgcttaactccacttagtcaccccacatggccattattttattattgacctaacctaaggctacttttttctctgtctacttctccttgtggttctcctctgaccccaagtccagtatccctaatccctgtctatgtctggtctgcccagctactgtccagctattgattgttgtcatctttaaaaaccagtcagaagaaacttgagagcaaggtcacacaccttctttagggtgtgtgtgcagatcttgtcttctatggagcaatcagtttttagtttcatgcttttaacattacagtacatagcaagagacgaaaccccaacatgaaggcaattttttgaagcatttaaatttccttaaagttctaaagggatataggatcaccatgatattatcagggcaacaagtgtcatttgtggcagctagaggaggagctcagagctcacgtcctcaccctatagccttaaagagagagttaaagccaggtgaggtgtcactcacctttaatcccagcacttgagaggcagaggcaggcaaatttctgagttcgaggccagcctggtctacatagtgagttccagcacggccagggcttcacagagataccctgccttgaacaaaccaaaaaaaacaaagaagaaagaaagaaagagagagtgtgtgtgtttgaggaagtaaactctgaaattcaaccatagtgacatattttctgcagcaggcagacatttcctacatctccccacatgacattactaactgagaagtattgatttctctgccatcaattctctgtctgctttttgttatataagccaacttatgatgaagaaaatctccgtggataagcattagatgccacaaaccctgggttatagtagtcaatgtttatacaagaataacatcatgaataaaattttctttgcggaccaacgtcgtttaattttatttatggggtttgtctgcatcttcgggtgagtatgtgcatgtctatgctgatatccaagattattaagttgttgtatcttcttatggcagaagatacactaagatgtccaaacctgaccttgtccctgggaatgaaaatgtcttaattagttggccatgtctct

SEQ ID NO: 4054 - DNA, 1400 bp, mus musculus
caatgatgtttatctttttaaagagttaataattgatttcacttttttgtttgtttgtttgtgttttcaagacaggatttctctgtgtggtcctgactgtcctggaactcactctgtagaccaggctgacctcgaactcagaaatccacctgcctctgcctcccaagtactgggataaaggcgtgtgccaccaccgaccatgatttcaatttttgaatgtgattttctttaaatctatctctaatattgtctcttaattgttttcattctccagtacttcccagtcattaaaaatttcttttcatttttaaagagtgctgttgattatttatttctgtttagagcattatctcctggaccataggctggctcattctctgtaatttagaattaatttgaactttcaatcctgtctctgctgccacaagctcgggtgtcagtcctgcacctctcccagcctcggccttgactgcattgaaaggaaagataggccagtgaatggttgccgtccaacttctgttttctgttgggactgtccaatgaagctgcacctgtgcaagaattgaattttgtgaccaactttgagatatgtttagtcacagcccagaaagggtcagtacaaaaggaggtgataatatctctgctttgacagtacttaagattcacattgaggtaatcaattttagatgattgataactgtcctgctgacccatttttctatccaccccaggcaatcaagaatctggataaaaacctgaacttgctaaaatgtcaaattactgtagttacactagttctaccaagaataatatctaggtaatgattgtcttgctaccaaataagacatttttgtgtttttttttacagttttaagatgatcatcctgagggctggcaatatgactcagtgggtaagagcactgactgctcttatgaaggtcctgaattcaaatcctagcaacatggtggctcacaaccacccgaagtgagatctaacaccctcttttggtgcgtctgaagtcagctacagtgtacttatttataataataaataaatcttaaaaacataaaaaagatcctcctgagagaataagcctgagtaatacttggtgtgctctaatacacttccctcctctctggagaacataatcttcaagccttttccactttaaaaccatatttttccattatacttacagcatttctaccatctctcttctgtctctgaattccttcataaacaatttattgtttttcatgagggcaatttctccttgaacaacaattacagtttgaatgtgacctatgtttgcctgcaggacttcccagctatgaagctaattgatggctgaactgactgtagatgtgtaagagaatgtacacatgatgtatcctgttac

SEQ ID NO: 4055 - DNA, 1000 bp, mus musculus
tttgttaatgtttaatcatcaagattgacctccttttaggctccattcccataacaaaaggagataaccctaattaataatcagctattaagtacccccaccccccactcacacacacaaagaacaggcttttaaggagcagctcaaggggcagtgcagggttaaacccatcatctcctggtctgccattaagtccactgtaggaggagcgtaattctgtcaggtgggcaagattaacctgggtaacagttgttggaaaagagcaacacttacgaaacaaacctggcagtatctttgctgtgtaaatctcccgtctgcccaagtgggcagacttgaagtctccttcctgtctctgtttatattgttcaaagtgtaacctggggctgggaactaaaagatatttaagcatgacagcataaataatatgcataaacctatggtgtatatcagctagtgaaatctatttactgctagattctctttgggcattagctagaatcagacattctacatgctacactgaaggttttttctttattaatctctagcgagtagagtaattccacactgggattaatactataacaataggtagagcttattttcttatttgaaaacaaaattttggggaaactacttttagttttctatcatagaagggtgtgacttgcaactaacctctatatatccaaagaatgtttaggatttttattacaacagcagaagtactgaaaacagactttagttagcttattcttaaacatttgttttcagacaaaactttaaacatatacattcatatagttttgatctagcaattagtaaagatttatcttcatttacattatgataaaccagtacagtgaatttacctgtatacatttgtgcaaactaggaaaaatcaccttataatttgttttacacaacttcccttaaaataattttttatttcaaaaatgaatgtattttatacaacttcccttaaaatagtttccctatt

SEQ ID NO: 4056 - DNA, 1000 bp, mus musculus
catggaattcttgctcatgggatatccagatgaacaggtgctgcagacattgtgtgccacacttttcttcttgatttacctgggagcactagtgggaaacttcctcattatcaccattactactatagaccagcatctccagtcccctatgtatttctttctgaagaatttgtccctgattgatatctgttatatttctgtcactgttcccaaatccatcatgaactctgtgactaacacccattccatctccttcctgggatgtgttttacaagttttctgtgtaatatttttggcaggcactgaatttgccttgcttttggtgatgtcctatgaccgctatgctgccatttgctttcctctacactatgaggccataatgaataaagaagcctgtgttcagatggtggcagcagcatggctcagtggatgtgtctatgggtctgttcatgccacaggaacattctctgtccatttctgtggtccaaatgtagtgtatcaattcttctgtgatatcccatcacttcttagacttgcttgttttggagaccaaattctagaatatgtgtttattattactagctgttgttttgccttcatgtgttttatattgatggttatttcctatgttcacattttcactataatcctaagaattccttctatacaaggaaggtttaaaattttctctacctgtataccccatcttactgtggtgaccttatttctctcttctggatttgttgcatatttaggctcagcagtaaaatccccatcatcactgaatctctttatgtcagtgttttactctctgttacctcccagcctgaatcctgtgatttatagctttagaaattcagatgtaaaagtggccctacataacatttttggtgaaaaaatgaccacacgcttctaaatcttgaaaatattagctactatgaaacaaactatataaaattatctggtaatccaaacctgtaataaaattatttggtatatg

SEQ ID NO: 4057 - DNA, 1400 bp, mus musculus
ccaatgttataaacagaatgattctaatgctatacaaaagtctataatttaacttaatcctgtaggtagtaaagtgtgaaatttttcttcttcttgtatatcctctttcttttccatcctctctggttataaaatgacaaattttacacgtgtctcagagtttattctacttggattcagaggaggtcctggtatacaaatgttgctatttctgatttttttatttttgtatgttatagcagtggtggggaattttggcatgattataattatcaggatggatgcacacctccatactcctatgtatgccttcctccagagcctttcctttttggacatctgctattcttccacaattgctcctagagctctgataaactgcttgaaacaggatcatacaatatcctttagtgggtgtgccacacaattcttttttttgtctctttttggtaccacagaagcatttctcctggctgccatggcctatgaccgcttcattgctatctgtaaccctcttctatactctgtgagtatgtcccactgggtctgtggattgttggtatcagggtcctattcatggggtgcagtgaatgctgtcacgcaaaccacaatgaccttcactttgactttttgtgggtccaatgagatcaatgacttcttctgtgacgtcccaccactcttatccctctcatgttcagacacttttataaaccagctggttcttcttgctttatgtggttccattattgtcagtaccttcttgactgtttttgtctcatacatctatatcatttcaacaatattgaagatccgcacagtgcagggacgacagaaagctttctccacgtgtgcctcccacttgattggtgtctgcttgttttttggtactgttttcttcatgtatgcacagcccagtgctgtctcctccatggagcagagcaaagtggtgtctatcttctacactattgtcattcccatgttgaaccccctcatatacagcctgaggaacaaagatgtcaaacaagcactgaagagaagcaagcagagattttgttcctgattctctggatgtaggtctcgcaaagtaacctggacttcacgccaattcattgttactctcatgatttatactctagtagtggttcttttttttttttttgaagtctttaagaaagagaatatattttatttttatatatttatcaataaatgaaatcatgctgatgatttgctgatgagaaataagatgtaaactgggaaaatggataattgctttggtatgtgtttattttgcctcatatacaggagcctaatcaaatttcatcataaaaatgattatacaatcagaaaatatttatcttgaatgtgactcatgaagtagtaaaacagatctttccaaa

SEQ ID NO: 4058 - DNA, 1000 bp, mus musculus
taatcattttatttgtttacaattcaaatgataacccctttccctcttccccctccacacaccacccattctatccccctctctgcctccacccactccagattcacactgctctagcatcaccctacactggggcatcacgcctccacaggaccaagggcctcccctcccactgatgccagatgaagccatcctctgctacatatagagctggagccatgcatctctccatatatactctctgataggtggtttagtccctggatgctctttatggtccagtgggttgatattgttcttcctatggggttgcaatccccttcagttctgtcagtcctttcctcttctgatggggtctttcctgtctttagacagaaatgattctaggttaaaagttttgatatggatgggtggctcaatccctcaactggtgcccgtgcctgtctactggatgtggcctctatacgttctgtgtctcctctgttggatattttggctaatgtcatttcccttgggtcctgggaacctctcaattccctggtttcttggactttctagagcctacccccagttccccatcctctagtgctacatatttatattttctgatcctctgtacttctctcttgtctcttcccatacctgatcctaccctccatttcattatgtccccttctacagtcccttttaggtacccatgaagcaacttcattggaaactttgccccaaggaatggcttatagctttccattatgtaaaaaattttgttgctgcttcgatacaagaagtcaggacattgaatctttcagtgtctattgttccttatatggatattttatcagctgatccctctgaaggagtttttactacaagccttgtctctgatacaaggagctttaaaattttggagtggttgttgttcaaaggcagtatcttctggcctcctccaagaggctggcttcaagtctccagctctgccctctgcagcactctaggctca

SEQ ID NO: 4059 - DNA, 1400 bp, mus musculus
agcctagctagaacttgaatgtgtgcaatagggaaaagacaatttctaagctgaaatcatggcaaaaatcgtaaaattgtaaaattatttctgcatgagaagcaaggaaagcgaaacttgagagcacaggctgtagggaccagggagtccctagacttaagaacctccgatgtctctgggtaaaggccctgctactctcagggtcacaatcccatgaagatgtgggagtggctcatcagaagactgggctaaacttagctatggtgtttattattatttattattattattttgagaaaacaaacctggtgatctttatcacactcctgtagaccatataaagttagaggagagaaccggctcagagtcgtcccatgattgacacatgaaagttcactgagagccaaggctagcccattaagatggaccagcaaggtccagggatttgcctgtctctgcctccccaggactgagtttgcaagcataggtcctcaggctttggaagccatcattggctgacccttatctcccagcccaggtgtctggtctttagctaagctctccaaaagagaggacacccaagtctgtcttcattgaaccacctgtcccatacctgcttgagttactgtgggatctaggacctacgggctctgcacagaggtgtcagccagtgtccactggagttggaggggtggaaatgtagctggtttatgccacctgtagtttctttagattccctgtgggcttcagtggagacaagggtttggttttgtataatccaaaataaattcaagaccacctagccctttttccctctgaagggactttccaaaagatactagcaggccaagtgcagagccagataaggaagcaggccgactaaacaatgctgagaaaaaccgtaagggcaggtggagtgagggactaggccaaaggtagtcactctattcaaaccaaccaatgcctgaaagggttacttgctataccaattagaataagccagttagacctgttgcctaaacctgccccttccaaggaataaaaagtgtgttctttgtttgtttggggccttttctcttgcctgtgtgttgaagggtgttccccaacgtgttggatcaattaaaaaaacctcttgtggtttgcaacaatgtctgtttgtggtctttgtgaaagagggtcttttggtggactcctacagtttctgttttactgtcacacaccccatgcatctcaagagcaaaataaaacaatgtccgatggtgtggacggctctgggtgacacagggacaaagctgcccacccagcaaaagatcccgaccctgagatacagatgctcagatctgcctcctttatgtctttggacactaaaggattctctaactttgtgtccatttaagtat

SEQ ID NO: 4060 - DNA, 1000 bp, mus musculus
cttcatgttctgttgtagtcatcagaaaaatattaatttgatataatgtagacatctttcctctttttattaatcattttatttgtttacaattcaaatgataacccctttccctcttccccctccacacaccacccattccatccccctctctgcctccacccactccagattcacactgctctagcatcgccctacactggggcatcaagcctccacaggaccaagggcctcccctcccactgatgccagatgaagccatcctttgctacatatagagctggagccatgcatctctccatgtatactctctgataggtggtttagtccctggatgctctttatggtccagtgggttgatattgttcttcctatggggttgcaatccccttcagttctgtcagtcctttcctcttctgatggggtctttcctgtctttagacagaaatgattctaggttaaaagttttgatatggatgggtggctcaatccctcaactggtgcccgtgcctgtctactggatgtggcctctatacgttctgtgtcccctctgttggatattttggctaatgtcattccccttgggtcctgggaacctctcaattccctggtttcttggactttctagagcctacccccagttccccatcctctagtgctacatatttatattttctgatcctctgtacttctctcttgtctcttcccatacctgatcctaccctccatttcattatgtccccttctacactcccttttaggtacccatgaagcaacttcattggaaactttgccccaaggaatggcttatagctttccattatgtaaaaaattttgttgctgcttcgatacaagaagtcaggacattgaatctttcagtgtctattgttcattatattgatattttatcagctgatccctctgaaggagttttactacaagccttggctctgatacaaggagctttaaaattttggagtggttgttgttcaaaggcagt

SEQ ID NO: 4061 - DNA, 1000 bp, mus musculus
tttatttatttattcccacggcgccccgccccctgccatcactctacccacagccccgccctgcgcgggtgcggccccgccccaaggctcctacacccaccccaatcccccccccccccccgcactgggcccggagcaagattaacctgcgcatttttagactctggcggcaacagcaggagcgcggaagtgtgaccctctgagacaccttgtcaacttcgcagttctcttcccggttactcacaggggtgcgggagcgcccactgctgtcaggaagcaccctcgccttcctccccctcccctcgtggccccgtgacgtcacacacagcctccttagacctgctccctcaaccttcaccactcaagtgcggatccgggatcacagagccctcgcgtggcgtcccgcccctcccgtgatcccggagactccgccccgtccccctgcaactgccagaagtcccacagctgcttccagaaccgcgacaggaattggaagtcccagccacccgccagcgctgcccgcttggggtcatccaggtcgtggtgcagggatgtggcgcgcggggcggccacgggggtccggactgagggataagggcgtgggcttggtgctcagcggtatccatgcggtgaatcaggcagcgcggccatagcgaagagttcaggggttactaagatcacaatccctgtccgcagctcattactccctggggtccaccgagggtgccctcctgctcccaacatctctcattcccctgctgcccgcgtcacgtgactctggccaggcggggcaactgtagtggggggcgaggctaggggtggcaccaaagcgcagccagggatcacactgtgtttcccagatggctttgtgacccctgacaccaagggtgacatctgacctatcatgagaaccccaacctcacgcctgacccctacatcacatgtgaactccgaattcagaccccaacatgacctctatagtgttttctgattcagactc

SEQ ID NO: 4062 - DNA, 1200 bp, mus musculus
atatgatgaagaagactacagaaatgtgcaatggcttcactatattatctacaatcacagggtttgtgtcttagaatttccattgctaggaatagatttcataaccaaggcaactcttgtaaaagcaaatatttaattggggccgacttacagttttagaggtttagtcgattttcatcatatcaggaatcatggtaggcatgcaggtaaacataatgctgaagaaggagctgagagttctgcaccttgatccataggaagtcaggaagagactgtcttctagggatcacacaggagggtctcttcagcactgggtggaacttcaaagccaaccctaacagtgatgcacttcctacaacaaggccacaccttctgacaatgccacaccctgggtcaaccgtattcaagatactacattccacttgctggcctgcatttgattgttcaaacacgtgggtatatggggaccacacttaaacatagtataatacaaaatacatgagattcaacttcaaaaggactcatcatctatagcagtctcacaaataaataaagtccaaagttcatcatctgagattcatccaatcacctaactgtaatcccctacattttcaaaaacaaatagcacattatatcattgtatacctccaaattcacaggatgtacattgccattcttttttttcttttcttttgttttgtttttgtttgttttgttttagagacagggtttctctgtgtagccttggctatcctggaactctgtaaaccaagctagcctcgaactcacaaatccgcctgtctttgcctcccaagtgcttcgattaaaggcgtgtaccaccactatcaagctactttgttatttctaaatagcattgtgaggaaatactggaccacaagaaggcgaatctccaaattctgcatatccgtgtctgatttcaagtgttcttcagttcttcaacacctttctgcttagttcactccagcacaattctttctctttggctggacttatttcaggaaagcagttttcctgagtaggtatcccatagctctagcatctcaaaatcttggggtctccaaggttactataatattacatcttcatgttccactggctgggatctacacatgatcttttgcactcctcaaaagaaagtgggtcacttttccagctcttttctctatagcaccctaggtt

SEQ ID NO: 4063 - DNA, 1800 bp, mus musculus
ctgcgtgcctggtgaagtggtgtggcctgctgtgtgtggatgggaactgagagtatataagagtgagaggcccgggttagagggaggattattattcgagagaggattattattcgagagaggattattattcgagagaggattgttattattgggagatataaacaagggagatataaacaagggagatataaacaagaagaaataggactgaataaacgtgtgcagaaggatcctgttgcagcgtggttcttcctggccagttgagcgcgcgcaagagaattataaaaaagtacctttgccacatactaatcaaaacactaaatatataaagaattataaaaaaaactacaacagaaaaaattaataaaaacaaaacagaacaaaaccaagtaacacatgagagcagacctattaggtttatacctgtcttctcaatgtctactgtaaaagacaaaagggtttgaacacatgtggtgcagactcaaagaaaccagccttgtttctacaagcctatggtccaaatgttttgggcagattcagaatcagccatgatagggaagctattcagaggtcactgcctgatctagcaagtgaggagcaacacaagggacctcacatatggcttatacttgccatcccagagaggacccaccacccagctcccattgctacctgctcctctgaattgtgggcagtgaccctgtgtctcaacttcagagcttcgctgaggtccccttacaacacccaacacctgagctcagagcaggacacagagagccattcaagtctgcacagccatagagaacttgaagaaaggcacctggaagatcccgcctccttgtctaactggcatgtcttcctggaggcgtttattggccaatgaatcttaccctgcctcaaggttaaagtatgcttcaggtccaggacctgaccttttccggatttgagcagtgctttgcattccattagcatttgtccttgccctccaagggattactcacccaccctaacctgggggaaaactcaccagaccagtttaggctattcagctgcctgctcctccctctgtgagcaatgatcctgcacttaccagggcctgacttcagaccttgcctgagctttcctcacagtacttgccctcctcttcctgaaatcaaggtgaatagctcacatagcccattactcctgtgcagtgtaggtaacaatctgacccactgagtggaagggtgcctaggcaattaatattaaagaggtattttaggaaacaagagttttgatttgtggcttcgtgctgggctcagggaaaccacagctccctttcaccagatgataggaatcaaacaaccctgggagaaaagccagaaacataagggaaacactgttgtgccctcttattagacagcacatcttcatcagtggcgaaatagagaaaaaccacagttggattagtacaagttctctagataaacatatctcaaatcatacaatgaatgtatgtatatagaaaggaaatttaatagaatgtcccaataaaggctctcagccaaccgaaattagaaaaatcaaggactggttgattgcctgctgcgggtttttatagctgatgtaccagaattctaaagaaataagtactttttaatgccagttataaaaatcacacgagcaaatcacctttgttttatgaaaaagaatggcacgtaagaaaaaactgaaagcactaccctgttcaatgtctttcatatatgcaggatgcctaaagaatctattgcctagattaaaggtggatctgaacatctc

SEQ ID NO: 4064 - DNA, 1400 bp, mus musculus
ccctatgattgtaataaatgtgttaaagcctttgcatgtcactgtactcaacacatacttaaatggacacaaagttagagaatcctttagtgtccaaagacataaaggagcagatctgagcatctgtatctcagggtcgggatcttttgctgggtgggcagctttgtccctgtgtcacccagagccatccacaccatcggacattgttttattttgctcttgagatgcatggggtgtgtgacagtaaaacagaaactgtaggagtccaccaaaagaccctctttcacaaagaccacaaacagacattgttgcaaaccacaagaggtttttttaattgatccaacacgttggggaacacccttcaacacacaggcaagagaaaaggccccaaacaaacaaagaacacactttttattccttggaaggggcaggtttaggcaacaggtctaactggcttattctaattggtatagcaagtaaccctttcaggcattggttggtttgaatagagtgactacctttggcctagtccctcactccacctgcccttacggtttttctcagcattgtttagtcggcctgcttccttatctggctctgcacttggcctgctagtatcttttggaaagtcccttcagagggaaaaagggctaggtggtcttgaatttattttggattatacaaaaccaaacccttgtctccactgaagcccacagggaatctaaagaaactacaggtggcataaaccagctacatttccacccctccaactccagtggacactggctgacacctctgtgcagagcccgtaggtcctagatcccacagtaactcgagcaggtatgggacaggtggttcaatgaagacagacttgggtgtcctctcttttggagagcttagctaaagaccagacacctgggctgggagataagggtcagccaatgatggcttccaaagcctgaggacctatgcttgcaaactcagtcctggggaggcagagacaggcaaatccctggaccttgctggtccatcttaatgggctagccttggctctcagtgaactttcatgtgtcaatcatgggacgactctgagctggttctctcctctaactttatatggtctacaggagtgtgataaagatcaccaggtttgttttctcaaaataataataataaataataataaacaccatagctaagtttagcccagtcttctgatgagccactcccacatcttcatgggattgtgaccctgagagtagcagggcctttacccagagacatcggaggttcttaagtctagggactccctggtccctacagcctgtgctctcaagtttcgctttccttgcttttcatgcagaaataattttacaattttacgatttttgccatgattt

SEQ ID NO: 4065 - DNA, 1000 bp, mus musculus
caccattttgtcttgaaccatatggttatattaactaaatctgtggtgaagacacatggcctatgctgtattgatgaaatcattatcaaagaagggcaccaagttccatgattgcttccatcttatgaggatccccaagtgaaacttagatcaaccaatgcagtagtggttttctgttctatgtgaattgggccccttggtaaagtaaagaaatttcccatcaggaagttccagattcttggataacctactttccacttttctgggggcaggaaaatagatgatgatatgaaaaagaggactagtaaggcagatgagagaaaagataaaagctgattacacatagcatagcaaatccattgccctaaccctgagcctagccctaaccatgatatttcttctttgtgtaacaggatactattgactcagtagaaccatcaaaaataatggtggccaacttaaccctaaccctgagcctaaccctgggacttacccccaacctcttaccctatcttaaacctcaacccttattttcctaaccaccctaaccctaatcctaacaacccttgagatccatctttaatctaggctatggtttcttttggcaatctacatatattttaaaaagcctcctgttttctaaaattcctttttaatgttaatagcctggccactcttccattcctgggtcagattgatacctacaatgcagctagagtaatgcgctattcaagctactcaccttgatttcaggaaaaagaacgcaagtgctatgaagaatgttcaggcaaggtctgaagttaggatcattgctcacagaggggaggagctggcagctgattgcctgagctggaatggtggattcttcccccagggcaagcacaaatgctaatgagctgaaaagggctccagagatctggaaaagctccagccttcgacaggaagcacacttcaaccttgaggaggggtaagactcactggccaatcaaggtctccaggc

SEQ ID NO: 4066 - DNA, 1000 bp, mus musculus
ctgctctcagcttcagtcctctttcctgaacttgccctaggattggctgttcaatcaggtctcagctagggactttacaggtatgtatgtggaagataaagacagaaaggtgacccatttggaaggcactgcaacagtccaaacaggtgttcatggccactaagatggttgtttagctttgggaggcaaagtgaatctggtgaaagtagttcagttgcaggtataccctccagatggagctgggcaggctcggagaggtgaggtgacaactactccttttaattcattcgattccttatcctgatcatttccggattaagtggtctgcccctggggatagcttctccaactttttatcagaccattgtttgagcgcttgaaaacattaagttcatcacgtcacatgtaacattctgtattagagttctgttaactgtgaagaagcactatgacccctgcaacccttataagggaaatcatgtaattggggctgccttacaggctcagaggtttaggccattatcagcatggcagcatacagggatacaaggtgctggagaaggagctgatagagaattgtacatttggatctgcaggtggcaggaagagagtgatagtgggcttgccttgagcttttaaaatcttaaagcccacccccagttgtgtacttcctccaaaatgctgtacctattgcaacaaggctcctaagtgctactccctatgagcctatgaggccattttcatccaaaccatcaccacatacctctgttttggttctccagccttaagtagagtgtgcctgggaaggaagaccctttgccatgtcattccaggcacccatggctattcacaagctccttctgtacagggacttggtctgcattctgaaaactgggctgttcagctttcctttgctgaccacgattacttgtcaatcatgattacttgtcaataaagggaagctgatcccgactctagcttgagtgtcacatctctctct

SEQ ID NO: 4067 - DNA, 1000 bp, mus musculus
aggcaaagaccttcacccagccaacactgcccaggcaatccttgaacttacaagcttctccattccttgatttctgtcagtctaacgcaggggtcagtcccaccaacccccgcagcgccctctcaccagccctgtccagaaagctcctccaaatcagctcttcccagctcccattccatccggtccctgttccttccggaactatgcaccccgcacagaccctgggatgactgaaccctggaccaacctccatgtcagagatccaacgggagagcacagcaggaccagagtctggcccagctttggataagagccgcacatgcttactaaaagatgaactgtttactaaaagtgcagacctgtgacgtcaccgtgctgcagactacatttcccacaagtctgtgcgatggcgttgcaggagtcctaggagagtgagttgtattatttaaaggtcctggatttctacattgatgtgtgtctgcaatgtagtgtcacctacttaggaaacaaggagaccatgaactgtgtccagttctaacgagccgaatgtttatgtaaggtgccgcttttccggattttcactgtaaagttcttaattccttaatttccgtggagtttacagctatttgaggaaccacctcactgccagttaagtggcaataagctagtttgcagaaaccagaccatgcgttaatcatttcaaaagagttttacaattttctggaggagggaagttgccaggaacttatcttttagtaatttaagagcgggtgcccggcacacaataaagtttcctcacagaggacaaagagcaaaagcagggactcaggctgcttttgacattcaagattcacagcctgcggtgtctttaatcccagctcactgcaagcaaattcaggcacctctgagttccaggctgccttgtttacagtgagtccctggcctgccagggctacacagtgaaaccctgtctcaaaacaaaacaaagaacaacaaaacc

SEQ ID NO: 4068 - DNA, 1000 bp, mus musculus
ttcaaaataaaagactatggagatgttgctctcggcagagcactagcagtcagcatgacacacattccgtttttcctgttctgtgtgtggatgagacccagcactgctttcaggggcactttatgcagtgagcaatgatctgtccagacagaacaggattgcctccctcaggaagcctccctgaggccagtatatgaagaaaatgttcagggaaccaatcacattgtttcaagtcagttactaacctttgcaagcatttactgagggctaacctagcacgattacgtttccaaagttgaggtaagcaattgcaacaaatcaagcccagggttccagcattggtgcttcaagagctcaggcaaagacccctgtgtcacccaccagtgtgacttggccaatggaagtcaagtttaaggcttctcggaggaatggcctttacaccttattaatctcaataggttttcagatcattaggtctagtttctaactccaaagagcactgtatgtaaatggctctggcacatctaaaaacatgttgggcaaaatgctccagaaacttctcttgcagtctctagggtttccatgttaccatggggacatgagattcctcttagctgtacttttctctctgtgtgggacaagagcctcaaaatcaaagcaagatcactgttctcaagactgcaggaaaggcaggtggcagagtatctgaagtggccatgttcatgccagtaaaggggccacaagtactcgttctcactgaacctctgcaagacacacacatcttcctgactttcgatttccactcctctctagctctcagagcttttctctctgctcactgacctgttccttttgtacccacctcactttatctggtgatggcccagtttccaatcacaaaggcacataccaccaaagcttatccttagccatgttctcttctggctttgaacttcctgtgtacattcctggtatctgtctgttgttctgcctgacatcc

SEQ ID NO: 4069 - DNA, 1000 bp, mus musculus
tgcacttagcaaagtggagattgttgccatcaatgaccccttcattgacctaaactacatggtctacatgttccagtatgactccacccacggcaaattggccacagtcaaggccgagaatgagaaacttgtcatcaatgggaagcccatcaccatcctccaggagcgagatcccgctgacatcaaatggggtgaggccggtgctgagtatgttgtggagtctactggcatcttcaccaccagggagaaggccagggcccacttgaagggtggggccaaaaggatcatcatcttcgccccttctgctgatgtccccatgtttgtaatgagtgtgaaccatgagaaatatgacaactcactcaagatggtcagcaatgcatcctgcaccaccaactgcttagcctccctggccaaggtcatccatgacaactttggcatcatggaagggctcatgaccatggtctatgccatcactgccactcagaagactacagaagacccctctgaaaagctgtggcatgatgatcatggggctgcccagaacatcatccctgcatccactggtggtgtcaagactgtgagcaaggtcatcccagagctgaacaggaagctcactatcatggccttccatgttcttacccccaatgtacctgttgtggatttgacttgctgccaggagaaacctgccaagtatgttcacatcaagaaggaggtgaagcaggcatcccgagggcccactaaagggcatcctgggctacactgaggaccaggttgtctcctgcaacttcaacagcaactcccacccttccacctttgatgctggggctggcattgctctcaatgacaactttgtaaagctcatttccaggtatgacaatgaatatggctacagcaacagggtggtggaccggcctccaaggagtaaaaaaccctggaccacccaccccagcaaggacactgagagcaagagagaggctctcagttgctgtggagtccctgt

SEQ ID NO: 4070 - DNA, 1000 bp, mus musculus
gtgtgtgtgtgtgtgtgtgtgtgtgtgtgtgtgtgtgttaacagaaacacatacataaataaaagagactttcccactgagattgcataccaagcttctttagaattggggcacaccagaggctccctgcgtgttgcttccgcttcacaggctcttgcaagattctacatggcttccagccatttcaactcctagtgtgagatgaccacacagaatcaccagctttagcaccagtgcaaggcagtaccgataatgtctggaactagcatgtgagaacatctgggaagccaagcttggggaacttctagcccaatccacagatctttggaccccatccttcactcctcttagctaaggagcaggccaatggaatcccttcttcagactgggagttaaatatcctgtgacatcaatgacaacatccatagccatataacccatgacatcatcttttaactgtaatttagtcaatgacgttatgcagtaaacatgatggcctatgagatgcttccacagtccagggtgacctgacgtctatcattgaacacccctacaatgacttgcctctctgttggtagaacaggaggaaggcaagggtcacctatgctgtaacacaagttcttggagcttctttctccttccttgtacagctttacaccagatgtatggataagacatggctgcatccccagcttatgcctgtggtcaacaggtcactatgagcagcctgaattaccccatgtcagtttggcaacacagcatattcactcaaacatagttatagtctgggagaaaattatttaagtgttgaagaccagctcgctactacctactcacagtacataaaattccaagcaaagaaacatcaagtgtatacaggtgagaatacagaacacagttattgatgtctatgttaaccccctgcaaagaataaagtttggggcccgtgagacaggagagatccgcaattaagaatgcttcttggtcttgcagatgaccc

SEQ ID NO: 4071 - DNA, 1000 bp, mus musculus
tccatctggggtctatggtatctttctagcttcaccgagactttatgcacagatctaacagaaggcccaacagccagagcatagacttcagacaaaggcagatgcccaacctctgtgtccactcacatgcaaaggtgccactagaagaaggtagtttggccaggccaggcctcgagaaatagtttccatgtaggagcgttctcttatgttatccactgtgtttaagtaaacgtgtgctgctctctgagcactggcatcttaatggtttgtttttatttaacagatcaaatggcctgtgtgatgtcaccacaaggcatctgtaaaccccagagtccttgagacacaccacactcaccctgcagagatctttatcacagcatcctagcctcggcatcaacatttgaagtattggcatgcagaatacacaaactcgtgaatttgcatgtgatttaggaagagggagaaatagcttgaaagctgcacttcagaagaggaactgataggaaagaagagacagactgcaaggcgcacgtgctcgacacagacatgacacctcctctcctccattccacaggagcgtttccttctcagttcttaaaattagaagcctgtcttctaacccttttcccacccagtctctgggggcctgccaatagtttaagttctcaaagcaccagctctcggttttatcagttttctctattgtttaatctgtttccagttttaatttttgtggtttgattggatttttatttccttttctgtttaaaacttcttgtgaaggaagaaagtgtttgattctcagcttctcggtttttaccatcagttttttgaggctacgtgctcacctcttgctgcggctttggctgcagccaacgcagtctgatgtgttcctctaaaactaaaaccccatgtttccctccctgcacctggcatttcagtagaatctcataaaggctaacagtttattaagtgtgttctttgttgttttgtagttata

SEQ ID NO: 4072 - DNA, 1000 bp, mus musculus
caaaagcagaaaaaaagaagtttctagataaaaagacacataaaagaaattctacctggtgtaggtatttaggacccatgtcaagaggctcacaatctcgttggcctcaaggtcctctgatgcaaggtcctgcatccgagtgctcaaggcctggtggtacatgctcaggaggttcttaaagatctcatagtgaggagggaagcactggaccatcaggttcttggcaacaatgagatcatccaggacatacttcctaatgatctccaggtggcgcacaagccacatcttgtcagattctctggtgtctgcctgtgtaccttcgattctagttgtcacagttctgtccaagatggcaaacattttttctttccagtttttgggccttccaggaggaacaaacccagtttgcttttttcgatcaagtatccgcctgtcaattttttcttccctttcaatgattctgaccacggagaccagcaaggtaggatcccggcggacagtgaccagtgatctttgcagcaccatccacagctgcttagccagctcatcagagagcccctgtgtgctaccaaagtagccatgaatgagggtcatgtcccgtttgttcccactgtccatgcggtactgctcacacattagcccatcccgagagcactccagatccattagcttccggtgggcttgcaggagggccccttgctcgatgagatcttgggtctccctcacaatctcaggcactagaaaaaggtacaagttgatttggtgaaaacacagagatgacagcaggtaaagcaagagggacctggcatccatcttcccacctggacagaagccctgacagaccctaatggctttgatctatggagtctatgaaaggctagaaatcttcataaacctagccataaaaggcctgatggaaagtgagttatggttaattcagctacatgtgctttttctaaggcactgaattccttctttccagagctaaagtaggcttcag

SEQ ID NO: 4073 - DNA, 1000 bp, mus musculus
cctatcattttcccaacatatctttcatctgttatctgtctattctatatttataaacttgttgtctgtatctacctatttatctctgtcacatgaaaaagatagtgtgggggctatctcatgagcatcaagcacaatatgtagaatatcttaatctcacctcaccctgtgagatcaaaatagtctgtatcaacctgggtagtgcagaatctgaagactgtgttcaatcacctagacagtgttattcataaatgtttcagtgtatagctttgaaacgcagataattggagatcatctccttgtaacacatttcctttaatttttaatattgtaggtacttcccacttttttcaagtcagttcgttaggtgataaattagattttgttttcatagtttttatttatttgattattagtaagattaaaaacattccatgcatttactgatagactgtttggcaaatgacctatgcacgtcatgtaccaatttctctgtgagtgtttatacatgttaatagatgtggtgagcctcaaagcatgtaattgcagaaatatcagcaatgaatcccgggaatctgaaatgtttattacaaaagaaagaagagataagcacacttcaaaaactgaagagaagctaactgtatctcatggaagccgaaggaagaagaaataaaagtaagtggaatcagtggaatggtttatggccctctttatccctgtctagcttttaggcagaaaaaaattgtggatcagatttttttggctgggttggtgtccccattcctccactggaaatctttcctggttacaggaggtggccatttcagggtctatatctcctattgctaggagtcgtagctgggatcaacctcatagattcctgggagtttccactgtcctaggtttctagctcctcccagagatgctccttcccctcaggattccagttttctctcccttcatcctcctcaaacttgacccctctagtacccctctccac

SEQ ID NO: 4074 - DNA, 1200 bp, mus musculus
gaattataaaaattgacaaaagactacagagaaagcctttggaatacatggatctgaacctgcttatgtcaatacaggataggtctagagctgaagatgtttaaattagggagacttgacaagaagtttgctaataagcatggcaccccccccccaaaaaaaaggagggtcaagagttatagagaataaaaggatgactttctttggatgctgattttgtggcttcaaaatcttcactgggacatataatccttttcccttgaaagaaaagtctgtggtaaaaaggtggaaaacataacactttactgtagttggtctgatactgcctgcattctaatgctaaatactggtttctcaagatgtgctctcccctttctgcacctcccccaccccccacccacccaccaggactagatcctcacgcaaaatgatgctagatgaaccttttcccaattttaactggtcaataaaaggttagagtctgtgattgggcagtggaggaggaaagtaggaccaggacttgagcttcaagtgagggctttgcaggtagagggagaagaggaggggggaaaagatgtgtgtggaggaagccaccatggaccacatggctgggagaaacaacaagctggggaacaagttggtataactctaaatttgcccaatctacacttatggctggtaaataaattaccttgaccgtgtgtcttttatatgggcttgttaggattatatattactttcatactttaccatgtcaatctattaaaacaactgttttccagatttatagaaactgctactctttttttctagttaaaaaacaattgtaatcatctcaaagaaacagtgactcacagtacattttcagaaaggcttcagaggtttgcctctagagtaactcctatgcaagcttcaggtttcagaaaggaacttcctttaaattctgttagagggatcttcaccgctgagttttcaaacacaatgttctttgccagtcaggagtggtggaccaacatccacaccaaccactcaccaagcacctaaaaccgaagtttgccattgctgtgcctgtcatttgagagaagcaacaccaccttgtgttactgaaacttgttgtaacctagtcttcatgattgcctgcatttaacaaacaggaccaaaaagctaatcttgtaaggaaatgccaaagacaggaataac

SEQ ID NO: 4075 - DNA, 1200 bp, mus musculus
tgacctctttattaggttttccatttccaggtttgcctccatttatgttttctttattatttctacttccacttttaggttgtggatcactttattcaattccttcacctgtttacctgtcttttcctgtattttttttttccagtgagttattgatatcctccttaacggactttttttcttcatgagataggtttttaggacagattactgattttcaggtgtgttggtgtattcagggctagctgtggtgggaaacgtgggttctgatgatgcccatgcattttggcttctgttgcttattggtcttaagcttgcctttcaccatctggatatccctggtgtttgttgatctgggtgactgtatggagtctgcctcttttgtccctgggttgtttcaagtttcctggtaggcttgcagccctagctgtattagaccacctgtgaggccttccaactggggcctctttacaggggcagaaaagctgctgatctgttgtcctggctgcagtagatctcctgggatgccttcagacttttgggtattcagtggaacagtcaagctgttgttcaactgtgctgagtacagccagtcctcaactgctctgagtgcagcgagtcctctaggatgtttctggatacggattcttcatgggagcagaccaactaagagtctgccccagcagcaaggactaaatggaaggagttgtagggatggagggaaggggagtggtattgtgaaaggtgggggttttggtgggtgatgggtcctgaggtccaccaggctcctagcagcagctctgggacttgagggccaggggtggtggtgtgtgtgatggtggtggggtggttcttaccaactgctctgagtgcagcaggtcctttaggatggattgatttattcatatgttgccccttccttgagccttcatgaatgtgctgatggataaagcagtgaacggaacacagtgagtctagcatagcaatggaatctaacaatgggccgctgggcttttctgagtgagttttttgttttgtttttgtttttgtttttgtttttgttttgtttttgttttttgagacagggtttctctgtgtagcactggctgtcctggaactcactctgtagaccagactggccttaaactcagaaatccacctgcctctgcctcccaagtgctgggattaaaggtgtgcgcc

SEQ ID NO: 4076 - DNA, 1000 bp, mus musculus
taagtggatattagccccaaagtttggaataccctaaatacaattcacagaccatatgaagctcaagaagaaggaaggccaaagtgtggatgcttcagttcttcatagaaaggggaacaaaatactcacaggaggaaatatggaggcaaagtgtggagcagagactgaaggaaaggctgtctcacctggggatccatcctgtgtacagtcaccaaacctagaagctactgtggatgccaagaagtgcatgctgaagggaacctgataaggctgtctcctgggaggcactgccagagcctgacaaatacagaggcagatgctagcagctaaccattgaactgagtgcagggtacccgatggaggagtttgcgaagaaactgaaggagataaggggtttgcagccccatggagggagcaacagtgtcaactggccagaacccctggagctcccaacgactggaccaccaaccaaagagtgcacatgaagggacccatggctctggctgcataagtggcaaaggatgaccttgttggacatcagtgggaggagtggcccttgggcctgagaggggggatcccagtgtaggggaatactagggcaggaaggcaggaatgggtgggtgggtgttggaacaccctcagagaggcagagggagggtgaatgggataggggggttctggatagaagacctggaaagggggtaacatttgaaatgtaaataaagaatatctccaataaaaggaaaaaaactatagcaggataaatttaaccttctataatccacaaatgagtgtttctgctaatgaatcattactgccctttccctccagttcaaatctcaagttatcacagtctcctatatggcttttctctcctactattagttcacgcatctcttggctcttttcccattgatcatctctctatccctatctgaaatcagagcctcacaacttcttgctggatactagcaatgccctgcctattagtgtctacagt

SEQ ID NO: 4077 - DNA, 1200 bp, mus musculus
ctttaagggatttttgtgtttcctctttaatgtcttctacttgtgtagcagtgttctcctgcatttctttaagtgagttatttaagtccttcttgatgtcctctaccatcatcatgagatatgcttttagatcagggtctagcttttccggtgtgttggggtgccctggactgggagaagtgggagtgctgggttctgatgatggttagcggtcttggtttctgttagtaagtttcttacgtttacctttcgccttctggtaatctctggagttagttgttatagttgtctctgtttagagattgttcttctggtgattctgttagcctctattagcagtccttgaggcaggcttcctcctctgagtttcactggtcagagcactctctgcaggcaagctctcctcttacagggaaggtgcacagatatttggtgtttggacttcctcctggccgaggatgaagtcccaaaacaggacctttcccagaagctgtgttgctttgacgggtcacagaagctgttagcttctatggtgcacactctcacctgtgcagactatgtttggtggagttccagaaccaagatggctaccgccaatctagaggcaaaagcctactgggccgggtggacacctgtcctctggccaggaaggtggccggatgtctggggccctaaaagggtgctgcctcagtagctctctggctcccgcctgttccagaagctgtcagcttctgtggtgcacactctcacctgtgcagactaagttcagtggagtcccggaaccaagatggctcccgccgatcctgaggcaatgggctcccgggctgggtggacacctttcctctggcctggggggtggccggaagtctaggggccgaaaaggacgctgcctcaaaggctctgtggcacccgcctgtcccagaagctgtcagcttctgtggtgcacactctcacctgtgcagactaagttcctaagttcggcagagtcccggatccaagatggctccatcagatcctgaagctaagggctcccgggccgggcagagacctgtcctctggccgggagggtggtggtcggatcacctgaagtctttttttttttttttttttttttctgtgttttagtatttctttcttttttttttttttttattattaggtatttagctcatttacatttccaatgctataccaaaagtc

SEQ ID NO: 4078 - DNA, 1000 bp, mus musculus
tcagaaaattacttggttaattgaagaatgaaaggatctatagaggagatgtttatattagtctgtttttttattacatattttatttacatttcaaatgttatcctctttcttggtttcccctttggaactcccctatctgatccccctcccctctgcttctatgagggtgctccccaactcaccctcctcccccctccctgccctgtcattcccctacactggggcatcaagcctttccaggaccaagggcctctcctcccattgatgcccaacaaggccatcctctgctacatatgcagctggggtcatgggtcgctgcatgtgtactctctagttgttagtttagtccctgggagcttggggcgggggtggggggagagtctggttgatattgttgttcttcctatggggttgcgaaccctttcagctccttgggtcctttctctagctccttcattggggaccctgtgctcagtccaatggttggctttgagcatctgcatctttaagtgtcagcctctggtagaacctctcaggaaacagctatatcaggcttcttttagcaagcacttcttggcatccatagtacctggcttgatgtctgtatatgggatggatccctaagtgggcagtgtctggatggtctttccttgggtctctgctccactttttgtccctgtatttcctttagataggaacaactctgggttaaaatttttggcatgggtcgatggccccatccttcaaccagggactgtgcctgacctctggatatggtcctccttctcctttattgggcatttcagctgatctcatctttgttgggtcttggtagcttcttgcttttctttcatctggaactgtgtttttcaagtcactaaatatatatcgccaactacctagcattcattaaagacattatcattttgtcaatacttatattcttacttgaatagtttgcagcactattcaatacagaaaatgtttctgcttagtt

SEQ ID NO: 4079 - DNA, 1000 bp, mus musculus
agcttcacagatttttgcttatttattatatatattatgttatatataacagataccttaagggagggagcattttacattagtgtgctatttttaatatggatattgaaagaaaaatccaatattttaaaataatttgtttcaatatctacagatacaagtaaataattatacatttgtagctataatagcttttatttgtaagtcatcaaaatcactttaaaattaactttttaaagacactaattttagctttgtaaatgaaatttgggattagggtgtatttaaggctattttttaaatgaacttaagatgccaaattgacagatgaccaatgtgtcagtcctgttttgcctgtccttcttgtcacacactggtggatatttctccacttttgttccactttaatataaagcacacagatgtttcagaacaagacttgacttctgaccttgaggccattagggtcagggtcctcggggcctgtgaaattatcacaagctgagctaaagtttttctccagcacaggaagtaactagtaagtaagaagttaaaaaggagctttgtctgagagacaagatggtcccagtaagggtcagcttctgtagtctgctgtccctgtaggaggccatgcatgggaggaggagataatgtaacctctgcagatctgtcagcctggagcagagctgagaagtctatttaatatgaaataccttgcttacatcttaaaatattaatgattatcatttcaaattcttgtatttgatacttgtgcaacaaatgattgcagttgtaaggcaggagcattacgatgcaaactgaagagagagtgaccccatcctaaagagcaacttacaagcaaataatacttgcactgctgtggtcttcactgtaataaacgtgataacatggagcttcactaggtttttatttcaaaatgctttttcaaagaaagcgttgggacagaaaagcaagctctatgatgcttataagcttgttt

SEQ ID NO: 4080 - DNA, 1200 bp, mus musculus
tcactcaacagcctttattttttattaaacattttgttcatttatatctcaaatgatatcccatgtacaggttacccttccaaaaatctccatcccacattttccttttcctccctcccctttgcctctatggaggtgatcccctatctacccaccctctcccactccaccactccagtatccccctaccctggggcatcaaatctccacaagaccaggggcctcccctcccattgatgtcagacaaggccatcttctgctatatatgtatctggaaccatggatccctcctggtacactcattggttgacggtctagtccctgggatccctgggtggtctggccagtcaatgttcttccttggggttgcaattaccctccactcctcaagttcttctgccagctcccctaccgaggtcctcaagttcaggctgatggttggctctaagcatctgcatttgcattggtcgggtactggcagaacctcccaaggaacagccataccaggttcctgtcagcaaagaaggttccaggatggccctttaaagcagtaattctcaacctgtaggccaagaaccccaaagacctttggaaaacacagatatttgcattatgaatcataacagtagcaaaaattacagttataacgtagcaatgaatataattttatagttggggtcatcatagtatgaagaactatattcatagcattaggaaggttgagaacctctactctaaagccataacctatcacagtggacctctaaggctaaaatttagaggcccgtgtaaatgccatccaaaagtgctaagagtggcactcaaggcatgcttctcactgaggttctgtgccttccttgtgtgaagccatgagaacacacaagtaatttggattagagtgcagtaccaatcactgtcatttcttctctgtttcattatggacttcaatgagtaaaagcatcactccttcaacatgctcagatcagtcctaaacatccatgaacctgtatatctatcttgtaacatctataattccttggcctcacccacaggcacagcacctgtagaaagataaaaacatgttcaactttctccagtggtagaaattctcttcttgctttttttccactgaaaaggtgtcaagagtggtttataattataaatgttcatagactttccctggcatcaaaagtatggtgt

SEQ ID NO: 4081 - DNA, 1200 bp, mus musculus
gtcatttttgtttctaaaatagtaatttttcattggaaagcacttttttattaaagtaatttattttttacactccatattgcattccctgtccccctcccccaaaccaccctccaactgctccacatcctatatctccttcctaccctactgtctccacgtggattccccgaccccccaccccacctgacctctaaactccctggggcctccagtctcttgaaggttaggtgcatcatctctgaatgaacacagaccccgggtccagatgaattgagactgctggtcgtcctaaaggatttacttctcctcagcttctttcagccttccctaagtcagccacaggggtcagccgcttctgtccattggttgggtgcaaatatctgcctgtgactctttcagctgcttgttgagtctttttgggggcagccatgttaggtcccccaaaaagcatgagtattccatagcctcggtgatagtgtcaggccttggggcctccccttgagctggatcccactttgggcctgtctctgaaccttcttttcctctggctcctctcgatttccatccctgtcattcattcagacaggaacaattgtgactatgggatggcaaccccacccctcactacatagcctgtcttcctgttggagttgggctctttaacttccctctcactactatagggcatttcatctaaataccctccctttgagtcctgagagtctctcacctcccaggtctctagtgcactccggggtgtccccccaacctgttatttcctgaggttgcctgtttccattctttctgctggccttcaggacttcagtcctttttcctcacccaataccaaatcaggttctcctctccctcatccaacctgtccactttccctcccagatccctccctcctcacttgtgtttgctttcttctctctcccaagtgggactggggtgtcctcacttaggcacttcaggttgttgacctttttgagttctgtggactgtatcttgggtattctgtacctttttttggggggggggctaatatctacttattagtgagtacataacatgcacgtccttttgagtctgagttacctcactcaggatgatattttctagttccatccatttgcctgcaaaactcaggatgtcctgggtcataatagctgagtattaattattccactgtgtaaa

SEQ ID NO: 4082 - DNA, 1000 bp, mus musculus
agcactgctgggagatcagctccttccaggcagaatctggatatggagagctgtggcacagggtcagccctggagcacagggtcagccctggggcacagggtcagccctggggcacagatggaaaccagaatgattgggtctctggctgttccttggttcctgtgtcctgatgtctttggatgggtccctcttgggccaggtatgtgaacagaagtggtggtcttacctgtgttctcaggtgtgttagcactccttggaatcctgctctcccctgtcaggatctaggtatggagatctgtggcacagggtcagctccaggagcagatggaaaccagaaggctgttggtgagattttatgtgtgttgcttttgacatcactggaagacacaatcacacagcaaactttctcatcttatgacacttataatctttttttataatagatgttttcttcattttcatttcaaatgctatccccattcctagtttcctctccaaaaatcccctacaccctcccatctccccctgctccccaaaccacccagttccacatcctggccctggcattcccctatattggggcatagaatcttcctaagacaaagggcctctcctcccattaatggctgactaggccatcctatgctacatgtgcagctagtgacatgagctctggaggtactggttagttcatattgttgttcctcctataggactgcagatcccttcagctccttaggtactttctctagctccttcattggggaccctgtgttctacccaatagatgactgtgagcatccagttctgggatccactatgaggcactggcattgcctcacaggagacagctatatcagggcctgtcagcaaaatcttgttggtatatgcaatagtgtctgggtttggtggttgtttatgggatggatccccaggggggcagtctctggatggtccttccttcagtctcagctctgaattttgtctctgtaactctgt

SEQ ID NO: 4083 - DNA, 1000 bp, mus musculus
caaataataagagctttgtacgactcaggagcacaagagaacaaagaggaaataaagaggaagaaaataaagatagaagctagctgaattttggtgctttcaagattcagatcctgatgttgaatatgcaagtgtggaatgtatttgtttaatttaaagcatgtagtttcattcagaaacccaggaaaaaagctgccgagtgctggacgtcaattaatattcttccaaatgactggcaggaagccacagtggacgtctagtcagagacagtgtgtcacactactgttgactgtaaaattaattaccatttctaaacacgaactctgtggtgcatattcttctggcatactatacggccctcctggcattaaaggttacaaatagttattttttttaaagtactctttagagaactcacaagtgaaaatattaacaatcccaataatgacaaaaaacacactgcatggtgaggcaagtcgacattgtgaaaacagggctgaatattaagaagtgtcacctacctaaagtaagtgttagacattcacatgatggcatcagctgctgatccagggcatctggagctgccctgtcaccaaggcattgctaaccaaggcagggacacagacaaagctgcttcatcattaatgtcagtaaaaggatctggaggaaaaatagagtctctggagaccttgtctggacttcttggagcccagacaacagtttttttttttttttttttccaacaacagtcttttccaaccttggagcagctgcaacaaaaggaaaaaggagagcattgactcaagttgtcactaagttcaaagaggtgagaatagtcatctgtggtgaacctttataggcagagttattaattgggaattcttttttatggctttttgaaaatatcacatttatgaacagtgttaaattatcctgggttattgtttgacatatgttgaccagtcaggttcaagctgataaaattaaaatctatcattgt

SEQ ID NO: 4084 - DNA, 1400 bp, mus musculus
attgacccttcatagtttatctagggttgctttcatgagcatgggtgcagagttatttactcaagcatgggcaaatgaccatccttgaggaaaaataactcactctcactttgaagatattaatgcccaatagcacctcagctagaggtgagctctatgagcctctcttccatccatactggaatgttgatagacttgatattgtgcaggctttatgtagataaccacatgtaatgtgagctcacaagtacagcagtcatgtcatgttaagaagattgcatttcatagcatatctctcttgttttaaagacattttctttatttacatttcaaatgttatctcctttcctagtttcccctctgaaaattccctatcccctcccccaccccctggtccacaacccacccactcccgcttcctgtccctggcattcccctatactggggcatagaaccttcacaggaccaagggcctctcctcccattgatgaccaactaggctatcctctagtacatatgcagctagagccatgagtcccaccatgggctttctttgattggaggtttagtcccagggagctctggggatacaggttagttcatgttgtttttcccccaatggggctgcaaaccccttcagctccttgggtactttctctagctccttcattggggaccctgtgcttcatccaatggatgactgtgagtattcacttctgtatttgttaggcactggcagagcctctcaggagacagctttatcagtcttctgtcagctagatcttgttggcatttgcaatagtgtctgggtttagtggttgtttatggggtggatccccaggcagggcagtctccagatggtcattccttcagtctctgctctgaactttgtctctgtaattccttccatgggcattttgttcctccttctacgaaggatcgaagtaagcacactttgttcttccttcttctaggggagtaaaaaactattctcaacaataagagagcctctggtggaatcaccatgcctgatctcaagctgtacttgagagcaattgtgataaaaacttcatgggactggtacagtgacagccaggtaggtcagtggaataagattgaagacccagaaatgaacccacacaacaatggtcacttgatctttgacaagggagctaaaaccacccagtgcaaaaaaaaagacagcagtttcaacaaatgatgctggcacaactggtggttagcatgtagaagaatgtgaattaatccattcttatctccttgtagaaagctcaagtctaagtagatcaaggaactccacataaaaccagagacactgaaacttatagaggaggaagtgggggaagagccttgaagataggggcacaggggaaatttttctg

SEQ ID NO: 4085 - DNA, 1400 bp, mus musculus
taaaaataaaatcataatatagaaagagacatgggctgttgctaaggcaaaaaatataatttatagctcagaacttcttgagatacttctaagaactgtacagcaaacaaaacctctattgtttataatcttatagtcttgtcaccaaaattgctagacacaattaaaattatactgcaaagaggacatgtaataatatgttaccaaaagaattcaggtctatatattttctaaatgtgttttcatccgagcctcacagctaatgaacaggcataacatgggctcaagagatttaaaacagtattaacactaaactacagatgaatttatcatgttaattaatttttaaaatttctcatttttatttttttatttttttttttaaagatttatttatttattatatgtaagtacactgtagctgtcttcagacactccagaagagggagtcagatcttgttacagatggttgtgagccaccatgtggttgctgggatttgaactctggaccttcggaagagcagtcgggtgctcttacccactgagccatctcaccagcccaatttctcatttttaattgatcttatttacattccaaatgttgtgcccccatcctggttccccttctcagagttcttcaccccatcctctctcccctttgcttttaagagggtgctcccccagccacccacctacccacctttacctcacccacttccttggagcatcaagtctctacaggataaagtccatcctctcccactgagaccagacaaggcagtcttctgctacatatatttctaggaccttggaccagcccatttatggtttttggttggtagcttagtttgtgggtgctcacagggatctgggttagttgacactgttgttcttcctatggggttgccatcccctttaattctttcaatccttcctcctctttcctaagggtccctgacctcagtacagtggctggctgtaagtatctgttttatgtttttatattacatcatttttgcaggaaagcacataatatattcatcatttcaattgactaagctttatatgtcttagtggaaaattaaatgcctaaaaatcaagccataaataaaatacgtggtttaatttaatgcatttcccagcataatgtaaatagtgggtttaggcatccagctgtcccattcagttttttacatttcaaatggccactttatacatttcaagtttttgtcatttgctattgaaagccaatcctatgcttttttaaacaacaaagaaaaaaattcacacttgattcttaaattgtgtttacttccaaagaattattatattttcaactcgtttgcttttgggaatatcaaataaatccaattattttataacagaatttttttttccat

SEQ ID NO: 4086 - DNA, 1000 bp, mus musculus
taaagccagctactgtgtcattttggctcattttcttgacagtgccatcataaatccatgcagctgcggggtaactgtcgactgcctcgattatcttcatagccagaatgaatcttgaaatgtgtgtaacaggcaatgactgttatggatcaggcacaagggccattcccaatccatcctgtcagtcctgtgaagcaatgcctcctacaaagacagttcctaaactactgtcatgtaactgagtaaagtacctgaactttgagaaatattgaggttttgctagggaaccatgagccatgtccagttactacaggaaccttactataagaccacattgatttctaacgggacatttttgaaggtaaatagcacttcttgacattagatatatgaggacaatgactatttaaggagataaaattgcaattatttgtttgaggaagagaaggcacttgcctattttcatataacaacacagaaggccctgttaatctttgttacagttttcttttaactttggactgagttctgataattccttggccatgcagaattgcctaagtgctgaagccaggttgctcttgggctttcacccaggaggttccacatttgtcttcatccagtgaattcttcataatgtcatttttctttgcaaaaatgttaacccatttttaaagaaaccatagagtatagttgtactaagttgcccaataactactaagtgaatgtatttaatatctcaaatgctaaattttcatcaattttaaaactaatctaccattctcacactataatttccagttacagtgtgtagaaggcctgctcttaatgattagtacaagtctaatggaggtaggtcaccagcaaatatctccactttgactttgtagtgaaatttttcattcatttcttagacactacctcatgaagaaatactatgtgattaaattactattctgcacaagatttgatttattaaagaatttttgtacaaaacaat

SEQ ID NO: 4087 - DNA, 1000 bp, mus musculus
aaaatatctactaaaaatgtcttggaaagataaggaattcaaggtccatatctaagcataataaaagcaatatatagaaaaccaatacccaatatcaaactaagtagagagaaacttgaagcaatctcactaaaacagggactagtcatggctgcccattctctcccaggaaagttctagcaatagaaattagacaacaaaaggagatcaacgggatacaatttggaaaggaagaagtcaagatattattatatacacatgatatgatagtatacttcagtgaccccaaaaatttcaccagagtacacctagagctgataaacaacttcagcaaagtggctggatataaaattaactcaaacaaatgagtagccttcctctatttaaaggacaaatgggctgatatagtatcccaccccatgggatttagttatttgtgggtgcaagggggacctcaaacctggaagaaaatgggaggaagggaaggagaagcagaataccatgcaaatagttgtcaaggtctccttaggctgagatgcctggttttaaagcatacatcacagggaataggagaggggttgagggggaattaaaaaagaacaaagaggtgggcatctgctgacatgagggccgaagtcaggcgccaggcagtgggcactctgtgtcttatctccggaacatagatcctctttaacagccttggatatcaggccgggctcaggtgtaactcatgtccttggatgttgtgggaactcaggaagagatcaggaagaggggactataattcagcttttacagcctcaggtgccaggaaaggaacagggaggagggagtgacaactggctcctatcacgaggtcatttggcctgtcagggtgggagattgtgagaagctcgctatctcacggtatagtctctgacaatatagaaattagagaaattacaccttttaaaatagtcacaaataatataaaatatcttggtgtgactctaaccaagca

SEQ ID NO: 4088 - DNA, 1000 bp, mus musculus
aatgtgtagcatataaatgttttgctatattgaagaattaatgaatgtttataaaatttaatttttggagaaagtttgcttttctgcatagtaaaatttatgatcagatatattcagcactataaacctgctttaccatttctgcacaaaattgacattcaaccatgttctaacagctcagatactggcaacgtctacaaagatgccactggaaaatatatatagtgcatacttttcatttctttgctgtcagggtaacatgtgtacttcatatgctttagtgaagtctagcagtacaaatgtgtcaaaatatcataaaaaaattgtcttctatgactaacattaaggatttaggaccatgccttttgggacatttatgttttagaaggaaaagataatgtattcttgaacaaatgcatatacataatgtttaacacacacacacacccttttgggaacataacaaaatgacattagctgaagttgccatactctgatgtttctaggattcctcagtatttgtttttttgtttatttgtttgtttgttttttgtttagttgtttgttttttctcattcagtcatcatactaaagtagactggaaagttataagatatttaaaaattgtacttttcgatattgagatatttcttcagatatttaaaaattgtattcaatatggggaaatacatatattttatattatataaacttatattcaggaaaatgaatacttttttaactgagatgcttttattgagtgagacagaaaatgaactgtttactgttatcaaaaatgtagtaactctcataaatgggaagttgaagaaggaaactggtgtgagacagcaataggaatgagattagcaattatgctatggaatctttgcttagctcctgcctcagctagacaccatttcaaactcctgtttgacattcttgccatggccatgaactgctgtgggcctcagaaccttgtataaaggttgttttctaagtt

SEQ ID NO: 4089 - DNA, 1600 bp, mus musculus
gttatgtaatgcaaactgatgagttgccccaagatatcatgatccaatattactttaaaaaatttgtcctgatgaaaaagactacaatggagaatctgtggataatattttctttcttcttatagttaattgtatgtgattgagaatttctaagtagattaactagcagtcatttccttctaaagagtgaaatgtgcttgcagttgcttgcttatcagtgtttattagtgatttcttattttttaaactttcttttttgttcttgtttctttattcctccttttaaaatatttttgaggaaataggtagaaaatattgatgtttctacaaccagggaaactattacaagaaatttaagtacttcaaatcttaatggctcaaaaattattactccttttattaataagatagatgagtcatagttttataacttgctcagatatatgcagctagtaagtagtgacttcagaattccacttcatattccaaattacttcagaaaccagttctctatcttacatgtaataggtaagcacttacagatatatatatatatatatatatatatatatatatcatatatatatgattcaataaatattcatgtctaagatttttcatgttctatgaaaaattataggttttagaattagtatttctatttttcttttttatgggggaggggcgttgaaacagggtttctctttgtagccctggctgtcctggaactcactctgtagaccaggctggcctcgaactcagaagtccgcctgcctctgcctctcaagtgctgagattaaaggtgtgcgccaccactgcttggctcagtatttctatttttaaaatgtctatagcaaatagtgggatgtacatatatagaacaaaattctatttctgcagatattaaaatttatttgtgtatatattgtggtttaaataagaatagacatcatatgctcatatatttgaatgtgtaatacccagaaagtagaactctttgaaagtattagaaggattaggaaatctggccttatggaaagaagtatgccactgggttttggagttgaggtttacaaagcctattttagtcccattctctttttatttatgctttttgcggatcagggtataagctacttctctagcaacctgtatatctgcaagcggccatgcttatgctataatgataatttacaaaacctttgtacttataaccaagattattaaataactatggaaaatgtgttcaacagaattacaatgacatcaagtaggacaagactgtagagaataatattacaaaatacttgccacatagcaaaaataataactcctatccacatcttccacttgatggttttgggaaaagacagctataactttgacaggatgagtaggaataccagataagaatggattatccagcctccactgtacagttactaaaaagtgtataacatactctgttgtcacattaaatctataatgggcttcttgaatctggggaattatttactacctaaaccagtatcatagaacaagttttatcatcatatttctgaggtactagcttaattttgattgtggattaaaagttttc

SEQ ID NO: 4090 - DNA, 1200 bp, mus musculus
caacactatattcagcaccccttcctgtctagagtttgagtagtatatggattaccttcaacccctggacacacatgagccccactgtagggttctattgttctgttggagtgaaatcgatgtgaatggctatttttttttattagatattttctttatttacatttcaaatgttttcccctttcctggtttcccatacaaaaaccccctatcacttccacctctcaatcctgttttctggccctggcattcccctacactgaagcatagacccttcacaggatcaagggcttttcctcccattgatgaccgattaggccttcctctgctacatatgcagctgtagccataagtcccaccatgtgtactctttcgttggttgtttagtccctgagaactctgggggtactggttagttcatattgttgtttctccttggggctgcaaactccttcagctccttggatcctttctttagctccttcattagggaccctgtgctcagtccaatgtatgactgtgagcatccacttctgtatttgtcaggcattgacagagcttctcaggagacagccatatcaggctcctgtcagcaagcacttgttggcatccacaatagtgtctgggtttggtgattgtatatggggtagatccttaggtagggcagtctctggatggcctttaacaaaagaacacacaagatatgcattcactaataagtggcatttgtccagaagctcataatacccaaaactcaattgacaaaccacatgaagctcaagaagaaggaagaccaaagtgtgaatacttcaacccttcttagaaggggtaacaaaatacccatggaaggagttacagagacaaagtgtggagcagagactatttttattcattgactatgctctgagaagtctagtactagttacattgtcatattgctagggtctacttattaagtctatcaaataccaaaatatcttgtcagtagcacagaattatagaatatgccctacacatcctgcctaaacacaactaaaatttctgataaaaatttaaaataatcagagatcattttaatccattttgtttacatactacccgatacaatttgataccatatttggcatatgtttgcttgcttgtttggctggctggttggtcgatagcttttacacctttaaaaatgcatttaaaatatag

SEQ ID NO: 4091 - DNA, 1000 bp, mus musculus
cctcggggccatggctgtaggagaaagagggtagtgggagagaacacacactttccatgtggccccgaatagacatctggctgttttaagccactgaccccacatggcacgtggtagacaaggagcagccccaggtaccaggttctcagactctggcatcccacactgtatatggcagatgacctgagaacagaataggggccccgggacagcacttggccttggacatgaagggagagaaaagcagggaagagaagggggcactgggtggttcccaggcaggcgagagtccttagtccagtccatggctacagcgtaggaaggccttctggctggagtttagactgcagctcattaggagaaagcccatctcatccatccttcaagtatggtgggccttgatgaatagagacagtctatggttttagagctttattgtagaaaggcagggagaaaggagagaaggtagaaagagagagagactggcaatagccatgtggagagaggggggaagggaaagaaaaaaacaagagttagagagtaggaaaggtggaagcttaaagagagagaaaggtggggccaagcagcccctcttatagtgggctgctctatcttgctgttgctaggtaactgtgtgtaggagtctagccaaaatgccagaagcttggcttcaaattgtctacctgactgatactcacacgcctcttctgtagtggttgtgggggtgttaactttgataggagccaggagcccaggagacatgtaggtggaaattaccacccatggggtcccactggggtccaggacctaatttcgactggagaccagtcggtctgtgtatagcccatggccccacaaataactacaggcaactgaggaatactgagaactgaagagagagttgattatccaacactaagtagttatctctgaaattatatataaataataggggagctgaaggaaggaaagggaagggaagaatgtgatataatctcat

SEQ ID NO: 4092 - DNA, 1400 bp, mus musculus
ggtgatgcttgcatctatgactcctaatctctttcctaagttttctatctccagggttgtccccctttgtgatttctttattgtttctatttccatttttaggtcctgaatagttttattcaattccttctacctgtttggttgtgttttcctctaattctttaagggaatttttgtgtttcctctttaagggcttctacctgtttacctatgttctcctgcatttctttaaggaagttatttatgtccttcttaaagtcctctatcgtcatcatgagatttgattttaaatcagagtcttacttttctggtgtattgtggtatccaaggcttgttgtggttggagaactgggttctgatgatgtcaagtaaccttggtttctgttgtttaagttcttgcccttgccctttgccatctggttatctctggtgttagctggtctcgatatctctgactgtgacttgtccctcctggaagcctgtgtgtcagtactcctgggaaaccagttctctctgggaggaatttgagtactgagaactgagtcacagggttagcttcagggtgcagacagaaaccagaaggatccaatcccaggcttttccttacttcctgtgtcctgatgattctgggtgcgaccctctcgtgctcagaatttgaactgaagtgtgtgctcacagatgtgttgacactcctgggagaccagctctctcctggcagtatttgggtatgtagcagtgtggcaaaggattcgcttgggtgctgtgtcacagcatcagccttgggcacagatggggtaaggcaagttgtgagagttattttttgaacttgtgaattaggactagagagatagacatcttgatggttaagggcacattcttctcttgtggaggaccgggcttcatttcccaccatccatgagggactgttcaccatcctttataattccaggttcagggtgtttcatgcctctggcaactgagaacagcctccctgacaggctcctgcaggtagttcaagaacttgtgaattcctccttaccatcttctcttcttcctgttctggacactgctgcctttcactctaatccagcccatgtctttcctgaaaggtatgtatgaggaagagttgctctagtcctccctgacaaactcaaccacctcactacagtgtggaagaaacctgtggagacaaaatgaaacagatattattgtattacaaattcctttcattttcctgaatagcaatttcttgtcattatatacctaattgtttgtcttagtcttttcttttaaattattataagtaagaatcaatagaattaagtaaatatattacttaatttattacttggaatggaatttttttctggttagtggttgtggtcggtgtcacagatttt

SEQ ID NO: 4093 - DNA, 1200 bp, mus musculus
aatagagtcagacaataccagactttggagttcaaggtgataaaggagttaaaaacagctgttgcacaatatggccctacagctccttttacacaagcattattggatactgtcatggagtcacacttaaccccccccccccccaagattggtagactctatgtacagctactctgtcaggaggagatttcttactttgggattctgaatggcgagaagccagtaagaaaactgccgctttaaatgctcagacaggtaatccagactgggatattaacatgcttttaggagaaggtcgatatgaaggcaatgctaatcagattggttttcctgttggagtgtacgcacaggttgatatggctgcccgccacccttggaaacagttaccaggtaaggggatcttggtggaagtttagccagcactcgtcagggtcctgatgagctttaccagaactttgtggataggctactaatagcagctagtaggattcttggagacactgacatgggaagtcctttcattatgcaattgcttacgagaatgccaaagcagtgtgtcacgctgctatccaaccacacaaaggacagacggatttagcgggatatatccatctttgtgcagagattgggccatcatataatcagggtttggcttttgccacacctttgcaaggaaccaatgtacaagcaatgctttcacagaaatgagggaattatgcatgttttaagtgtggaagtttggatcattttaaaaatgactgtcctaagaatagaggtgctgagagtgggcaagcaggccgtgctccaggagtttgtccttgatgcaggaagggcaaccattgggctagggtgtgtaaatccaagtcagacattccaggctgtccattgccaggaaatgagaggaggggccagccccaggccccaaaatacccacagcaagcagcttatggggccatgaagctgttgcccagccaaagaaatccgttttttaacttgtcagggcaaccccacgaagtgcaggattggacctctgttccaccacccacacagtattaaccccagaaatgggagttcaaactctgcctacaggagtttttgaacctctacctgcagaaacttgtggatttcttttaggacaaagcagttctattgtaaaaggtctgcagatttatccaggtgttatagataatgattatgagt

SEQ ID NO: 4094 - DNA, 1000 bp, mus musculus
tcacgagagcttcttggaccatgagctttcctgttatggttcccatccatcaaggctaagaagataatgtaataaattactaaaacccttccccaaacaagtcctgcttgccaagcagttcataaaagaaagtagctgccaccatgagcccttgactcaagattctattatgtttaacaaagaatcatgcagaaactttaaaaattaacttgtacctcaaaatgtaatagtaagtgtgtttattgtagttttgggggcacactgagcaacaggtatttatgctagcgctggctttaaatttcatcttttttacattgttgctgtaggtgtgataggatacaggctaagttgggacagtgttgacctggcgctgattccacttaggggttgacagccgaaaatgggattagaaaattctaaacaggcatttgtctgcagtcttcaagagctgcttcaggtgagaagagcagcggaagttgacataacaatagagccatctaaatgggaaggctacaccccaggtgatctcatattcagtggcagcaaagtctgaatcagcctgcttcaaggctgagggaggctacagggagctgtcttttttttttaattagatatgttcttcatttacatttcaaatgctatcccaaaagttccccatgcccttcccccgccctgctcccctacccacccactccaacttcttggccctgtcattcccctgtactggggcataaaaagtttgcaagaccaggggcctctcttcccaatgatggccggctaggccatcttctgctacatatgcagctagagacatgagctctaggggtactgattagttcatgttgttgttccacctatagggttgcagaccccttcagctccttgggtactttctctagctcctccattgggagccttgtgttccatccaatagatgaccgtgagcatctacttctgtatttgccaggcactatagaccctgattgttattttctagaaa

SEQ ID NO: 4095 - DNA, 1200 bp, mus musculus
taagaatatgcaggtagataacgtatttatgaacatcaccatgatattgactctaatacctttatcaagaaatgctgaaatccatctatagcatgactcaccttctgcaaaagtaagaatgtctccagcacccataaaatctaaaccttcagtagccgttccaccaacaacgcgccattcgaccatgacctgccccaggctgcctcctgtcctgtagataaccagttccacagaagtttgtggctgttcctgcacttccacacataagccatcttccgaggtattgggactaacactgtagataatgaatactccaaaggcatcgccattcagtcctatgaccacagcggaagtattcggatgtcctatggttggctggtttttaaaactgtctgagatgttcataaggtgaacttcaaggagagaaattaggaaactttcatccatctcgggagcatcgtcaggaagtacagaaacagtgagatttgcaaactcatcaccttccagtatcacggcccactgtcttgtcacaggctcgtagtcactaccagcaactgcctggccactgaaaagagaggccaccctagtcatgttcttcttgtaggtttggaagtcagagctgttcacagttccgctgacccacgacgtcatccagaagcaccgagggccctcggcaccactgacaactgaaaacgctgagcaggcacgttctttgagacacaaagtggcacaggtatactgtgtctcctccactgcagacacgttcacccaagttctccagagtgggtcgggcaccccttgagtcggtgattcatagtaggataacacatcttcaccttcctcaactgcacgagccactacatcaatatcagaagtaccatagcacaacagcaggcgaccaaagtgtcctccgctgaaatgtgtgggcagtgggaaagcggttaagcactcagactgatgtgggaactgcacacacacagagaacaatgctgattgattgtggttttgagaagtgttttcttagtaatattttaaacactagtactaatacaaccttatttcttaattatgtttgtctttcaacactttattttctggtgtcaactatactgcctagttttcaaccagataaggctcacttgtactcatgctctcgaaatacattgcaagttaggcaagttgtatccatctcagagttcc

SEQ ID NO: 4096 - DNA, 1200 bp, mus musculus
ctttaagggattttttgcttcctctttaaggtcttctacctctttagcagtgttctcctgtatttctttaagtgagttattaaagtccttcttgatgtcctctaccttcatcatgagatatgctttaaaatctgggtctagctttttgggtgtgttggggtgccctggcctgggcgaagtgggagtgctgggttctgacaatggtgagtggtcttggtttctgttagtaagattcttatgtttacctttcaccatctggtaatctctggagttagttgtcataattgtctctgtttagggattgttcctctggtgattctgttagcctctatcagtacacctgggagactagatctctcctctgagtttcagtggtcagagcagtctctgcaggcaagctctcctcttacagtgaaggtgcacagatatctggcatttggacctccctcctggcccatgatgaaggcccaaaacaggacctttcccagaagctgtgttgctttggcctgtcacagaagctgttagcttcggtagtccacactcacctgtgcagaccactttcagcagagtcttgtaaccaagatatcttcctccgatgctgaggcaaacaaagccctccagggccgggcagacacctatcctttggccgggaaggtgaccagatgtttggagccctaaaagggggctgtctgaaaagctctgtggctcctgcctgtcccagaagctgttagcttttgtagggcactctctcacttgtgcagactactttcggcagagtcttggaaccaagatggctcccgccgatgctgaggcaaagccctcccgggctgggcagacacctgtcctctggtcgggaaggtggccggatgtctgtagcctgaaaagggggctgcctcagaagctctgtggcacctgcctgtcccagaagctgttagcttctgtagtgcacactctcacctgtgcagactacttttggtggagtcctggatttctgtgaattatggatctagtcagcaaagagccagccacatcaaccatgacaggatatttattatcatatttcatattatcatatttactatcgtatttcccttattaatctacttttttctcctgtggttgactatgagttgggcacaagcatgctccaaatttcagttataactattatgaaagataagtttttggaaacaaaatgtg

SEQ ID NO: 4097 - DNA, 1000 bp, mus musculus
gaaaaatcaccgagttgatcttcagacccctttaaacacatgcatacaacagccacagagtttagaacctttgagccttgtaaataagggacttaatgatataaaaatcacggacacatccctttgatagcctagtgattctagtgcttgggtgagaaaacttcactgaagtgcttgcagccacattcctggtcaacactgataatattcctagtttactgatcttatgctcaaaaataccttgtaggcaaataattctgaagtgtgactcttttaaagttaatgacgacaagatgcagagagttaacaaatggatattcagaatgtggaattagccagtacttctccagttttaaatgtggagacataagaggcttgctgtcctgctgaagaacaggagggaacagcgcactgttagtggaaaacacaatctttaagccagacaaccttgaattgaaagctcactctcctccttgcaatgccagcacctaacctctgaactctggccttccgtaccatctcttctaggagagtcatctttgtgtcatcagcttttcagtgttaagctgcatctgtgcttgcaacattgaaactgctgaatgtaaaagtctcctttgagagacatggagctcttatggtaaaaaggcagcattgtacaaaatgctaagttctagtataatatggtttgcattttagttttgtagtcaatgtattcaggtgtgcctggcacactgggggcacttgttaaatgacatatgaaataattctaactcaaataaaaatcttagcatttaaggagaaattgagtaaaatggaaaacataatgaacaggaaagagttcctcagtactttaaaatatctttatgtctaggataattgcaatgtttacttttttataagtcagaatgactactgtaggtttcttaaaccttaataatatttaaagtattttgtgcttgagtattagcatgactatcagtacaactttcattgctaacga

SEQ ID NO: 4098 - DNA, 1400 bp, mus musculus
atggtttgagaaaaattagtatcaggtctcagacccaaaaggacattcatggtatgtattcactaacaagtggatattagtttaaaaaaaaaaagtaaaaaaataaaacatgacagaatacccaagatacagtccacaaaatctaaaaggatcaacaatctgaagtgcccaaatgagtacatctcagtcccacttgggggagagaagaaagatatctcacaagttgggtagaggggagggaggtatggagggagggaggaagggacctgggaggctaagtgaatggggtgcaggaggagtggggaggaaaggggaatctgatctggtattgggtgagggaaaaggaatgaagccctgagggccagcagaaagaatgtaaacaggcaaccttaggaaataggaggttaggagaacacccccagaatgcaccagagacctgggagttgagagactcccagtactcaaatggagggatctcagaagaaatgcctgacagtagggagaggaaacttataaagcccacctccagcaccaagaaaggatatcaagtgagggatggggttgccatcccacagtcacatctctgacccataattgttcttgtctgcaagaaatgcaaggatggaaatggagaggagcctgagaaaaagaagatccagaaacaggcccaaagtgggatccagctcaaagggaggttccaaggacactattactgaggctgtggagtactcacaaaaggggatctatcatgactgccctctgaaagactgaacaagcagccaaaagagtcagatgcagatattgcatccaaccaatggacagaagcattgaattgaattagggaagtctgaaagacgctgatgagaaattcaatcctgtaggaggaccagcagtcttaattaatctggaccccggagatatctcaaacactggaccaccaaacaaacagcatacaccagcttatgtgaggccccaacacacatacagtagaggactttcggatctgtgttcattcagagatgatgcacctaaccctcaagaggctagaagcccagggagtttagaggtcaggtaggttgggatgtgggggtatccatttggagacagggtagggtaagaatgagatgtgtgatatggagcagatggagagtggatggggtggcagggaatggaaaataaagtgtaaaaattaaaattaaaaataaaattaaattaaaaatgagaaaaaattaattaaacatgaaaatacttcttagaaaacaatactgctgtagtgcttgctagctgtatacataataatcatgtaagtttataccatcagataaaattaattaagactttaaagataaacttgagatctttcaaagtatacagcagaatgtcaatagattgaaaatatg

SEQ ID NO: 4099 - DNA, 1000 bp, mus musculus
aaaggacagaaagcaggcagcacaacacaggaaagtgcctgggacagaatctgtcctaagaacaaacctccagtgacttgttctatccaacaaagtcctacctcatatttttagtcctcttagtaatgtgatcgtgcattgagtctaacaaaggattaatccactgattatgctagagcgctgatgcttttagtgtttctaggcatgacattgtagatccaatgagaggtatgctttattccctttttgtttctcaaaaccaccatttgacagttaaaattaaccatcaagccaggcgtggtggcgcacgcctttaattccagcactcgggaggcagagggaagcagatttctgagttcgtggccagcctgatctacaaagtgagttccaggacagcccgggctacacggagaaaccttgtctcagaaaaaaacaaaaaacaaaaaacaaaaaacaaaaacatcaaagcacatatagcaatacagacagaaattatatgcagttgatttaaactatatttattatgataaaggaaacgacttcattgttattctttactttaaatgtagacttttaagattaaatccattgcttgagagtttcatcagtgtgtataatgtgttctgatcacagtcactcctcagcctctcttgtcccacatccaatttcatgtgctggagtttgcaaccaactgagggccacccatgcaggcatgcattttagcagtggaattacccactcaagcactggggactcacgagtagccacattactactaacaccctcctccagaagccatcaacagtcaaaggttgcccaacatttgacagggcctatgggtccctcctccatccatgattgttgacaagcctcgtcttgtacaggaggtgtcagctgctctgagctcaggacgacaacttctgtatcaagcctagaagacagtcagtacttcacagtgatcctccgtagcttccaagtattatgttcttcctacttcatc

SEQ ID NO: 4100 - DNA, 1000 bp, mus musculus
acttataccaatagacaaatgagtgtcccactccagacattactaacagtccagagaggccatgtttttcatattgtatagtgtaatgcagaagtgatatctagcacacatgcagcagaacagagtactgcccttagatccttcttgaacagaatgctacattaggcattccatgagttcccccttcccaggaggcctgtgcccagtctagttgccatagatggccatcagacatttgcaatgacatcaggagactatctgagcagccactgccctaaagaatctgctagcaggagactggggatatcagtgtcttcttggccgacaactgcattccaaaggtcaactggggtgaaaaggatgggcttggagcatctggtgcgttttcagccacaaggcagctaacaagcagagagcagccgccacgagggctaaaagtagcctggagaccacacacctgtgaaaaagtcaacctgacccaggaaaacaggattttaagtctagagagatttccaattcttcaaaggtaaaatttcagacctgtccccatcctgaatcaatcctcaagtctctgatgacccacttacttttctatgacaaccactgcaggagtgagtagggacttggaagtgtggaagtgagaattgttctcacagaattactgcagtttgttttctcagccctgttccttgtcaagcagctcattcattcctcatagcaaagcatggatgatatcacactagagtccacatgtggagtatacctgaggaaaccaagtcaccgagcaagaagcttggggtgtgagtgatcagttagcctgtgttccctcagttgatgtttggctatattcacttcagagtcccatcagccttttcacttgtaggctatggagaagctgaacagctatggagaagctgagactttcattgtctgcagagcactgaggcattttcatatagcatcttagatttcaggtagtatgccaagaatcctttcaaac

SEQ ID NO: 4101 - DNA, 1600 bp, mus musculus
ttcatcacacttcaagttttcctgaatgttaaaactaaatgtaaggtgctagagccactgtcgccaagcccaggccacgctgcttctgctcgcccgttgccccccatcgtgcactagcggtctcaaaagattcaaagtccaagatggcaaccctcaaggaccagctgattgtgaatcttcttaaggaagaacagactcccccagaacaagattacagttgttgagggttggtactatttgcatggcttgtgccatcagtatcttaaagaaggacttggcagatgagcttgcccttgttgtcttcatggaaaacaaactcaagggcgagatgatggatctccagcatggcagccttttccttaaaacaccaaaaattgtctccagcaaagactattgtgtaactgcgaactccaagctggtcatcatcaccacgggggcccgtcagcaagagggagagagccgactcaacctggtccagcgaaacatgaacatcttcaagttcatccttcccaacattgtcaagtacagtccacactgcaagctgctgattgtctcaaatccagtgggtatcttgacctacgtggcttggaaaatcagtggctttcccaaaagccgagttattggaagtggttgcagtctggattcagctcggttccgttacctgatgggagaaaggctgggggttcacgcgctgagctgtcacggctgggtcctgggagaacatggcgactccagtgtgcctgtgtggagtggtgtgaatgttgccggcgtctccctgaagtctctgaccccagaactggtcactgacacagacaaggaacagtggaaggaggttcacaagcaggtggtggacagtgcctccgaggtgatcaagctgaaaggttacacatcctgggccattggcctctctgtggcagacttggccgagagcatcatgaagaaccttaggcgggtgcatcccatttccaccatgattaagggtctctatggaatcaatgatgatgtcttcctcagtgtcccatgtatcctgggacaaaatggaatctcggatgttgtgaaggtgactctgactcccgaggaagagacccgcctgaagaagagtgcagacaccctctggggaatccagaaggagctgcagttctagtcttcccaatgtcctcgcacttcaatgtccaggctgcagcagggattctagggagaccacacccttctcttctgagctgtggttagtacagtggtgttgaggtggtgtggggaaacatctcactccccacagctctgccctgctgccaagtggtacttgtgtagtggtaacctggttagtatgacagtcccactgtcttcgagacacactgccaactgtgcaggcttcgattaccctgcgagccttctgcattgctgccctgtgcaccctcatcaagcatgcctaggccaacgagtttccagttagtcataacctggctccactgtgtacgtccatgattcatatcttgtgcataaatgttgtacaggatattttatgtattatatgtgtctgtactgtgcattacaatattatgtgagatgtaagatctgcatatggatgatggaaccaaccacc

SEQ ID NO: 4102 - DNA, 1200 bp, mus musculus
atgttctttgttgttgttgttgttgttgttgttgttttaattgggtatttatttcagttacatttccaatgctatcccaaaagtcccccacacgctccccaacccactcccctacccacccactcccacttcttggccctgtcgttcccctgcactgaggcatataaagtttgcatgaccaatgggcctctctttccactgatggccgactagaaggtgtttgtaaggtatctagttttccctggtgctggttaaattatcctgaaggcagcaggacttcttagggaaggtggaaggagctgtgggccagacaatggacattaggataccctagtctgttagctgtgcctctacaggtcccattctgtaggttgtgtcttagtcagacctagatggggtggcagatagatacaactaggatgggtggttgggcagggttccaagctggttagttttcaggtttgcttccaaggagaggcaggatattcttggggttcacaaggcacctctggaccaaagagcaagaccagagctagacaataatgctcaggggattgcttgtgtttctcacttctccaggcagacccagatgaggtggcaggtagatccaactagaatgggtaattgagcacggttccaagctgtttagttttggggacccaaagtattccacagggaggcaggactctgctagagtcctgcaagtctcccgtggactgagaaacaaggccagaactagacaatattgctcaggggcctgtgcctaccactcacctctgcaagctgtcataatttcttttgttttgtttttaaagtaatgtcaacagctgacagatttgcaactggcagagactaggatggtgttgctcgagagcacgcagttactgacaaagctaaccagactcttccagcagaagaacacgctgtgttcatcaccctgaagaagtatgatggtcacaccaaacccattccaagaaagagttctgtgaagggcctcaaggcagcagaaaacaagtgtcggttaagagctatgggtgggaaagggaagattaggactgaggtgagtcccacagaaatgactatgatacgctctataatattgttgagtagaaagttgccagcagttttccccttttgcttgaaaagaaaaaagtaccatgtctgtggaattaatgtctcagaagctgcagaaggagtgaa

SEQ ID NO: 4103 - DNA, 1200 bp, mus musculus
ccattcactcaacagctctaagaacccattaagataaatggagtgtttatctgaaggttggagaaatagtagccaggaaaactagcccttactggtctctcatttaaatgtagttggtagaatgttacattttaaaatactgtagggaagtgtagaaagtcaaagaaagcagtggggtaggagtggggtgccagagggtggtatgggtacttttttacaagtgaccagtaaacacacttgtgacagtgacatttaagtaaaactgcaaagtctggcaaatacagaagtggatgctcacagtcatctatcagatggaacataggggcccccaatggagacgctagagaaagcacccaaggagctgaaggggtctgcaaccctataggtggaacaacaatatgaactaaccagtacccccagagctcttatctctagctccatatgtagcagaagatggcctagtgggccatcactgggaagagaggccccttagtattgcaaacttagtatgccccaatacaggggaatgccagagccaagaagcaggagtgggtgggtaggggagcagggcagagggagtgtatagggaactttcgggatagcatttgaaatgtatataaagtaactatctaatttttaaaaaatacaaaaaagaaccctgcaaaatcacccatgggaggaagacagtacaatagcaactatgcagggcccaggcaagaactaatgtggttgaggactgggcgggttagggaaggaggaaggggagagaaatgtgcacacaaggctggaggaggcaacccaagactgctgtcaaggcctgagagaaaatccagacaccaagacctctgacttgaacagaaggcctaagatctttgcaaaagtagtttcaaatatttttagccagttttgactctggttaactaggtacaaagtcattgatgtggttttataattactttgtaggtattggcaataaggcatattttctcttaaagaaccaagaagaaccactgtacaatgatttttttatgtctccatataaaataaaattaatggtccctctagcttagtgtttgtttgagggggtcattatattagagggaagataattctcgtttttgatgactaagcaaactgattaaggataaataacaggtaagctgaaatatgatatttaaatggaataaaaccaagcatgca

SEQ ID NO: 4104 - DNA, 1200 bp, mus musculus
ttttaagggtcttccttccaggatttctgtctcagcccattgattattttccttttgtttactattcactttacatttttatcaaagcactcctccctcctctcctttcagtcccatcctcacacccctccccttctcctatgagaagagaagctccacccagtaggtaccaaaagccctggcacatcaagttgcattaggactaaacacaccctcactcgagtgaggccagcaaggcagctcaaatagtgaaaagggatacaaatggaggcaacagaatcagagtcatcctcccaccacttgttaggggactcacatggagaccatgctatgtatatgctatatatgtgtaggcagcctagttacagatctctttggttggtggtccagtctctttgaaacccatgggcccaggtaatttgactctgttgaccttcttgtggtgcccttgatccctatggccccatcaattctttctcctattttttctccaaactctcccagcaatatccaatgttcagttgagcaactcagtatctgcttttatcagctattggatgaagcctctcagagaacagttaagctagacacctgtctgcaagcatagaggagtatcgttaacaatgtcagggcattgactctcccatgtgatgagttttaggttgtaccagtcattggctgcccatcccctcaatctctggtccattttatccctgtacatcgtgtaggcaggacaaattttggatggaataatttgggggtcagttggtgcctcctccatacactggaagttgggactgattacataaggtgagcaaatcagcctctatgccacccactgctaggtgtgtcatcttgggccatccacacagattcccagaaggctgcaccaacccagagttgccccaacaacattttcccttctctctcctagccatttaaatgtcttccctcttcccacacttgatcaccactcctgttcagttcgccaaaccctctactccccagtttcctccatctatccacctctggtgtctattttatttccccttctgaataagattcaagcatcttccttgttacttagcttctttgtatctatggaatgtagcatggttatcctgtactttatggttaatttccacttataagtgagtacataccatgagcatctttcccagatttctgagaaacctccat

SEQ ID NO: 4105 - DNA, 1000 bp, mus musculus
ggaatcttgcttttcttgcatgatggcgtgtctagaacttgctgttgtgggagaactgggctctggtgatgctaagtagccttagttattattgcttatgctcttgtgctttcctttaaccatctggtgctacctgcccttgctttctttgactggagcctgtctgtcctgtgatcctggttgtgtcagaactcctcagttgcctctgtgatcttgtgattttgggatcttgtgatcgtgagatcctagatgtgtcagaactcctgggtgtcaagctgtctctgggatcctgaaatcctgctgtgaccaagcttctgagatactgtggcatcagagctccttgaagtcaagctttcgctgggtgttgcaagggttggtggggagccagagccctacgtttcctccaggcatggatgcaagctggaaggaacctgtgcctgtggctaggctgggattttgtttccctgttcttgtgggggttccagttacattgcatgtagggaaaggcattgtggtctcagttgtcatcttgagtgtgtcaaaactccagtgctcctgggtgtgtctgatctcttgggagctgagattcctctctgatcctgtgatcttgtgatcctgggtgtttcagagcacctgagagttgggctccctttgggtgttttaagattgggtgcagagccagcgcctcaggtctactggtgcaagttcaaactggaaggaatccatgccactgtttgtttgtggggtttctgtgtccctgaatgccggggacccaattactctgggagttggggcagatgttgcagcctcctcacctctgatcttgtgcatgttagagtacctgggagttgagcttcttctgggtggtgtgggactgggtgaggagccagtgcccaaggtctgctagtggcacagtgtttagactggaaggtccactgcttttcctaatccaaagttccaaaatccacatttctgcaaaaagaaaaaaaaaaaaaaggca

SEQ ID NO: 4106 - DNA, 1000 bp, mus musculus
agtccctttcccaactcctccattggagacctccacgctcagtccaatggttgactgcaaacatctgcttctgtatttgacagattctgggggagcatctcaggagacagccatatcaggcttacatcagcaaaaatttccaggaatccacaatagcacctggttttgatagttatatatgggatgaatccccaggtggggcagtctctgaatggcctttccttcagtctctgcttcacacattgtctgcatatttcctcctgtgagtatttagtttacccttctaagaagcaatgaagcatccacattttggtcttccttcttttaggcatcatagggtctgtgaattgaatcttgggtattttgaacttatgggctaatatccacttatcagtgagtaaataccatgtgtgttcttttgtgactgatttacctcactcagaatgatattttcaaattccatccatttgtttgtgaatttcatgaaatcattgattttaatagctgaggagtattacattgtgtaatgtaccacattttctgtatccattccttggttgagagacatctgggttcctttcagcttctggttattataaatatggctgctatgaacatagtggagcatctgtccttattacatgtcggagcatgttctggttatatatccaggaatggtaaaactgggtcctggtatttttatgttattttttaaactgatttataaattaatttttttgacactccatattttattccctcacccccatccaccctctgactattccacattgcatacctcatcgccaccccatccccggtctctacatgaatttccccatcccataccccacctgacctctaaactcccgggggcttccagtctgttaggtgcatcatctctgaatggacacagaccaggcagtcctctactttatttgtgttaagggccccatatttggtggtgtatgctgcctgtttggtgtccagtgtttgagag

SEQ ID NO: 4107 - DNA, 1000 bp, mus musculus
aggaccacagacctctccttccattgatgcctgacaaggccattctctgctacatatgtgattgaagccctgggttttttgagacagggtttttctgtgtagctctggctgtcctcaagctcactctgtagaccagactggcctcaaactcataaatctgcctgtctctgcctcccaagtgctgggattaaaggcatgtgccaccactgcctggcaagaatatattttctctcttctcatttatatttagtccagaagagtctgatatcacactaccacactccatataactagcttagtaactactaaattgccaatctcagaataaacaacagaagatcagaagaagtcaatactgtctcattaaataatctcttgccttttctgatagatgacatttcttttactactacgttcttgtttcctgcaccaaagttaaataattatgacaatattttctataaagtattaaattttattacagtaagctgtttctgtttaattttattatcatatgtactccttggttggtagtttagtccctgggagctctaaggattcaggttggttttgctcttcctataaggttgtaaaccccttcagctctttcagtcctttctctaactctcccattagggactctgtgctcagtccagtggttcactgaaagcctctgtgtttgtcaggctctggcaaagcctctcaggagccagttatatcacggtcctgtcaacatgcacttcttggcatccacaatagtgtcttggtttagtaactgtatatgggatggacaaccagatggggcagtctttgaatggcctttgctccacatattgactccgtatctgctcccatgaatattttgttcccctttctaagaaggaccaatgcatccacattttggtcttccttcttcttgagcttcaagtgagcttctgtgattggtttcttaggtattctgagctttttggataatatccaattatcagtaagtgcatat

SEQ ID NO: 4108 - DNA, 1200 bp, mus musculus
tttgtagttttagagcttttttttttttggtgtgtgtgtatgtgtcagcctttgcatacacacacaccgtgtgtgtgtgtgtgtgtgtgtgtgtgtgtgtattatataatatatatttctcatgatttttacttgcatgttttattctgctttttacatttttctgagagagagacaggaggagagggagaaggagagagagagggagagggagagggagaaagagagagagagagagagagagagagagagagagagaagcatggagctaaatggtagtgagaagggcaggatttgagaggagatgagaaaaggaaaactgtgatccaaatctattacatgaaaaatggttaaaaaaaaaaaaacaaaggtgggggggagggagagaatgaagcataggcttccttatttatttacatcccaaaggatgtctccctcctggtccccctctcagagttcctctcccctacccactccatccacctttgagaggacatcctcctccatatcccccaaccctgttgcatcaagtctctgcaatattaagttaaccttctaccactgaagctagacaagactttcctctgtacctatatgccaggagaattggaccagtacctgtatgctctttggtttgtggcttagtccctgggagttctcaggggtacagcttctttgacattgttggttttcttgtgcatttgccatgcttttgagagcatttaatccttcccctaactcttccataggcattcctcggccctatccaatgtttgactgtggatctctgcatttatctccactgtctactatgtataacctctcagagggcagctatgctaggttcttgtctgcaagcacaacagagaatcattaattgcatgagagattggtgcctgcctgttggatgggtctcaggtagagctgatttctggtagactattcctcgagtctcagctccatctttgttcctgtatttattttagacaggaccaattttaggtcaaaaatgttataggaggtctttgtgttatggtggagcatctttagggtatatgcccaagagaattatatctgggtcttcaggtaaaactatttccaactttctgaggaacctccatattgatttcctgagtggttgtaccagtttgcattccatcagcaatggaggagtgttcctctttttccacattctcacca

SEQ ID NO: 4109 - DNA, 1000 bp, mus musculus
ttttctagtgttttggagaaaccaggacttgctgcggtgggagaactgggttctgatggtgctaagtagtcttggtttctgttggtaagattcttgcctttctggttatctctggtgttagatgttcttgctgtctctggctggaacttgttcctcctgtgggtctgtaagcctgtgccagcactcctgggagaccagctctctcctggcagaacttgtgtacagagggctctggaatagcccaagctctgggtgcagatggagactctaagtatcccatctcagctgctccatggatcttgtgtcctgtgtgctcctggatggagttattggagagaaagtggctgtgtcacctcctagcccaggagtgaaaacactcctgggagaacaggtctttcctggtgagacccatgcacagtggtttgtggaatagcctcagctcgcaggtgcagattgcggaccagcctcatttttaataccactggctggaatacaaacattctcttagtacatacctttaatgtaaaattagtttgtagaaggaagcagccaggttttaaagtgacatctaattgaagggcagataaaatgacaactcagacagagatttaacagaatgagtcagagatagggtatggccatttctcttgtatgccatggacccagcacttgggaggcagaggcaggtgggtttctgagttcgaggccagcctgttctacaaagtgagttccaggacagccaaggctatacagagaaaccctgtctcacaaaacaaaacaaaacaaacaaaacaaacaaaacaaaaaacaaaaacaaagtatgccattgaaagagggagagtcaatcagttggcaatcagtgcagtgagtacagtacagggtaattgagacagtttctgagttcattccagttcagattaggtcagcagaagcagttgaagtcagagaataagaaggagccagaagattgtgagaaattgtcaaagtaactttgaggcta

SEQ ID NO: 4110 - DNA, 1800 bp, mus musculus
caattttatttatgttactttatttgcaaggcagtgtttgcttagtcacattttctgttttagtcattgacctcagaactgtatcagacattggcttttcaatttgagtcaaatagatatatgaaacagttcttacttctagggcaacaaaagtcatttagaactatattacatctgttgacagtaaataatttggttcaattttcaagaaaataaaataattaataatgtaacttagaactaatccttctcattgttttctgtttattaggggatagcatttcattatgtaccacagactgggctaaaacgtgactcttctcccttagctttccaactgttgggattattagtgggtgccaccaaacctacttgttaatcctctgattaatccaggaaccttaatagatattgtgtagtgaagatcatattcacgctgcttattacataaacaaatgaaatgctgagttctgctttggttataccgtgaaggcttagtacagacatctgacagcatgtatagaacatacaataactcaaaattaagcatcagggaagcaatcaagcaaaccagcaaacaaaaattaaagcttaaatggaggcatggatctaaacagggaattttcaaaatattaaatacaaatagttgagcaacatattttttaaaatatatatattatttttaaaaactgctttttattttattttatttttattggatattttctttttataattaaggcatgtttaaattagatatttaaattagatattttctttatttacatttcaaatgctttctacaaatccccctacaccctaacccagccttgctccccaacctacccactccggtttcctggccctggcattccactgtaatggggcatatgatctttgcaataccaagggcctctccttccactgatggctgactaggccattatctgctacatatgcagctagagacaaaagcatccactattgtatttaaaaggctctgccagggcctcccaggattattttattttatttttctcaaaaaggatttaatcgttttttctaaatacaatcagaatggatgaaagaagaaaaagaagaagaagaagaggaagaagaagaagaagaagaagaagaagaagaagaagaagaagaagaagaagaagaagaagaagaagaagaagaagaagaagaagaagaagaagggagaaggagaaggagaaggagaaggagaaggagaaggagaaggagaaggagaaggagaaggagaaggagaaggagaaggagaaggagaaggagaaggagaaggagaagaagaagaagaagaagaagaagaagaagaagaagaagaagaagaagaagaagaagaagaagaagaagaagaagaagaagaagaagaagaagaagaagaaaagaagaaagagaatatatactggcttggatttagaaaaagggaaacacttcactgtcaatgttactaaaaacattatagacagctctaaaaaagaaaaatatatattttgtgtatgacacatcttatcacttttacataagatatagaaaatcaaagcattctaaagccaactattgagagacttcccttgtttatgtgcattgttgcttcattgacaatagtcaggaaataaatacactctcgtttcagtgaattgtcaactgataaatgaatagaggcattgtcttctccttagttcttgggttttgaaacaactgctattgcagaccttaccgttgtatagtaaatttttcaatgaggtctaaattcaggattttaaatgatgt

SEQ ID NO: 4111 - DNA, 1200 bp, mus musculus
actgaatcagcatataaataatgcattcctccatatgttaaatggatgtgttcttattatacaaaatttgaaatgtacagaaaataattaatgacccaaatcacctattttattttatagatataactacctttggcattcatatacatagaattcctctgttatatatgtgtgtgtatatgtcacacacacacacacacacacacacacacacacacacacacacctccattcatgaagtttcaaagaaacaatgtaacagaaacaaaatactcctaatttctaaataaaatatgtttcgtgtaattttaaaacattcttgcttttttgagagctctgcacaagctctctcaacctctcctggccagctctaccaagcagccaatggccaccacagtctcactaatacctctcccagtctcactcagctgagccaatccaccagctcatgcttttctcataaacacagggcgctaccaccactctataccaaccaaccaaccacctggcagctagctatgctaaacctctaaggacagccctactgctgtgccctttctcctgcctacctgaatcaccagagatggaaaacaccagacaggcttaatattttaaaaccagccagataactcaactgctgggcaaagaatctattgctctaaactcatcgactatcctatattataattctgatggtggcagaagccaccacctgttctagtagccaccagaccttgcatcctcctctctcaaaatcctgacccccaaaaaaaaaaaattgctatctcttttcttcttcttcctcctgggacacagaaagcccacctctttacaattgtccaatgcttagcttttgcagtctttattggcatcaatgtgaggggaggcccttggtcctgtgaaggcttgatgctccattgtagaggagtcctagagcagtgaggtggtgtggttaggtgggtaggcgaatacctcaatagaagcaggttaggagggatgtgataggggttttacagaggggaaaatgagaaagggaatgacatttgaaatgtaaataaataaaataatagtaatagataatgaaaataataaattaaaaatcaagaaacaactacggaatcagatttcagtatcagctcttcctcttacaaaaatatatatgttgctgaggcttgtgaagtttacagaattgcctgtgtt

SEQ ID NO: 4112 - DNA, 1000 bp, mus musculus
cttattgctttttgtaatttgttttactgttgtctcaatgtcttctatggtatcttcgattccgtagactttctcttgtattgtgttgatgatgctctcatctatgactcctgctctctttcttaggttttccatctccagtgttgtgtcccttcctgattgttttattgtttctatttccagatttagatcctgaattgttttgtacaattccctctcctgtttgattgtcttttcctatatttatttaaaacatttatgtgttaactctttatattttcctctaactttttacctatgttctccagcatttctttaatggagctgtttatgttcttcttaatgctctctatcatcttcatgagatgggattttagatcagaatcttgcttttcaggtatcttgggggtacccagtgcttgctgtgttagaactggaatctgctgatgccaagtagcattggtttctgttgcatatgttcttgcacttgcctcttaccatattatctttgccgctagttatctttggtgttaactggctttgctatctctgtctggacactgttcctactgtgaacctggttatgctgggccttcttaactcattctgtctctggatatggagggagtctggaaagcctggccagtgggcctggctgagtcagaactccttggagtcaatctgtctctgcataagtgtcatgttgggggatagggcacaggatcacaggatctgctccctgataaatatgtgagctggaaggaaaaacacgtgtcaccaactagggatgagttattgcttcctctggtatctgggcttgtctctgtgaggctaggtattgtgccagtgttgaagcttcacctgtgaccccaggtatgtcacaactactggaggtcaaacttggtgtgtgtagagtggtgtgtgggtgtctggagcacagaatacactcctggatgccagtgtaaaaggaaaagcaatagttcatttttaatagaaaaaa

SEQ ID NO: 4113 - DNA, 1200 bp, mus musculus
gctccccgagatctgattaagataggatccgggccataccatttattatcaaggacatttttccatttaaccatctcattgggcctatctggctctgaacaatgacattcagccgcagtatggccatgagcatcaagatttaaaaaattgagtgtaaagagtgctatagacacagacactcttggtactcggggtagagcctcctcaactccccttttctgttttattagataggatttgagggtgcgatgtgcacaacaaaccggaatcttcggcggcaaaagctttattgcttacatcttcaggagcaagagagagaatggcgaaaccccgtcccttttaaggagaattatcctccacctaggatgtgtcgctccttgattggctgcagcccattggctgagttgtagtcacagggaaggcagagcacgtggagtggagaactacccttggcacatgcgcagattatttgtttaccacttagaacacaggatgtcagtgccatcttgtaacggcgaatgtgagggcggctccccacacaccatgaaccccagtccagctcaaagagagcagacctccaaggagtgctgacacaaggaagatcacagatgagaccaccactgctgcccaaatttcaggcacaagtgggaactgcccagagcccacaggacccaggaactacagagcagccaaggacaggatcctgcaagtttccatctgtgctctggggcagaacctgtgccacaattatacagatcccagttcagtcctatggcccagtcatacccagagagagcaggtcttccaggggtgctaactcaccaaagagcaaaggagtgctgccatagctaagacaaagagcccaaaggctcacaggagagtcaagcttcagtcagcaaaaccagataccaccatagataaccagatggcaagagaaaagtgccagaatataagcaacagaaaccaaggctacctgacactgtcagaaaccagttctcctacaacagcaagccctggacactcaaacaaacttggaaagaaagattctgatttaaaaactcatctcatgattatgatagaagactttaagaaggacatacataactcccttaaagaaattacaggcaaatacaggtaaacaggtagaagtccttaaaaatgaaacacaaaacccttaaagaattgcaggaaaacacaacc

SEQ ID NO: 4114 - DNA, 1200 bp, mus musculus
actcaatgataaatggatattagccaaaaagaagctcagactaaccactacacaactcacagaccatatgaaacccatgaagaaagaagatcacaccaaaatgtggatgctacaaggcaattagtagagggaatagaataatctctgggaagtagagggagagagggatctgggaggaagaagggatgaggggggaaatgagcaccagttcagataggggaggagatggggggaaagtacagagtgtgaggtgtttgaatacaggtgtatagcagtggggcagggggaacaaggtgggattagtcactaggaagtcctagatgccagggacccaagtggttctcatgaccaatcgggttggactttagccgaaatatccaacaaaggggagaaagaacctttagagacaacattcagtgaataagagtggacccaatttgaggaatggggccacccatccacctcaaaaatattaattcagaagacctcctgtgaaaaggaaatgcagagacaaagaatggagcagatactaaaggaatggccatccacagactaccccacctagggatccatctcatctgctgacaataaacccaaatactattgctgatgccaagaactgcttactgacaggagcccactatagctgccacctgagtgactgccagagctagaccaatacagatgcggatatatacagccaaatattggaatgagtgcagggaacccaatggggaagttaggacaaggactataggcgctgaaggggtttccaacctcataggacaacaacaatatcaatcaaccagataccctgaagctcccagggactaaaccaccaaccaaatagtacacaggctgtatccatggctccagttggctatgtagcagaggatggccatatcggacatcagtgggaggagtggttcttggtcctctgtaggcttgatgacccaggataggggaacactaggctgctgaggtaggagtgggtgggcagttggggagcactctcatagaggctgaaggagggagggggttatagtgagcttgttgatgggaaaccaataacatttggaatgtaattaaataaatagtcaataaaaaccaattcttagaaaccaagaattcaagcgttcacatacatgactcttagacaataggaaatactgcttcatgccagtattataaaaaaaaaag

SEQ ID NO: 4115 - DNA, 1000 bp, mus musculus
aacatataacaaggacacatgctctactatattcataacagccttatttataatggtgaggagctggaaagaacccagatgtacttcagcagaggaatggatacagaaaatgtgatatatttgcacagtggagtatttacttagctattaaaaacaatgacttcatgaattcttagtcaaatggatagaacaagaaaatatcaccctgagtgagacaactcaatcacaaaggagcacacatggtatgcacacacgtataagtggatattagcccaaaagcttgaaatacccaagatacagttcacagaccacatgaagctcaagaagaaggaagaatactttcaaagagtgaatactttggttcttcttagaagggggaacaaaatacccatgggaggagatatagagaaaaagtgtggagtagagactgaaagaaaggtcatccagagactgttccacctggggattcatcctatatacaaccaccaaacccacgcactattgtggatgtcaagaattgcatgcttaaaggagcctgatatagttgtctcctgagaggatctgccagagactgacacatatagaaatgaatccgcacagccaaccattgaagtgaacatgtggtccccaaatggagaagttagggaaaggactgaatcaacggaaggggtttacagtcccataggaagaataaaaatatcaaccaaccagaaaccccagagctaccaggaactaaaccaccaaccaaagaatacacatggagagacccatggctccagctgcatatatagcagaggttggccttgttggacttcaatgggaggagaggcccttggtcctgtgaaggctcagtgcctcaatataggggaatgccaggctgggaaagcaggaatgggagggtggaggaacatgctcaaagaagcagggggaggggaattaagtaggggttttttttttttttttggaggggaaaccaggaaaggggataacatttgaaatg

SEQ ID NO: 4116 - DNA, 1000 bp, mus musculus
ttgttaagtgaaaataaaacaaaatcaacactgaaaaatctcagtatgactgaaccttccaccagggcagattacaaccttgactgctcctcaaaaggtcccacagtttgaaggcctcctaggagttccactgcacacagggcaagaagtaggagaccctcccaaataactgcaacagttggaaaccccatggagcccagtggacctggggacacatagctcttccccatcccccaaattccactttgcttccttcctgttccttctgcctgggcagatcaccatcttgtctgctgctctgaagacaccccagtctgaaggcctcccaggagttctgctgcatacaaggaaataggtaagcaaacctcccccaaaaaaactgcaacagctgggaaccccgaggagcacagcattctggagaccatatcccctcccactcaaactcctctcctcctctggcctgcaacttcttccaggacagatcaccagattgtctgctatttgaagccccaacaatctgaaggcctcccaggaatctggctgtctgcagggcaactgataccacagtctgaaggctaccctggtgaatagctatatctagggcaacaactttactgttcctctgaagcaccaacactctgaaggcctaccaggagatttgctgcatacagggcaacaaatcaccagcttgtctatccctctgaagaccctacagttagaaggaattaaagatggtctactacagacagggccacaagcttcccagaagacgtgcaacaaaccaggaaaacaggaggcaggctccatacagagacacccaggtcaactaacaccagaaataaccaaatggtgagaggcaagctcaagataataagcagcagaagtcaatatacatgaacataatcagaacccagttccccctacacatcaattcctggatacaccaacatacctgaaaatcaagaggctgacctaaaattgtatctcataaagataatag

SEQ ID NO: 4117 - DNA, 1000 bp, mus musculus
ccaaatgaaaatatccaaaggtgttagacattctggattatcatatcgtatttcaacaaaacagttcatctatatgtgtcaagaatataatattttttcattctcattgaactattaatatttaaaagactatatttggtgccttccagtcagagccagcactgggtcaacttgagtgcagagttggtggacacccccaaggtcccaagaggactctccactggattataggaccacaggttagtggaacacatcttctgttccattccaatttcatgagatgagcagtagggaagcagaaaacccagcctgaccagggtcacaagtcccttccatttggtgccagcaccgggtcacctgggccatgagttggagaacacccctaaggtgcctagaggacagcttctgaggcagaccccatttcaggctccagacatccgggcattttccctgccagaggaatcctgtcctccccacccgagagggctttgcaagagcacttggggaagccatcttggttcccggatccctctgagactagtctgctcaggtgagagtgtggactacagaagctaacatcttctgggacaggccctgtttcaggcattcatcttctgccaggaggcaggtctgaaccccagatatctgtgcaccttccttgaaagaggagagcttgcctgcaagaacgctcagaccactgaaactcaggagagagctagtttcccaggtctgctgaaagaggctaacagaattgtgggaagaacaagctctaaccagagacaactataagaacttcggagattaccagatggcgaaaggcaaacataaaaatcttactagcagaaaccaagaccacccaccatcatcagaacacagcacttccacctcaccaagtcctggccaccccaacacacccaaaaacctagacccggatttaaaagcatatctcctgatgatggtagaggacatcaagaaggactttgataactcatttaaataa

SEQ ID NO: 4118 - DNA, 1200 bp, mus musculus
gagtagacctctgacaagcctaaggagtattttccttaagttgcacataatcaaaattgtagttcaaaaccatggattaggacaaagagagactaacaaagattgactctatcttaagagaaagcagatggtgggtttgtggactacaactgcatctggtactgaattcaagcagaagagtgacatctaggaaaaatcctttcatctcaactttggaccagaatagtggcagcaagcactttagaagatttctttttgctttttggttgtcctagaagtgtatgcccatatctgtaagtcaaaaatctagaaatccagagctcctgtacaacctgtagaatactttcagctaaaaggaacaaaactcacatacacaaacttacaggttcagctctgtagctgagcatgcttgaatggttagtgtgatctggtcagaggtttgctgctgctgttgctgctgggtgctgtgagtggagacatgagctacatttctgctcctgcctgctaaatcttcttaaagcacacaaaacagcaataaactgcaccctgtcatttatgcttcgttttccagactaaagttctgcctgcattcctggaggtctgctggctccagggataaccaggtaagacaacagcctctgccaagtccaccaaaagcacacccaacaatagtaaatttcaccttggccattgtgcttcattttgaggcccacaactctgcctgctttcttggaggcttgtcagcaccaagggcaaccaggtaagtatctcactccaaaccctcacctgccaagtctccttaaaacattgtcaaaagcctttccttacctcaacccctcgactccactttatgacccacaacacaacctcatttccaacaagccactctggaacctgggaccccagagcacaccggtactaggaacgctaaaggcaagtttagcacctaaaaccccagagaccacacagtccacaaaaagccttaaggaaaaatatctaccagacctgaagcatcactagtcaccagaacccaggccaattagaccagaagaaagaggggaaactaaaaccaagagaaatatccaaaatcacccagctaataaagataaactcagaaatcagcatctatacttataataaccataaaacccagatggcaaaaggccagcataaagaaacaaccaacaacagtgaatgtaa

SEQ ID NO: 4119 - DNA, 1200 bp, mus musculus
ggagttggtattggagtttcaaaagtctttgttgttattgttactgttttaattattttatctatttatattccaaatgctaacctccctcatagacctcctcacagagtcactccccaatccctatcctattttcctctgagagggtgggacccctcccttgggtattccccattccttacacatcatctgtgccacattaggcacatctttctacagtgaagccagataaggcaactatgttggggagcagataccacagtcaggctacagctttagggaaaagctctgctccagttgttgggggggccacagggagactgagctgcatgtctgctacatatgtgctgggggcctcatttcagcctataggttttgttttttccagttggtagctaagtctctgagagctttcacaggtctaggttagttgattctgttggccttcctgtggggttccaatcctcttcagctatcagtctttctgtcaactcttccataaaagtctctgacctctgtcaaatgtttggctgtgggtttctgcatctgtttcagctagctgctgggtagagcctctcagaggacagttatgctaggctcctgccaaaagttcactccaaatccagtctttgtctctctctctctgtctctctctgtctctctctgtctctgtctctgtgtgtgtgtgtgtgtgtgtgtgtatgtgtgtgtgtgtgagagagagagagagagagagagagagagagacagagacagagacagagagagagagacagagagagtatctgtctttctgtctttctctctctctgggtcaccctctctctctctacctatgcactagatgtggccctttgatgttaatcctatgtctgcatgaaggtcatggtgtttcctcttatgatggtaatatattaaatctctgaaagtataaggaagccccaagattaagtgctttcttttataagaattgccttgatcatggtgtcactccacaaaaataaaacactgactaagacagggtggaagaatgtagatgtcctctgtccatattgttatatcaactgttattgttattgtgttagtattgtttagacacttgatattattgagatttcatggatgaattttctcctattctacctaatgaacactgtctgacaatagttttcttggtcctttggctcttgtaaagttttg

SEQ ID NO: 4120 - DNA, 1000 bp, mus musculus
atgaatggatacttatactttcagatggataacattaatgtcgccgggaaaaaatgtgcttagtgttggagcatttacattttattgaaatgtacactctcctgggatattcatagaacactaggctcacaacgtgcctcgtacaggctttgcttttgtgcaatctgttccaactactataccatgtgcctcagggattttgcttacatattctagaatgttatttaacctaaagataaataaaacttttcaaaatagagaacagaggctgcattctgaagctcagctcctactttatccttgggtgcaactcaacccacagaaagattattcacacccattcctaggtcccactacaccccaaccaccaggtatgtgggcaccccaaatggcgcctttgtggatcaggagagcctgcattggaggaacagtgtattcagtcattctgcaaccacgaggcaaaaaagttcaccttgaatccaagttttagatgctagtgcctcttctatatgaatgtgagagctggaaaaaaatgaaatgcctaaagaaaggttatatttttaaagttgtaagttttattagtgtataaaattatgaaaaatcatgctgttcattatattttcagaaatgttaaagatatagttttatcatattgacctccagtaccctctcttctttctattacatcacgggtcttctaccttctctcaaacatctcctgcattgtcacattagttaaaacgtaattctaaagccgggcatggtggcgcacgcctttaataccacactggggaggcagaggcaggcacatttctgagttcgaggccagcctggtctacaaagtgagttccaggacagccaaggctatacagagaaaccctgtctcaaaaacaaaaacaaaaacaaacaaacaaacaaacaaaacaccgtaattctaaatatgaaagaaactatatatttgtaccttcttagtctaatttcattaaagatggaatcacaa

SEQ ID NO: 4121 - DNA, 1600 bp, mus musculus
tatcttctgtacctgtgattctctcttctatctcttgtattctgtccttgatgcttgtgtctatgactcctgatcctaggttttctatctccacggttgtctccctttgtgatttctttattatttctatttccatttttatatcctggatggttttgttcaattccttcacctgtttggttgtattttcctggaaatctttaagggatttttttgtgtttcctctttaagggcttctacctgtttacttgtgttctcctgtatttctttaagggagttattttatgtccttcttaaagtcctcaatcattatcatgagatgtgattttaaatcagagtcttgcttttctggtgtgttggcatatctagggctcactgttgtgagagaactggtttctgatgatgccaagtagccttggtttctgttgcttatgttctttcccttatctctcaccatctggttatctctggtgttagctggtcttgctatcagactatggcttgctcctcctgcatgtcagtactcctgggagaccagttctgtcagggaggaatttggatatggagatctgtgtacagggtcagctccatggtgcagactgaaagaagtatcctgtcccctgctgttccttgctcttgtgtcctgaagactctgggtgggtccttcttgggccaggaatttgagcagaagtggtgttcttacctgtcctcacagctgtgtcagtactcctggaagaccagccctctcctgtcagtatttggatatggagagctgtgtcacagagtcagctctctgtacagatggaaacctgaaggatcctatcccagtctgctccttggttcctttgtcttgagggctccggtagggtccctctgagcagaagtggtggtcttacttgtgctcacattcgtcttagcactcttgggagaccagctctctcctggtggtatttgagtatggagagctgtgatataggatcagctctgggcaaagaccacattttgcttgttaagacaaggtctcatgtaattcagattgtcctcaaaattactctagggccaaagatgaccttgaagtcctccacaacctacgttctggaattatctgttttggaccggtttttttaatgcagatattttaaagaacatgattctaggtcaagagaataaacacgtctaattttagtaaatataaaaaaaaatttctctggctgaatttcctaccaacttcctttcctgaccacactgtttcaggatctgtgatttcctcaccaccatgttgagcatttaaactaatgtttctattctcagctgttagcaggacacagaatcttgctataatctgaacttaattatgcctttctttgtagaatgagtaggcttgttaaattatcacaatcacctcatgagtgagcttgtgagacaatgtatgtgactatgttgaccttagcacatgtttgtgcatgtttgaagctctatggttcacagcctacactttcaagtgtttgttttcttttccttgttcatcatgaaaatactttaaatgacagagttgagggtttattggtatcttgtttcttttatttcatgattatcataa

SEQ ID NO: 4122 - DNA, 1000 bp, mus musculus
ctgtctccacaagaatgtcaccaaccccaaacccccacccacccaggcctctaaactccctggggcctccagcctcttgagggttaggtgcatcttctctgactgatcctagacccagcagtcctctgctgtatatgtgttgggggcctcatatcagctggtatatactgcctggttggtgttcaactgtttaagagatcttggtggggggcggggagggggagtctaggttaattaagactgctggtcctcctacaggatcgcccttctcctcagcttctaccttttccctaattcaaccacaggggtcagcagcttctgtccattggttgggtgcaaatatctgcatctgactctttcagctgcttgttaggtctttcagagggcagtcatgataggtccctttttgtgagcgatccatagcctcagtaacagtgttgaagaggttaactcaggacctttggaaaattccatcaggtcgcagaacatgaaggccccctcccctcctggaagagagaggtcatggagcatataggcacccctcccttctggaagggagagactgattacattccaccttcagataagggaagcccttgctacctcattccctgaggaccaatcagtttaaaactcacactgttctagcaatcacattgtgcctagtgactcttgctctattctacccccgaaaactatttaaaaactgtccaaatggactgcctggggttgtcacctctcctttggatgcagtacgaccctagcatgctggaacaataaaatccttttgtattaatctctggctccatgtgattcactcaggggtagctaaggctcatcagagtcttacagtgtcaggtcttggggcctccccttgaactgggacccactttaggcctgtcactggagcttcttttcctcaggctcctctccagttccatcgctgcagttcttccaaacaggaaaaattatgggtcagaattttgactatgatatggta

SEQ ID NO: 4123 - DNA, 1200 bp, mus musculus
aggaggctgtattgtactttaattaattcaaagcaagattaatcgccaaaaggcgcctattctattacttgaaacaaaatgagatatgtgaatcgtattatttgatagtatgatgcatttttaggtaggaattgaacacaatcattattaatttcagcacaaatactcacctgcaatgacttaagcttaaattgtctcctttttataataagaatcatatcaaaaaataaaacaggattcaaaggtttaactcagctgctgttgtcttaacattgttatattaagagtgaaattgcattgaaaggcttcaattaataagaaatttcaattcagggtgtgttctgtgatttttggaattctggggtgcagttaagaccccactctgacgttgttatctccccacctcccaaaaaaaatcccacttgccaaactccctactgtgttaaccataatggtggtattaagtctgtttgtgtcactgcactgtaggtcctccatgcacttagtacagaatacagaatccatcccgacatccactggaacctcagtgggtatatatttgctgcagctttttaatctgtatttttaaaagagatatcaaacacttacgtttaaagcagtaggcatcaaatctgctatcagggagagggaagcatgtctggttctcaaaacgatacagggttctcaccccaagtagacctcctccacactgggccctggccacagtcacagggtgccgcacgctggcatccgacagccagccgtaatcgcattggtcaaagccatttctccaagctgcctgaagttctccaacagtcgccagcctcgcatccctgcttgtacactctgcttcggcctcctcgaaggtgaacttactgggagcagtgatgtggaacacatcgcctgcaagaggaggaggaaaagggcttaggtcgacacctcattctctcccagatttgataaatgctgagggaagacgtgatacttcttacagtgaggaggcagctgcttatgcggtagagcaaacagtcacatatttattttgagaaaactattattaccatataataaaactatataccataatagtttaattatttataagtgtttgtgtatgtatgcgtatgaatatgtgtgcatgtttacacacacagatatacatatgtgtatatatatacatatgcatatacatatatgtgt

SEQ ID NO: 4124 - DNA, 1200 bp, mus musculus; identical to SEQ ID NO: 4123

SEQ ID NO: 4125 - DNA, 1200 bp, mus musculus; identical to SEQ ID NO: 4123

SEQ ID NO: 4126 - DNA, 1400 bp, mus musculus
taagagttttctcaggattttactgatgaaaagaacttattcaactgttaataaggtaaattaacttctaactccagttgtcataaataaatagtaaacactaattgtattaaattcattttttttacttgcaaataaggaaacaccttgtccaatacaactggaggattgtggctaacagtgtatagaaagttgtagtagctaacaagccatgacattgttctactaaatgtgtcacatttaatcagcatgcctcttagccaaaagtcacatttaaccttcaaaccatcactaaccatagaacttaatgcttattttaaaagttctacaagtttacagggatataacatggtccttatatggaagaagattctacacagcgaggtagaaaactacatgtaagagaatattgaaagaatgatcagtggatgtgaagaacagtctgacaaaagttcatgatatgatgttgtaaatgtgagttcacccctttgaacctcagaatcctcaaatataaaataagaggagactgattctgtgccacagcactccatactcaaataccacccagagagagctggtctcccaggagtgctgacaagcctctgagcacaggtaagaccaccacttctgctcagagggtcccacctggaaccctcaggaaacaagaaatgaggagcagcctgggacagaatacttccagtttccatctgtgcccagaactgaccctgtgccacagttctccatacccaaatagtgctgagagagagctggtctcccaggagtgacaacacacatgttccaacagataagaccaccacttctgctcaaaatcctggcccaagagggacctgcccagagccatcatgacagaggaattaaggaacatccagggacagaattgttccagtttttgtctgcaccctagagctgaccctgtgccacagctctccatacccaaattactcccagaaagaataggcatcacaagaatactgacatacaagcttgcagaagggacaagccacagtcagagacagcaaagaagctactctagacataaaaagatggtgagaggcaaggataagaacataaaaaacagaaaccaaggctacttataatcatcagaaaacagttcccctaccacagtgagccctggatactcccaacacaccagaaaagcaagactccagtttcaaaaatcacatcttacgacaatgatacaggacttcacaaaggaaataaataactcacttaaagaaatgcaggggaggctggggaggcggcctaagccacagcagcagcggtcgccatcttggtccgggacccgccgaacttaggaaattagtctgaacaggtgagagggtgcgccagagaacctgacagcctctggaacaggcaga

SEQ ID NO: 4127 - DNA, 1000 bp, mus musculus
gcagtgtatatcaggatagaagtcgggggacaatggagtactttttagtagaaaggaacaaaaatgcacatgtatagtttaaggctaggatgtttgagcaatctggaaggcaagaaaaggtgggagggaagaatagagggaggaagggacaaaatgtctccatggtctaaagggaagagctgcagaattcagtgcaatataaaacctgcagtcaaggcatctaaatcttcagctaacaaagatggcagctgggaaagaagcacagttttatgtgcatttttaaaactctaactgctactgtgtgtggtagagcatggaggttaagaggaaaagccaagaatttggttaagagtctgcagagtgaccataaggcacagatacaacggcaacctgaacaggacagtgattctggaaatacctgttagccatcagtctgaaaccttgggaacaaatgacttcctataggttggatggcagggctgtcggggatatgctatcctggagcacaaggaaaggtgacagagagaagagcatgacctcagctggaaaggaaggtgccaggaagcaagccctgcccaagtggtactgagccagcagtgggggcttcaagtgaggtacacaccagagtcagaaggcactgtcacttagtgcatctgctcaacatgtcttaatgatcctgttcctgacaactgtgctttttctttcccaagtaagaaagcaccctggaatgactaagacatgtcttaattatggagacctctaattgtaatgattctgcactttatgcgggaaaggatatatagcctggtttgtataatgcttgaagcaacaaggtctaggaatccatcagcttttaatgcatgacctcattgttccctgcaaaaatcaatcaacctcctggtacccatattgaaaagccatagaaaataagtcttcttgggtttgtttttcctttattcccacgggaaattctcaggtcacggagcaaatgtgagaccac

SEQ ID NO: 4128 - DNA, 1200 bp, mus musculus
tgcatatggatcttgctgatgacttagtaactactgcttccaggacctggaggagccagccacaaagatggaagagcggccatgctacttacaagaacccaacgtgtagaatttgtttaagataattagagcagttaggagggccaagtgcagaggggacacaaagtagtgggtttagggattgcttgacaggtcccagcatggtcatttaactgctctatcaactctagtgaacacttaatcttctaaataaaactaaggaaaattgtttctggcgtcgtgttacagtaagcagaattggagaattaacaccaagaggaactttcatctttgcatctcacccaacacttttagctcatatacacaaacaaggcccagaaatgcagctggcatcaaggcagtgagaagcaagggctggcactgcagctacaacattttgttctgcctacagtgttcatcctctgttcccttctggagggaggaggggatcacagaggcatcagtgaaagaggcggctcaggaaccttaccaaagctacaccaagtcacaaggctcctctccgaggccacataagcagtaaacaacagctagagaagcgtctcctcggtggattgcctgcctagggtcggaagtttcatggataaggcatctataagaagtcaaggtggcacatgcctttaatcccagcactcgggaggcagagacaggaggatttctgtgttcgaggccagcctggtctacagagtgagttcctggacagccagggctatacagagaaaccctgtctcaaaagaaaaaaaaaaaagagccaaggtaaagtggacttttcaccacttctgcttccgctgccttcaagctgcccacgcacctgaaagtagtcccaatcacgtggtctcctacacagagttgtgggctctcggctctcttgagccgctctttacgcattgaaaggatgcatgtttgcttcagcttgggaaaagtcactcagctgcgatagtaagccacttctcaattattactgcactggattttggctgatactcaaaacataatagcatttttagcttaatgttttgcttttttcattatgtagtgttttaaatatttggatttacttaatttgatattaagagttattagaaaaagaactcacaatacatttattttcctcgagatgttactaattcactgaacgagaag

SEQ ID NO: 4129 - DNA, 1000 bp, mus musculus
gtatattattccttaggcaccatctaccttaatttttgagacaggtgtctctcactggcctgggcttgacaattaggacacactagatggtcagaaagtctcagatatttgccaatgtccagctccccaccactgggaaccaagagaagttgacatcagctgtcttcctttatagctctctaccttactttttgagactggcctctcattgctcttggagttgatagtctcaaccagactagccatatcccacgctccaatgatcaccccatctcctcctcctcagtgccaccatacctgccaactgtcatggtttctgagggctaaacacaagccttcacgttggcagggcacacattttactatgtgaactttctttccatccccttgacttgttcttgaagcggacttcacactgttgctgtaaaccttactcaattctgaattggtctcatgagtccatactaaatatggaaaaatagaaatgatgaccccatcatttgcaacgatattcaaaactaacaccaaacaaaaacacaatgctaaggttaattaaaacaacaacaaaaaaagcaacaacaacaaaaaaacctaggccagaaatgattgcacacatctgtaatgccagcagagggaaccagacagggaagaaggaagagtttgaggccagcttgggcagcacaggaagaccctggtgaagacaaactaacacagttaaactcactgtaccgcatagcatgctattttagatactaaaacaataaccttaagaacatgcgaaatgtttcattctttgtataattatgaattaaaacaatgtaatgccttcaatgggcaaccatgggcctgggtcactgctggcctgggaaggagcacgtgtatcttgtccttgtgatgtctgccttgtcttgtcaccagtgctgttgtgtggccccacactccattccctccacagcctatcccactgccaactatgctctagacacactgctttgacact

SEQ ID NO: 4130 - DNA, 1000 bp, mus musculus
tggtttgagcagtatttaatgtttccattattataactgactgctattcatagccctgccatgtcttctcagacaattttttcttttacagttttgctactggaatgtacctgttagaaagtggcttagattttctgtaatgtcaatgttatttgttaataaatgtagttgccctgttaattttctttgtctctgttttgttaattgtttactttacgttcctatggcagcttcccctccccctcttctcctagtctcctccccccatcctatccttcctttctcctcagctaagggcagggcttccatggatataatccctccttggtgtatcaagttgcagtaagactaggaaaggcagtccagttaggggaaagggatccaaaagcaggcaacagggcagatacagcactgctgctgtctggagtcccacgtgaagacagagctgaacaactgttccctgtatgcagaggtctgtcccatgcctgctctctgggggttcagtctttctgagcccctgtgcgcccaggttagttgattctgagtgttttctaattctttttttcttgatggggtggggtggttctcatgctctccaccattctaagatgtgctggtttctctgtgagtgagggcttgtccacccacacctggtttctgaataatgacttggaggctatttctacatgaatgaatgcctaggccagaagcttggacttgcttcctgactcttacacgcgttcttgtgaccggccaggaaagacgcaacaaaccggaatcttctgcggcaaaagctttattgcttacatctttaggagccagagcgcaagagagcaagagagaaagcgctttattgcttacatcttcaggagcaagagagcaagagagcaagagagcaagagagcaagagagcaagagcaagagcaagagagagaatggcgaaaccccgtcccttttaaggagaattatcctccgcctaggacgtgtcactccctgattg

SEQ ID NO: 4131 - DNA, 3000 bp, mus musculus
tgctgtggtaggagaactaagctgtagtgaagacatactgctctggctgttaccgattgtgttcttttgctggagtttaggcatgtttgatgtgattatatgtctaggtgctgatttctgggtttctctttgttgagtgggtattttgctcattgatttccatttcttctcttgattttcagagtgtggtggctgtgtgttgcctgttttcctggcctgatcagttggtgtgtttacagagaatgcctgctggtgtgggaggaaaggatgcagggaagagtgtgagcaggaaggggagggcagtctacagggacatgaacactgggaaagacaggctgcagctgatgttcggttgcagtgctagttgcctgagagatttggtctcgggaacagagagcatgtttcacctttaggatttttttaatcctttattttttgcaatttaaacatgatatatttttgattgtatagtggttggtgttatgtgtttcctagttttagtgtttggtgactgatagtaattaagatgaattctcaattttttgtgcttcactcatgtggtggtttgaatatgcttggcttggagtgacaccattaagtgtggcctagttcaagtaggttggagaaagtgtgtcactgtggggatgggacttgagactctcctagtagcctcatgagaaccagtcttctcttagcctttggatgaagatgtaaaactctaagctcctccagctctgtcctctgtagcactcttaggtctggttgactccactccattgcctctggtgttcttagtgatcaactcatggtactggcatctccaacttgctgcaactaggcttcaccaatagcctctcataggctcccttcctggtaccaagcctcatcttctttgtaggaccccttcagtcctgggttgtcaactgcagttgaggctattaccaagtctagctgcaacacaaagtacaaccttgactatctctggaaaacaccttctttgtgctctcagaaaacactttccagaaagtttctcctcagtgatactctttttttttttttccttcttttaatttattgaatgtatgtgagttcactttcatctggccaagcatattcaaaccaccacaacatactacatctatctgtcttggttatattataccttatattatacatattttagttgccccatagttcgtgcataatttgccttgtcttttgttttgtttttagtgttttttttcattctccttatatttctgtttaataattggcagactcgcagtcttccatcagccattattactttactaataacactcaaggtagaggaaacttcataatactacattcccaacacgcttctgaacggtctgttatttgtcctctatgaaataaaatagggtcatttgttttaaagttgtttgaaaaaaatgacatagacacttttgtgcttgtaaataaatatcagaaacctagaaatatgtgcagattgggaaagaaaagagtagagatatatagagatagagaagcagggctgctcaatctttatagaaaggatactggaaaccttggctactgtagtaagaatagcaaaaatgtcaatgatacttatttagttgcctctgttcttccagacatgatttacctgtcatgtcccactgacctctgaaagagctggtagtatatcagatggcagtaatagtagctaatacttattgatcccatattttatgccagtcactattgcaattgctttctctaaatccattcattgaatctctgagcaatagaacagctcaatactgtcagcatgtacattttcttgggaagaaatctttgctgagcttcagtaacagaagtttcacagaggaaacacattcttattgtcttgcttttaactgtatattttacattgtgttatagtatgtgagtcttgccttggtcattgcttgcccctttttaattttttttaacttagtaccaatatcaaaatataaaacacattccaactgtttaaagaccacagtttttaaaaattgtcctaccttagaagttcaatctcttacatatccagagttctttttgaacttgtatttcaaaagagaataacagggcacatttacaatcaagttaaagaaaacacaaaacccagtagtatagaaagttcactgttgacattctgggatttctgactgtctgggctcccgaggacctggcagctccactgcactgctctgccatctactgcactgccactctgctcatcatttcaggaagactccaccccacagcgtctgctgtcctcattgtttgtcccacagtcctggcatcccaataccgctgggtcttcagatagctgcactgtgctagtagcccgtcctggctgtcgttagggtctctagcccttgcccatgatgctgtgcctcagctcagtgctttcatttctgtgttgtgatgtccacttgtccagcctaacagcctggcacatgttaaatgttggtgtccacacttttgttttctttctcattcttctggcccctgtactgtggagaaaactccccatcctcatattgagttcttgagagaatgtaactctcattgggtcattgagtcctgtgtctatggatcttcaggacttctgttgaccatctcatctcatggccagctctctcctatcatcaaggaacccttgtctgtcttcttcaggtcagcaagcattgcttccttggggcttgttagcgttgctattctaataagaatgtttataaagtcctttcaaacatacagtttttttcaaaatcagcttaaccaaaacttcagtgaagctcattcaatatttgacagctttcttcttactgtgcatgctcacagggtcttacatgctctgacccaaatcacctgcaatgtgagtaggcctttgattttcgtgtatttggagaggtttagcctactcttaatgtgtggaagatggttgacagtgcctctgctgaggcataa

SEQ ID NO: 4132 - DNA, 1000 bp, mus musculus
gtggatgaagtgcaccagaatggtggacagctttgtacccaggttcccaactgaagacagacctagaaagaagagtggctgtctcaagggaagacaggacttgtgttctctttcacatggatctcagtgtcttgtctcttctcctaaaagcccaagtcatcgcaacttagagaagtagctagaagttgtaactctgatggagactgcaccactcagcaccctgcagttgctacctcaaaaacctccacagagctactgagaacagaagcaaatcaaggccactggatgaagggtggggatcaggagcatggagaacggagttacagtgcatccgtgccctcttggtccctgcagttcccagtgcttgctaatcctatctcaccaaagagtggatccagatctctgaatagaccaccaagacagggacagtctaaaaagacacattagtagtcaaggttccgaggaataccacagtaaagaaactcacttgtgtaacacagctctcttctctcccccatacttttggaagtggacacatctaaccagtagaaccaaagcatacaagtagatagatacaggacatattttcagagccacttctccaagactgcaaactctgtggcaccttgtttggtattttaaaaagccccttacaataatccttattaataatacagccaagccctgccccacctctaccttacctctgatcttacccaaacattattttttaatttgaacttgaatgttaccatgtaaggtaaactgagtctagcctcttctccatcctgtgagttgaacttggttcctctatcaagaattaccttggccactcctagaaccctcagcaaagacaaagcagaagtcttcgcccctagaacatgaacagactttcctagccctcccaggtaactagaaaccattggagagtgtgtcccaacacatcctctcgtctcctgttatcaggggcaatcggacatcctaggggagaccttgaaat

SEQ ID NO: 4133 - DNA, 1000 bp, mus musculus
cactccagatgttacctgacatcagttaaatggtctccaaactggcttccagcgaaattatacaaaagtaaggtgtcacttggtactaataaaacctctgataactcctgtattagggtttctatagctgtgaagagataccatgaccacagcaactcttacaaagaaaagcatttcattgggttcaggggtttagtccatttccatcctggcagggtgtatagtgtcacacatacacattgtgctggagcagtagctgagagttctacatctagattgacagatgagagagtgacactgggcctggcttgagcatttgaaatctcaaaccctacccccagtgacacatttcctccaacaagaccacacctcctcctgtcattccctatgaatctatagtgggccattttaattcaaaccaccagcagctactaagtagcttttccccagcttgctgcttctaacgtgacttagtagataatcttataaggccacaaggtggtttgcaagtcgttgtgactccagttctaagggatcgaatgctctcttttagcctccatggacactaggaatacacatagtgtacatgcacacatacaagcaaacatttaatacacacaaaataagtaaatcttatttactttttcaaagaagtggtattgtcttggaacatatgcagatggttttgatcttgtgaataacctgaacactattagcatttaaacactggcttgaaactggctggaggaaatctttgcaccaggtcatatgtcaagttgtatatgtaactattaggacatccagtatctgcttgggatttatttactgacagactcgtaactgactttgaagggttttcttctcagacagtcctagtggggctggctcctcagccattgtcagagagcgtgatgatctgctccttgccaaccagaaaaccatggcaactgcagtccctgggcagctgcaaggatgagcaagtgaaccaaggtaagccagt

SEQ ID NO: 4134 - DNA, 1000 bp, mus musculus
tcagtgagcgaccctgtcctaagaagtaaggtgaagagctagagggagaccgccacgtgtgcacacaaatgccatacacaccctcccatttgcacacatgaacagtgtgtttccttcatgttatattaaacatttcaccagtggcagcctgatggaaatctatcttacctgctttcaccagacgcacggcacactctccagggggcacgccatgcagatctccctcgggcccaatgcacatggtagctgctacgggcttaccagatgcttttaaggcttccactgcccacacggcttcttcaacatgttcaaaatactgaaaccagtgaagggcagaacacctttaatcatgtttcccacaaaacaataggaataccatccgattattatttgaggaactgtctagtagtaagcatttttgacccagaatagaaggaagagagagtttcttagtgtgactagaagacaaacgatttgaaagctgctgtgttaggtgaactgagtcagaggctgcagaggtcttagatggaaaaagatctggaaagttaagtagatattgtcgctccttgttgaggtttgaactgcatcctgttctggcctcctgagagtaaggaaggtttctttctttctgaatggatttcccttgctcacctctgcaatgaggaagtccacgttcttcttcatgaacacctctagctgttggcgaaatatctttttcacttctacctcactcttgcagctaaggtatgaaggcgtctggctcacgcctcctgcaaccaaagcgtctccttcatcagccacttgccgtgcaatgtcacaagcagcttcgttgactttctgcccctaaagtgggtaagtagggggacacgtctaaatttacaggtgaaattggaaaaatatattacatacacgcccacctctcagttttatttttagtgtcattgtttttttttcccccccaggaagcaagggttatgtagatcaatggttgaccgagtct

SEQ ID NO: 4135 - DNA, 1200 bp, mus musculus
aagatacctgtccatgtcctgtaagtggtggaaaaagacccatatgtaagatgagatagaggagatgacagccatagggttttgatcgagtcaggtgacagacttggctgtggccaacagctttctttggcacaggcaattggagatagtatttccccaaagaaggaaagactcacagggaagccagatctttgtgacaatataaactggatgtcaccctgtccttctaagatgtgggtgtgagagaactttacatttgtttgtgtgattgaaacagagtctcactgtacagtcccgcctagcctagaacttatcaaccagtctagcttcagactctgagacctgcctgcctctgcctcccagtgttgtgattgcaggagtgagtcactacacacacacacacacacacacacacacacacacacacacacacttcaaagatccgtttattactgaagatgctagagcaaatgcctggctccaggagctccttcagagtaggccctgtcaccgcctccaaattctgtttaaggaaatgagtagatggtgagaagcagagatgtcttccgtgacgtcatactagggaaggggacattcagtgacgtcatactagggatcagtgacgtcatactagggaagggagcagatgaaggagcccagttaccccagttctgccctgggataatggacgagattgaggtttacagggagaaagaactgggtcatggcaaagggttggagtgactcagcatcctggtcatggtctgccctggtcagatatcttgcttctggttctgttagaggccctggccaatgctatgacttgaggggaccaatctcaggggacgattacttctgctccggggtgtagccttgcccttgtgtggtggggaggggctgattttcaaggttctgctgtcccaaatccaagggggctggggagtcttagagccggagttatctctgtgcccgcaacctctgagtggggataaagtaggtttagacaggcacttcctgagcaaccaacatgcctacgtgctaaagtgagaggaggccactcactcactgtacaggagacagacagtcaaggcacagattccagacttttatcctgcacgcagttaccttgttggctcaagaagggagtgaatacttctaatccagtagttctcacccttccaattgttatgactctttaat

SEQ ID NO: 4136 - DNA, 1000 bp, mus musculus
ttgagtgggcgctgcttactgtagcttctctgagctgccagctgcagagttcctgtgattgattttagccggcaccttttatacctgggaactcccaaagcacttaacaaagcagtgagcgagtgtgaagctgacggagatagctcaggcaaacactgcaaacactgcgtcagcaccagtccagctgcacgagtccagccgcatgggtccagccgcgctcgggtctggctgcacaggtccgactgcacgggtccagtcacacgggtctagtcgcacgggtcctgctgcacaggtccagtcacacgggtccagccgcagggttccagtcactcacattgtcccagacttcaaagtcttcagaggagtaacggttggccaggtcaccaccatcttccggtctgtttccaatacccagtgcaaacaggacaccagaaaagacacaggacagatgtgatcggccactctggatggcttcagacaatccacttctttaagtcttcatttcctggttggttcaacggaaagattagatatggtggtccggtccattcaggggttctaagatttgcgttctcaattacttattgaggccggagaagtggtcagccgtgactcgggacagccctttgaggatgtcttcagagttgtgggctttccctctgatggggtgcgttgtggtgtgtatgtatgtggaaagaacaatttcaggagccattcttcagccaatgtccacttttgtttctcgtgggcctggaactcatcaaatagactaggatggaagacccctgagctccggggtctctgccaccccagtgaaggggttgcaggcatgagccgctaggcctggctttgtttgcatgcattcttgggttgaataaagaccctcagactggtaaggcaactgagctggctgtctagattcactgctcattaatacctggcatattggttagcacataatagcccctcaataaatgttagttgagtgaatgcatgaaaa

SEQ ID NO: 4137 - DNA, 1400 bp, mus musculus
ggttttctctcactggcctggaacttaccaagtctagcgagccagtgatctctgttttgtcttccgagggctgggattataacacaatagcctaccagactttaaaaatgtaggctccaatgtaaatgaagaaaataccaaatcaatcaatcaatcaatcaataaaacaaacaaaaaccaaacaaaataaaataaaatgtaggctccagaaactaaactcaagttcttaggcttgcagtgcaaagactttatagactgagccatctccccaagccaggactgtcagttctaatactgtttcaataaaatcttttttaaattaaatttttgttctgagattctaccagtttacctgtttttgtataatctctgcttgacttcttccttcttcctttcttgacttttttttctttaacttctctggaataatgctcacttcattaattttcagccttattttctaatatgcatttaatgctatcaatgtttttgtgcaagactgcatacatgtgagggcacatgtgtgcacatgcatgtatgtgagtgtgtgtggaggccacaggatcatctcaagtgtccttccatcttggtttttgagagtgggtccctcactggccctggagctccctgagtaacttaagttggctagccgtgagcctcagggatctgcagtctctgccccacccagtgctgggactgcaagtgcggtccattatgcctggctcctgcagttaaacacaggtcctatgcttaggtgataagcactttactagtcgaagctatctccccagcactaaaactgtgtgtgtatgtgtgcacgtatgtatttggtgtgtgtaccaaagaggatgcacacagagaccactggagaagtctgtgtgttttcctacactattctctggcttgtttgtaacagggcctttcatggaatctctagttttccatttcagctaggctggttagtcagcaagctcctgagacctgcctatctatgtttgggtcacaggtacaggtggccatgcctggccttctcaaactcaagtgcttaccacagttaccagcagttgtaggctgcccactgtgcatgctgggaatcaaacgccatgtcttctgcaagagtggtgtatgctcttaaccactgagccacttctcctgcttcagtctgtcattttactagagaatttaatccaataatacttagcacaattatttatcttctttaataagaggacctggaattaggtttttagtaggataaggacaataggaagtctgttctgaaatatttactgtgaattcatattttctagatgtgttctaagtgctgagaaagcttacagttttaatttaaaatattctatggaaaaggaaggagatagtgggagtggttttaagttgag

SEQ ID NO: 4138 - DNA, 1400 bp, mus musculus
tgtatatgtaacagaggatggcctaagtcggtcatcagtgggaggagaggcccttagtcctgtgaacgatctatgccccagtataggggaatgccagggccaggaaacaagagtgggtaagttggggagcaggaggagggggaggggactattggaggggaaaccaggaaaggggataacatatgaaatgtaaataaagaaaatatctaagaaaagaaaagaacagaaaagaaaagaaaaaaagaaaagaaaagaaaagaaaagaaaagaaaagaagaagtcaaggagcctcacacaggatgtgtaatcattacatgactccatattagttatcacgtaccttctttaagctttccaacaatcttgtaccagtccttgatgaccatggtaatgttttgattccaaaatacttatttttggaactctaaacatgaaagcagttgaactaatcacatggcattctctgcttcaccaggaaggtttaagaagaagtaagtctgtgagtgagatggggaggggaaggaaggccagcagcaggaggcttgtccttttgtcaagggaccgggagctggggcatggctgtacccgatatgatcacatctcatccctctgttacatctcaatgtgcttgttcactagccttggggcaggaactaagacagtcatggccccacaggacaccttgaggagcatttgctctgagcctcagcagtgggaagaatggatggctgatgtctgagaggagcctgtcctgcaaccaagggcagtgaatctaagatctgtgttcatgttcatttttaaccttgttcaccatgcttgtacaaagccatttgcagcagccaacaaatcaagttccagacttcaaggctggtttccgtctttgctgtaagactaagcattatattccgagagccatcgttgctctggtgaaggcccctgacactgacaccttcaatgcaatggctcctgactctctggcacttgagtcacaacagggaataaaccacagacatttctattcttcccaaagaccccaaaatgagaccgcatgaaaggggaattttccttcctgctaaaagctacattatacatttcctagtttgatagtttccagtgtcctgctttccctccattggacaatttcccatccttttccaaactaatccataagctaatccttgctgaccacccctggactaacgctcattttctcattgttactttacacaggatcctgccccttaataagtttgtcctattttctttttggccatgaacacttgcttccttgttctgggaatctgcagacacatctattccttctaaactctaatttctcagggtaggtattctcattctctctctctctctctctctctctctctctctctctctctctg

SEQ ID NO: 4139 - DNA, 1000 bp, mus musculus
ggtaacacaaaaactgcctttgtgaaggtcactatggcccattgttttcatgtttatttttcagttttgctgtttactgttcagccctgtaatgtgtggggaggaaaaaagccagaacttggagcctaggcactgctgtgtattgctgatgctaatccagaggaagaattattagttctagatataggtaatagcagaagccacctaggatttctaaagtcttgctcatcgttatgttttccccatgggctgaatgttccacagaccccaaatatgaccagttaggttcagctctcccacaacaccatactccaaaaagccaagactccaagattccctgcctcaaatagtctacgtctaacacctgcctgtggctctagcttcttgtgtgtcctttgtagggctgagcagtagagcagggggactgttcctaagtgtcgtggatacagctaactctggaatggcttatccacgcatgtgagtagagcccctcatggtgggaccaagttagctagaagaaaggagtagaccatgggccagactagaacaactggcctcttctcttgcctcttggcactctagaattctgaggagtccaggaatactgaattttccaactatggctttccaagttgctaaacaaatttactcatcaaagttggagactgtcttacagcttaatagactttaatagaccttgttccattttcttgttttgtttcatggtgtaagtgtcttcccttgaccttttgctcctagccctccagatggtggggtgaatatggacaggctcgcccttccctctcttctctctttcgctacttctcactcccaccttacgcagctcaccttgtttggttctctcatggagacctggtgaggtccagttccaaccatcagtactgaaaatccttctgtttccctctctatgcctggctttctcagatcatcctcatttgtcagaatccagtacatgaagatggctttttagaggataaat

SEQ ID NO: 4140 - DNA, 1000 bp, mus musculus
ccatttttatcgcttataaattttcataacgtatgtatatttgctttataacagaaagtagcagtagccaggcctagagtcctagaactgttacctcagctcattgggaggctggggcaggagaattgcaagaaaaatgcatcctgggctccagtgtgagttcaagtccagcccaacagcttagtgagatcttgtcccaaaagaaagaggaaaaaatggctgagtttacgactaggtggtgggatgcttgcccgacgtgtgtaaggccctaaatgtaatctctaatcctgtaaaaaaggagaatgtaacaatagctagatgaaggggactgtgacatgagggaaaggctcgtaggtgtgtatttgaggaggaggaggaggatccgcagaggatggaggaagtgttcatggtgagcttcagagcgttgttgtgtcgtgtgcagactttcctctgaggggagcaaaactcatcacgttggcgtgtaagctaagatgctgactgtgtgcagaaagggtatgacccaggctggagagatgctcagtggtcaagagcacagctgctcgagcagaggacccaggtcaggtgactcacacccacctgtgactccagtcccaggggatccaatcctctcctctgacccccacaggcactagcaagtctgtggtgcatgtacatacatgcaaggtacgtgtatatagcaaataagagaaacatgtaaaaataacatagaagttagagagatgactcagagtttaagagcagacgttggtctggcagaagacccacatcctttcccagaacccacaatggtctgtaaatccagtcccgagggagccaacaccctctcatgacctctgagagctctagacacacatctgaagcacatacatccatgcaggcaaaactctcatacacataaagtattaaacataaacataaaaaattattcttataaaagatatgattcatctgtcatgtttctgcgcccatgaccggaatc

SEQ ID NO: 4141 - DNA, 1000 bp, mus musculus
gtgccttcatgagttctgcctagtgggaataaaggaagtgtccaggctacatatggctttgcttgtggaggttggaattgggtcagctttcccatcctttcttcctcttaagctgtcctcttttgttgttcctccgtggtggagttcaaacccggtgtgtgcacggtctatgcaaacactttacctttgtgctgcatcccctggctttgggtcactgtcttctaatgtgtatggtgtgtacttactctgacctaagaactctgcctagcatcgaaaattcattcttgctggcaaggaatcagaggggagaaatgtactccaaatcctcatgcaggtacagagccaactactcagagtctgcgcatggattgttttgggtctgctgtgcagccccaggctggctcctcagacacccaatagtcttgtgccgtgcctcccaaggtcaatcttgtcagctcttgcccgttcatccaaagttagctccattgcccttccctaaagagaacagtgtctttggtaatagaaattcaatctagaatcttcaacattagcttgggagacctctgtcagtgagaagggaaagctgatataagccccaggagatgccttacctcacatcctccctgtggtttccctcaccacacattgcacccaccagtccccccagggactgagggcagagaagaatgctcttaacacgctgctctaagcacagacgcagaatccgtctttgtctccctcactgcaggaccaaggaaaaagctgaagctcccaaatgctgctctcctggggcactgggacaaaatggaccccagagtcaccactgtgtacttttcttctgtggaggagtagcagatcccctcctgagatctgtcatgtatgcacccacactgggtggcccacaactgcttggtcgtctgcatgcacatgggcccacacaggttacacatccataaactcagacatacgcacagatgcatacatctctaaaagtctgctt

SEQ ID NO: 4142 - DNA, 1400 bp, mus musculus
gcaattgtggaggactagaacattctagaagcagtagcagacagaggtgggcgggtagggctgggaggagagatagcgaaggtgtgtggggaaaaggaggagacatggttttcgttttggaaatccaacccccttggggactcagagcccaaaccctttgtgcccatctaccaagttctgaatctcggtccgggctgtggagggcccacaggcaaggcttcctctgaatcgctgctcaaaggttggctcctgtgaaaacaccgccatctccactcgtttggggatgtgaaaggtttaggatggtgaactcagtcacactagtctgggaactttgacagctgttgtgtgtggtcaggggacgcaggggcactccaaaatgagctgttgagatcagaattgccctaccatgtggagaaattacctacatgcctgccacagttacataacaacaagagatgtgattcagtgctttctgactgtcccggaaagtttgactgctgtggcacatacactaagagggtcgtctcatcactcctgggtcaggtaaggagtcagaggggttctgtggctgcaaatatctactttagttactgctacacatctgagaataggaaagccctaatttggtcaaccagctccctcatcccatagcttttgtgacccaagaccagtcaaaagccagaacttaggcaaggcacatctctttcctgagggccatctagccactgaaaataacatattcatctagctttggaacaactttccttcaaaattatcaagttaagacaagaataaacatgtgtcttatacagtttagtagatcagaagtggaggggtgtctggcttgtgagtcaagattgccaactaaactggaactggagggttgacctccagcgtaagtactcatgtgctgttcaatatgctggctgtggggaggaagcctggccacatggactcctctatggggctgctgcagcatcctgatatctggctacctcatatcatgggataccaagagagagtaaggcagaagcttagataatttttaggttcttgtttccgaagcacactctgaaattcctcatattggtcacaacatcagctctatctggtgttacgatggagctacccacagataacggatgccaggagataacagtcattgttgaccatcctgaaagccttcttccacaaagagctacaacctgctgggaggtatgagatagtgttttgtcaatcactcactgtacatgctacagttactatggttttaccattttagcttaagtggagaataagcccatgtgctggatgcttggtccttagctgctgctgctgttttgggaagttatgaaattttcaaaaaatgggacccagctgcaggaagtaggccactgggg

SEQ ID NO: 4143 - DNA, 1400 bp, mus musculus
tgattaaggatgttggacttttttttcaggtgcttctctgccattcagtattcctcaggtgagaattctttgttcagctctgagccccatttttaatggggttatttgaatttctggagtccaccttcttgagttctttatatatatatatgatattagtcccctatctgatttgggataggtaaagatcctttcccaatcagttggtggtctttttgtcttattgacggtgtcttttgccttgcagaagctttggagtttcatgaggtcccatttatcgattctcgttcttacagcacaagccattgctgttctattcaggaatttttcccctggaaccacgatggcccctcgtggatcctgaggcaaaggcctcccaggctgggtggacacctgtcctctggccaaaaaggtggccggctgtctggagcctgaaaacagcgctgccccagaagctctgcagctctcacgtgtcccagaagctgctagcctctgtagtccacactctcacctgtgcagactgccctccgcggagtcccggaaccaaggtggctctcgcagaacctgcagcagaagcctcccgggccgggcagacacctgtcctctggccccgaaggtggtcagatccagcagcaattcttgaagaagatcaagcactgctgttgtgagtgccaatgacactgcccagtgaggggttgtaagccccctagagatttcatacaactcatagatcatgagggatgcagtgggaaggcagcaagcagagcaaatctctgtaacagcatgaagccctcaggacccatagtggtttgctaaccaggaggctgcgttccatgagttctaaagctgttttgctgttcctcttgcactaccccagcacccatcaaatactgcttccatgatgtggcttctacatagatcgatgtagcgccttcctgttgaccttggcagtggatggttctctatatgaacatgactgaagctctctagtcttcagacaggaggaccaaatatggactgacaaggcacttacatgttcaatatagctcctaaattcaatagggggcatgcaggctttttttaaaattagcagtctgcacacataataaatattctttagtaggatggatagttgtgtctttagctgtgaaacagaatctggtctgaatttcttgattctcgcacatcagtgtcctaaatgttgaaagtacaggtgtataccaccatgcccagctaaagtaaagtgttttaggaaatctggtattctgaactgtcagtaaccttcaggagcatcctttactccaggacaacaggagagaatgggactaccaatttccagaagataatcaagcgtttggactgagggtgtctttccttcacatcattaatcactttcatgt

SEQ ID NO: 4144 - DNA, 1200 bp, mus musculus
cagactttcattccttcataaccttaactcaagtaaacattttcttttattaaaaacaaaacaaaactttttatttgatgtacttttgttaactttctatggattctttgtgaatattaaatcatataccccaatcccacttatgtccctatccctttgtatctgcccttgcaactgccctcctaagagaaaatcaaaaaataaaatgaaaacaaaagtttgttgtggaagctgtgatatgtcacagtgtgtcccatagtgtgccctgtagtccacatatctttccttgcaaatgttcactgtaaggagccattggtctgtttcaagtactgctacactgtgagtactagatcctcaccaggattcctcagggatattgtggtattgctctgtgccgtggagatcctgcagccttggacctgcagaaccagccccttcacatgcttcagaagttcatagatggaatagatgttgggttggaccaactcaaagccctggatctgggagtgggtactaactgagctaggtggttagcctgccagatctcctgcacccacatcaccaaggtgagatccccaacactgccttggttagcccacccaatgtaaggggcagggccagcttttctgctctcacacatcctcagggccagctctactgtgctgcccaggccatgtgcagggcccactctcacatgctgcagccagtgaggggcagggaatgctctcccattctcatgacctcagggtcagctctctcacgttgcccaagttaggagtagggccagctctccagcttgccccaggcagcaaggagtggatgggagggagcatcttacctgagaccccacactatcatatggccagtgaggggtgaggccggctctcccaagctcatgcccttggagctggctcatctgcaacccatgaaaccaaggtcagctctactgtgctttctgagagaggtgccaggctgctccctactgccctagccaggcagagacaaggacagttctctcaagtgcagcagttagtgacatatggggccagctctacacagccctcaaactccaaaaggctccaggcctcataccttagcagcagcaggggccaggacctcaacacagtctcaggtggcatcaccagctgttcatctcaggctgatctaggaagggacagaggactagtgtgtgtgtgtgtg

SEQ ID NO: 4145 - DNA, 1200 bp, mus musculus; identical to SEQ ID NO: 4144

SEQ ID NO: 4146 - DNA, 1400 bp, mus musculus
gcatatgcagctagagtcaagagctccggggtactggttagccctcttgtgcactgaaatggaggtagatggctttagcgttggaggtttggaagcctcatgcataccagctcctctccaggcctctgcctgcagtgcgcatgaccactggctgtgagaagaaattaaactgagttctagtagatggactcatagagttaagcctcgctttggggcacaaaggtagcaataacccagtgagcttgtctccttctccttttctaatgatgactaagtcacctgaagcaaacattacattagccttatcctaaaatcatgggaaaccccgagacaactgaaagataaggcttactggagagcaagctgcgacttcatttcattttaatagtttgtgctgactggaaatctttaaaccaatcccactggatgattttagtggcattttcttggctaacctatcagagagattggtgcatgtggcttgctttctactttaacagcaagggcacacgaggtttgttttccccatgacacagcatcatcccttccttctctctgttaagtgggaggtcctaggtaggagtctggaacccttttccagcccttgggttttgcggcaggctcgttagaacctgacaggggttcttggcacttcagctagctcttggcagccaagtgacctttcactttgaatgtaactaatgtccacttgtaatgtccagctcatgaatattgccagacagattggttgatgggacaacgcataaagacaactggtcagctctgccctgtcctcacttggcaactagtggctgtggatgaaggatgggcagtctctgtggccagggtcctcagcacccagccatggaggctgagctggcactgtggcctggggaggggctgcagtggggagcagagaggggggaggacatgttgggattgttctcaaggccaagtgctacagttctgtgtctatatgaacactatatctataggtggactttaagtatggacttttagcatcataattctggattagaggattagagagatatttgaagatattatttagtagctcttggtattatattgacatatgacacgatataggatattatatttatttagtcactacaatcatgtaactttaaagtatacgtcacagatgtgtatatgtggggcaaagtcaaggaaaggaacctatcagccacatagttaccttcttgtggtagaagtatccacattgacactctactattagctggacttccaggatacagtgttgtaactacagactccaggatacagtgttgtaactacagactccaggatacagtattgtaactacagactccaggatacagtgttgtaactacagactccaggatacagtgttgtaa

SEQ ID NO: 4147 - DNA, 1200 bp, mus musculus
tgttattatagtcttgctctttttatataaatccgtctcctctacctgtgtctaatttaagatatgtcttctatctctaatatggtgttaagtccattaactatcttttgacttcagatacataataattttggttttctggggtgtttatgtgcctttcacttcatttatgctccactttcttatagattattgagcttagacattagtcggaaattctgctaattccacatctgagccacttctgcagctctgtggactatttctgttttcattgactggattttcttgtgattaggggtcaggtgttacctaccccttggcatatgcagcacttattattactgagtatgctctcatactcagtaataaaatgaataatatgaatgtttggatcttggtgattttccttaccatgttgatatttgggcaatgtatttgcccatcagtttaatctttgttggggcagctgaacagcaggcttctcatagggctgtttgacttaccccactaatgttgggcttttctgggggtttctgttgcatgcatattcaaatgaggtcatattctgagtgaccacatgaatgtgtcttagtgctttagctccaggattcttaggagagcccctggagcagttctttgactggatttatggagttaagctaaacatctgtaatttgggtttcatctagcaactcctatgaagactgctggattcttccactagttagctcctccctctctggaacactgcactggttagctcctccctctctggagcactgcactgcactgcacatttactgctgcctcagcctttctgggctcccatgtctcctcagttccgggagccttccaagctctgcatgggtgctccttcctgccccaaggttaggaaatcgcttccaaagatcacagatcttctagcgctcactgtccagttctggaaaaagggtgttttatatgctttgtccagttgtttgtgggttacaggagtcgaagtgcaaatgtcagtcaattactgctccttcctgggaggaagctgaggtcgctctgcctatggttttaaaatggagtcaatgagaactattcaaaggaaaagaaaacaacttgaaataaaaataacagtgacaccgagtttaccgggagtgtatggaagtagggcatatttaaaaactggttgaggtttaaaattagaac

SEQ ID NO: 4148 - DNA, 1000 bp, mus musculus
gagagtatctaggtcacagataatataggcacattctgaaaaagtttccgtgataattttttcaagtctgcacatgtaattgaactttgagtccagaacattctacaattctatgggaaatctacgtgaggcctttggcaggaaggaggcatgctgcgatgtgtggtgccaattgtgtcataccatgtgacacctgtaccttaagtttatcacctcagtggcatacttggcagtaagtaatatggcttttcagaagtgaacaggacaagccataggcatcgggcaatcaagtgtttgctttgtagctcaatttttgtcaacaatttttgaatgttgcatttgccactggaagatttgtggaggggggaacctctttggctttacaactctaaaaatatcaccagtgataacaacagattttagacacgtcatgctcataggtactaaatgttctttgagtaattgacgtgtgttaatttagttaactctcatgtcatgggccaaatggtcaatgaaagatggaggagggaactaaaggtgcatctatatgactccatttaggacatggactcaaaggctcatcacatgccttgttccagaggcatgcctgctaatctgtggcatgtcagagcctgaacaccatggtgcacagtgctatcactttcctaaaaggaatcttccctcatgcccatgcctttgagtgctacaaatctccctccagccaactgagtaggcttctagccaccagagagcaagacaactcctgtggacaggctggcagaaggacaaggcatggttagacactgaaaatctgtgtgtgatctgagattgccacatagtcacaaatggaatctgcacaatgtggacttcttcacgttccttcctggtagcatgtggtgacatctgaccaagcagaggtcttcaataaatgttgatgaatgtgataaaggcttacataatgacatgccatataaaatgttcctgtaataatgagagacat

SEQ ID NO: 4149 - DNA, 1200 bp, mus musculus
acagggaagagcatttgctgctcttgcagggcttctggcttcgactcccagcacccacatggtggctcacaatcatctgtgactccagttctaggtgatcaaacaccattttctgctttctgaggtgcaaacacaacagcatacatgcagcaaaaattaaaaaaaatatttagaaagagaaaacatgaaaaaacaggcacatattgaatcctttgaaaaaaatccccatacgcagatttcagttttgacctttctcggtaaggaagtcaagacacagatgaataaagagagagttgggtgagtggatttatttctcttaatgcagaatccatgctcaatcttatacacgagagaacacaacagaaaccaagatcagaattcttgtgttccctgctgctaagggtttaaatccatcctgttgagtgttatcacagcacatggccacccataacaaccacatctgttacaatgtatatgtgaataataacagactcagattgtttgaaatggaatcttttttattagatattttctttatttacatttcaaatgttatcccctttcctagtttcctctccaaaaatcccctataccctccccacccccctgctccccaacccactcctgcttcctggccctggcattcccctgtactgggcataaaaccttcacaagaccaagggcctgtcctctcattgatgactgactaggccatcttctgatacatatgcagctggagacatgagtccctccatgtgtgtgttttttttgtttgtttgtttgttttttgttttttgttgtttgttttttgttgtttggttggttggaggtttagtcccagggagctttgggggcattggttagttcatattgtagttcctcctatagggctgcaaatcccttcagctccttgggtcctttctctagctccttcattgtggaccctgttctcagtccaatggatgactatgagtatccacttctgtatttgtcaggcactggcagagcctctcaggagacagctatgtcaggctcctgtcagcaaaatcttgctggcatctgaaataatgtctgggtctggggggttgtttatgggatggatccccaggtggggcagtctttggatagtcattcctccagtttctgctccaaactttgtctctgtaactccttccatgggtattttgttcccccttctaa

SEQ ID NO: 4150 - DNA, 1000 bp, mus musculus
ttaaaaattctctggagactatgccttttttcttttttaaaaatacagacattgtaattgtcttactaggtaatattcaaatgttgtaaataaaatataaaacacatgggatagtcaggttgtgaactccatgaattcagccactgccacatgatctgttttgtctctcccatttatggtgtatcactgatggttcaaaggacccaagatacattttcctgttggattagtgaaacatgaaatgaggtctaaaaattgcatctttactatattattactaaatttgagcccctttatatacctcctaaaatagtagttttcaaccttcctaatgctgcaactgtttaattcaaattttcatgttgtggtgactctcaattataaaattatttccattgctattttatagctgtaaatttcctactgttaatgtaaatatctatgttttcttttctttttctctttttgatattttctttatttacatttcaaatgttatccccttttccagtttgccatctgaaaataccctatcctctccctcctccctctgctctccaatgaactcactcccacctcctggcccaggcattcccctatactgaggcatagaaccttcacaggaccaagggcctcttctcccgttgatgatcaactaggccatcctcagctacatatgcagctagagccatgagtctctccatgtgtgttctttgattggtggtttagtcccagggagcttgagggttactggttagttcatattgtggttcctcctagggggtgcaaaccccttcagctccttgagcactttctctagctccttcattggggacccggtgctccaactaatgaataactgtgagcatccacttctgtattagtcaggtactggcagagcctctctggagacagctatatcagtctcctgtgagcaagcttttgttggcatcaccaatagtgtctgggtttagtggttgtttatgggatggatccccag

SEQ ID NO: 4151 - DNA, 1200 bp, mus musculus
cccagaaaaaggaatggccatagccttatgcttttgcttgaggaattggaattcagttttgttttgttttgtttttttcagcaggtatccacacatctcagtcacttagtcatgcaatgactcaggtggagagaaggaatgaacaaaacaatcggtaggaaggcaaaggtcctccaggcagaggtctgaagtagaagagctcccactccattaatctaattatgaggcatgaagcattcttcagaatccaggaaatgaacgcattgttctcccgtgtgaattttcatccaccctctttcctccagaagagaggagaggataaaattataagtgatgagaacttactagaaatgtttgttgctttttcaataggatagcagtgagactactgatcagggtactttagacaattctagttcctatctgccctttagcaaaagaaccgaggtagcgtgtatactaacagctccagggaggacagctctgaggacaagctcattactcgatggtgatgtgagcgccaagctcgaggcttctagccaggcacactctaatctctcaggtcatactggacatctcagggtcagggtaacccacctcgctgagaaacttctgccaactcagcctttagtctcctggcagaagaggacagtgtaaagacagagggcaaaatgaaggctgccaatccctgctatcctcaaatccagagttcttccatactctggactgccgtggcttcaaagttgattgtcccagcaggccggtactgtctcaccaagtccccaccgggacccttgatctgtgttcctctgtactcctttgctcacccagcggacacacttgttgtggagtgggtggaccatggccaaacccatggcttcttttctgactcacataaccacatgtgtttgcgtttcgtaccctctgtgtctgtaatcacaccatatggcaacgctgcgtctcatttgtctgctcctctccatgtagatctttgtggctgcagcacccaattcctacctgacagaaggcaaaagaaacatccatccatgagatcttcgtgactaattagatcataggattatgggttagctaaaaaataaaatagtgcccctggagagatgactcagaggttaagggcactgactgctcttccagaggtccggagttctattcccagcaaccacatggcggctcacagac

SEQ ID NO: 4152 - DNA, 1000 bp, mus musculus
cccttaatgtgtgagcatccagttgtcccacatcttcaccagcccttgatatggtaagtatgtcaaatcgtaattggtgtacaattctctgtgttttcaacttgcatttacctagtaacaagtgaacttttcacatgtttcccttttcacttattttcttctctcattttggtaaaatatctctatacctctagtctagcattgtggtggcttgaacatgcttcacacaaggagtgacactattaggaggaggtgtggccttgttggaggaagtgtgtcactgtgggagtgggcaattaagatccttctagatctgctcctggagctgaccctgtgtcacagttctccataaccaaatcccaccagctggtctcccaagtgtgctaacacatctgagaacgcaggtgagaccaccacttctgctcaaattcctggctcaagagggacccactcagagccatcaggccacaggaaccaaggaatagccagggacatgatcccggagctgactctgtgccaaactctccatacccaaattcctcccagagaggagtagtcccccaggagtgttgacaaacaggctaacaggagggacaagtcacagtcagaatcaacaagttcagctaacaccaaagataaccacatgtcgagaggcaagggcaagaacataagcaacagaaaccaaggacacttggcatcatcagaactttgttctccctccacagcaagccctggatacccccaacaaactggaaaagcaagactctgatttaaaatcatatctcatgatgatgatagaggactttaagaaggacataaataactcccttaaagaaatacaggagagactcgagccccgggctaccttgccagcagagtcgcccgacacccacaagggcccacacaggattccccacaggatcctaagacctctggtgagtggaacacaacttctgccaggagtccggttcgaacaccagatacctgggtaccttccctg

SEQ ID NO: 4153 - DNA, 1200 bp, mus musculus
gagaaggaaggaaagtttgtcactggttcgaatggactggagtaggggaagggaactgattataaaagagcaggaaggagcttcctgggctactgaaaatatctgacttctgactataatggtaagcaactgtctactttcattagtgtctttaatatgtacctcattacttgattaaaactaaatgccttgggttggtgcagggcattgtggtttttaagagctccccaaaggattccagcatcgagttgtggtagcagacccactagtcctcatccagggtcatccagggtcaccctggtacttgtctaaccctgcctctgaatgagggcgggggctactgacttgcttgtaacaagcagaaatcaacagtgggacagaacgtctgccactttattgaagcaggctgcttcttagtggctatgactatgtctgactgacaggctccctggcctcttgctggcccacagcacaagctgccgtgtgggaagacactcatggagaggtcatgcgtgaggaagtaagtgggacctccagccagccagacactggagaggagctgagatctcagagcagtgaccctgcagaaactaaaatcttccaggagtcatagacttggatgtggatccttctaaagagaacccgaaacaattaaagccttacatgagactccaagctagcaggcccacccaagacatactcctagtctttaccctcaaaacctctgaggtaaggcacggtgtttacagccaccatatttggagaaactttgttgcacagcaattgctgagtaacacagcagtcaagattgacagctgctggcacaagtcccttccactcgactcgagccccggctaccttgccagcagagtcttacccaacacccgcaagggcccacacgggactccccacgggatcctaagacctctggtgagtggaacacagcgcctgccccaatccaatcgcgcggaacctgagactggggtacatagggaagcaggctacccgggcctgatctggggcacaagtcccttccactcgactcgagccccgggctaccttgccagcagagtcttgcccaacacccgcaagggcccacacgggactccccacgggatcctaagacctctggtgagtggaacacagcgcctgccccaatccaatcgcgcggaacctgagactggggtacatagggaagca

SEQ ID NO: 4154 - DNA, 1200 bp, mus musculus
gggccatcgatgctgtacgctcgtgcagaaagaggtctctgtgatcctgacatgactggagttcttcccattgaatgtaactctctgtacgataagtaatctccttcagtacgccttgtggggtcaccgagatttacagaagccgttgaagacacgctactctgtctctgaatagtagtccgagtgactgctggcactagtcggtcattcggggagatagcccacatttctccatgcctggctggggcaagtctctgttgtaagtggtatccagtattggctctaacattgttatggttagagaaattcatgttggcagaatgctttgcataactgtgattttctgcactctcagatcttggaaggcgctgaggaggaaaactgacaggatctatttgtggattctgtttagggtgccacaaggtgtctttcactgtagcactgccactgtactggacattatattgtgggggaccatacaggtgaggtgtagactgtgggccagatactgtggcagctcttattatatctggctcttcagggttgtgatttgaatcaaacttgaaaactgcctttgtacctgacagtaactcagaagatgaggaggcagcagtgaacacctgcaggggctgatcatacagcagtgtggcagacttgcttctgactatgttcttcccatccacagcagatgcgattttaactgctgcacttggcggctgagggccatcatcaccaagaatgtcatagatttttaaacctccagtctccatgttagttatactatgagatttcacaacagctccagttggaccacttctctgaggagatagatcttccgtgcttttagaaatgcccacgtcagcagaagaactggccttctgtggttcaaccctaccaggagacggtgcagtgtcctcacaaagaccatttaccttatttatggactccaaattcggaaacttagccccattttctatgtgctcagcctcatttttaggatgaatacttaaaaagcctgttccaagtactatatcctgcatctttgatctttccattacttctggttgaaaaatattattggtcacaagtttattaatattcatgttgatatggtctaactggcgagagtcatcagatgtggcttttgaatcaatgtctttttcaatcagaactaactgttcttcaatattcaaatcatac

SEQ ID NO: 4155 - DNA, 1200 bp, mus musculus
acaagttccacatgtgaatatactatacaacatggttgtagagaactactattgaatattcaaaatagttccttaagctagaagtgtaatataatacacaaaatttagatttttcagccggacagccatgttatttaaatattaactcacttattttctagccacttgatctctgtgaatgccaatttcttcatgtcttaattcatggctgtattaattatcaattgctacataacaaatacagagtaaataagttagcacatattcactatgccagtgtctatgagtccagctatgactaactgtgtcctggtgaggttataatcaaagtattggtaaagactgagttctttgcacgaagcctcgttggtgaagaacggccttctaagtattctggggcaggatttagttactagtatgctattggatggagtgggaggttcagtttcttgtcagtactaggtagagattactctgatttcttttttgtgaatatcttagtattaatattaagttgcttcatttaagccaaagaaacaaagtctactaccaagattctgatccagaatcttttgtaatcgaatcatgaagtggcatcctttcagtattgagacattttattgatcacaattaaattattcaagggatgaggatgacagaagagtgtgtctgttttgtttgtttgttttgttgttgttgtttttttaagagtgtgtctgttaagagacagcccccttgccgtgcggtggtggcacacacctttaattccagcacttgggaggcagaggcaggcagatttctgagcttgaggccagcctggtctacagagtgagttccaggacagccagggctacacagagaaaccctgtcttgaaacaaaacaaaacaaaacaaacaaaacaaaaaaaaaaggggggggggaaagtgacagcccctattaaatctggcagaatctgccttactgcgggggtgctattactttgtaagtgaagactgatggaagtaatctatattttcaatattttatttttggtctgaccttaaattactttcctgtatgttactatttatgcttttgcacaggaaccaaatttcctctttctattattattaatgttagtacgcatttgcttcatctgcacccgcttgccatctaggccttctcaaatgagtttcttctatcagtaatgattatatcta

SEQ ID NO: 4156 - DNA, 1000 bp, mus musculus
ttgggacaatcatccagtctcagtatcataaggtaagtggcttctaatatcctagcagcattggggaaagcagcaaggggcctctctatgaacacagaagcagtgcttatacatatacacagtgctaaggcgaagagggccgcataattattcagtgtacacagactgacacatcatctcataacttaagactaagatttcagaatgcgtacattcacattgacctctgtgccacagaccccagtacttagggacactatttcttgctaaactggttgcaaagcgcttacctgcttctgtagccatcgttcgcgcctctgctgccttcgcagagtcctcaacttgcttctctccctgttgttcagcctgtggttaatggtgcccaaggggaagctggcagagcgcaggaagtccagctgggagaggtgctcctcttggtccgaggcctccagcacgctcctccctgctgagggcagatccatcaggaatggcaggctgttagcgttagcgtgatccgagtagactgaagaagcttctaggccgcactggcattctcttcccctttgtgcctgggtctcatggggagccactgaaagtctgtgcagcagcatattcggatcaaaactaggtgggctttgaaaggagcagctactgttactacacggtaaagccaagcctgaaaggtcaatgggccccgtttcatttagcctgggataggcagtaggcttacgatgtatttcatataaagtgggtaataaaatcagcttctcactgatgttcaggtccaaactgtgtgactttctgtgagacgctcttgaaggacacctgccggtgtcaggctgaggaacaaaaggctggcattttgggtccgaggctttgaagagcagtttttcattcttcatctcaaaatacgtcgctcgcacctccaggcagagtgcttctgtaagtcttccgaggccgttactgtttcgggccatgcttaaaagccagtggtttctgg

SEQ ID NO: 4157 - DNA, 1000 bp, mus musculus
ccactaatcatttagaatcagtatcttttgggactggagtcacaaattctcgccagagaaccagctaaggcactcatctttggatggattgccataaaaaagacagatatcacattgtctgcagggaaatgggatgtcatcagacattgaggcaagtaaaataagctgatcacaggaggacaactagaacaggtcttcttctctgtacagaaccagagatttgttctttgtctaagtgcacatggaagcaaatgcattgctctggaggtcaagctgggaaaggagagtgaagtgtgtcaacaacagtcttggtccccaaattcctcctcaaatcatgatatactttgtcacatcccactctagattgaaagcaagggctctgagtttcatgggatgctggtggagcccagttaaaatttattagaaatttattccgtggtacttccttggatttacccatataatgacctatgtctggctatctttttggtttgtttggtttttgaacacacagtacttttcttagggaagaactctcagataaaatctatcctgttgctatatgtggaagctggcttcttggatgtagtcatttcataaaaattcatgaagctgcccatgttatctatggaatcttttgcgaagtggtattttaagccccccagcaagctccatgcctttgtatttttccaatgcagagtatgtaaggttatcaggaaggttagtaactgtacacactctggggttccactgcctcagagtcaaattcccccccctcaggggatacaccctgcctgcttgaatgccacaggtaatgctaatgcaggaggtactcactatgatttctcagcatggctgcatgtattcttctccagtgctttctagtactcggggctactgtgattgatgaaatctaaagaaaaatgagttcttttctcttccaacagactgctactgctgaacttcaagttccaaaggaaatctacatagatcagaactg

SEQ ID NO: 4158 - DNA, 1200 bp, mus musculus
agggaaatagtcttaaattaattatagatttctacttcttttctgagcactgatttaagtctagttttttcccagttcagatactgtagtggtttgaatgggtatggctcccatagactcaggtgtttgaatgattagtccatagaaagtggcactatagaagggatggccgtgttggaagaagtgtgtcactgtaggggcaagctttgaggtctcatgtctgctcaagctaaaaccagtgtgtcacagagtctctttctgctgcctgcagatcaggatatgaaactctctaatacttcagcaccatgtgtgcctgcatgatgccatatttcccaccataatggtaggaacttaagggttcattggaaagtcaattggatgatgttttgctggggcaaacacttgaaggaacctttcgttaaagtggacatgggtgtgaaaggctaaggcagactggtgaagaaacatttcactgaagcagacacaggagagaggatgttctgaaaaagcaagcacatgaaaagacacatgatgaaggattttttgctaacaacacgcatgtattggtttgccttacactgtgtagttgagctgcatttgttgagactccataaagagaaacacactaaaaacttctgttgggatactgcagtttcttgccacttccatagactcaggctcattggatatacatgctgaggcaagacgtgtgctgaggcaaggtacataaggagatgtaatacttggagaatataaatagggctccacagagtgacagagagctgggcttgctggtatagctggctgtgcaatgcttatgggtctcccatcttcactgatcttcacttccctgagagatgcacagcaaagaacttctcctgatgtccctccagctgactggagctgaggctgaggcttggctgtcttagctaggtcatgtcaccaatgttgctgatgtgactctaccaaactggactgctgatgtagctatgaaatgtttatgagtggatcgagctgtcactgaactgaactgccaattttcagacaacacatacaggagttgctccaaagaacctctctaaataggcccacttcctcccaaccccatatcctttcttttctactaactctggtgggtggtgggctacaagggagattaaggggtttaagaaacattatcaaaaattaggtatgaaataa

SEQ ID NO: 4159 - DNA, 1400 bp, mus musculus
tttctaaattgcggtgctattaacttacatcttttaccatttctcttcagaatcactcaccatggtagagtattatcaactgtccaagtaccacacagatagggaaggcttcagtcagaacattcagaacaagcctgatagttcttaagtatgataagtatgatcatccttaagtaaccctaaccctaaccctaaccctaaccctaaccctaaccctgatcgttcttcagtaactctaaccctaaccctaaccctaaccctaaccctaaccctaaccgtaaccctgataagtatgatcatccttaagtaaccctaaccctaaccctaaccctaaccctaaccctaaccctaaccctaaccctgatcgttcttcagtaaccctaaccctaaccctaaccctaaccctaatccctaaccctaactctagccctaaaccctaacgctaaccctaaccctaaccctaacccctaaccctaactctaaccctaactctagccctaaaccctaaccctaaccctaaccctaactctagccctaaaccctaaccctaaccctaaccctaaccctaaaccctaaccctaaccctaacccctaaccctaaccctaccctaaccctaaccctaccctaaccctaaccctaaccctaaccctaccctaaccctaaccctaaccctaacccctaaccctaaccctaactctagccctaaaccctaaccctaaccctaaccctaaccctaaccctaaccctaacccctagctcctaacccctaaccctaactcatgaatggactagttttatgtcaacttgacatgagctagagtcatccaagaggaggaagcctaaattaataaaacgcctccataagaactggctgtagggccttttctaaattagggattggtaggtgagggctaaacccattgtgagggatgctatccctgggtttgtggtctcttgatctataagaaagcaggctgaggatgccataatgaacggggaagtgaaaaacattcttccatagtctttgcattagctcctgcctacagttactgccctgtttgagtttctgttttgacttcatttcttggtgactagtgatatagaagtgtaagccaaataaactttcttcatcaagttgcatttggtcgtaatgttttgtacctctgctgtttatattgcaacatattctgaatagagtaaagatgagctccagataggcacattgtttcctaaggagcattgatttctggggattgtactgggttctagcagctggcagatggtgtgaatttaaaatgaagagagaatccagtatcagggctgtaaggaagagttcaaggctatcacaaacacacacacacacacacacacacacacacacacacacacacacacacac

SEQ ID NO: 4160 - DNA, 1000 bp, mus musculus
tacccctcttctctaacttgattcatcatataaatgtattcattttcataaagcatattgtcattatttttagctcaattatatcaatgagaatcatactttaaaatgtcttatttatttataaattctaccaaaaagaattttgaggagttccatagcaattcctatagtttagagaagttttggttggttggattggtttggttttatactaaatatttaagaattcctaggctgaccgccagagcaagtgaaggagccatcttgtgtcctgggtccctctgagaccagtctgcgcaggtgagagtgtggactgcagaagctacacagcttctgggacagaccctattttgggctccagacatccgggcaccttgcccaccagaggagaggtggccgcctgggagggctgtgacctccagaacaggtaagggagccatcttgtgtccgggtccctctgagaccagtctgcacaggtcagctcgctgactacagaagagacacagcttctgggacaggcagaagcaacacagcatctgggacaaacccatgttttgggctccagatatccgggcaactaccccacaagagaagaggtggccacctgggagagctctgacctctggagcaggtgagggagtcatattgtgtcctgggtccctcggaaaccagtctgtgcaggtgagcatgcagactgcagaggcaacacatctgggacaggccaatttcgggccttcatatcagccaggaggctggtctgaatgccagacctctgtgcaccttccctgtaagaggagagcttgcctgcagagagtactctgacaacagagactcaggagagatctagactccgaggactgctgacagaggctaacagaatcacaggaggaacaggttctaaccagagacaactatgacaactaacaccagagaataccagaaggcaaaaggcaaacgtaagaatcttaccaacagaaaccaagaccactcaccatcatca

SEQ ID NO: 4161 - DNA, 1200 bp, mus musculus
agacttctacatatcccaaggcctcttgatgatatgaagggatgtcagcttctagtatgtttctgagacccaaggtatacctggatgtgttcacttaaaacgaagcgaacgttgctgtaaagagattggtatatgtatcagaaaatggcctagtcggccatcattggaaagagaggcccattggtcttgcaaactttatatgcctcagtacaggggaacgtcagggccaagaagtgggagtgggtgggtaggggagtgggtggggaagggtatgggggacttttgggatagcattggaaatgtaaatgaagaaaatacctaataaataaaaaaagaggaaaaaaaagagattggtattggcagaagagtgtgactatgtgacacttcccatttcacaggtatgtattaagctgtgtggtattctttcttctatccctggcctgtgtatgtttgtgggactcaaggtggctgaagccagtggtccacattgtcttcaggttcatccatgactgtcatccagttgccttttgactattgtaggcctctcatttcctcatcatcttttcctggttctttcatcctgagcttcatggaatactgcagggtcttaagatgctggtttggtttcatttttgtagctgtgatgaaatcctctgacaaaaagcaacttagggaagaaagggtttattccgcttataattccaggttatagccactattgaggggaagtcaaggcagcaactccagcagccagtcacgtcatgtccacagtaaaaacagacacacgaatgcatccaggcttacttgcttgctggctctcagctagctttctttctgtcttttattgttcaggaccttctgcctagggaatggcgtcactcataatggacttgtctttctaagtcaattagtaatcaagaccacccccacagacaaatctgatctagatagttcctcattgagactctttctagatgattctaggctgtgtcaagttgacaattacccagcgcataaacccaagagtggtttggatgtaaaggtctttctgttgatatctgtagaaatttttaccagaagagacctgtgtttggctcacctttttcacattttaacaaaaacttagataatctaagagaaaaccaaaataaatgtgttttagggcataaaagcatccaggatgtcactctacagtgtgtc

SEQ ID NO: 4162 - DNA, 1000 bp, mus musculus
ggtaggtcctttattctttccttccttttcctccttcccctcttctcctccccgtcattttctccccttccttctcctctcttccctccctccctcccctcccctcctctcctcttccctttttctttctctgtctttcttctggagactttgcaatgatccactatagataggatccaagcagtgcaaagatgagagcctgcctatctccctccattccatctgggctgggtagcagggattagcatgatgaagtaggcacattccttcacgtgtggctgttatctggcagttgaaaggcaaaattcaaaggactgcacattcatgaaaaagccgcttctctcagcctctcctccaaggaaggaagactgtttggggaggctcctcaacccactggaggtggagacttgagcagacgctcccagtttttagagagctgccagtatatcaggtttgttattaaagctgcccctcccctttgtcatttcctgtcacactgattccttaaactagaatctgaggttccttcccccattcctctcccttcctgttccttctgtagacttctgcattgtcttctgtgctctcacagtctgggggtacagttcttacttccttatagaaagatggaggtttgtggcttgacaaacataagataatgtggtagttactttttcatgttgctgtgacaaatacttgtcaaaaacggcttcagggagggaggaagagtttattatggctcagtttgagatcacagttcataggacaggggtgtgaagcagctggtcacacacacacgtactcatgcacgcacacacactggcgtttcgatgcatactcccttttattcagtctgggatttgaacccctggaatgtccaggtcaggttggtctccccacctcagttatacctctcccagacatactggctccttatctcttacttgattccagatcccatcaactcgacagccaggattggccgctacaggtggggtgc

SEQ ID NO: 4163 - DNA, 1000 bp, mus musculus
cctccagccgaaaaagtaatacggattcatgcttttgttgtcttaaggacactgaacaatttagacctcttcctgatgtcctgttggacaagccaaatgactttgtctccttccacttttgtccttgttttccccatgagcctcctttggccttgccacagagtcagagaactctgcgcacgagtgtgtgtcctggctcgtatgagaatggagggggtaggaacccatgtgcagccatcttaccctttctttctctctctgctctcatctctgaactttctcactccgccacattcaccttatcactctgctgctacggccggccttcagcctgagcttctttaacttaaacacacctgaggacactcaaagttaaaatgagctgtttagggagagatcttccttagaaagcctgtgagtgaacttgagttgtgctaatattaaagctagaaagggaaaaagtagaggtaagctttatacctgtgggcatggatggttgtgccaagtcattgccatcagcacactccagaaatgtgcttggaaggaggactacgtcattgcagcccctggaagaggctgttttaaagggaaatgcttcgtctacattaaatgtgtctcagaagtgcagttccactactcactgtagctgtgggctagtcctctgcttctacttgaaacttaccaaggaaatgtttgatgtgtgtttttaattatcactcccttaagtgttctgtttcaataactgaatagtcagcaatgcacatgcctctggaggagttaaaggcagcacgcatgtcctcgaggagcaccttgagagcagcatcgaatccttgggggtgggcggcgtggcagagggggaggggctgctcagaggcaagggactcgtttccatgtccccgctattcccccagaccgcactccccgtgctcgctattatgatatgtagtagagatatgttacatgtatttgcttctgtgggttttgcagatcccctctaaag

SEQ ID NO: 4164 - DNA, 1000 bp, mus musculus
cagtcatcaaaataacggcaagtttcatttaggtcaggtatattttctttataatttcgcagaacagtctccgtgtcctctggacattcggtgaaggccagtcagtgcatctccaacctttactgggtgctgtccacgtggagcgctcagtaaggaaaatgaacattctccccgagagaacgcccacttttctgtttgttttctcctgtgttctccggtttggaatctgcgtagcacagatgtccgctgagttagcaaagtggctgacctcatcctgcgatggtaggaaatctgactttcattcacccgccacagttcaagacaggattctgtccttatgtattgaatattgagcggtcggtccatccccttgaggtccatcttgtagtgacttcacacgacgtcccccaagacctgttagaattccacaacccaagggagaactcttagctgtcggaaatgtctagagccatagagtagctcttctaccagcctccattctgcctggccagggccagtgctgtagcccctgcttcactgttccacgtgtctcatctgcacatcagatttctacaagagcgcttccttaaagttattagagtcactgccgtcttttcttaaaggcgttcaaggactcggcgagttaagacacaacaggaatcctttttggatgcgataccagcttcctttctcctggtcctagaacacagcctcagactgcgccctgttcttgttgaccatctgcaggcacagcggttgttgactgaccctgcagcactgtgcatgggcttcagacacaaggaggaaagaaccggaaaatttggagggaagcatgcaagacactcaatccacagactcatcggataaagcttcttgctttcagagtggctggctggatcagtcaggacccagcaagccagccataagaaacacttacctgagcaggaggaattggtggttccaccaggctttaaacttacccaataaattcccatcgctc

SEQ ID NO: 4165 - DNA, 1000 bp, mus musculus
atgtctatctttattgctgaactatgtttcttatgtgcagcagaatgatggagcctgttttgtaattcattctgttagtctgcgtctttttattgatgaattgagtctgaagtggaaatttaggggttctattgaaagtcggttggatggtgttttagtggggcaaacacatgaaagaatgtttagctgaagtagacacaggtgaaaaactaaggcaggctcgtgaaggaacatctagctaaagcagacactgatgaaagaatgttttgctaaagcaaacacatgaaaggacatgtggtgaagaattctgtgttagtgacttgcatatttggtctgccttacattgtgtagttgaggtgcattgttaggactcgatagagagaaactcgccaaagaaactggtggtgtgctgcaatttcttgctgcttggactcaggctgattggcaaagtgatgtcagctgagatagatgcagatgttgaggcaagacacatgctgaggcaagacacatggaggacgtgtaatgtttggagggtataaaaaaggactcaatgtacagcctaagtggctgcgctaggcttgcttatagagctagctgtgcaaagctgtggctctcacatcttccctgatcttcacgtccctgagagaggcacagctgagaacatttcctggcatcttttctgatccctcctgctgactcatgcctggctgtcttttctatgtagtgccacctcagctgattggtgtttgctatccagactctaaccaagtagattgctgctgtatctgtgaagtgtttgcaagtagatcgagctgctgctgctgctaacctgtaatgaactatcggacttgtctatttccagacaacacagataggagttgctccaaagaacttttctaaacaggtccactccccccatatcctttctttactggtacctctggtagtttgtggctaaaaggaaggttaaaacattttagaactatcattaaaaatgggc

SEQ ID NO: 4166 - DNA, 1200 bp, mus musculus
aaacaccagaaggctacaatgatggcaatactttcttttcagttttcttcttctctcacctctcctcagctaccatcagtgatgcccagccatcccagtcttgctgtaggacacagtcttagtcagggtttctattttagcacaaaacatcatgaccaagaagcaagttggggaggaaagggtttattcagcttacacttccatactgctgttcatcaccaaggaagtcaggactggaactcaagcaggtcaggaagcaggagctgatgcagaggctatggagggatgttccttactggcttgcctcccatggcttgctcagccttccctcttatagaaccaagactaccagcccagagatggcaccacccacaaggggacctcctgccttgatcactaactgagaaaatgccttacagctggatcttgtggaggcatttccccaactgacgctcctttctctatgataactccagcctgtgtcaagttgacacaaaactagctagtacagacacttaaaataatctcctcatacaatcacttgtgtgggctgggctcctgtatatattcaagtgtgctctaggcctgatatattcacatgttgatcagctatgtctcttttgtgcttagcaggcagaatccttctcagaatgcaatttttcctttccttaggggaaaaaattgtggtctccagatagtgagaaaaggcatcatcaggtcaagatgtaagtgtaaaaaataagtggggtatattagttactttagcttaactggagcaaagtacccaagataagtgagttatgaagatcacatatttattttggcttatagccacagaagttataatccaagaataggcgacccattgttttgagcctctggctaggatggtccgctatggcactggcacacgacagatagctcagtgtatgggcttagaaacagataggaagagtccgaggccagaatcttcaaattccctccataccatgtcttcagttacatatacatctcatgtaaggctctgcttccaagtacttctttgtagttccatcttggggagcaattctttaaagtaatgggccactaggaaaacattcaacactgaaattatagagcagtacaaagaaccacatgcaaggagaaattaacccggatctagtgctaaagcctgaactatcttggcagctttcattacct

SEQ ID NO: 4167 - DNA, 1000 bp, mus musculus
gtgtaggacacatgagtactgaaagggttaatgggagttttaaaacaatacttaccttaagtgccagtggtttttatggctcgctggaatcagaatccttaccattctatttcccctgtgtcttgtccacgtagtctagcaacagtggccctgtaccttggattagcaaacacgaattaacaatgcttcagttgaccttaagttgtcctacatacaaaccattacaaataatactttttactcttctagctatcaagttttagcagagtgttatttttggcagaaagtggcctttgacattactctggaatgacttcctttggctgcatcaacctcaggtcactggagaagaacagaagctttgaggctgacagaaatgaagaggtgacttgtgggccagcgcttcaaagcaaggagcaggtgcatatgaagagccatgtcctccagctgggactctaagcccacatttctttccttagaggggcctataattttcacaaagcacgaaatgaaaagctttcaatctgtttctgacacttaaaaaaaaatgtcttaaattaagaatttctctcaaacgcccagtttctctatttaggatgaaatggataattagaatgtaatgaacgtactaacacaaatgatttcattatgttataatgctagctggtaggggcttttgaatgttttacataattcttgatttttgagggggggagggttgcttggtttttaagaaattaaattgtggttactttgctttttcaaatacattctgatcaaaattttatctgttgagagctagagtttttcaaaaatccttagtgtactaaagttcaaggccgcacatcagattatactattaaattgatatttttcagtctcgaataaaaaaaaagagctagcggattatctgagaacagagacaattccttttacttttatgaactaatattaataagtgctataccactggagctgattgtgtacgaaagtgtacggt

SEQ ID NO: 4168 - DNA, 1000 bp, mus musculus
ttaaaaggaggccatactgcacgtcagtgcctttactggcactgcctaatagtatcttctccagtttttgcataaataatttaataaatcttgattctatcatatagtttaaacaaataactttgagaaaagtagcagatttactaacaatgagggaggctgtatggctctgaccgaggccctctgcatatatgttgcagtagtatagctaggtcttcttgtgggactcctaacagtgggagcagaggcagtctgtgactcttttgccagctcttgagctccttcttatcctgcttggttacctcatccagccttaatatgctcggaggggcctattcttagagccacttgatatgtcgtgtttggtttgtaagactggggagcctgccttttctgaactgaaacggaggtgtgcatggggtgtggggagaggaaagatggagaggatataatataatatattctctatatgcgaaatacacacataatatagaatagaatataaaataatatatgctgagaagagtacatattttttttaaaaagaagtaacaggttttgtttttgttttattgtttgtttgtttttgtttgtttttcgagacagggtttctctgtgtagccttggccgtcctgagactcactctgtagcccaggctggcctcgaactcagaaatctgcctgcctctgtctcccaagtgctgggattaaaggcgtgtgccaccacgcccatcttgtaacaggttttttttgttgttgttgttgtttttttgtaacaggttttataagtaattttgtcttgaatgtttgattatatattgtaataaagctactaccatccaaatcatgacatttgttgtagtatatcaaagagacatggaaatacgttatacttaatcaaaacaattgaactacatgaggaaaatagaagaaatgtttgactaacgcgattccacgtctgtcaacttgttttaaacagtttctggaaaagttaattttat

SEQ ID NO: 4169 - DNA, 1000 bp, mus musculus
gttatatgttatatatctttttgggtatatgcccaggagtagtatatctgggtcctcaagtagtactatgtccaattttctgaggaactgccagactgatttccagagtggttgtaccagcttgtagtcccaccaataatgaaggagtgttcctctttctccacatcctgaaccatcatgaactacaggtccagaaacatgcagtcccaggatatttgtaagaggcctgccaccaagtttaccctcttcctgttactgtcacaataggaacatccagggacaaaaaccagccttaagtctaaagggcctcaaagaacacaatcaacaaaagcctgggcaatatgacacctttagatcacagctgccctactacaacaagccctggatatcttaacacaactgaaacacaagaaaatgaccttacatacactcctataaagatgatagaggcctttaaagatgaaatgaataaatcccttaaataaatgcagaaaatccaatcaaacagatacagagctttaaagaggaaacacctattgaagctggaagcccaagcataggagaatgctagggtgatgagtgggtgggtgggtggaggagcacccttatagaagctgaggcaggaggaggggatagggggtttgcagagggaaaacaaggaagtgggataacatttgaaatataaataaataaaacaaccaataaaaaataaaggaaacaaataattccctaaaagacatagaggaaaacacaattaaacgtgtgaagggaataagttacaactgtggaaggcctggaagtggaaatagaagcaataaagaaaacatcacctgaggaagttctggagatggaaaacccatggaagagaacagggataacagctacaacacaacagaatgcaggagatggaagagagaatctcaggcagagaagatacagtagaagaaagaaattgatagatcagtcaaagaaaatgttaaacctaaaaacttcctgacac

SEQ ID NO: 4170 - DNA, 1200 bp, mus musculus
aaggaaacattcatacacatttatgggaaaggaaagtatgctttgataccagaagagcaatgttattattaggaatttctactgtataaaatactaacatggtagtagtcccttctttgtttatagaacttataagtgggatatatatatattgttctacattgtgaggaaaacaataaaatgttggtgggataagtaggcagtctcataaactttcccaagcatcatacaacatagtgaaacaggaaatattaatgtacttggtgtgattgtgagctagatactttaaagaccatatattactaaaaaaagcaacattacttccccccaccccccgccaccaacctgaagctctttcatgaaaacagcagcagaagcatcatctatatctgacatctgtgcacacacacaccagtgtcaggcacgccagccataagagaataaaaataggctggaggtctggatgcatcatctggtacctgttatcggtcagcaaagagcctgtgctaagtggctccacagattgcaccaggcaagaagctctccccaggaggaaaagccaaggcaatattgctccaaaggggctgtagaattgtggctgtggtctcagaaagtgactctgatgataccgatgacaattaggagagagggtttagaatgtgaatggggagcaattcagctgctacactctctgtgagcagactgttgcctcaggcaaaaggaccctgctgtcctttgttcaaactgctaggactggtggaaggtaaacccagaaagggggatttgtataattcatcttaacttaaaagttcaagttaaaaactttgaatgaatttagatacccatttcttgagtgcaggactgatgctttaggcccatctcaccaggatagttttaaatttaaagaaaatgcttgaagagaaaaagtttgtatctgcttaggggaagccatcagtcagaggaagtactgaactacattctttcaccactgtgccttgggagtaatgtcccacactgagtggtctcttgtgctgctgcggttatcactgcagtggttggacagttgtgttttacggtctctgcatgtagcattcagctttatagttcagcataagctaatcaatatatcgagatcaacaattttaaaattaagtatttccatgaaattcaccattctacatattaaacaaagtaattcat

SEQ ID NO: 4171 - DNA, 1000 bp, mus musculus
ttaccaaacaatgaccaatgcttgcctctgaaccatcactccaagaagaatgcctctcatgagctgaaaggtagaggcgcacctgcggcagaaaccttaaatgaaaaataaagaccactgtgttgtagggtgcctttccctcttgaaaataaaattctttggagcatagaagacaaacaacgacgaaagtgaaagggcagcggtgcagattggataggcttacagcataattgaattaaggcttctgcgccacatatgaccacaaagcgggcctatggctccggctgctgaatggaggtggccggtctgtcaataaagaccctttaaactggttaaatgcatccgaagcgagtgcagagagctttctagctaacaggtggctgagtaaccctcagctggtgccacccaggcctgtcacactggcctcctttaggataatttcacccccctttaaaaaaaaattgttactgtacttgctgtggtggaaacaatttagggatgaataatttcttttggtccctagcggcactggtggctccctctccaccaccctctcctcctcccccttccccgtttttttttttcttgtactctctcgctccccctctctttctctgtcttgctactgaattaacataaaggaacagtgacaacagcaagctgaaaagcatggctggtgggaggattaagtatatcattgaaaggaattacgttgtgaatggcgaggagggatgggcgcttctgttccttggtcccatctggtccttaaagaataccttgttgtaattacccccagatggtttgtggtgcactggggtctggactgccaggtgccactatgccctgctgggtgtgatattcattgctacatgcagcgacaaaaatggactttattgaaacctagtttcttccagggtattacacaaatatgaaatgaacctatctcatcgagagggagctttgtttcctaagcgaaacagtctcacctaagacgaggctg

SEQ ID NO: 4172 - DNA, 1000 bp, mus musculus
gaagaggttgccccacttctgtacaatcctgccctgggacatccagtcacagcaggactaagcatgtccttttctacactgcacactggcccaaccaggcagtccagttagagggaggagatccaaaggcaggcaacagaatcagagattgcccccactcctaattattaggggacccacatgaagaataaactgcatgtttgctacaaatgtatagggggccagggtgcagcccctgaatgctctttggttggtgattcagtctttgtaagccccttatgggaacagagaagttgactctgtaggtcttcttgtgatgttcttgactactctggctctgtcaactctatccctcactcttccacaagactcccagtgctccatcagatgtttggctgtgagtctctacatccatctccatccactgctgcatgaagcctttcagaagacagttactctaggctcctgtctataaacgtagcagtgtatcattaatattatcaggggttggctctcttatttgggatgggtctcaagggagtcattcattggttggcttttccttcaatctctgctctatttttatcaccacacatattgtaggcaggattaattttgagttgaaggtcttgtgggtgggttaatgcccccctccttcctctggaagtcccacctggctataggaggtagacatttcaatctctacatccctcactactagaagtctcagctagggtcaccctcatagactgctggaaacctccccagtatcagatctccagctaatcccagagatgccccccaccaattccagttcttactcccagttccccctggcccctgttcccctagaccttataaccactcctgtctctcctacctctcctatcaggtttcctcttttcatccacctccaaagactatttcacttccccttctgagtgagattcctgaatcttctcaagagacctccttattacttagttttctgaagtctgtg

SEQ ID NO: 4173 - DNA, 1000 bp, mus musculus
aaaccaaaccccccccaaaatgttttcaactattaagattttaaaatagactgtatacaagggtgtttggataggtatgcactatggaactgggtgagaaaacagagggaagcaagaggcagtaagaaaggggaaactggggaggtaaccaaagtcacatgtgacatcaaagtggagagtctactagactgggatagcgcaaaggagactacaccaggagaaaaaccgggggaagaggaacaactgaagcaaatgctgctataacaactccacagtgagacccagttcttcatgtgctgataaacattattactaaagaaatgggtagtaacaaatattaggaaagagtcttaaggttccaaattttgaccactgtcactgggatatagagctacatctacccaaagagagctagagctttttctgcatgagttaataacttacttctcttggactcgtaactacatggaatcctcacagggtttatagatagaagaattagcccaggcagattgagggaggctagcttataaaaccttcagggagcaaagctgccaagagaaagactttgtgccttctgagctacttaagttgtcctctaggcaagaaatatcaagctctgtgatcacgttactacctcagcccaggaataatgtgataaaatagaaagatgtattcaatgatcaattaacaaagtagaaattactcataggccaaacagcatacataaggtcccagcagatcccacataaaagcttgccagcaatattctcattaccaaccagcatgtcagggctcttagggtcagctcattcaaacatggcaggtaggatgtgggtacagactaaatgcccatctgggtacccctttaatttaccaacaaatggttaagaacatatgagaatatgcccttaaagtatttaccacattttcaattcttgccttgcaagttataaagtcctagtctactgattctcctgagaaactgttaccacaatag

SEQ ID NO: 4174 - DNA, 1600 bp, mus musculus
aaagagtgaatatcaatatctctcaaattattccacaatatagaaacagaagaaacattacccaatccattttataattactctgatacacaaaccacacaaagactcaacaaagaaagagaattatagaacagttttacttctgcacatagatataaaaattctcaaaagcaaacaaaaatatttatgaaccaaatcgaagaatacatcaaaaacgttatccaccatgattgactaggcctcatctcagacatgaagagatgcttttaatatactttaatagataaatatgattcactgtataagcaagctgaaagataaaacaattatatgatcatctcattagatgcactaaaggccttggacaaaatctaatgtctcttcataataaaagtactgcgagattagtgatacatgggatagatctcaacataataaagacagtttacaacaaaaacatagccaacattaactaaaatataaagaaactcaaatcaattccactaaaatcaggagtgttgcgggccggccaacgggtcacatggacggggtacacctgagtggcaggccagagctgaaagaagaggagaaactaggtggttgagagaaaaatggagccaagataaggttcctgataaaggctcaaatgtttaatggcaaatgtgcttataaagggtggagggaggcccattcctgtcaattcattcttgaagcccagctgcaggtgatgatgtccaggataggatgtagtctcctgaatagcttggtggcctcccagcaggtagcagtatcttgaagaggaacagagacagtggctgaacaatagagtgatctaggaaggctccaccctaggtaatctccttagtggcagaaaggtcaaggtctggcttgcctgcttcaggctgggggaaggttacacaggagcaagacaagattgttcactctcgccatgcttactcaatatagtacttgaaggcttagataagacagtgaaaggaaatcatagagatacaaactggacataaagaagtcaaagtatcattttatacagatgaaatgacagtataaattttcaccaggaaaatcccacagctgattaatgctttcagcaaagtagatggatgcaaaattaactaacaacattcagtagggttcatatatacaaatgacaaatggactgagagagaaatcacagaaacaacagctttcacaatagcctcaaataatataaactatcttgggctcactctaatcaagcaagtgaaagtcttatatgataaaaatttaatatgtgaagaaagagcttgaaaaagttgtcagtagatggaataacctccaatggttgtgtgggtcagtggattaacacaataaaaatggccatcctcccaaaagcaatctagttattcaatgcaatcactatcaaaattccaatacagttcttcacaaatcttgaaaggatgatttttatcttcatatggaaagacaacaaacccaggatagctaaggcaataataataataataataataataataataataataataatgctagaagtatcaacatccctgacatcaagttgtaccacagagataaaaat

SEQ ID NO: 4175 - DNA, 1200 bp, mus musculus
aggacgaattttattttgtccaggaaaaaaggggcatgtcaagaagtcttaaaaatataaccatgttcttgactctggctgcataagactggatcactttatctagaacatctctatgaggatgggtagtggaacaaaaatatgaacaagaattcagaatcttgggtcatgcttaaaaggcagagacttttgctatatggagccttaaccacattcataccggttcctgtgtgtcctgtgggacagcctgaatcatcacaatgccaaatagtgcaaactactgcttgtgttccatatttgtcagatatgagctgctctggagtcctttttatcccttctaggagagaaactaacccgtcatatgaggattactgtggcttgattcatgcttggcagatctcctgacttgataacatgacgtgttgtatcagatgcgcaaggcttagcttttcagttaaggggaagcgattcacaactgagctgtttgcttccagacttgtcagacacggtgagccactcaagtagacagcttccagcagaatcctgcaagcagctgggcccaagctgtggcgtgatgggcacaggcaagtagcacctgtgattccagggaacccagcttactgctgcaggtaaattcttacagcactgtaattatgatcaatagcaacttagaaaagagtttagttaattatttgatcctctaacccttgaaagcacaggatatcagggaggtttccttgcttcatttcagtcccagaatagcaaaaactgttacctcaacatgtcactgttactatatttagaaaaataagagtttgggggcaggggtgttgtttgtttttgtttttcagacatggtttcactgtggagtcctggatgtcctagaactccctcagtagcccaggctggccttgaactcacctgtgtctgcctcctgactgctgggattaaaggcaccaccactgccctgaaaattaagttatttttaaataagcacatttttttgtcaaaaaaaaaaatgaagataccagacagtatacattgtacatgaaccaatgcatttagtccaataatgtgcaagttacaggcagaggtttatgaaacataaattaaagtttcatgtagacctattttacttttgaaaacatcacccaaaatgcagagaccttttaaaagaagaattctgtttgctgatatgtg

SEQ ID NO: 4176 - DNA, 1000 bp, mus musculus
agagagagcgagctctgtagttaacctgaaatgcactcttcacgcagaggagccagctttttcctcacccacctggcagctcatgatcacctatacgctcagtgggagggagctgatgctattctgttctacacagacttctgcatgcatgtgatccacacatactcacaaaggcacacatgcatgcaaacacattcttaaaaaaatatctagagaagatgcaatgaagagataatgggaaaatattggttttttttttataattttatttttctaaggaatggggtctagacagagtattttacacatgctcagaagtgtccacccactgatgtatatcctggtcttctcttattttgagacactatttcactgcctccaaggatttgcctaggcagtccttgaatttgcaatcctcctgcttcagcctcatgaataaactacactgatcataggccctgaatcatctggcctataatcatcatatttagaggaaatagttatttgtgtaggagatgcccttgaatgaattcatttccttacttaagaaaaaaaaaatcgctgcgccgccgccatggccgacgtggaggacggcgaggaaccctgcgtcctttcttcgcactccgggagcgcaggctccaagtcgggaggcgacaagatgttctctctcaagaagtgtaacgcggtagccatgtggagctgggacgttgagtgcgatacctgtgccatctgcagggtccaggtgatggatgcctgccttcgatgtcaagctgaaaacaagcaagaggactgtgtcctggtctggggagagtgtaaccattccttccacaactgctgcatgtccctgtgggtgaaacagaacaatcgctgccctctgtgccagcaggactgggtagtccaaagaatcggcaaatgagaggtggcccaggcgttcctggtgtggttgctgaccctggacaaccttgccatcaagttactggacaaagactcaacactgcag

SEQ ID NO: 4177 - DNA, 1400 bp, mus musculus
agtgtacagttgtaggtaggtacaaccatcaacttgtcaaggtacagtcaagtctaggctgcacagatcacttttggtttactgtcgtttattacatagtcctaatagaattctgttacagttttatgaattataatataatggccttctttgtgtacacagtgggattaaatcatgattatcagtcactgaatcaggtagtgatgactgagggcagatacaaggctggtaaagagaactgagaaagaaatgagaggattgaacaaggaagacatgcagagtagaagccaaatagtgacttcagtaaatgcagtttactgattagacactgtgatccaggtatctgtctacatctatggaccatgaaacagctagtactcagatgaccagataatatcaatatcggtttaactatccaaaacataataggacaatatacacagcatatctttctggttaagaagggatccagctcaaggggaggccccaagtcctgacactattactgatactatgctgtgttttcagacaaggccctgtcatggttgccctccaaaaggcccaacaagcagctgacagagtcagctgcagatatttccacccaaccaatggacagaagctgctgaaccctgtggtcgaattagggaaaagctggaagaagctgaggcggagggtgaccctgtaggaggaccagcagtctcaactaacctggaccctcaggatctttcagacactgagacaccagccagggagcatacttcagctcacatgaggcccccaacacatacagcagaagactgccatgtctgggttcattcatagaagatgcacataaccttcaagagacttgagaccccatagactgaggaggtctggtggggtggaggtgggggtgtggggataccctcttggagatggtgggaggtggtatgtggtgaggaacagttagagggtgaactgagagggggataaagtctggattgtgaaaaaaaataaagaataataataaaaaagaataacagtcctaaataaacttatatggacactagtagtgggaaaaaaccacagtggaaaagtgacaaggttaaacactactaatgtatttttcatttatttttcattctattgacaagcctataatttaattattatgaattttcttgtgtgtttctaggcatcataaatatgtgcataactatgaagaattccttgctctttagaaagcccttgtcattttattagacagatgtggacacatgtgacttatgtcacagatgttattataccatgtgggaaagacataaagggacaacgtgatgaagctcacatgtaaggaatatgaaaatgttctagcttgtgtatgctggcagaagatattcagctagccctgttttcttttt

SEQ ID NO: 4178 - DNA, 1000 bp, mus musculus
ccacttggttcttgatctgtcagtgaagaaagccatggaccaattgctgggcagaaggtaaaggtggatttttcaggttccaggaggaaaaggagattcaggggaagggaacggagttcaccctgctttggaaaaaggagaactgagcagctgtgtgagatctcaaaatggagtggccacgaaggatgctcctacaggtgggtggtcaggggagtttagcaactgaaatttagagcaggtagggagacagagataagaaattggcaaaagcatgctttttcaggtgggagagagtagtgccctgcaattgtgtcctaaggcaagttaaaaaggaacaactgtgtgtctgtgcctttttatctgagtactcaaaggaagctgggagggggctggtagcacggtcacctcccagagtgggtggagcattaaaaccacaggcaacactacttggacttaaagcatgtttgaaataatactgaaagagaaggatcactactctgaaggttggacatctcaattctcattcattagtctatcactacagatgctgttaccttaattagaaaatcccctaaacatttctggtctttcatttctgatccagataacaaggatttgaatcacaatattgttgtatggttatgctcaatcaataacccaagcttgctgtcttctacatcttgctaattgatttttttcttttttgtgatttatttttactttatacattagtgttttatgtgcatacatgtaaatgtgtagcatgaatacccagtgcctggtatcataggcagccagaaaaatgccctgaattcatggaactggaattacagacagctgtaagccaccagcgggctactggaaatctattctggatcttctgcatgggcagcaaatgagagtaattgtgccatctttccagtttcttatttttctttgtttttgaaattcaacatcagtcctattttaatgtgggacttttttttttttttttgcttcc

SEQ ID NO: 4179 - DNA, 1200 bp, mus musculus
gtcccaaggctaacatcccaaggctgttgtcaagaacacaggttgccctccttcaattgaaagcaaggactcattacttcagaaaacatggacacaacacacaggtgaagaaagacacaggtgaagggaaatcttcacagtgggcagaacttcgggcagtacacatggtattacagtttgtttgtaagaagaaatggccagatgtacgattattcactgactcatgggctgtagccaatggattggctggatggtcagggacttggaaagatcacaattggaaaattggtgagaaagacatctggggaagaagtatgtggatagatctctccaaatgggcaaaggatgtgaagatatttgtgtcccatgtaaatgctcaccaaaaggtgacttcagccgaggaggagttcaataatcatggagacgttgaacgggtgtctacagagagccttcacaccttgatattagcatctttgttacaggaaggtactctgcaaactaacaaaggataaaaataaacaccaacttagccacacaaatgctttgatttacaatggtatcctgcttgcacaatatactagggcaatggtggcacaaaactaatatgaataaacaaaaggctcactccacaagatgaagctcatgaccaacactccaacactgcttgggtgaccaagaacctgagagtagagagcccatactcttaggataaagccaaattctactcttagaaacatggtagcaataaatgactcctaaggacattctgctctgctcctgctcaggcatcatcagagacacttcctcctgcagcagatgggcgtaaatagagacccagagtcagacaataggctgggagtgagagatctaggaagactctgacctaaacagcgtgcctttatcatatcatcctttccctcagtgctcagtgaagcctgcagaataaagagtgtaagagccacagggatggaggacaccaatggaataagtcaatgggatagatgtacacatgaattcacaaagtctgtggcaacatggacagtacctacatgggtctcatcagatggactaaaagaagtagatccgtccctgcgtccataaccctggagcaatctgcaattgataaccacttacaaacaaaattttaatttcagcaaagagagtttgactggggatgtagggtgagtaaaaggccaacgg

SEQ ID NO: 4180 - DNA, 1000 bp, mus musculus
aagtgctgtgaaaagaagagacacaaagggcacaatgaaaaaagaaacagaaaccttaagtgttggaagtttctttccaggtcctcaaaaactggaaaccgtcagcatacatgacgtgggggattcaggtaaactgatggcttttatctagcctacaatttctggtttcctatagtgaagcctattttggacaagtgtctaatgttcaccaaacttatctttccttttctgagtgtctggacctcattaggtctcataatttactttgtaatctgtgagttgagcaaattgtctcattcacacaagatttctcaaaacatacctccttggttgaatattctgcttgcatgctgttttccagatatgctggaggatgggttgtaaccaaaactcttgagatctagacaggcagaggacatgtctttgtgctctcacgatctcctaacatcaattaccaagctggagggaaacagctgtagatgttcagagtgtctgggctctccagcagtccatgatagacagttggttcctccagaagacattgagctcagagctatcaaactccaggactttcattggtgaggtttgtctctatgtacttcactgactgaactcaacctcttgatcctagaacaattcatcttgacaatggccagccctcctactccccacactacttctcaggattatcttacaccctgggggctgcagcttgtcctctcagagcccagtgaatagctcagtattaaacattgggttctcaagttagtgcggaaactgctctccgcgcgtttcctcttcatttttgaccagcctgctggagaaatcactgagggctatgggcttgtgctggggacctaatggataagacagtaagatccagttcaaaaggaccatatggttgcctctgagcttggacttccatcctctctcttcctgcccggaaggaagctcctgcagctgaatctgtgctgggcttgactcacttctttcaagtgca

SEQ ID NO: 4181 - DNA, 1000 bp, mus musculus
ctgaagtgtctctagtgcccgttgcattgtggcttctttgatctggtgagtaaggcgaggagcggcgctgtggcggcgctgttttgttgacttaacggcagctattttgaggacgcagagttagttctcagttgacttttcacaggtggaccttctgtgactcacttctacagagacagcccgatgcagaagacttttcctatcctgagcttgtgaaggtggtgtggtataagggtgttacatacaggtaaagccccttcccttcttgaatcaggagttttgttagtttacaattaatttattttatgtatacaagtacactgtagctgtcttcagatgtaccataagagggcatcggaccccattacaggtggtcgtgagccaccatgtggttcctgggagttaaactcaggacctctggaagagcagtcggtgcttttaaccgctgagccatctctccagccctgtttgtttatttcttaactcacagtgggaatgagactatacttgcaaaccgattcttataaacagttttgctgggtcaactgggctgctgtgttttatctttacttttacaggtcacaaactaattttattagtatgcatagaggtcttaggactcatgttagccaagtttacaagactgcgtgacagctaccaagccactgagattcggacttgctactgaatggaatataccagaggcttagggtatccgctgtacctgagaaggtctagttgtgttacctagtgagcatggaatcagcctaagggtgattcagtcaaaggaagtcattcctttcctggctgctctaggccagcactactccactgaattctcccttccctataacagagtaactctctagtgacgggacacagtgttggccagatgcggtcttctttccatgactaatgctaaaaagcatacctggtgggttttgggtgcccgaggctttcctgtcttgtatgaagacccatgcgctcggacagtgttttt

SEQ ID NO: 4182 - DNA, 1200 bp, mus musculus
tagtagactgagctaccttgctgttgcagggtaactgtggggaagagcatgtttggctactgccaagtaactgtggggatgaagtctggacagcctatgtgactgatggccacagaatgatagagttgagagcttgtggtgtcaggcatttgtgtctggggttgtagctcactgttccatcccttgtagaattttctactgggtctccggagtaagccttgctccaccagaacacagattgcctttcacagtcccacacatgaggtcccttctacaatttgggactgagtgttccaaggcctctcactttgcattagggtcccagtgtgtcttgtgatcaacttcagaaggaagctttttgatgatggttgagaaggcactgatctatgagtataacagaacgttgggagtcattttattactgtttctttagtagaacagtagtatttagctttaccataggtctctgaactatctagtctcaagttcttggtcatccaagcagtgttgaatatgggttctatctcagggagtgaatcttaagtcaactcagatatctgttggttacttccacagtatttgtgtcaccatactacatgcatatcttgcagatcagacactattgtaaatcaaagttttgtagtttgtttagtgattatttttccctcagaaacatgcagcgttttctaacagctactagatgcctagaagtcaaggaataccagctttggctttgtcacatttcacactgcactttcccccttctggagcattcattgtctcaatgctagtggtgtgggattagaacagtcaaactctctgtgttttgcctctccagctgacatgtacagagaggttggggaagggaggtggagggacttggaccaacaatacggatctaaacaggatactcaacaacaaaatctcacttaaagaaatgcaatttaggagagccggccaccgtccggaccagaggacaggtgtccgcctggcttgggagacggcctcagcctcagcagcagcggtcgccatctgggttccgggactccgcggaacttaggaaattagtctgaacaggtgagagggtgcgccagagaaccggacagcttctgggacaggcggaagcacagagccgctgaggcagtaccctttgcaggctgcagacagccggccaccatccggaccagaggacaggtgtcc

SEQ ID NO: 4183 - DNA, 1400 bp, mus musculus
aattaaatgcttttctttataaaagttgccatggccatggtatatcttcaaagcaataaaacattgactaagacaaaagataaatatataattatggagagacggttaggggtggggagactggagtgggagattaaatgggaacatgaaagaggaataaagaaaggaatgtggctcagctattgaaaacaatgaattcatgaaattcttttgtttgtttgtttggttggtttttagtttttagtttttttttttccgagacagggtttctctgtgtagccctggctgtcctggaactcactctgtagaccaggctggcctcgaactcagaaatccacctgcctctgcctcccaagtgctgggattgaaattcttaggcaaatggatggaactagaaaatattatcctgagtgaggtagcccaatcacaaaagaacacacatggtatgcactcactgataagtggatattagcccagaagttcagaatacccaagatacaattcacagaccacatgaagctcaagaagaaggaagaccaaagtatagatactttggtcattcttagaagagggattaaaacaaccatgaaaggagaaacaaagtgtggaacagaaactgaaggaaaggacattgagagactgtcatacctggggatccatcccatatacagttaccaaacccaaacactattgtggatgccaacaagtgcttgctgagccttatatagctgtctcttgagaggctctgccagtgcctgacaaatacagaagtggatgctcacagccatccattggactgagcacagggtccccaatggaggagctagagaaaggacccaaggagctgaaggggtttgcagccccataggaggaacaacaatatgaaccaaccagtatccccagagctcccagggactaaaccacaaaccaaagagtatacatggagagacccatggctccagccacatatgtagcagaggatggccttgtgggacatcagtgagaggagaggcccttggtcttgtgaagcctccctgccccagtgtaggggaatgccaggatagggaagcaggagtggacaggttagtgagcagggggagggggagaggggaggggggttttggaggggaaaggagaaaaggggataacatttgaaaggcaaataatgaaaatatctaactttttttaaaagggggaatgtggcagggaggggggaacaactgacactaatggtcatttgagagcctgtgtagaaaactgctcctgaagaaacttcctaaaatatatacatatatgaatggaatctaagtggactcacaaaataatgggagaaacaaagccccaactagacctctgatgccagtgaagtgaaaattctagtcccaggaatggacttcgtt

SEQ ID NO: 4184 - DNA, 1200 bp, mus musculus
ctttaaacttgttttggatattagaataaactttaataaaaattataattagcagaacttttgacacatccagctagatagatgatcaattttgttaattgcagaggccagactcaaacaattgtgaggtgcatgattccagacagaatatattccaaaaagccaaatgatagaatatccacatatacacagttggtaaaggttagatgtaggggattgaccaggaaaaggcagccgagggaagatcttaagaggggatgtttaagaggtagagaaagccctgaagaagtgatgtccggagtcaatgtgtgttgtctacatagaaatggaaatgtcaaagatgccagattctctgacccaggaaggaataccaaagccttctccctgggggataggctgagaaggaaagggcagaaccttctcacttctggtgtgtgtgttaatgttaacagcatgggcagaaaatattcaccattgctattttcccagatagttacagcatgacgattgcttccctgcatgcattgcttacgaagattagctaaacctgttgccttgattgagctgtaaccaataagtcttaccttcttgcttatctctgtgtaataaacctgccaatgtacagttggataactgtacaataatctcactttctattcaaccctgcataacaaaccactgagctatcctccagggtgctgaggcttatcatgtggagagctcagacaacctggtcccagatttttgtctgtgtttatgtctatatttgtcttcattttcttgccaccctagtcacatccaagtctctgaaagccatgatgatgtggtaggaatgaaactcttctgcatcctgactttagctatagttataaagatcaatcatctttcagaataaacacaaaaaggtacatttacaagtgaatttttaaaaaatattttaatgagtatgtcataaagacaataaaagttgtattttcctacaaatatcaatactttatgaaaagattctcaaagctaaaccaaaatataagctactcaaaatttaagtgccaaacttgaaaaattgaagaaatctttttctccactctcttcttttcctctcattatgtttccatgcatatatttgtgtgtaaggaggtaaatatattagaacaagtaagctgtcagaaaagttaaaagtcaggaaaaattattgtaaac

SEQ ID NO: 4185 - DNA, 1000 bp, mus musculus
ccgctctaaaagaaataatgctgtgttatgccgtggggtgcgaggctaagcactgcacagaggatagcttgctgttggcatcctgtggaaggcacgtctgattgcatgaaggttcagtgtcctagttcccttcccccaggaaaaacgacacgggagctggccaagacctctctgggtgatgagcctaagggatggttttgtgtagggcccctatgcttgcacactggggatcagacctctaccttcacccatgaggcttgcttgcagcaattaagatctggccataagttaattaacatcctggccttttgatgcacctgccgcaagcaaaacaatctccccaggagtggcttggcatgattgagaggtagtcagtgataagactccctgggcatgtcaccaacctaagacagggatcaaaccaatgctgtttgtcacccaaggacgggtaaggggcatggctgcggggggctatctacagacattctctctgccaaaaaagaaaaaagggggaattgtggggagcaggtgtggcggcagtcccaaaggcgccagggactgcagctaagtcatatgacttgcacctgacttcctcatataagacacaaacatcttgagtgctgcccaggtgtaccaggatacaggtgaatccaatttggtggagatttgcccctgctgccctgattagctgaagcctcatgactggcgagggggcgtggcctgcggtgcgtggatgagagagagtataaaaggagtgagaggcccagggttcgggggagatataaacaagaagaatcaggactgaataaactgctgttagaaggactggtggtcatgtcgttcttgctggtcaagagtggacgcgacaccataggtgtgtgggttcatttctggatcttcatttctattccattgatctacctgtctgtcattgtaccagtaccttgcaggcatcacagttgctctgtagtacagcttgaggtcagggattgtaattcca

SEQ ID NO: 4186 - DNA, 1000 bp, mus musculus
tggcatgatctctgaaataatggagccactagttcgtttctagctaggatcccattgataggattgggataccagtacagccacaaaacaacaaaacctgcaacacacaaacatgttccttcctgcaagattcaaaggaagagtgatgtctcagagcttgtgggaatgggcaaccaatgactggccaacttcaggaccaaggcatgggagggattctagacccaacactgcctggatatccagggacagcaagctggaaagctcaaagacgtatggtaaaacaaacaggagtgacaaaaaaaaaaaagccaataacatgattcctaaggaaattctgcttcattcatagatctatgcctatctgtatcatcatcatgagacttcctccagcaactgatgcaaacagatagagtcctacagccaaacataaggcagagctcaggcaactcttgtccagaagagagggaggaatgagtgtaggagccaggctgttcaagggtatccagagaacatgccacagagtgagtggaaatcacaaagcaaatatggctctgagcagggtcctctgcatgcatgctgtggttatttagcttgggttgtttcttgggctcttaaaagggggcatagagcagaggatggcctagacaagccatcaatgggaggagatgtacttggtcttgcaaagattatatgccccagtacagaggaatgccagggccaggaacctggagtggatgggttggggagcagggttgggggagagtataggggacttggggagagaggaaactagggaagtggatagcatttgaaatgtaaatgaagaaaatatctagtaaaaacaaattacaaaaaaaagtaggcatgggcagtggtggcgcgcgcctttagtcccagtgcttcagaggcaaggcagaggcaggcagatttctgagtctgaggtcagcctggtctacaaagtgagttccaagacagcgaggaatacacagagaaaagcggt

SEQ ID NO: 4187 - DNA, 1000 bp, mus musculus
tctcccagagcattccctctgcccacagccctctcacaggtccacgcctgagccttaccttggtccccatctgttcagaggtggacactttatggatcagcttctggggcccctcatgctccaattcactgtaggatgaatcctctccaggtcctgcagcagtggggcaaaccacactggcctcagggacagctcctcctgcgaagccctgagggtggtgctggctgcaggcccaggcatcctctctgattcctgcagggacacagcagtgccccaggggctgtggtcagctgctgggctctgcccaaaagtctgagccctgcccctagatagcaccatcttccgtgatcccctctgcgcagcaccctggacccgggaccctggatcacaagcctcccctgcctagacctcttgggtcctctgtgcacttcacgcctgggcacccagccttgggatgttctggtattgctgacccaggatatgaccagcaccagaatgagatgacagatgttgagataagcctcaaatgatctccctctcactcctcctagggtctggagggctcagagggaatggagagtagagatagtcagggcatgatgcagcaggccaggcagtggagatcctcctccccttgttctaggcagcaggagtgaggagaaggctcctgagggaaagggggacatggagctatctcctatgttctggggtgctctctgaaccccgaatccctccacatacttggaccacaaggtaccattccagctaagtaaaagttccctctgcccggaagaagaactgggtcttacggaatctcaatcagcaccattgctaggaccttacctcccacctctgactgggggttcccgtcctttaggccacctctacagtgctgtttagcttcgggcccacccccatctggcgcattaggtagagaagagcattttctgggaggttcagctctgctctgagagcttttggttcagaaagagtgattccc

SEQ ID NO: 4188 - DNA, 1200 bp, mus musculus
tgccagaataggtgcttggaagcggctcaggggcgcaaagcacagccttgctctgttgaagccaggtactgtcctgggcaattggctccaggctcagctcaggaggcaaccacctggagctacaggcacccgaggcaaggaatgcctgaaggaaaggggccaggtcctgctcacccctcgtgagctacttgtccctgacacccctgatgctcctgttgagcctgggtccttggcgaagcttcctcttttagctgcaccaccaccaggtgcctgtgaccacctggtggctgctttcctttccgcgccatatatggcctggcaggggggggtcacatgcatcccgggccgccggcccggaggggtcgctggggaaggggcagacggcgggagaacaggggagggggtcggaggcagagacaggagaggggtggggtggcggattctggggccatgggaggcagcaaaggctcgaggagctgagcgctcaccaccgcgccatggagctgcactcatgcggctgcggaggtggtggtggaggaagggacccacgcggggggcggggggggggggcgaacgcgtcggaagccagagagcgccgtgtccctgggctctgtcggtcagcgggcgcgggccggcaggatggagccgcagcacgtgcgccccatgcttggatcccagagcccagcctgggaggaaccggtgagtaccgcgcccgtgcccgcgcccacccctcccgcttgtccttgctccccgcctccccctcccggccaggttccgttccggaagcggtccgggatgaggtccccagctgcttcacagcctggacagcgcttcctcccgcgccctggctcctccttgctcgctgccctaagcgcctttgtctggtcggcctctggatccggagaggaccatttccgcgtttcatccttttctcagctttgcactttatttcctagagtggcatggaggccagggaagtggagggggctgggttgcgcggtcagcgggtgcggccacgaggagagggaggttcacctcttgaccacgcgctggcagtcacctgggcacgcaggttcccgaggaccgccgcctgggaaggcccgcggctgccagaagcccagagccacgcctctgactcgggtagcctaggctgccctgaactgttctgagggtcaaggacctgaccagggatccagcccc

SEQ ID NO: 4189 - DNA, 1200 bp, mus musculus
gacatttagaaaatatcactgtctatttttatattcgtagatatttatacacacaaacaatgtgtatatattctgtttaaaaactgatagtaggactattccctaatggccttctgtatatttacttccttctttttagtgatagtaggccattcagatgagctgtgctaaattgctttcagcagttcaaagttgacaaagtgtagacagtttcatttggttgaaataacacggtatgagatcatttaattaatcagtttagtgggaggaaattggtggttttaggacagtacactaatctcaacatttttcggggtggggtagtgtatatgacaacttttaatgtaaagaatagggtgtgtgtgtgtgtgtgtgtgtgtgtgtgtgaggggggggagggagagagacagacacggaggagggtgagggagggagggagagagagagacagaaacagagaaacagagagacagagagacagagaaacacagagacagacagacagacagacagacagacagacagacagacagacagacagagaaaaagaagtgtgctggcactgccccagctcagggctaagactgtgctttgaagggcatgtggtttgacagtgatctcctgtatcttagtgccctcctcacctccatctttttgatgtctttggtccattttgttcatcttcctattgactaggtacatttttttcctcttcactcattctctgtttttcacttgtatcttttctcctgtcagctgagtaggacttcaggtagttacatttaggttgccgtgtgataagcaagataattttgtgtccaacttaattcccgaaaggcaaaaaaaaaaatctgcaggcttgaaagagatgttggcttgaaaaaggcaactgggagcagtaaggtttccattcttgatttgcctctttacccttctgtatgttccctgtgaggtggagtcccctttagacttggtgctgtaggtatttcatatgcatttcgtagatatcaatggtctgaaaggacattgctataaactctgaatgtgaataagtctgtgtgcgccttttgttggcctgtgagtacagtaatctttcattatgcctcaatggctagagattgttgctctactttcaagctggcatggttaatggtcggtcatacggtggtacactcggatgagaactgtctccatgacttt

SEQ ID NO: 4190 - DNA, 1000 bp, mus musculus
tgtcaacagctggagagttctggtcccacgtgctgcctctcagtgtgacaggatttctgcaggtcactgcttttctctgattttgctcattgtactctgaattgtatttatttggcattctaagtgtgtgtgtgtgtgtgtgtgtgtttaccttacaatccagggagtctctggcctttatttggccagaggattggcctgaatcaattttcaggtcatgagagtgatgaggacaaggagcctcccattttagcagcacagcacatgacctctgtgctcaccttgggtgcacgttggaaactcctagtatgtgtttttacaaagcctttcactgtagatattatgtcctttggggatttatgtagcaatagaaccaaggattgacaattccttgtctaaaaacaggagaagggtcatcacaggtttaaggtggacccaggcctgtggcacaggctcctggaaagttcttggagagctcatctattccttcaagtcccctcagggagctaaagcaggtcagctctcttcttttacttccctagctctactggccccaggccaagagtaataattttaataatcaccaagaggaaccagtaccaaggagcaggatgtggcatatgtgggctgaggtagtccacgattcagcttgaactgacatgatccttgtagcctcagttcaagagattatttgctccttgggccatgccatcccacaggatcaactttgaggccttcatgctcgagatgcaacaccaacaggtgatagccaacctgcagaaaatatcccaggacatcagtgaggcttctatgtgatgctccatggccaatatgaattgttgtctgaggctgtcagtggttcagggctcatgatgggaggatggtccttgggaggagtgggaggaaggtgctgcctgggagtcacaattttttgtttgtggctcagcatcaggcactgccacctcctgagtgaatctaaccaccttcagcacaaagtcag

SEQ ID NO: 4191 - DNA, 1000 bp, mus musculus
gggcgctggcatggtacccaccggttccacccaggctgtgctctgggatccaaacccggggcgcagatgctgaggctccatcccgctggcccgcgctcactgaccgactgagcgcagggtcaaggcgctctctggcttccgccacgctctccccgcccctccccctgcgctggtcccttccttcgtcaccacctccgcagccgcacgagtgcagctccttggcgcggtggtgagccctaggctcctcaagcctttgctgcctcccatggcctcagaatccgccccctctctctcctgtctctgcctccgactccctccccttttctcccgccctccgccccttccccagcgacccctccaggcaggcggcccaggatggatgtgacccacttgccaggccatatatggtgctgaaaggaaagcagccaccagttggtcacaggcacctggcatgctgcagctaaaagaggaaccctcaccaaggacccaggcttgacaggagcattgggggatgttgggggcaagtagctctcaaggggcgagcaggacctggcacctttcctttaggcattccttgccccagggtgcctgtagctccaggtggtcgcctcctgagctgagcctggagccaattgcccaggacagtacctggcttcaacagagcaaggctgtgctttgcacccctgggccgctcccaagcacctattctggcagctgagatgactggctgggctggctggggagccctgcttttgttcattttctatggctgaaagaaatcctggaaagaaaaccagctaaggagctggtctgtggtcccctgtgagctctcaactcaaattagggacaggggcagttcagagacacagctcaaatgtcaactgcctctcctgctgctctctgggaaaaagaaaatgaaaattgtaactagcaagtttttcaatcatctttcctgaaatcatctttactggcagtggagacagtttccatctagttgcaa

SEQ ID NO: 4192 - DNA, 1200 bp, mus musculus
cagcgcgcggtcaagaggtgagccccgtcccctccccatgccatccgctgaccgcgcaacccagccccctccacttccctggcctccatgccactctagggaataaagtgcaaagctgagaaaaggatgaagcacggaaacggtcctctcaggacccagaggccgaccggacaaaggcgcttcaggcggcgagcaaggaggagccagggcgcgggaggaagcgctgtcccggctgggaagcagctggggacctcatcccggaccgcttcctgcacggaacctgggccgggagagggaggcggggagcaaggacaagcggaaggggtgggcgcgggcgcggtacccaccagttcctcccaggctgggctctgggctccaagcacatggtgcacatgctgcggctccatcatgccggcccgcgcctggtgaccgacggagcgcagggacacggagttctctggcttccgacatgctcggcccccgcccccccgcccccccgcccccccgcgccggtcccttcctccgccacccgctctgaagcgcatgagtgcagctccagggcgcggtggcgagcgctgggctcctcaagcctttgccgcctcccatggccccagaatccgccaccacacctgtctcctgtctctgccttcgaccccctccccttttctcccgccgtccgccccttccccagcgacccctccaggccggcggcccgggatgcatgtgaccccccctgccaggccatatatggcgcggaaaggaaagcagccaccgggcggtcacaggcacctggcggtggtgcagctaaaagaggaagcttcaccaaggacccagcctcaacaggagcatcggggatgtcaggggcaagtagctcacaaggggtgagcaggacctggcccctttccttcaggcattccttgcctcgggtgcctgtagctccaggtggtcgcctcctgagctgagcctggagccaattgcccaggacagtacctggcttcaacagagcaaggctgtgctttgcgctcctgagcccctcccaagcacctattctggcagcttggatgtctgtctgggctgtctggggagccctgcttttattcattttctatggctgaagattttgtggaaagtaaaccagctaaggagcaggtctgtggttccctgtgagcgctcaactcaaattagggacaggggcagttc

SEQ ID NO: 4193 - DNA, 1000 bp, mus musculus
ggtcctagcaatagtgctgagtgagggtccatgagaccgagttcttctcccgggcagagggaacttttacttagctggagttgtactttgtggtccgagtatgtggagggattcggggtccagagtgcaccccagaacataggagatagctccatgtccccctttccctcaggagccttctcctcactcctgctgcctagaacaaggggaggaggatctccactgcctgacctgctgcttcatgccccttcctatctctactctatttcctctgagccctccagaccctaggaggagtgagagggaggtccttcgaggcgtatctcgacatctgtcatctcattctggtgctggtcatatcctgggtcagcaacaccagaacatcccaaggctgggtgcccaggcgtgaagtgcacagaggacccaagaggtctaggcaggggaggcttgtgatccagggtcccgggtccagggtgctgcgcagaggggatcgcagaagatggtgctagctaggggcagggctcagactttcgggcagagcccagcagctgaccacagcccctggggcactgctgtgtccctgcaggaatcagagaggatgcctgggcctgcagccagcaccaccctcagggcttcgcaggaggagctgtccctgaggctagtgtggtttgccccactgctgcaggacctggagaggattcatcctacagtgaattggaacaggaggggccccagaagctgatccataaagtgtccacctctgaacagatggggaccaaggtaaggctcggccgtggacctgtgagagggctgtgggcagagggaatgctctgggagatccctggaagtggtatccagaagagtggtgcaggggggccgggggggggggcggcctggatggggcgtggcctggcgcagaggactggaaggtgctctagggattcaagaggtgtgttgaagagatatctatggtgtgttctggaacacttgtctagctatc

SEQ ID NO: 4194 - DNA, 1000 bp, mus musculus
agagagagagagagagagagagagacagagacagagaaacacagagacagacagacagacagacaggcaggcagacagacagacaaacagacagacagagaaaaagaagtgtgctggcactgccccagctcagggctaagactgtgctttgaagggcatgtagtttgacagtgatctcctgtatcttagtgccctcctcacctccatctttttgatgtctttggtccattttgttcatcttcctattgactaggtacatttttttcctcttcactcattctctgtttttcacttgtatcttttctcctgtcagctgagtaggacttcaggtagttacatttaggttgctgtgtgataagcaagataattttgtgtccaacttaatttccgaaaggtaaaaaaaaaaaaaaatctgcaggcttgaaagagatgttggcttgaaaaaggcaactgggagcagtaaggtttccattcttgatttgcctctttacccttctgtatgttccctgtgaggtggagtcccctttagactaggtgctgtaggtatttcatatgcatttcgtagatatcaatggtctgaaaggacattgctataaactctgaatgtgaataagtctgtgtgcgccttttgttggcctgtgagtacagtaatctttcattatgcctcaatggctggagattgttgctctactttcaagctggcatggttaatggtcggtcatacggtggtacactcggatgagaactgtctccatgactttcagccattgaattatctcagcctgcctggcagtggtgatgcatgcctttaatcccagcacttgagaggcagaggcaggcagatttctgagttcgaggccagcctggtctacagagtgagctccaggacagccagggctacatagagaatccctgtctcagaaaaaaaccaaaataccaaaaaaaaaaaaaaaaccaaactaacaaagccccaaaaaacaacaaaaaaagaattatctca

SEQ ID NO: 4195 - DNA, 1200 bp, mus musculus
ctatgttcttaaaaatgtgctgttgctagctttagatacactatctatcagaagaacatgagaatgtcaggcaagaagctagcaagtggaaccactctgggatattgtagcatacatcctttctaaactatatacaatgtttctccttgagagttgctgtaaagaggagtcaacacatggacagtttggaatgcattttcttcagatctctgtgcttttcccccaaaatcatttcccttaggaggatgtcaactcttatttaaagtagtgtcttgtagagataacaccttgaggccacactggaatttagaagcaagttatgtgcttaaactggtctgaactgtgtctttatgaacataaaaggatgagaggataggaactcacacacacacacacacacacacacacacacacacacacacactcacagtgggagaggacaagatagagagggacagagagagaaacagggagacagagacagaatctgagagtccctcttctagttaaatgagaagctgtgtgaaaaccaaaacaagcagtagtgcaaaagcaggaaaaagagaaaaagaaacactgttcaaacttccaaccagctgcagagattcggaggccttagaacctcagctcaggtctagggaacatgagcagcagaacaaatgaagatttgggaagaaaaatggatactttgaatggacagaatggttatgtgtctcttctgtcttacatgtgggtcatagctatggagttccagacaaatgtgtttaatatgaagggcctgtaaagtccagaaagcagtaatgggactataaaagggaaggaaaaaaaaaaaagagacagatctcaaggtaagtgggagggcagaatatatgttctatgaaagcagatggggaggagcctgcaagtggaaatttttttcccattacattatgaaattttcttattcattcaagtgggtatacagtgttaacatcatacagtgacattaacatctgcccaatcaggcccccacctctctgtacccgttctccacacagatcttctgattctccctcttttagttccaagccattctttcccttgagcattccacaccttccctgcccactccatccacactggtgccttagcttaaagctagctgtcctgcatattgctctgattttagctgccttgacacctgtacaggcaggtgctgct

SEQ ID NO: 4196 - DNA, 1200 bp, mus musculus
taagttaatggatttcagggaataaatccaaagaccccgactcgcatcttctcacacgcaacactgagccccaaaagtgactcaatctgcgcgtggcgtgtgctgtgaggtccaggcgaaagcgaagttatctggggctggatccctggccaggtccttgaccctcggaacagttcagggcagcctaggccacccgagtcggaggcgtggctctgggcttctggcagccgcgggccttcccaggcggcggtcctcgggaacctgcatgcccaggtgactgtcagcgcgtggtcaagaggtgagcccccgtctcctcctggccgcacccgctgaccgcgcaatccagccccctccacttccctggcctccatgccactctaggaaataaagtgcaaagctgagaaaagaatgaaacgcggaaatggtcctctccggatccagaggccgaccagacaaaggcgcttagggcagcgagcaaggaggagccagggcgctggaggaagcgctgtcccggctgtgaagcagctggggacctcatcccggaccgcttccggaacggaacctggccgggagggggaggcggggagcaaggacaagcgggaggggtgggcgcgggcacgggcgcggtacccaccatttcctcccaggctgggctctgggatccaagcacggggcgcacgtgctgcggctccatcctgccggcccgcgcccgctgaccgacggagcgcagggacacggcgctctctggcttccgacgccttcgccacccccccccccccgccccccgcgccggtcccttcctccaccaccacctccgcagccgcatgagtgcagctccatggcgcggtggcaagcgcttggctcctcgagcctttgctacctcccatggccccagaatccgccaccccacccctctcctgtctctgcctccgaccccctccccttttctcccgccgtctgccccttcctcagcgacccctcccggccggcggcccgggatgcatgtgaccccccctgccaggccatatatggcgcggaaaggaaagcagccaccgggcggtcacaggcacctggcggtggtgcagctaaaagaggaagcttcgccgaggacccaggctcaacaggagcatcggggatgtcaggggcaagtagctcaggaggggtgagcaggacctggcccctttccttcaggcattcctt

SEQ ID NO: 4197 - DNA, 1800 bp, mus musculus
caattaaaagatccagatcaatattgaaaagcataaaaaggtctactcaatgtggcttccctgggaagacagagaaagagctagttttccctcactgacccagagtcccaatgtgaggtttcagtttgagtgaaaggccagagctatgcatatcttagtggttctggtcaagtgtggtcctgcccaccactagctcatcatcattttgtctgagatggtctgagaagctgtatatcttcagtgagaaaagtttccattctggctagttcagagtttaggatttctgtctcttcagtatgagattcccaagggaaattcaaatttcttggaagtccattgtttgaatagtctgatggacacaagagtctctttgggatatcttgattccttccagattagttacattgctgttttagcatctaaatcttgaggtggatggaaaatgtttatgcctgtgacaaatataagcagaatacactcagtgtcaactattggtatgagttttcagtaaccacttaacgttagtgacctgtgaaagtctgacacaagggattccattttgttggtttaagacatggtcttgccaccaagtctaggtaggcctcaaattgaaactctccatctttggcttctcaagtgtaggaattacaggcaaattccaccgtgctcactgtgacctcatctcaatcctgactcctcccatcctgccccatctctcctttgaacaatactttctttttttttttttggttatatttttcatttattatgcattttaattaaaatttaattacaccaaaagaatttagactgaccaattcagagtctgccatttaaaagcataaggaaaaagtaggagaaaacgtgaggctgtctgtggatagtcgaggctgctttagggagcctcctcaccattctgcacttgcaaaccgggccactagaacccggtgaagggagaaaccaaagtgacctgaaacaataggtctcatgaaggccagccacctccatcttgttgtgccggaggtcagttagcagacaagatggtgaacaatattttctaaagaagctgctgatttaccatcttgtggatcattctctattgtatttgctaagatgagtagtcatctaaacacaaagccaggaaaagtttagtgaacattgatggtttggagggcatcatttcagtgaaatggttccaaaaaggctttatatcttagatgacttatgtaatactgtggggcactgggctatgcaaagacagtttggtttccagctgagttgaggtctgaacctcggtgttgtgtctggccagtagatcacaaccagggttctagcctggaaaggcattttggaaacctggaagagaagaggggctaggcggcaagaggaaaaaatgcagctaagacagacattctgatcaaagctcaattttactgttccgcacgcaattataaagcaggggaagggggcccgattcccgccaattaatcttggggtccaatagcagggtgaccacgtgcatggctccgaacaacaaagcggcaggttccagcagtgggcatggcagaacgattgagccggcaagctccacccctgagcaagcaggtttcaggctgggggaggggagactgcatctcctccctgttgttaattaaaaaaaaaaaaaaaaaaggctggcctgaggcaaaaaatttatctatgctcaatagttctgcctgaatttttagggctaaagaaaaaacctgtccccgtgggattccctaacttgtcttatggtaaaccatatctggataagactgt

SEQ ID NO: 4198 - DNA, 1000 bp, mus musculus
aagcttctgaccttcaggctaaactcctccccagttacctagcaacagaaaataaaacggcacactataagaagggctgcttggccccacctcactctcttgctctcttggtcttacttcccttactctctcctctccctctcttcctctctctccctcttactctctagcctttcttctctctctcctttcccccttctctctcatggccggtctctctctctctttccaccttttctcttctacaataaagctttaaaacctacaggcagatcgctgtctctgttcatcaaggcccgctgcgcttactctcacctgggtgggaacctctctccctcagccttctctcccataaccctggggctacagggtgtcagtagggtaaaaagaccatatcattcgcaaccccctaaattttagatcttttacaagtgttacaagtgctctctagggaacagtgctagttattacaaacattatgtccaaatgtttctcacatacaatagaaaaacacttattttgttgggctcacagattaataccaaagtctcaagtagcaagattgtccatatggcagattactgtttgtaagacactaaggccagagttataccacacatgctatgagacttttttacagggagtgggttgggtctctggaggcccataagcatgcatcaaaagcaggtgtcagtagctaagggaactaaagaaaaatgttagcaaggtctaacacagcacaggaaggttccactgttttctgaaaagaacaaagtcatgtgaatgggagtgtgttggatggttttgtgtcaactttatacaacctagcatcattagaggaaggggtcatgactgaaaaaaggcttccttaagatctgcctgtaggacattttttaaattggtgattgatgggagagggcccctgttcatggtgggtggggccatccctggactggtggttttggattctataagaaagcaggctgagccagccatgtga

SEQ ID NO: 4199 - DNA, 1000 bp, mus musculus
cagcatcacgtactttcaaaactctgcccaggaagaagtcctatgtggctaccttctttttcatggccactgtacttttccccagtttcaaacagtgttagatgtgagccgatccctgtgcactgcttgagttaaacagttctgactcccaagtgcaggcatgctcacaattgccttctttttaaaggccagcatccaatatagaatcattgctagtaaatcttaaagtcttaaaattttgggggagctgattggtgatttggggatccatacaagtaggatatgaacattgatgtgttggagttatagaaggcaaaatacagcaagcagtttatacatcagtgttctgaaacaatgaagctagcatacttcatgaaatcattgaaactggttattgaaatgttgacataaaagtattcaactaggtggatacaaggagggaataatactactgtttaagttcaaaaacacgttaatagggaaaacaaagatcattgccatacagttttcaccatcaactgagcagcaagagattgagttttcagaaatctctgagatggtacctatcagagaaatgcagccttggcaatagaatctagttttcctaccattaatttgtctcagtcacaagatgactcataccctcacaatacaaactgattatgaaaaggcttacaagcagagcgggtagatgggcagagtgggtgggaccttccaagaacttcagattatcctgaggaatgtgcagaaacacaaaccccactgggaggagacagacaggtgctctgtctggtaagaggcctcttcctccaaatgtatgatatccaactccccagttcacagaccaaggtgtcatgaattagcccaggttgtccctgttatcactgaacgaaaaaggcacagttcttagcttcagatacacaagcctaaaactgatgtgtagttgttcaaatcaacaaaatagaaaaaaaaaaggaggttaaaaataagaaatggactt

SEQ ID NO: 4200 - DNA, 1000 bp, mus musculus
ttgacacatattaggtgctcaagtgccacatctggccagccgccgaagcctggacatctttggcatacttcagacgtgggggtgaagagtaagctccatcatgcctttccttctcattactctctgacagttaccacgcgtactttcattactgaacacactactctgtaataagaacaggtttgacattccaataaccaccttgttccatctctgagatatgctcgtgatcatttcctttgcaatgcacagacagaacacttttagagctgggaaatggctatcctttcttgccttccctttaccttccctttggatgaatccacagccttggcttggggatttgagtgagactcaattgcaaatgtgcagtgtaactactatggaggccactgctttcctgtgatgcagcctcaaacccaacaggtctcgtagcactgtgatagtagctgaatggcttctggaaggacatggaatggggccagaaactgcttaatttgaggttaattaaatagtgatgacaagccttaatttccaacttgtcatcagactgtaaacactgactgcagctgcagcaatctgcaataagcctgtggaaagagatcttggccagaatgaaatgagtatgaagctgggagtgacatctgagaaatcctaacctctctgtacctggagatttaaaggggagctactggaggatggatacattgaagctgctttctatgcagcaccaccacaaaagaaaaattctgcatcacatgaccaggaggctggaagaaacaagggtagagatgtgaaactgtcaaacggagaacttggaaaaccgtccaatcgctctacctcagttagccacgatggttttgtacaaagaaccaggagtccagtgcatgcgctaaggctctagacacgaagacagataccatgagcggagatcactagagagtagggtagatgccgccgtgtgtggggagctacaaggagttgaacacttcatgtacaa

SEQ ID NO: 4201 - DNA, 1000 bp, mus musculus
tgagctggactctgcagctcacggcttgccttgatggataattaaatgattgggtcaattctgggtcaaagaggaaaagttagtaaatgatggataaatccactttacaagggcttatcttagaatgcgatttaatggaatgatgacaaatctgtaatgggaatgttgctcttcaaaactcttctaattacaagaagcagaaacctactcaaagtagatcaagtaaaaatagggagtgaaggtcaacagaaatgatacagctgctattcagagtctgtgttaccccagacagcacaaaagccaaagcctgcagaacagagcatccaggatgtcttcatgcgtcttctctcatttctgtgtctaagtctgttttcttcttcctctgctctgtctccctttgctttctaatctcagacataatccagcagtgacaaattcagtccacaccccatgacttgtctacttcactgcctgactttaatataacctggccaggcaagtctttggattgctatgtgtgactttaggtagtaccttagtgttgagccccattttggccctggtttggaccgtgatgacaaaccggagcctgacttgagttttgagacctgtctcagtcacttccatatcaggatgactcagcaagacctatttggccctgcctctgccccgccattgctgatgtagagctttgcatggccctgtcagtcactccatacacttcatcacccttctccatctcctacatcatcttatcctgccaaaaatccccctccctatgttctaaacttatataaatgagaggctgatgccataaagttgagttcctgctttgacaagactcccgaccctgtgtgcttcttttaggccgtcaacacttgtcattctgctcagccccagagaaacccaggcaggaacaggacctctctcctctcccccggaactgcctgcaaggagcaggcaccttaggagttacatatgcatgcccaaacagcactta

SEQ ID NO: 4202 - DNA, 1400 bp, mus musculus
atggttcttactaacatttcaagtcctatattgagtacatatggggaaagagggcatccttgacctcatgaaactggaaagcttctgtaaggcaaaggacatagtcaataaaagaaatcaacaacctaaagattggggaaaatctccactaaccctatttgatagagggctaatatccaaaatatacaacaaactcaagaatttaatcagcaaaaaaccaaacagctcaatgaaaaaatggggtatagaattaaaccaagaattcacaactgaggaattttgaatggctgagaagcatctaaagaaatgttcaaagtccttagggatcagagaaatgcaaatcaaacaaccctggggttcgaccttacaccaatcagcatggctaagatcaacacatgacaggttgacaacacatgttggagacctaggaggggaagttgaaaggtcgggtaaagtgggggtaaaagggaaacctggtcatcatgtatgggtgagggaaaaggactgaagccctgagggccaacagaaagaatgtaaacaggcaacctcaggaaataggaggttggggtgatcctccagaatgcaccagagacctgggaggtgagagactcccaggactcaaagggagggacgttagagaaaatacacaacagtaaggagagagaacttatcgagcacacctccagcaggaagacaggacatcaagtgagggatggagttgccatcccacagtcacatctctaacccataattgttcctgtctgaaagaattacagggatggaaatggggaggaacctgaggaaaagaaggtccagtgacagggccaaagtgggatccagctcaaggggtggtcccaaggcctgaaactattactgaggctatggagtgctcacaaaaagggacctatctatcatgactgccctccaaaagacccaacaagcttctgaaagagtcaggtgcagatatttgaacccaaccaatggacaaaagcagctgaccgctattgttgaatgagggaaggctgaaagaagctgaggaagagcgtgatcctgtaggagaaccagcagtctcaattaatccgaacccctgagatctctcaaacactgggccaccaaacagacacatacacaagctgatatgaggcccccaacacacatacagtacaggacttctaggtctgtgttcattcagagatgatgcacctaaccctcaagagactagacgccccaggaagtttggaggtcagaccagtactctaccccccccccttcttttctgtaaactggtctgtctcacagtaattccttcctttagtttttttcatagaatcaggcttaacctgattggtctccatagttgttttaccttagaatttcacaattcccatgtctgacaaaat

SEQ ID NO: 4203 - DNA, 1800 bp, mus musculus
cctagggtttccatctccagatttgcctccatctatgatttctttattgtttcaatttgcatttttacatcttggaccactttgttcaattccttcacctctttgtcttcatttctttaaatgagttatctatattctcattaaaggcctatatcatctacattagaggtaattttaggtcaaaatcttgttctttgggtgttttagggtatttagggcttgctgtggttaagaactgggttctgatagtgcgagattacattgggttctgttacttaggtttttgagcttgccttttgccatttggttatctctgatgttaagtggcctgggtgtctcagactggagcaagcctccttggaggcaggtagagagaactgtgtgacctgggttagatcaggcctcctgtgaggcaggcagtgatgtttctggttagggcaggcctcctatgtccctggttagagcaatcctcttgtgtccctgtgtctctggtgagagcagacctcctgggagacaggctagctttgaggtctgaaggcaggtatatcgatctgtgttcctggttatggcagaccttctgggtgacaggtagcctgtgggatcccaaagggggagtctgatctgcaacaagttaagttggaggatcaaaccaggaggaagattgatgcttggacagtgtagtgactattcctggttgtcaacttgactatatctggaatgatctagtcaagttgttcagtcccacacatctgcttgctgtgtgggactgaacaactgctagatccctggacttccattcacagctgctgctgaccattgttgggagttggattgcagactgtaagtcatcaacaaattcctttactatatagtaaagactatatagactacccataagttctgtgactctagagaaccctgactaatacaggcaaagaaacatagttccacttccgctgggctctgtggggtcccagctgctgtggatactgggttcctgtcctgggagacagaaagactgtgggctttgggctagaggcaggcttgcagttcagaattggaaggctcaccagtgattctaatctggaggctgggagatagaagtttctgacatggatcttggtatggagattttgaggcattgtggctatgaattccagaagatcaagacaatgagatctctgagttcaatgtcatctgggattaaaggtgtggtggcatacacctttaaactgggctacaccttctgctggaggcctacataaggacatttgaagaagagactctctctcttctctccttcatctgcttgctgtgtgggactgaacaactgctagatccttggacttctattcacagctactgctgatcattgttgggagtcagactgcagactgtaagtcatcaacaaaatcctttactatatagtaaagactatatagactacccataatttctgtgactgggagacagaaggactgtgggtttgggttagaggcaggcttgcagttctgccatgagtgatgtttttgatgtgttcttaaatttggttttcaggtaatttactgagtattttttacatccaggctcattagcaaaatttgtttgaaaacatctttctttgttgagccttttatgtagtttaggatcagggtgacattggcctcatagaatcaggttgacagtgttccttcagtattttgtgtattatgttgaggagtattgatatccgctcttctttgaaagtctgatagaattctgtgcaaaaactatctgacactcagctttcttttttggctt

SEQ ID NO: 4204 - DNA, 1000 bp, mus musculus
aagatgttccaatgtggtaactatttgacattttaaaaaacatattaaaaccataatatcatagaccaaaaggaactttttgctgaacctgtgccctgagcagaccttgggctctggctctacagtcagttccacaacacccagaagaagctcgactcacaggtgctctaacacacccaggattgcagttgaggaggtcacaatatctgcccccaacaccaagagtaactgggaccacccaggatccagggatgcatgaactcctgcccagcctgtggtacaagttcctttggtctaaacctgtgcccaaagcagacctggagagctggctctgcacccactcctacaacacccagagggaaccagactcccaggtgctctaaaatgcccaggatcacaggaaaggccaaaatatctgctccaacacccagagtaactgggtctgccaggatcctgggatgcaggaatccccacccagccagtggcatgggctccttccagtctaaacctgcactcagagtagacctgggttgctggctttgcactcattattacaacatccagagggatcctggctcccaggttctctgaaacacccaggatcactggatgatgggatcacagtaacacaggatcacagaggaaacttaactccctggagatcagacacacccaggagcactggagctccaacacactcaagatcatagttgaggctacaccatctttaccaacacccactgtaactggaaatcccacaggttttcacaacctttccagcttgtacctatgcccagagcaaacccaggactctggctctccacccaccactacaacacccagagaataccctggagctctgagacaacagtatctcaggagcttggtcacaccagcatttcaggatccccgaggaagcttgactaccaggagctcttacacacccaggatctcaggatcaaacaatcccagaatcccaggatcacagagaaagctgaac

SEQ ID NO: 4205 - DNA, 1200 bp, mus musculus
catagtcctaacatattaagctcaccttaatctaaaacccaacactaactctattctttgtttttcacaatttctacttcttctcctcctcctatctatatattaattatattatattatattatattatattatattatattatattcattggtgctttgcccttcctatgtatgtctttgtgaatgtcagaattcaaggaactggaattacagataatttcccctggaagagtagccaatgaaccatctgaaccatcattcaagtccccaagatacgggttttttgatggtggtggtgtggtgttttttaagatttatttatttattatatatatggtattttgcctgcatgtgtgcttgcaggccaaagggtgtcatgagaactcattatagatggttataagctaccacgtggtttctgagaattgaaatcaggacctctggaagaacaggcagtgctcttacctctgagccatctctccatcctgcgaagtctattcttaaacctaattctaaacaagttactaatgcaatatcaaccccaagcaaaacattctcttaaccttaatttaaccctagccataactacaaccctagtataatgaccactcccataactaaatataaacacaaacctaaccatagacagctcagtccataacccaaacataagcatgttcttaaacatttcccaaccaagtgacctaaggtaaaccttaacattgatcgcaattttaactctaactttagccatagacagaaacctgactcaaccttaacactaacaaaatcaataacaaaaactttgaacataatatacctaactttatccatagcactaaaccagcttcaaccttaatccaagtcataaacctagccaaattcataatgctaattctaaccctaaatatattctaaccctactcctgatcctatccttaaccccaaaccagcattagagcagctctagcataagcctaacactgacacagttaatcattataaacataaatatgaccccaaacctcttcttaaacctacaacttactttgccataatcattatgctaacccatgtgaacctgattaataactctagcattataggtaagccataattcttacccagtccctagtcataaaactaacactaatcctactcataatattaacactaatcctattttttcctagcacaa

SEQ ID NO: 4206 - DNA, 1200 bp, mus musculus
tttgtgtaaagttcaacagtggcatgattccaaagaaactaaaatacaaagttttaaatgtgtacaatgaagggggaaatgaatcacttattttcctacaaacagaagctcccttcccagtgccagccagcatggctactataccacagtgctaatgtcatcaggctcatctgccttcttttgcctgcttggcagggatttcaagtattcaaggtgtctccgggcatcctcctgattctgcctcacgtagtacaccacataagagatcaccatggtgaaccagccaaacatagtgacgagcatggcatagtcagtagtctttttagggaggttacacaggtcagcgtcattggcagcattgaggaaaggtctcccagcgtgctcatccaacactgatgtcttgcaaatcacattgtgtgctgtctcatgattggatgccatgctcctgagaacttgctggagagtacagtcacaatgccatgggttgttagcaatcctagccctagccttcagattattgaaggcatttttgtgcacactttgaatcctgttgtcagacaagtccagggtctgcagggtttctgctactcctttgaatgcatgctcgtcaataaactcgatgccgtttttggacaggttaagcactctcagttgatggaggtccttaaaaatctcattggggatggatgtgatctgattggagtccaaatacagcaaaactgtttcaggagggagatctctgggtatttccttgagatttgcattgctacaggtgacatttaaccctccagaggaagagcaaaggcagcccttgggacacatactggcagaatgaaaacacagtatcatcagtacaaagctttggaggaggagacacatggagagggagcgggacagccacaggtcgaccagattcatcctgcaacctctgcataatcacgagtccattcctcattcactccaagggttgcatgtgttctgcccctgaccacactctggatttccttcctgggtggttcaaaaggatgcagctagcacacagccttcttcattattcctgtccttgattgggaacctaaaggaaaggaaagcagatgcaattagcttttctgtgaggagacatgcatggcaattaaaaagtgccctcaggagtccacctaaagtaggggcaagaaggtgaggtaggcaggtaatttccat

SEQ ID NO: 4207 - DNA, 1000 bp, mus musculus
tgtacaagcttgcaatcccaccaacaatggaggagtgttcctctttctccacatcctcaccagcatctgctgtcacctgaatttttgatcttagccattctgactggtgtgagatggaatctcagggttgttttgatttgcatttctctgatgattaaggacgctgagcattttttcaggtgcttctcagccattcagtattccttgggtgagaattctttgtttagctctgagccccattttttaatggggttatttgatattctggagtccaccttattgacttctttatatatattggatattagtcccctatctgatttaggataggtaaagatcctttcccaatctgttggtgggctttttgtcttattgacaatgtcttttgccttgcagaagctttgcagtttcatgaggtcccatttgtcaattctcgatcttacagcacaagccactgctgttctattcaggaatttttcccctgtgcccatatctttgaggcttttccccactttctcctctataagtttcagtgtctctggttttatgtggagttctttgatccacttagatttaaccttagtacaaggagataggaatggatcaatttgcattcttctacatgataaccgccagttgtgccagcaccatttgttgaaaatgctgtcttttttccactggatggttttagctcccttgtcaaagaccaaatgaccataggtgtgtgggttcatctctgggtcttcaattctgttccattggtctacttgtctgtcactataccagtaccatgcagtttttatcacaattgctctgtagtacagctttaggtcaggcatggtgattccaccagaggttcttttatccttgagaagagtttttgctatcctaggctttttgttattccagatgaatttgcagattgctctttctaattcgttgaagaattgagttggaattttgatggggattgcattgaatctgtagattgcttttggca

SEQ ID NO: 4208 - DNA, 1000 bp, mus musculus
tcttaaagggcttctaccagtttacacacgttctcctgtaatttttaagggagttatttatgtcttgattaaagtcctctatcatcatcatgagatgtgattgtaaatcagagtctttcttttctggtgtgtttgaatgtccagggctcactgtgatgggagaactgggttctgttgatgccaagtagccttggtttctgttgtttacattcttgcccttgcctgttgccatctggttatctctggcattagctggtctttctgtctctgattgtggcttgttcctcctgcaatcctgtgtgtcagaactcctaggagaccagttctctctgggaggaattaggtatagagagatgtggaattgggtcagctccagggtgcagatggaaaccagaagaatcctgtctccaactgactcagggtggatccatcctgggcaaggaatttgaatagaagtggtcatcttacctgtgctcacaggtaagttagcagtcttggtagacaagctctctccagacaatatttgtgtatggagcgctgtggcacaggatcagctctgggtgctggcagaaaccagatggttcctgtctcaggctgctctttggttcccgagacaactgagatctctgggttcgtacctttgaacatgacatacctgtgctcacaggcacacctaggagacccactctctcctggtggtattttgggtaaggagcagtatggcacaggataggctcctggcactggggcacaggatctgctccggatgcagacagaaagcagaagccttttccagtggtttttgcagagaatatccagtcagtttccagccatttaagacttatttaacttttgaaataaacctttcccactctgaggcggtggtgaagtctgtgatctcaaacactttagactcaggctcactgtttactgatatcttgcagagcagagcatctgtatcacatttctttatccattcttcagctgaggtatatcttgt

SEQ ID NO: 4209 - DNA, 1000 bp, mus musculus
attgccggtgggagtgcaaacctgtacaaccactttggaaatcaatttggcagtttctcaaaaaaactctcaggacccagttattgtactcctgggcatataccccaaagatgctccaacattccacaaagattcttgctcaactatgttcatagcagttttatttgttatagccagaaactggaaacaacttaatgtccctcaactgcagaataaatgaagaaaatgtagcacatctacaaaatgaatactattcagctattaaaaacaaagacattatgaattttgtaggcaaatatatgtagcatgtagattttactaccctgctttaagctccaggcagaccatgctaccagacccacccagatttccttggatctgcaaatgaaagacagacagacagacagacacacacacacacacacacacacacacacacacacacacacattagcttatttttgatatgctttagctccatggtctgtgttgggagccgcccccacattcgccgtcacaagatggcgctgacatcctgtgttctaagtggtaaacaaataatctgcgcatgtgccaagggtattttatgactacttgtactctgcctttcccgtgaacgtcagctcggccatgggctgcagccaatcagggagtgatgcgtcctaggcgaaatataactctcctaaatagggaaggggtttcggtttcattatagaaggggctttcgctttgggggctgggggtttttgcgctcctagctcctgaagatgtaagcaataaagttttgccgcagaagattctggtttgttgcgtctttcctggccgggcgtgagaacgctattaagaattggtgctgaaatccgggacgagaaattccgggacgagaaaatcctgggacaaaaaaatacaagaaaactcgggactggcgcaaggaagatccctcattccagaaccagaactgcgggtcgcggtaataaaggttcccgtaaagcagactgtt

SEQ ID NO: 4210 - DNA, 1000 bp, mus musculus
ataggcctggaacagagaccctgtgagcctaagaagcacgtgagcaaactggatctctccacggaaacgttccaggcacactgtgaaacagggaggaaatctttagaaagctgacaattcttcagcaagaagagggaaagcaaaacctgcagtttctgatttcgagggcatccgaggaccaagagagaagagaagaggaagagccatggcatggtggccagtgggaacacttagtgttggtcagtgctaagtcaaatccagacagccatctgggcatgagactagtgccttccagagagcagggacaatggctaggtgaggaaaggaggtgcctgaagccagtttcccaaatgtctccattttaccaacaggaatagattttaagcattcaatggacagagtatcttgttgaaactttatcagttcagacctcagatatattttaattccagcccaataacagtagtttagtttggcatcaattaagcttaacgaccaactaaaattctacttatttgattacttggtaagtttccagaacaaaatttgactgtttttaaagaccattatgcagcataggcagcaaggctatagaaattcccttcagtcattataatgatataaaagtacaaaaagcaatcatgggagataatcccaaataggaagaaaaggacccagctgttcaaattagtgaacaaggattgcagcagttattagaaatatgttcaaagatgtaaatggaggatgaatgcaatatgtgaacgaatgagcagtctcggtagagaaatgtaactgtggaaaaaccaatagaaaccttacaattaaaatgcctgtctggccactgagttggctctgtgggttaatggagcttagcaccaggccttatgacctcaggtcaatctcaggcgcctacgtggtggaaggagagttgtcttctgacctcaaatgtgtggcgtggtacatgaagacacaccccttccaaaatgaacaaatgaaatgt

SEQ ID NO: 4211 - DNA, 1600 bp, mus musculus
tttcaaccgaaagttatcaaaaaagacaaggaggggcacttcatactcatcaaaggtaaaatctaccaagatgaactctcaattctgaatatctatgctccaaatgaagggcacccacattcataaaagaaactttaggaaagatcaaagcacacattgcactgaacacaataatagtgggagacttcaacaccccactctcatcaatggacagatcatggaaacagaaactaaacagagacacagtgaaactaacaggagttatgaaataaatgcatttaactgatatctacagaatattttatcctaatataaaaggatataccttcttctctgcaactcataataccttctccaaaactgaccatataattggccacaaaacatgcctcaacatatacaagaagactgaaataatcccatgcatcctatcaaatcatcacggactaaggctgatcttcaataacaacataaataatagaaagccactcagcatcggcaagagccatcttggttccaggtctccgcagaaagtagtctgcacaagtgagtatgcactacagaagctaatagcttctgggacaggcaggagccacagagcttctgaggcagcccccttttcgggctccagacatccgaccaccttcccagtcagaggataggggtctggccggctctggagggctttgcctcagcattggctggagacatcgtggttccgggagacattttggttccgggactccgccgaaagtagtctgcacaggtaagagtgtggactacagagactaacaggttctgtgacaggccaaagcaacacagcttctgggacaggtcctgttttgggcctcaatcttcagccaggagggaggtccaaatgccagatatctgtgaaccttccctgtaagaggagagcttgcctgcagagagtgctctgaccactgaaactcagaggagagatcgagtctcccaggtctgctgatagagggtaacagaatcagcagaggaacaatttctaaccagagacaactataacaactaactccagagattaccagatagcgaaaggtaaatgtaagaatcttacttacagaaactaagaccactcaccatcatcagaacctagcaaaaatcctcaataaagttcttcctaaccgaatccaagaacacatcaaaacaatcatccatcctgaccaggtaggtttcatcccagggatgcagggatggttcaatatatggaaatccatcaacgtaatccagcatataaacaaactcaaagacaaaaaccacatgatcatcttgttagatgcggagaaaacatttgacaaaatccaacaccaattcatgaaaaagtcttggaaagatcagaaattcaaggccgatacctaaacatgataaaagcaatctacagcaaaccagtacccaacatcaaagtaaatggtgagaagctcgaagcaatcccactaaaatcagggactagacaaggctgcccactctctccctacctattcaacattgtacttgaagtaatagacagagcaattcgacaacaaaaggagatcaaggggaaacaaattggaaaggaagaagtcaaaatatt

SEQ ID NO: 4212 - DNA, 1200 bp, mus musculus
agaggaatgttgtgacatacacttatgacatcctccatggtgatgtcgcaaatgctctggtctgtctctcactctccgttctctcttctcccgtgaacttgaaccaaacatctagagcagtagccaccatgaccacaaggaaaagtctaagtgaacagcaaagcgagcctcagtactgctgtgactgggacatgaagccatcttcagggttccccccaaaatcttcctcaggggaagaaagtctctactttagccagtgaaatggagagtttttaatattttcagaaaaatatcttgttaactgtcttagggtttcactgctgtgaacagacatggcaactctttttttttaaattaggtatttatttcatttacatttccaatgctatcccaaaagtcccccacaccctcccccacccacaccccacacgctcccacttcttggccctggtgttcccctgtactgaggcatataaagttttcaagagcaaggggcctctctttccactgatggccgactaggccatcttctgatacatatgcagctagagacacgagctccggggggtactggttagttcatattgttgttccacctatagggttgcagatcccccagctccttggttactttctctagctcctacattgggggtcctgtgatcctccaattagctgactgtgagcatccacttccttgtttgctaggccccggcatagcctcacaagagacagctatatcagtgtcctttcagcaaaatcttgctggtgtatgcaatggtgtcagcgtttggaggctgattatgggatgaatccccaggcatggcagtctctagatggtctattcttttgtctcagctccaaactttgtctctgtaactccttccatgggtgttttgttcccagttctaagaaggggcaaagtatccacactttggtctttgttcttcttgagtttcatgtgttttacaaattgtatcttatatcttgggtattctaagtttctgggctaatatccacttatcagtgagtacgcatcatgtgagttcttttgtgattgggttacctcactcaggatgatgccctccaggtccatccatttgcctaggaatttcataaattcattctttttaatagctgagtagtattccattgtgtaaatataccacattttctgtgtccattcctctgttgaggggc

SEQ ID NO: 4213 - DNA, 1200 bp, mus musculus
aagctccatatcgtaaggaaattatctgtcacctagaccctctgaattgaattagttatgacttccacaccgtccccctaggcagggttatgcagggaggtgatctttcctgatgtcttatagaaaatcaatcctggcccctggcgctggctagttgctcaagtaggaaacttgtcccccgctgcatggtcttcacttcccattttttattgcatcctttgttccgcattcctgtctctgaactggttagggcaatgaccagggccaggggacactcttggtgtgatgaacacagagactcttccatgaagaagggtcccaggttgagtgataaaggtcttgctggtggcttttcttgcacagcctgattgtgtatatagagtgtttgccaccagaaacacaggcacttgcccttcggcctgagtaacagcatgtggacagatgtgcagtctggtttgggagtttgctgttgtctcttctatagtttcattgcctgtgcctcagaatactactctctattgtaattttaatatatgaaactctttcacctcataaaacctcacaaatgcacctaagagactaagacatgtaagaaaaatccactccaaccaccgtgagcctaggacagatatccttactatataaacagttattccaaagtatcaacatcaccatcctgttggggggacttgcatttttagtgccttgggagcataaactcgagataaagctgagcacgccagcagggcacagaacaccgcacagttagaaatgttaatctacatgcagtcaagaaaggcctgaagcatcccattctgcctttcttacatctgtcaggagagcctacaaggcattcttccccagccatgtgaccacgatgccttgggctttagccattccagccaactgaccctgctactgaacgtttaatagggataaattcacacgtgaattcataatcccctatctaggctaagagtgccgggtaacaagcttgtaacaaagcaaagcttgcatctcgtcctgatactctgaccccacctcacatctctcctcctaacctttctgcacctcccgggctgatgcctaaaggcatgtgccccgcctgtagacctcgccggcctacgctctgttaaatgcagcgtgatcagtgtttttaataagtagctcccgtcaccgccagcatacacattgagctgt

SEQ ID NO: 4214 - DNA, 1000 bp, mus musculus
gtgtttggcccactgagacatggcctcagatcaccatgatgactattttgtttagcagggtattagggaagggtggaagtgtagaatccatctaggtggctatctcgggcacattgtcatcttgacctgcctggacagtgactagtgtgtgcattctgtatttggagggccaacctattctctgtggtaatggggtttctttcctcccagtgctacatcgtggaaactgttctgtgccaactgttggtggctttttctctgctagctctgcaaagggagggctgagactgctctgacgaggcagggagagagaagacaggacttcacgctcccggctgggctgatttcttctcaaccatcagcaatcaaatccgcatcaccactgtgagaattaattcctcctcaagctccccttcagagaggtgagaaatttgtatgcctcccattagcataattgtgaccccatttcttgtgaaatgacaggcctggtttgattatgctcagagagcatcccaccaccctgtcctgggcggcaggatgagagcgttctcgcattaactgacaagtgaacggtctgcagtccaggctttctctgtgatccgtggccagcacttactgttaagtctatctccatgagtccagaggaagttctactttacatccccatagctggttatgtgtacactgagaggcattaaatgtccagctgtggctggaagggcagagagcttggggctggggcctgagctggtttgggacatgtatttcttatgctttggggatcaattcccttcctacccagtgggagctaaggactggccagtcatactctatactagcttatactaggttgtcgcccagcacatgctaaaccatgtgtggcacacatcttggaataatactcaattagggaaaagttatgaacttgaaattataattacagtgtttctctgtgcctcctccagaccagttagccctactcaaagtacccagggctggg

SEQ ID NO: 4215 - DNA, 1400 bp, mus musculus
cattaagaaacagtccttgggatttttcacataatacaccatttggtcttccttgaggagctgttgacatggttcaatggaaactgttataacgtcaggtgaagcccactttgtcctgaaatcccatgaatgaagttcaactcatcctttgcctggcttcttggtttcctccctggcttcagtggtgtgctgatgagttaagggtcactatgctgatgctgtgagagtggccagctctgcacagtggtccaggtgctgccaccgtttatcacgtcctctcacatggcagatgttgtcttaagcaagtcagaaggaggtggtttctcagagctgagagggaggaaaaaaaagtcagatgtttcactggctgcttgtctttttgttttgcccaagtggttcttctagcttcctgcatagaatcccttgctggtcctagcactcagtgcgggacatgagttcacagagagagctgtacaggtcaccagctacagcgcatgcctaaaaacaaccccaggtgtcctggtcaggtactctacaaggcacgagtgtaagaatagaatgtgcccacctttactcagctaagggagctcccaggtctggaataggaacaccagagctataatctttgagttagagaggacgtggcgtgcagggaagtgtttagaagtactagtaaaacaggcaggagtcaccagagggataagtggaaaccctttgaaagcttgtgtcttgggctccagagatgtgggattaaaacatttcaaggcttctctccattagtttatcatgtagataagtctgtgatggatgtctgtattgcttttagcgcaatataataaaatctccaagtatgtgatgtataactgtattcttgaaaattaaaaaaatacccattttactcttgctataaaccatttccaaaaataattctcctactatgaaaatatatattacaattatactattactatttaagtcaatcatagctttaaccttatgacagaatttagaaaaatgttttcaagttctcttccaaaaaaatatcagttcagttgtatatacattacttttgacataattatttcagtaatttacctaaaatttagaggttttgtttttgaagttagcttaatgctattggaactgtgtccgtgtagttttagaccccctcgctgaaatttaatttaattgattagccgaacccctgcttctcctgctttctccattgtccactaccacacccagctacttgccttttttttttttttccttaacctcattacatggcatgctcaacctggctgtgtttctcttcgggaattttggacggcttcctctgatgtagtagagggtcctgaacatctgtctggactacgggattccagggctacttgtatggc

SEQ ID NO: 4216 - DNA, 1200 bp, mus musculus
aatcattggattaagggctgcagaaagcacagtaataaaatataaacacaatagcaaatatttattgagtgtttctgggtgccaggcactgtgctaagtttctttcttctgttattatttaatccacaaaacaactggatgaaggaggtactgttattatcttgatttcttgtatcatattttattcatgcttgtgttctatggttgggtttacggtcatcgctgtgagttggttggacatgtatgtgcactgccgtctatttgtgaagagctatttccttgagtgcttgcttatttatttattgaactcagtgccatgggttttattttcattcccaattttttttcctcccaagcccatgatatttaactcacgtattcactcccaaagactcagcttcctttgagttttgtccttgagtcttcttttcttttttctttttaaacctctttcaatatggagtggaagaactggaatagaatttggggtcctatgttcagaaagagcaaaggagaaaaaggacttttcattttccctagattcatgtaaattgcatggactagttctttacagtatgtgtaaaaatctagttttaagatgcctgcatcttatcaaatccagaagttatagtagtagctgtttttgaatggtttaaggtatcatgcctttccttcaatccctacaggaacatggggttggtgggggaattcttgcctctcacagtccgttgaagatgcagactttcagaggatcagatatcttgcagctccaccatctaccaaatatagcctctaggatttctaaggaatggcagaatgttggtatgccaacaggaagtgatgtgctacatctgggagcatgactaaaatcccagacgccatctttctgcaagggggctgactagacaacccagtctttttcagcattcaggagggcagagcattgcctgtgaaggagaacgagtggtctccaccacagcaagtttggggtttgaggttattttgttgtttgtatctttggaagctgtgtatgttatgtatccttccaactttgaagctgtcttctcatttgaatgattgtgagttgaatcaaattcaaatagacccttaacccaagtctgctattagggaaaacaaacaaacggaaggactttggatgtggaataaactatcctgggaacttttgtgagcattctggtt

SEQ ID NO: 4217 - DNA, 1600 bp, mus musculus
gtgccttaccatgtctgataagtaaatacagctttgctcttatatttatctagaaatgtagttttgacatagcaacttgactcattcctgatagtgaatgtttgatacttgcagctgtaatgcttactatcattttgagctgccaaagcagcggttcatggacataggaagagagtcttttctttactcattaactcttattaagttaaacaccagatcttgagactttgtgagaagtcttttagagctaacgggttgtgactgctgactgtgggcaaattagtcctcatggtctgggtcattactatgatgatggggatgtctgactatattcacaatatcccaaatttcactttccctgcttatgatcattcctgatttagttatacgtggaaagggaggccccaaagaggagctgaagctcaataaagggagaggggtggtcagttctctgcatcaagattcccacttggaggaacttaaaagtaacgtggaagacaccccttcctgattccccaggggacactcattaataaggaaatttatgcaaattcaataaccactaccctcaaatatgcccctttggcatgagaattattttgaactaaacatagcaaagaaagagtaggtgaagaaggaattcggtggcttccactcctgcctaaaatcagagcataaacttcagtccctgtagtttgcttcctgccctctcccacaccagggcatgtgagagagcactaacttgtctccagggtcccccatatgtttcccactgaacattactcaaccctagaagcccaggtcacctgttcatttgtttgtttgtttaattctgttatacctccatattgtattgtcctctattaaagtagtatagcctaaagatttggggaaaggagaggtttcagttatccccatgaagcatctatctacatatgaaacaagagatttctcatataccttcttctcagcacctcacgggaccttctccaaaattgaccatataattggtcacaaaacaggcctcaatagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagactttttagagtttaatgaaaatgaagccacaacgtacccaaacctatgggacacaatgaaagcatttctaagagggaaactcatagcgctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaa

SEQ ID NO: 4218 - DNA, 1000 bp, mus musculus
caacatttggtggactctaagactgagtaaataagctgacgcatgttcagcagtggacactactcctcttcaggtgaagaaatatttcccctagatctgtctgcgctaagaacatcacaggagtcatttcccagtagcagtgagtacatcggtgcctaaatcctggtgtctaaattccccactaaaagcaacagggccttctttgggaaaaaccctattccagaggctggagagccctcagcagttaagagcactgtctgctcttccacgagacctgggctcagtgtccagcactcatgaagcagctcacagccacatgtgactccagatccaggggtcctgatcccctcttttggtctccatgaacaccaggcacacacatgttacatctatatctatcgatatacacatacacacacatacacataaaatgaatattaaaagtctttaaaagtccatttcaagactgcatctgggaaaatacagactgagctggggacgtcttgctatgccaggaagtatggatttattcaaagcatgatgagaacatggcaaaatggcgggaggtcagcctgaagaggacacagtccacattgcagcctggaaatgaaaaaaaagctgcaatgccctctaaccctttcaacctggcaagaaggctccacaatgaggttactggagaccgtcaggcaggacttagaatttaacacctgatggggtcagcaagtggcctgtgccaacttgatacaagttagtgttatttacaaagaggaacctcaacagagaaatgcctccatcagattgcctgttgcaaagtcagtaggacgtttcttgattaatgactaatgtgggtgaacccagcccagagccacccatgggcatgtggtcctgagttgtatgaaaaaatcaggctgattaagtcctgtggagcaagccaggaggtgcaaaccagtaaacagcaatcctccatagattctactttagttcctgccttcagattcct

SEQ ID NO: 4219 - DNA, 1000 bp, mus musculus
ggccagggctgagttcagccatatccccccagacttctctgtattctttgtacatttacttagtatgcgtgtatgtgcatgtgccacagcctatgtgtggaggtcagaggacaactgttaggagtcagttctgtccaatacgtgggtctccgggttgaatgcaggctccgtgacaggtgcctttctttcctcgctgaggcatcttgcaagcctcattattattatttttagatgagggctctcacggaacctagaggtcacccgttcagttaggatggcaggtcagcgagctcccggaacccacctgcctctgccatcccccagtgctggatttacaagtgtacatcatcacacctggcttttacactggttagggacctgaactcaaggccttccgtgtgtgcagcaagcactataaccgctgagccatctcccctgcacaaaagaaacagagttctgagctggtgagccctcatctcattctgtcacctcctcgacacacagtgacaaagcaagcaggcgcttgcagtgctggccagccgtggatgtattgggggtggtccactctcagtgggactggcgcatgtcttcttttacactgcggcagagtatctcatctatactaccacagggagtggggtggacctacatggaccaaccttgcaccgcagcccagaagtcagttgcagcatctgcaactacactgtctaagtacaagacgatgacccggaagccatttgaggggcaaaggcaggtgggtctctagtagaagtcctagactctctgcataaaggctcaccatcctctaaataggcagacctgacaggcctccctgtgggaaactacccgcacccattcctggtgaccagctgcctcctagggcagatactaaaggtaagaccaagtctggtctacctgtgtgactctcactgcccctttcaggacaacagaacagaaagtctacctgtgtgactctcactgcccctttcaggacaacaga

SEQ ID NO: 4220 - DNA, 1000 bp, mus musculus
tcaagaaaaggtaagagtgctggaggccactgcatcagagccacacaccccagccagcactcgggaaatcacaggatgcatccccagcccaggcagagcaatcagcatgagctccagggaagagcataggcccatgcttctcctgctgccccgcccccacaccaccccatgtaggccagcctggcatccagaacactgtgcacttcctacaccaggcactgcagaaggctactgcaggccagggagtgaagaaagagtggaaagtcagttgctcttgggactgcaaccccttggaagaattagctggatcaccatgacagctaaaataatagcccagggtcaactttgagactactctgcattggctaagagacttcataaggcattccccctgccccccccccccatgtaccacggtcatcctgagcatgttagcatcactagtgggattcaggacaaaaggacctctttaagacaaacctacaaattatagttctctaccatttgcgtctctttgtgaatctatgcatactcgtgacatagggatcaagaagagcacatggggattagcaacaagatgggcctgcctgggtccctgtagtgatgtgatctccctgggtctgatcattgagaacccagctggaaatgttgggacttggctaggttggctgtagcgccctctgctggagtcctggagaaagttcctcggctcatgggctgctcttacctagtgatggccagagctgtcacagcaggacttgccttgctgggcttgccactcagagcaacactgacatccagctctcggctcagggcaagattcttggcccacttgtgacctgtggaaagtgtgagagaggaaagttagagcattggcggctgcatgcacaaagcctgtgcacccaatacgtaggaccacacagatacaaacatttatatttgtggtcagcaacttgttaaattgagggggaaaatatatttaatcttggcctgtgctgtt

SEQ ID NO: 4221 - DNA, 1200 bp, mus musculus
tgcaggattaactccacagaattcccctggcttccatatttcttctttacatcacgttcttgcatttggggccattagtaactaaaatgaacacaagcactgctggttcaggccaagagagcaagtgtgatagcatgcaagtagtatatatagcatggaaacaccaggcacaagggctgacccatgtgctgggcaggatgccagaatgaaatgatggactagaaaaacaactacatttttttttcattaaaaaaaaaaaagagctcacattcttgctatcactgctctcaaactcaggtacttaaaaaggtaaggaggagtatgttgcccgggtaacagggacaggatcttggaccctgtcaggagagacactgattgcagcatctatctctttatagctcagacttacaagcagctggaaaaatcttctgatttctttaaaaaaacattttaatttaaaacatatatgtgtgtatgtctgcctgtgggtatgtgcatgagtgcaggtgcctacacaggtcagcaagggcaccagacgctctggatctggagttacaggtgactgacagctgcctggtgtggatgctgagaaccaaactctgccctcggcaagagtagtattggctgttatccacagtgccatttcttcagtgccatttcttcagcccaaacctttctatttcttaaaccatttttagagtttcttcagggagtgaggcagtgcttgtaaccattcacatttcctcaatagacccctgaactatcaggagatcaaagactcaccatggcaacctgtgctggatcagagcagagccccagcctggatcaagaagacaactggagggacagtacgtctctggacgcaggtgaaggtctgagtcccgggccagagtcttcctacaaggatgttagacaggtgaagggggacagagaaaaagagaggccctgggccaagtcctggatgcatcctatggagtcccaccctcacgtatgtaaactccacccagaaccagagacaccagcactggccacctctttggaaaaggatatgagacaaaactgctattctgtgtgtgatatcaggagactgggaaggtaagaagtgccgtgcttgcagccacgttgtaaactgtgtgcactacattgccagctgattacaatcaagtaatcacttaccatagagaggcttattctgcccag

SEQ ID NO: 4222 - DNA, 1000 bp, mus musculus
tttgcactaaaggaagggaatacaaagtcaaatatagcttcctctgccctccagcactgggcatagcagtcagtgactgtatttcagtatggcactcccaaatcgattagaggtgggtgagggtcaggagaagagatgccactcaaactgagttttgaagacaggggacacattcccactattaattcctttgtccctagtgccctctattgtttcttaagctcttactttgtgacaacctctgttgtaggcacaatggttttgtggtatgtgaatccaacatatctccttccttatggcattttcagtgagtgcagggagtagacattcaacaaaccaaaacccagccacaccagggagtcacaagttcaggtgcctgtgaggctgaagatgtgcaaccatgctgttcagggtcctgatccagatgcacacatctagttggggaaggcttctgagggcatggcacttactcttgggtctgaagtgtgacaatggtgaagtcagtgattggggatgagcatcctaaattcagcaaaacacagggtgagtggaaaggcaggtaggcagcggatgggtgaggaccaggttgaaaacagggacctgaggctgagtgagggagggagagcccctcccagtcaaagttctgcctagaaagacagcatgagctgagaggcaggccagctggggcaactctgaaagctgagtgcccaggggctgttctcaccagcatctatgatgttcctacagtgcctttccctccatactggtttcttatgtactaggcttatgggagcagggcaagtagcttgggcagaggttctcaggcatcagcacccctagccaggaaatacagctggggaatgcgggtgttccttttaaagtacttaacaggaggagaggcaaggtatggattctatgcagttacctgacaaaaatgcagactgtagatgtgtctgcttttgcagacaaaagctctccaagagaaggaagcttttctgtg

SEQ ID NO: 4223 - DNA, 1000 bp, mus musculus
gagacagggtcagagctaagagtccaagagtggaacaaagctagggggaagaataggaggaggtcagaagggagtcaggtctaagcagaacagatactaaaatgtcctgattacattatgcaaaagactgactcctggttcacataaaaggagctggaaactgcaactaagtcaggacatgtggtgaaaccaggcttagaatataggtagactgactccaaagcccacaaaatcggggctcatctatggggccaaatagaaagaggagaagacaaagaaggggatcttctccaaggattagcttcatcaaaaataagacctctttttcccaaagcaatatctgcctatcacatgattattacaagtgactcccaagcagggcatgacaagcaggcccttctatttgtaggctgccaggcacttgcagccatcccctccctccctcccagctgtcacacccagctcaccaaggcatttaatttggtagagcaaacgttggttatctgttagaatgcttatcaaatgccaattagtactgtgtggtaattgatgtctaattaacatgccaataatgctgttgggtgtcaattaaatgcctaaacagtccttcctgttttattgcaccaagacagtgattgtgaatttctcagttcagtaactttggagtgaattttattgtacgctttttggaatatggaaagccagagagaacttgagggcagatatttaattgatgtgacactctggtattgaaaaatcctaacttgtgttcagtacctttctgagaaacttaattgttcgtttctgaaaaggtcaaagacataaggtatacatatattacctgtatttattcttaacagaatttcaaacatacgcacaatagaattttacatatccacccttctcttcctctctaactccgttaggttttccctcttccaaacttcatgcctttatgtttttcctttctctttacattagcccacaaatagttcagccc

SEQ ID NO: 4224 - DNA, 1600 bp, mus musculus
acgtccttacttatcacacatttccaaataggtgtgccagggatgtagatgtactctgagtagtgattcctgggttctgttgctagatggctgtttgctataaggtcccggttgtcactatattagcttcaccttcatgcctgaaaggacagaatgcgtacacacatgggtgggtttctaaacaacgcttgaatggtgctagacactagagctggccaaaggagggggtaacggttgcttggctccacaactccctttggctgaagactcgggcttccgtggctttgttcactaatgcctgccatccccccaagcttggatgacttgaagggcagaccactggattctgctgcctggttttgagccaaggaggaaaagcctaatctttatgctctttatttataccaagcagagatggtcagtccagctctcagtagcacaatacttcttggagcttcctttataaagttacaggcttgctgactgcaaactgtgaagcaatagggggcaagacagcctaccccgctaaaattcaccgttgacttattttgtgtagagaaataaaattctcacagtggcagctgttttcctgccatcgtttctatactccctggccagaagccagtctcaccaatgtctaataaagttatgccattatttttttctctgcttgagaaaatgggcatttccctttgttttggaacaaactcctgttctgtcactcaacacttaaagagattgaaaatgacaaagataacgtgccctgcccatgtacattcactgtcttgttcgtcatttggcctgatgggaacaagtgtttctgcagggccaggcatgtgcacacggatgcctgcacaggggcagggactggaacaagtgatgaagagatgctccatcatcaaggcgaggaagagcaggctagcactcttggtgtcttttaagctgggtgacctgggctttctccagcctttgagtagtctcaccaagtcagaggactttgtactttatattgtacattgtatattatttgagaattaggcaactttcaaacaaggcatcattcactgggcccatcctctttcccagactcactggcgagaagataaattatctttatgtcgggttgggttccaaagctgtctgttctcactttatatttttgatatttccctaaattgatatagccagtcatatatatgtacaaacacacacacacatatacacttatcctactacgtgtgtgtgtgtcttaggattttactgctgtgaacagactccatgagaaggcaactcttatgaaggataatattttattgggctggcttacaggttcagaggttcagagattcagtccattatcttcaaggtgggaacataacggcagcatacaggcacatggggccggagggtctgaaaggaggtgttcaggatatgtaagcagtatgtggttttctttaaggaatttgagcacccatgtatttgggtattaagagccccaaaccaatcttcctcagacaccaaaagacaaatgtacttcactgatttatcctctgcatatatactttgcataatcaagtatatagttcaaaaacaccttagt

SEQ ID NO: 4225 - DNA, 1000 bp, mus musculus
gataggggccgtgtcctgaacatcttccacattgatggtgacggtggtggtggctgagaacaccatgtcagcccctcgaagcctgcccccaccatcctggggaagaagcagtccagagaagggggatgaagacaagctgtccgaggggtgatagactccacttgaatgggacgcccacctccccagttgtgaagccagctggaccctttcagtgtctatttgttcttgggtctctggagcccatttctcctttctcaatggtgttgtggatgccaaagcaatgacgcatggaagttttaagtcaggtgtctggcaggtttctttggatacaggattaattaactctctgggtacattatgtgtgattagtgactaggaggaagaatcagaccgaaattcctactcctagctgaaaaccaagcctcgggtaattcccaagaactttccatatgtccagtctacgctggggaccacaggatctcaagagtatgacttgggccttcctctgtttaagagtaagggaagtgagcagctagcacatagactggtacccagcctcctggtacagactgtaggagagtgacctatagggaagcagtgatctgaaagagagctggtgcagaagaatccaacaggcctaataggacagctgggttttccttctccctggtgaaagaggcttgtctgagactctgctaactaccaacttcccaccatgtgcttcataaactgaaatgagagtcttcagtaagcttcagccatgggaacatgagggaacaaagttcagagaaaggagctggccacacagcaagaagagcagcatgagccagtctggccagcaggagaggtggcggagcttgtgagagggatgaaaatctctgtgtcatggctacctcctctatgaagtgtacccaatatttaagtttctaaggagttgtatgatcaccgccagaagaaaatgtggcctctctagcctaacacccccagcattcctggaaaa

SEQ ID NO: 4226 - DNA, 1000 bp, mus musculus
tccaccagcttatctcttgataaggacagatttatgctacctcaaggctattgtacacaatgagactatggcttagattttgcaaataccttctccagactatgcttacaatgatagacttatactcaagtagaatcttcagcttatatgataatttcatcaagtattttcatagtatttttcatagcagtttgataattgtacattctcaacaataattcaagttacacttttttagccatatcagcacttgctttacaatagcttgcctcatagtacatttgatttgcatttctctaatgactactgctattgaatatcttttcatatgttcatgctcatttgtgtaccatagcatttgcccaagttgttcattcattattattcattcagttctttcagtcttccctaattcaacaacagggatcagctgcttctgtccattggttgagtgcaaacatctgcatctgacactttcagctgcttgttgcatccttcagagggcagtcatgatagatccctttttgtgagggctccatagcctcagtaaaagtgtcaggtcttgggatcccccctcccccacttgagctggatggtcaggcttcagaccagttccaaacttttaatgatcttgcttcaagcttcctgagccctggtctaaagtcataaagccaccatgcctatctgatctgcattctaatatctatctccagaggcttcttatattgtaatttccagttggaagaagtatttctactctattttcacaacagtaaaggttgattgtatatgttcaactaaaactattaatgaatgaatgactgagaagatgagtcattaaagtcttgcaggcattagtaagtgaattcaacccttagcaccaatgcaaatcggtgagtgtggcatttgaaactacagtactgggaaggcagtgacaatggatcttcagatattgaggcatctattacaagtttacttggagtaaatttccttttattta

SEQ ID NO: 4227 - DNA, 1000 bp, mus musculus
ttcagaagtgatttttacacacaaaaatgataatttctctctctctctctctctctctctctctctctctctctctctctctctctctccctccctctctctctctcctctgttctttaatcctttttatagtccagccttcaatctcttcctggtatgcccccccaactgcttgatccccatctcatacctcctaccctggtctccaagaggatcaccccaccacaccagcccccacaccaccagacctctccacttcctggggtctcaagtctctcaaagtttaggtgcaacttttcttaatgaggtcagaccatgcagtcccttgtggtatatgagctgggggcctcatatcagctggtgtatgctacccagttggtggctcagtttctgaaagaccttaggggtccaggttagttgaaactactggtcgtccctcctccttagattcttccagatttttttcccaattcaactgcaaaggtccctggtttctgtccattggttgggtgctagtatctgcatctgactctttcagctacttgttgagcttcttagagggcagccatgttagtctcctgtctgcaagcacacattacagcctcagtaacagtgtcaggcccccagggcctccccttgagctggatcccaattttggcctgtaactggacctcctttctctcaggttcttctccatttttgtccctgcagttctttagacaagaacagttctcggtaagagcttttaactgggggatggcaacctcacccctctacttgaaatcctgtgcctccactggaggtggactctacaagtttcccatccccactatagagaatttcttcgaagggatcctccctttgagtcctgagagtctctcaccaggtctccagtatattctagagggtgcccccacctcctacctccagaggtttcctgtttccattcttcttgctggccctcagggctttagtcctgttccccccaatacctgatcgt

SEQ ID NO: 4228 - DNA, 1000 bp, mus musculus
agtgtttgaaagaaaccaaatctgaacgatttatgctctctgcttaccacggtggagttgttgacaaaatactggtcccttcacctttaactgtctgtttcagtagagtgcatttggcattaaaaaacaagctgcaaatataaactatgcaaagtagactaacatgaatatacctgtgatttatatatgccaagctttccttcacattttctctattaccagaaagcaaattgcaaaacaaagcctttacttgaagctcaattatgattgctgattctagcaattttctctgtagagcagagatcagaaagcttaattctgagccaagtcctaatttgccataaattctttgaaccatatctgtactttatttttatttttcaatatgaagaaaatttaaatgttatctaggtaaaagtagaaaaagcttttcaaaatactaaaagccagggcatgctaagacattagaagttcactatggaaatttagtcaccttgaaacattgaataacaacctgctacgtccttatgtctgaactgtgcctgagggacacagatggaattgtccttgactcatggaaatagcaacacattaatagcatctaggggtggtaactactctttcttgctatatcacattacagtcacattggaaatatgaatggatactatagtctctgtgatgtttctgaaagttaaacttgtttctataacaaactattttattcatcataactttcatacaaagaggtcatcaagcataaaagataactggacaggatcatcacaaaaggaacatatttattgttataatttgcatcttactagtagtcctcaaacatcgtagaaagacttggttactaagtagcactgttgggatgtgagtcagcatttaggagtagcttagaaagaggctgtccagtctttagaggaatgtttacttggaaggctgatagtcttttcactgcctagccaggaccttagatttttctttatcattt

SEQ ID NO: 4229 - DNA, 1000 bp, mus musculus
tgcatgtgtgtgtgcacatgggaacacacatgaccatgcacacacacacacacacacacacacacacacatagaagaaataaggtacatttccaaatattgatggtcacactgtaaaatttcgccaaatactcattttgtaagtagaataatttgtatttttttcttagatcatacaagtcctctatggttaagtttaaaacatcatccacaagagagaggcccttccattacttttatctcagaaggcctcctcggcagaagaccatggtacccatgaaatccagtgcgaatgagtcaggcctgtagggtccaactaggtagacctgagtgacagatttccattagagtacaaagtccattaccacatcgtcagaaattaactgagcaggtcagtggttgaggctggaatgctgggaataatcagtttattttgaatgtgatacaacaggacagtgtgatagccataggagtcctttaacctctgtgttttctcagctacaacgaatgtttctacggataccctgaatggagtggcagccattggaaaggaagagcacaggagcctgagcctgcatggttttcacttaaagagggaagttgtcaacatagcccttaagttttaacctattccatttaggtctctggcttctgcagcctccatctctccagaactcactatttttcatgttcatcttgtgaagggacagcatggtctttggaaaacatgcctatctgccctgtcctgcttccctgcctcctgcagcactcagctagtcttctagtactcccttggacttttatttttaactctcaatggcagactcctggaatatcctgcaggccattctcagctgtcactctacctgatcccttagcagtgtttgtcatgatggcttgcttttttttttttttttcctcttaaagtgcttcaccattcaggcatcaggacaccattatttcctgatgcctcttacttctcagtgtcacctaatctggcc

SEQ ID NO: 4230 - DNA, 1200 bp, mus musculus
gccccgtaagctgtagcttggaactctctgatctgttaaattatattattctcctggaaaatcaggagaatagatccctgttctcatgctatgtatagaatgaaatagcatcaacataaaaatgtatactaaacacaaatcaaaaactccagattggtagaaaattctatttttattaaatttttttaaaatttacatttcaaatgctatcctgaaagttccctataccctccctctaccctgctcccctacccacccactcctacttcttggccctggtattcccttgtactgaggcatataaagtttgcaagaccaaggggcctctcttcccaatgatggccgactaggccatcttctgctacatagcagctagagacatgagctctgggggtactgattagttcatattgttgttccacccatagggctgcagaccccttcagcttcttgggtactttctctagcttctccattggggccctgtgctccatccacttctgtatttgccaggcactcgcacagcctcacaggagacagctattatcaaggtcctttcagcaaaatcttgctggcgtatgcaatagtgtctgggtttggtggctgattatgggatggatccccggttggggcagaatattaatgtagatcaaattttcctaagaagcagcagataacatgaagtgggaagtattcatttggcattgtggtggtttgaatatatttggtccatggaacgtggcactattagggggtgtggccttgttggagagaaagtgcctcattattggggagagctttgagttcctatgcttaagttcttccttacctagggtaaaagcctctcttgcctctttggctgcctgcagaagacagtgttctgctgctgcctttgaatcaagatgcagagcttgtggcttctctagcaccaaatcaaaactgcatgatgccatacttcccaccttggaaatgtactgaacctctgaaattgcaagccagctccaattaaatgtttgcctttataagagtttccttagtcttggtgtctgttcacatcaatagcagccataactaagacaaggcatcaaattttaaacatttgggtatgccaaaatataatttgcgatttaaatttaaaaggaagttgctgttttgaaggtaacatctacaacatattttaccatatcaaggttatagaaa

SEQ ID NO: 4231 - DNA, 1600 bp, mus musculus
gcatgcgtgacaagcttaaaatacttacgtgacttgccttcatgtgtagctaacacccctgaatttggtactcactgtctccctgtgccctccccaaacacacttaaaatctgaattatctgcaactcattatctctacttcaaaacccacttgatttcctttgcccaggctagttctgaaattctttactgtactgtagtcaaggatttagattataaattgaggctcctcagtggagaactaagcctttctgagcagtgttttctcccagcagaactgacaaacccattgtagtcattgacagccttagggcacttgagtagaaatgcaaattcttgatatctgaaggctactggctagggaagtctggtggctttgactcaaaactgagtaaatcttcaggttagtgttgtgatgcaataaaatttagaaacatttttacagggaaacaacacatcttctctaagcccctacatacagatagataggatacggtttgtccacagtttgtgttcatagtcttcaatacaaaatcttctcaaatttcagtagacaagatatgtcttatggaatagggcatgtgcgcatgcgtgtataataaggagagtaggaagatttaaatagaatgtcacccttagtgcgcatgcgtgtataataaggagagtaggaagatttaaatagaatgtcacccttagtgaatgcttagtcatcagagagtgggcttactagagagatactaggaggtgtggccttattaaggtagggttaagattaggctttgtgtgtgtgtgtgtggggggggggcagggagattgtcactggggcttaagccaggcccagtggctttctctttctgttgcctgtagatccagatgtagaactcacaacttctccagcaccttcatgctttcatgctcccctctatcgagatagtggactaaacctctaaaactctaagtcctctcctttataagagttggcatagtcatggtaccttcacggcaatagagtattgactatggcagagaatataattaatatacacgtctatataaacacagcatatttcctctctctaatttaccttttactttattgaactttgcaggtttgaccttattctcttaaagcaagcctccattctgttaatgaattctgtggatttggcttggggaatgtccaattattttgcctgtcttatctttgcgttgcttgtgaatctttggcttattgcattgataactcaaattacttctaaagctttctcagtgtgtcctcagtcttccaatttcttacccacagatgagaagcaagaacaatggaatggaaaggaaatgagatgcaatggaagtaaagaattaatagttgtccatttacttttcaaactcattatgtcagctggtcagactaactacaggaaccaatgttggctatatactccaggcactccttggtaaattaagtggctgtactatgaaggataatcaaaatattcttgatagcaaaatgctgtcttcagggctgtaagttgacactccccatgaagttcttagttaataaactgttacactcaaagtagcaactttgatatctgtcttt

SEQ ID NO: 4232 - DNA, 1000 bp, mus musculus
taccaataccatgcgtcagtcgtgtttccccctttccacaactttcttgtgtttgtttaaacttattagaatagggcttgaatagttcatctatttatctcaaaaaatattagcataatataaaatgttgttcaaaatatcaccaactgtactgtctcttttgtcaatttgatacaagcttgagtcaccagggaggaaggaacctcatttgaaaaaatgcctccataaaattgggctacagataagcctgcagggcattttcttaattagtgattgatatagaagggcctaggatggtggtcccacattttgtaagaaagcaggctgagcaagtcatgaggagcaggccaacctctagcatcttccatggcttctgcattagctcctgcctccatgttgctgctctgcttgagctcctgttttgacttcctttgatgataatattttacatgaaattgtgagcaaaataaaccttttcctctccacgttgctttggtcatgatagtacattgtaacagtagtaactctaattaagacactaaccagtgctgtacatattgcactgtccaaaagtggtgaacttttggaggtaaaaatatgctttccctctcagagtttctgttgatattaaggaaattttacctactttcatgataaaagcctgaaatttagaagaacataagtgacaggctagtatccatcacttagtaaaatagcatacgtttttccagttaatgttataatatataattgagccaatattataggagtaagatctgaagtgctaggatagatggtaaataagacataccagataaagtataaatgcaagaataaatacacattgatgagtagagtggaaatataattataaaccaattatcagtttttaactcacttgcaaatccatcatgtgggctttaaacataaagtaaagtgttctgtttatgattggcaacacatgcaagtatctggcaaaaaaaaaaaaaagatcaatcaa

SEQ ID NO: 4233 - DNA, 1400 bp, mus musculus
tatttgcttgagatgtaaactacaagtcattctcaggtatcataatttttgccatgtaaggtaaaaggaaggagatacaattagtaagacttggcctctgtttcttcagtactacagatggtcctgatgcagctctaacacatggctcttccttcttggaaagattctactatcaccctaatctaacagctaggaagttaggaatctactttgacagctttgtcactgttgcattagagatttagtctttgctgccactatcaagatgcttgggcaagaaaacctatgtgtgttgtatattctttagattccatcctgaactattttgtatccactgaataaactttaaaaagaggagaatctacctgatccctggtgtgatttttcaccattcatactaatttcatgtaatccacagagcaggtgacattgtttgctggaggcattttctccacccacatgtctaaattactgaaagtatcttttctgtggtttgaagagtagatttgtttcctgctcaggctaataaaggaattgcttcccttgtgagggagaaaggttagttaaacttggtagcaacggccttaaagtcttaactttgtaagcccatggtaaagaaggtgggacagaaattgactgtgatcatgaagtccatctgtgcctctatcaccccagccatactcatggggagggagtattcatagagagtcacagcccatgatgaactcagcctgagtgctgcttcacaagtggcaaatatcgacttggatttgtgcttatcttactagtcgtgctgatgagcttgaagcaaggcaacccgtgatctgcggatttgcaattgcatgagtctggtttattggatacattgttcatgtgatttctgagggacacatttggttggggttttataagacactaccaaaaataaataaataaataaacaaacaaataaataaataaaataataaaaaaggtcctgagttcaaattccagcaaccgcatggtggctcataaccacccgtaatgggatctgatgccctcttctggtgtgtctgaagacaacaataaataaatctttttttttttttcttttttttttttaaagatagggtctcacaatccctaatatttcttaagctggcccagaacattgtatgtaacgtatgcttccctcactcatggaacttttcctatttcagtctcataaatgctggaattacagggatgggctactatactcaccatacaatgaatcatttagccatcaagatcgtcagtcttacacttggttaatttaagcattatgaacagtcatttttataatgttgcctctaaattttacaagttgatgagctttaagaaagcacagaatccttttcaaccttacacgagaaagcaag

SEQ ID NO: 4234 - DNA, 1000 bp, mus musculus
cttcattcacatctccagtgctatcccaaaagttccccccacacacccccactcctccacccacccactcccacttcccggccctggcattcccctgcactgaagcatataaagtctgcacgaccaatgggcctctctttccactgatggcctaccaggccatcctctgatacatatgcagctagagacacgagctcctggaggtactggttagttcatagtgttgttccacccatagggttgcagatcccctcagctccttgggtactctctctagctcctccattgggggccctgtgatccatccaatagtgactgtgagcatctacttctgtgtttgccaggccccagcatagtctcacaagagacagccatatctgggtcctttcagcaaaatcttgctagtgtatgcaatggtgtcagcatttggaacacatgagacttaggaggaacaaagaccagggtgtggatgctttgccccttcttagaattgggagcggaacgcccatggagggagttgcagagacgaagtttggagctgagacgaaggagtggactgtctagagacttccatatccggagatccatcctctaatcagcctccaaatgctgacatattgtttcttaaaacatcccttcttaatgtgttatattggagctaaacaaagtgatctgtgagctaaattagaagacagcagattcaagaaggccaatggtactgtggtggttaaatcagtggcctccccattacaaatataaaagaattacgtgttgtagctgttttttacaccaacatcacacaagctagagtcgtctgagagggcagaacttcaactgagataagattctcataggatatggttgtaagcaagccctgatggacatttcttaattaatgattaatgtgaaaggagccacgggtggtgccacctcggggctggtggtcctgggttctctaagaatgaaggttaagcaagcaatgaagagcaagccagctgat

SEQ ID NO: 4235 - DNA, 1000 bp, mus musculus
tgtatcttgtattcttttggtgttgcttgaatctatgactcctgttctctttcctaggttttctatctgcagggttgtttccctttgtgatttccttattgtttttatttccacttttagattctggatggttttgttcaattctttcacctgattggttgtgttttcctgtaattctttaagggtttttcgtgtttcctttttaagggcttctacctatttacctgtgttctcctgtatttctttaagggagttatttatgtctttttaaagtcctctatcagcatcatgagacattaatttaaatcctaatcttgcttttctgatgtgtttgggtatccaggatttgctgttgtcagagaactgggttctgataatgccaagtgcccttggtttctgttgtttatgttcttgagcttgcctctctccatttggttatctctagtgctacctgcccttgctgtctctgactggagtctgtccctcctgtgatcctggttgtatcagatctcctcagggtccagttgtctcttgtgattctgggatcctgtgatcctattgtgtcagagctcctgggagtcaagctttctctgggtgttgcaggattgggtagggaggcagcctgggtctgctctgagcacaggtgcaagctagaaggaaactgtgcctctgaccaggcatggttttgtgtttccctgattcctgtagggcatcccagttatgctgcatgttggggcagttgttgtggcctcagcctgtgatcttgagtgtatcagagctccagtgatcctgagtgtattcaatcttctggcataagagcttcctctgtgatcctgtgctcctgtgttcttgggtatgtcaaagagtcagtaatcctgtgatcctgtaatactgggtgtgttagagcacctggaagttggattcctctgggtgttttaggagtggctacagagccagcactctaggtcttctccaggcacaggtttaagctagaaggaac

SEQ ID NO: 4236 - DNA, 1600 bp, mus musculus
gctcgagtctcgagtcgagcggaagggacttgtgccccagatcaggcccgggtagcctgcttccctatgtaccgcagtctcaagttccgcgcgattggattggggcaggcactgtgatccactcaccagaggtcttagggtcccgtggggagtcctgtgtggacccttgcgggtgttgggcaagactctgctggcaaggtagcccggggctcgagtctcgagtcgagcggaagggcctgggaactttttagaagggtttccttccaggcccatgaggtaggtcttgaagcccttgatcacttactaaggaaccccaacctgtgttgtactggcatcaggatactgagtttaataagcaccagaaggtctcagtatataggaggcagatgtggcagccactgcatgatggtagtccaggacataccctgaattcacatgatccttgaggcctgtgtcatggagtagcttcagtgactagaagaatgggtcagatttatttcctatactcaaagcaggcagaaaaggatgaaagtcctccatgtaatatcaaatatatccagaagagggtgctagatcctcagtacccaaagtatccagaagatgggataagacagattgccatccagtaccaaagtcatccagagagcatcttaagatcaaagtcagctggtgttgtagccctaggagcaaggaggaggaggctgcatcctgatgccctcttctgacagtcagaatgaaattgaggagctcttgcagagcagctgcagccttgatatttcctgctctctgtcaaacaaactgcttcccagaagctccaagctcctgattcccattactggaagtccaagctcaagcccaccttctgtaggaagctccctctttcatgcccaggattcacagtgacttccccaggaccattaattcttgctctttaacactaagaccaatggccatcttgtggctgcctctttctggtctcggtatgttcattgttctctcctccaagaagcctgcccagttttgtcaacatgtctaagggtgaaccataaaggtagttaatgaatgctccaagagcagttggagtcaccacacattagtaacatcacagaaaatgccagggctctccaggttacaacacaacatctagggaagggacttctgatgtctcacaggacagctcttaccttcctgctcagtacctcacccaaattgacctgaaatcaaagtgccttttccagagagtgggatagattgccttttgttactcaaaatattaaaaggtggctatcaatcaccttccaatgacaaacgtatccagaagagatcctttggatccccatgcaaatccacatgaaatacccagactccagaataagacactagacaatacacaacacatctagataaagtgtgatagatccccttgcagtactgaaactagccagaagaggttaatacacgtccagccagtttctatgctgtgacgactgacctggacagaatggaaaatgtcaccactaatgaccaaagtatggttatgttggccaggtgttctggaagattttacatgagaattgcagcccagcttgttattgcagga

SEQ ID NO: 4237 - DNA, 1000 bp, mus musculus
ctcatagagactgaactgtgaaccagagaatatgtaagggatggaactaggccctctccacatatgtaacagtttcatagctgggtcttcatgtgtctacttccctttttaggaatcatatggttttgttcatttccatcacctgtttggatgagttttcctgtttttctttaaggacttctacctgtttggttgtgttttcctgtttttctttaaggacttgtaactctttagcagtgttctcctgtatgtctttaagtgagttattaaagtccttcttgatgtcctctaccattatcatgtgatatgcttttaaatctgggcatttcttttcgggtgtgttggagtgcccaggactggctgaggaggaaatgctgggtactgatgatggtgagtggtcttggtttctgttagtaagatttttacacttgcctttcgccatctggtaatctctgtagttagttgttatagttgtctgtggttagagcttgttcctctggtgattctgttagcctctatcagcagacctgggagactaggtctcttctgagtttcagtggttagagcactatctgcaggcaagctttcctcttgcagggaaggtccatagatatctgggatcagaacctgcctcctggcagaagatgaaggcctggaacagggcctgtcctagaagctgttagcttctgtagtttatactctcacctgcccagaggagtctcggtgggattcacgaaccaagatggctctcctgcatgctccgcaaagccctgccgggcgggatggacacctttcctctgtcagggaaggtgcccggatgtctggagcctgaaacgggctctgcttcagaagctctgtggcttctgcctgttccagaagcagttagcttccgtagtccacactctcacctgggcagactagtctcatcgggatccgggaaccaagatagttccccctggtgctgcagccaagacatcccgtgtggggcagacacctctcc

SEQ ID NO: 4238 - DNA, 1600 bp, mus musculus
ccccctgtgtcaccctgtcaacaccccaactctgggggacctttgtttttgaaaccctgcagacctccaacactgcaccccactggatccctttcaagccacttattttcagtagtgagattcccccactagagtgtttgcagtgagaacctgaaattttcatttaactttcccctgccctaggtcctcccagttaggaacctatcactgtggagaatagccagggccaggcctggccttgctcacttgctccaaaaagactttaatttgcacacttgcctcagggtggttctggggccaggaggctcacaggtccatgtcctgcattcacccacttgggcccccagctgggaccaaagccctgaggcccctgagcctccccagctgccccgcgggtggcgccctcctccatccctccaccctctgccctctgcagcagtgcccgccccctgctcacagagtgctgcagcagtagttagttaacctgctccaaggggcaaacacgtgcaggggcaggcagacactcctggaccgcaggaatcgcgtgggtgggctgagtggcgagggtccccggggaggatcggggtgggtgagagtaatggggtgtagggggctgtgtgggtttaatcttgggctaaagttgagactgggtaggttatgggggccagctggggggagctagaggaacctcccacagcggggacatcaggacaccagggtcctatgccagcttgaggcccggagtgagggagggcagcggagaacaatgatataggtataaatattgagccatgacattgacctaccaggcgcctcccctcccctgtgctcagggcacactctgggctgctgggcaagcaccctctcttcctgtgctgcactcatccctgaggggccccagcgaccttttcctccctaagactgcatgagccctgctggggggaaaagtaacttgatttttctccaagaaacctggccagattaggaagccaaggcgagtagagaggaggaggaggggatctggtggaacccagtggaagtctcctgggcagtctgatcacactttctccttgtcctcctgtctcctcctcctaagtgcagagattggggcagactttgtaattgctgaggagggggaagaggagggattggtgctctcttgcagcaccagcaaggtgcagcaacttggctaggtggagtttcactgcagctgagcctggtttgctccagagggcaaggaaggctgtccatctagcctggtggccagtacaactccaggagtccctgaggcgtgtaaggcagcaagtgctcacccagattccactgtgctacaccagcagcttgcagccagcatggagaaggacagcctgagtcacactgatcagcagtatgagtgcatggcagagactggagaaggcgcctgcctacaggaaggtgttcaaggcctgcaacctgaagaatggcagccccttcctgactctgaagcacttgggagtgcagaccagtgaggagggcatgctgctctccaccatccacgaggtggcggtgctgaggcacctggagaattccagcaccagatcatggtcagttgagccaggag

SEQ ID NO: 4239 - DNA, 1000 bp, mus musculus
agaagaaagaaataggaaattcagatataatagaatacatatcaaggccagctgaaaagctgtcatgcacaatgaattctatgcagtgattgtacaaggctaagattaagataaaggggaattatgctttagtatgaagagcttccacaggctattgagatgtttctatcacagcctacatcaggcaatccctaatttcaaatggcaggaacccaggaggaatgtgtctcctgcttctcaagaccacagacaccatccttttttacaagtagctgctgcaggctgctgagaggtttccattttgacctgtagtgggcagtccctctaattgcatgctctctccatcacccttgaaatgtaaaaatgcagataaccaatgccaaacattaggctgtggtcagagtcttgtggaagtgttggtggaagggttgtagtagccagaagggttaggaagccacaagaggacctacagtcaactaatctgggttcttggagttcacagagacggaacaatgagccaacaccatgtaggggcttgaactaggactgttacataaatgaaacagatgtacatcttggtcttcatgtgggtgactaacaattggagtgggtgctgcctcggatttagactctgttacctgcctttggatctcttttccctagctgggctgccctgtctgggctcagtgagagagaatgcacttattcctgatgcaacttgatatgccacctgggtcatttaaaagtgatcttctggtacacataacaggaaagtaggaccatatccctgtcatgtgagtgtccagagaacaaggtggtacatgattaatccatgtgggctgaaaagagaaggagaatgttctacagaggaatgaactacagctatggctgtttctgtttgatcttgagccaactccactgtgtatattcagaagaggaagcaattgtctcagcagcaatttcacaagacagtgactttcattactctccttatgctgcc

SEQ ID NO: 4240 - DNA, 1000 bp, mus musculus
gaccacagacaccatccttttttacaaggagctgctgcaggctgctgagaggtttccgttgtgacctgtagtgggcagtccctctaattgcatgctctttccatcaccctttaagtgtaaaaatgcagagacccactgccaaacagtgagctgtggtcagagagtcttgtggaagttttggtggaagggttgtattagccagaatggttaggaagccacaagaggacctatagtcaactaatctgggcccttggggttcacagagatggaacaatgagccaacaccatgtaggggcttgaactaggacccttacataaatgaaatagatgtgcatcttggtcttcatgtgggtgactaacaattggagtgggtgctgcgtcggatttagactctgttacctgcctttagatgccatagagaagatcggaggacctggttcctagataattccggaagtgacatcctgagtcacctctccataccatagagctggaaggggttgctgtcaggggtccaggaactcctctgcctagaaaggaaagctagcagtgaccaactgggagggggacaagagcatgtggctggattggaagtggccacgaaggtcacatcttgcctggtgtcctcacctcctgacacaggtgtttgagtatttcctgtgattgctgccagcatccaggaggcaggcaagagaaagagtgctttgtgaaggccctgcagcagaagacagacacagaagtggaacttcacgaagaaacttgatcccagggccactggagtctgaggaccagtggatggagagccatgataatccaggtaagttggcttctgtggtccctcaaccaacaccagtgctttcccaccaggccagggaaccatcttttgtgactccggggtgcctggactcctgccccctgccctccaagagccccacactcctatcttagaaggataggctgttgttttaggttcctaagtgtcctttcaataagaacatcg

SEQ ID NO: 4241 - DNA, 1600 bp, mus musculus
cctgtcctcatcaggctgatatgcccccctgtgtcaccctgtcaacaccccaactctgggggacctttgtttttgaaaccctgcagacctccaacactgcaccccactggatccctttcatgccacttattttcagtagtgagattcccccactagagtgtttgcagtgagaacctgaaattttcatttaactttcccctgccctaggacctcccagttaggaacctatcactgtggagaatagccagggccaggcctggccttgctctcttgctccaaaaagactttaatttgcacacttgcctcggggtggttctggggccaggaggctcacaggtccatgtcctgcattcacccacttggtcccccagctgggaccaaagccctgaggcccctgagcctccccagctgccccgcgggtggcgccctcctccatccctccaccctctgccctctgcagcagtgcccgccccctgctcacagagtgctgcagcagtagttagttaacctgctccaaggggcaaacacgtgcaggggcaggcagacactcctggaccgcaggaatcgcgtgggtgggctgagtggcgagggtccccggcgaggatcggggtgggtgagagtaatggggtgtagggggctgtgtgggtttaatcttgggctaaagttgagactgggtaggttatgggggccagctggggggagctagaggaacctcccacagcggggacatcaggacaccagggtcctatgccagcttgaggcccggagtgagggagggcagcggagaacaatgatataggtataaatattgagccatgacattgacctaccaggcgcctcccctcccctgtgctcagggcacactctgggctgctgggcaagcaccctctcttcctgtgctgcactcatccctgaggggccccagcgaccttttcctccctaagactgcatgagccctgctggggggaaaagtaacttgatttttctccaagaaacctggccagattaggaagccaaggcgagtagagaggaggaggaggggatctggtggaacccagtggaagtctcctgggcagtctgatcacactttctccttgtcctcctgtctcctcctcctaggtgcagagattggggcagactttgtaatcgctgaggagggggaagaggagggattggcgctctcttgcagcaccagcaaggtgcagcaacttggctaggtggagtttcactgcagctgagcccggtttgctccagagggcaaggaaggctgtccatctagcctggtggccagtacaactccaggagtccctgaggcgtgtaaggcagcaagtgcgcacccagattccactgtgctacaccagcagcttgcagccagcatggagaaggacagcctgagtcacactgatcagcagtatgagtgcatggcagagactggagaaggcgcctgcctacaggaaggtgttcaaggcctgcaacctgaagaatggcagccccttcctgactctgaagcactttggagtgcagaccactgaggagggcatgctgctctccaccatccaggaggtggcggtgctgaggcacctggagaattccagcacca

SEQ ID NO: 4242 - DNA, 1000 bp, mus musculus
actcaaagaaaataggactgacaagctgctactcaggctcactcagtgtgaatcaagatctacaggggaaagggttggagtgggggacaaaaacttccaaaaggcaacagtgaaatccacttatttgtcagttacactaagctatcatccctgcaatcgatgtcctacctggaatcctacctgatccccataaagcaaatgagcttcagaactttacttcttccttcaaagctctccactgatctaaagaagggctccagcacagcatccttcaaacttaatatcatgtagagctgtgatgtgtaatcaactaatctcccctagtgaactgcagattatagcagggcagaaaaatttgcttgctgaacatatagtttcttgaaaaaggctacctccacagaaagccttgtagttgatcacctaaataaacacttggaggagaaacaggtgagtgcctggataagttggtggactgttacattggattgtctatgtttatggttagccatgagggcaatctgcctctgatacacatcatcctatgtgctactgcttagcacttgggatgtatgttcttgctggactcatcacagaacctcttttcttcaccataggatgcttccaggtcggcctgctctaccagcagctttctgttcttattcagcaacatccttactttttccttcaattgattgcattctttcaggaggtaggtgtgtgtgaagctgaaccacaaacaaacaaacaaacaaacaaacaaacaaacaaacaaacaaaggtgattcccagcaagcttccatttacctgccactcctccaagtactatgatccctgcaagggccctgatcaccagacagccccagactagagaccacagtatacccatcagtccaaaatagaggcaggtcaaatccagggaccagccacatgccacaagaatcaaaggacttctgaaaaccctgacactaagaatgtcccacgtacatcagagaggaggaaa

SEQ ID NO: 4243 - DNA, 1000 bp, mus musculus
acacctcagaatttgcctatacaaggccctgtgtcagatgcccaaaaccactgaagaaaagagatgcattattacacactgattcactgtaacagatgatgcaacgctggtgggaaaggcagaatttatgcatgtttgggagcaggggaggaatggcagctctgtgcttccctcatctttttgctaggaaactaaaagtgctcttcaaaagaagaaatgtcattttaaaacaaaaataccagccttccggtttcagtctggcccagagctgatcctctgccacagggctccctacccaaataggaccaggagagagctagcctcccaggagtgcagacaagcctgagagcacaagtaagaccaccacttctgctctgaggcacccacccagcaccctcaggacacaggaactgaggagcggtctgggacaggagccttcttccatcagttcccagagccgatcctgtgccacagtgctacatatacaaataccaaaagagagctggtctgccaggagtggtgacacacctgcaagcacagctaagaccatcacttctcttcaaattcttggcccaagagggacccacccggagccatcaggacacaggaatcaaggaacagctggggaccagatcattccagtttctgtctgcactacgaagcagaccctataccacagctcttcatacccaaattcctccaggagagaaatggtctcccaggagtactgacacgcaggcttgcaggagggacaaaagcacagtcagaaacagaaagaccagctaacaccagagataaccagacagcaagaagctagggcaagaacatgagcaacagaaaccaaggctacctggcagcatcagaacccagttctcccaacagagcaaaccctggatatgtcaacacaccagaaaagcaagactctgatttaaaatcacatctcaagatgataatagaggactttaaaaaggacatacataactcccttgaataaagagaa

SEQ ID NO: 4244 - DNA, 1800 bp, mus musculus
tcttctataattttgttgaatatatttgctggccctttaagttgaaaatcttcattctcatcaacgcttattatccgtaggtttggtcttctcattgtgtcctggatttcctggatgttttgagttaggatctttttgagttttgtattatctttgattgttgtgccgatgttctctatggaatcttctgcacctgagattctctcttccatctcttgtcttctgttgctgatgctcgcgtctatggttctagatttctttcctagggtttctatctccagcattgcctcactttgggttttctttattgtgtctacttccctttttaggtctagtatggttttgttcatttccatcacctgtttgtgttttcttgtttttctataaggacttctacctgtttggttgtgttttcctgtttttctttaaggacttgtaactctttagcagtgttctcttttatttctttaagtgagttattaaagttcttcttgatgtcctctaccatcatcatgagatatgcttttaaatccgggtccagcttttcggttgtgttggggtgcccaggactaggtggcgtgggagtgctgtgttctgatgatggtgagtggtcttgatttctgttagtaggattcttacgtttgactttcgccatctggtattctctggagctgtgcaggatacactcggtggggtcctggaaccaagatgtctgtgcagggtacactctgcagggtcccggaactaagatgtctgctgccaatgctcaggcaaagcgctcccgcgctgggcaggtccctatcctctggccaggaaaatggtcacctgcctgtacaggatacacttggcgggatcccggaaccaagatgtctgctgctgatgctcaggcaaaatgctcccacgccgggtagatccctatcctctgaccaggaaaatggccagctgtctgtgcaggatacactcggcggggtcctggaaccaagatgtctgtgcagggtacactctgcagggtcccggactaagatgtctgctgccaatgctcaggcaaagcgctcccgcgccgggcagatcccaatcctcagaattcttaagattatgtggctggtgttgtgggtatctggcggtagtcagccgactgtgcgccctagctaccccggtgctgctcggactgaaaggggcttgtgcccctactcagaccgggtttttgcttccctgactaatgcagtctcaagtcccgcgcgattggattggagcagatgctgtgttccactcaccagaagtcttaagattccttggtgggtgttgtgggtagctggaggtagtcagccgactctgcgccctagctaccccggtccccagttaacatctatcttagcttctttttcctctattatgataaaatactccaaaaaaaaaaaaaacccacaggaaagaaaaggttgattctggctcacagttcagcagcacaatccatcataacagggaagtcagggtaacagagcttggcacagctgctcacatgtatccatagtcaagggtcagagaatgatgggtgcatgctgctgtgtaccattctttctcagcttagatagcctaggagagagaatggtaacaccatctacagtggatgggactttccttctcaattgacactattaggagaatactgcagtgacacacccagaggcccatcttttgggcacttctagaatctgactccttggcaattaagactgatcatcacaacatttttgttgacccatccagcaggtccagttatttgagggtctcgaggggacc

SEQ ID NO: 4245 - DNA, 1400 bp, mus musculus
ctgtaactggcaagaagcaaaaccagctctcccattctcatgaccttgggaccaactctcccctctgtcacagttggtgagggaatcaagtggtggagccagccctcccgtgctcatgccctctggccggctcaccctgcaaccaggatcagctctactttgtttcctgagtgagggacgggccagctctccttctcttccaaggagtgaggccagctctgcacaaccctcaaatatcaaatggctccaggcagcagctcagaacaggggcatctgcctgacattttttggatcacagaaccctgctgctgcagggttatggaccacatatgaaccttgggggcagcactgggcaggacctcaccatggctttaggtggtatcccgggctacccacatcaggctgttcctcactaccctcaagtctccagttccccctctcctcactgtgcccacatccttctgtttctcctcctctcccatctctcctgtactcacttgctcttcttagcgccacctggggcctctgggtgtagagttgtctcaggagtgcagtaccggagaccagtgggacccaggcacccagcaactccacccgacccgtggcatggatttcttccagtctaagctggagccctgagcagaccttgggagtgaactccacagccagtcccaaaacacccagaggaagctccacttccaggcactctaacacttccaggatcataggatcagaggtgccccaagcagaccttgggcactaaccctgcagccagtcgcacaacacccagaagaagcaccactcccaggtgctctaacacacccaagaccacaggatcccaggatcccaggagcttggtcacaccaggatctcagggtcccagaggcagcttgattcccaggagttctgacacaggatcacaggaaggacaggctccagtcagatatagcgagggcaggtagcactagagataaccagatggtgggaggcaagtataagaacataagcaacagaaaacaaggtttcttggcatcatcagaacccagtactcctaccacagcaagtcctggataccccccaacacactggaaaagcaagattcggatttaaaattatatctcctgatgctggtagaggattttaagaaggacataaataactcccttaaagaaatacaggagaacacagttaaacaggtagaagtccttaaagaggaaacacaaaaatcccttaaagaatggcaatctcacctgagtcccagggtctcagggagactggaggactccactccctggaggcaagctctcccctggcagtgaaggtgcacagagggctgtggaacagctccagctattttgaaaattttaaaatgtacttactgataaaataatttctctcct

SEQ ID NO: 4246 - DNA, 1000 bp, mus musculus
atgaatttatggttgttgagtaatcccctgacctctgcccacaagatgccaatagcacctctgtccagctgagatcattaagaaggagtccaggcattgccacaagtccactacctctgaggatgacaggacataaaatggtcactactacctgatgctgagaactgttggctggtaggagtgacaatcctccatctggttagtaaggtaaggacaggcagcagactgttctggtcacctctatcgactgagcatttagcttggtgtgtggtgcatgatggaggctacataatactcatgtagtgttgattgaaaacataacacaagcaatgaccacaccacagaggccaatagagaaggatggctaatacacctcagggattcaaaggacagggatggggaccaataagcagaacccttggagaaggcatcatgggtaaaaaagttgagaaatcaccataagggcaaaccaggaataagccgagagattctcagcttgcctggactgtggggctgttgacggtcattctgaagggagagaagcagggactcagctccaggttgcaggggatgtaggatgtcggattggagtcaaagcaagttcataaacgagggaaatcacagcagtaatcaagcaaggttggggcccatgtccctctatcaagaatataaacctggtagtgatatgtggggtggggagaggacagagaggaagaacccagttagcatatttttctagcagttgaaaagaaggcatgaagtaggctaataataggcacagagttccaagggagatggagttaaacagggaagggtttagagcaccatgctgtgcactggctttcagttgtaccaggtcaaagctccttagggggacattcatggcccttaggtccaaggtctttagggggacatttatggccctttctaactccccttaatcccctttgcccactctctccctgtcacctctaccctcctattcatttctcagtctcag

SEQ ID NO: 4247 - DNA, 1200 bp, mus musculus
tcttatttcaaaagggaaggatgaactaaggtaccaggacaatcagagcaaagcaaaatcaaaattcaacagtgtaaaaatcttagtgtgcggtttctgggactcacaatcttctggtctccaaagaccttggacagttctacttcttcaactttggcatccacaggacacatagcctgtctcataggctcaagatggctcactccacacctgcctctgtccttccctgacatcccattgtcctggtgcctgcatcttatcaatagcctccaggcctcttttttggtactctacccctgctatatgatagcaagcctcaaattttctctatggcacatcaaatcctgggatttccactgacctttgactgcaccttcaccaatggcctctcagagggccaagtctcagttgggttctatgaccccatttgtagtgtagcttccatgccaccaaaattagtgtcactcttacatattaccaagttcagcttccaggacagtgtcttctggaccacagcttcagagttctaacctcaaggaaatactgtccatgagttttcacctcagtggtgctggtcttttcttaatcaccaccaatttcttggccctagctaatcagcatcaattgtcaaagtaatggtgctgggctcttgttaatcgcgtctgattcttcacaccccagatgaccagaaactaaagattcttaattcaaatatattacacgaatggccctaatagtctttgtttttctctgaaacatcctaagccaaatccattgtctggacctgtcacagcactcctatcttccacgtgcccacaacagctgtttttccatccctaagttctgactactttcagagtcttctcctaaacaaaaccttcagttctttcacaacaatagctcgctcactagcaccaatttctatactagttttcttttcactgctgtgatagagcattctgaccaaaatgaactcgggatggaaaggtttgtgtggcttacttcatcagctcaggagctcaaggcaagaaccaggtggcatgacctgaagacggtgtcatggaggaatactgcttactggcttgctctccatggcatgctcagcttgcttttctgtgcagcccagggccacctgctcagggatgacatcatccacaacgggcttggctcccctacttctatcattaatcaagaaattgc

SEQ ID NO: 4248 - DNA, 1000 bp, mus musculus
tatttatgttcttcttaaattcctctatcatcatcatgagtcatgactttaaaccagagtcttgcttttctggtgtgttggggtatccacggctcactgttgtgagagaactgggttctgatgataccaagtagcctcaggttctgttgcttatgctcttgcccttgccttttgccatctggttatctttggtgttagctggtcttgctgtctctgactggcctgtcactcctgcaagctctccaggaggaatttgggtctggagagctgtggcacagggtcacctccagggcacagacagataccaaaaggattctgaccctggttgttccttggttcctgtgtcctggtggctctgagagagtccctcttgggccagaaatttgagcagaagtggtggtcttacttgttgtttacaggtgtgtcagcactcctaggagaccagttctctcccggaggtatttgggtatggagcacagtggcaaaggataaactcaaggcagacagaaaccataaggatcctgacccaggctgccttcatgaaattattgacatatctagacaaatgttatctcaatggcatcccaaaagaattggtattcatacagccgatagcactatagtctactagacaattcacatgtcaagagatgatgtttccatctcagaactaagtggacattgccttactttttccatatcaagcttaaactttttaaacatgtgtttatttattgtgtgtacaggtcagcatgcaagccatgaatagaggggtcagagggcaactcacaggagtcagttctctccaaccatcatgcaggtatctcccagttcatcacataggggccaagtcatctttctagatcctgtatgcttttaaagagccagaactcccactgacgagaaggaagtacacaatcttgttgtcctggggattctttaccacactataaatgcagaagattggctcactgctgtcagggactactgcctacatcct

SEQ ID NO: 4249 - DNA, 1400 bp, mus musculus
agtcacagtctcagcattttcgctctgagttttatgttttacttcaggatttctcactgagtagttgttgcccaaaggatcactcaggtcctaaagccctctaggacccacaaaggaactagggaatatatgggtaagatgaaactataaactctagttcaatctgtctgaatgagagctatacaggaaagacatgaacacacccactcaatattgacctctccggttcccttccttagagactatcgtccaaaaaaagaaaaaaaaaaaaaaaagactaacagaacaaaatacaaaaacacatacaggttcccaggagaaaggtagaatgttaatgaatgtatttgttgtggataaaagaatggtaaatcagttccttttctcatgggtaacaaaatagcttaaagaagcaaattaagaaggatgatttattttgggtcacagtttgagaggggacagtctgccacagtctgccacagtctgccacagtctgccacagtctgccacagtctgccacagtctgccacagtgggcaatgcataggggagctcataggagtaggagaatgagggttctcacctttcaacagaccaggaaacagggatcagacagaaagtagtgctgggagatgtgtgtgcgtgtgcatgagtgtgtgtgtgtgtgtgtgtgtgtgtgtgtgtgtgtgtgtgtgtgtgtgagtacatattgtgtacagagagctgaggtacagccccaggtcctgggtgcagatggagacagaaaggatcctgccccaactgttccacactcctgaggcctgtgtgcttctggctggttctgccttagacagtcaccagagagatcttgtctcccaggagtgctgacacaggcttacaggccaacaggagggacaagctcaagcaagagacagcaagaccaaataacaccaaagataaccagatggcaaaagcaagtgcaagaatcttacctatagaaaccaaggctacatggcatcatcagaacccagttctctcacagcaaaaagtcctagataccccaacaccagaaaagcaagatttggatttaaaaatcacatcccatgatgctaatagaggactttaagaaggacataaataactcccttaaagaaatacgggagaccacaggtaaaaagctagaagctcttaaagagaaaaaacaaaaatcccttaaagaattacaggaaaacccaatcaaactggtgaaagaattgaacagaagcatccaggatctaaaaatggaagttgaaatgaagaaatcacaaagggagacaactctggaaatagaaaacctaggaaagaggtcaggagtcaaagatgcgagcaccaccaacagaatacaagagatagaagagagaatctcagatgcagaagataccacag

SEQ ID NO: 4250 - DNA, 1400 bp, mus musculus
gttttgttcatttccatcacctgtttagatgtgttttcctgtttttctttaagaacttctacctgtttggttgttttcatgtttttctttaaggacttgtaactctttagcagtgttctcctgtatttctttaagtgagttattaaagtccttcttgatgtcctctaccatcatcatgagttatgcttttaaatccgggtctagctttttgggtgtgttgaggtgcccaggactgggtgaggtgggagtgctgcattttgatgatggtgagtggtcttggtttctgttagtaagagtcttaagtttgtctttcgccatctggtaatctctggagttagttgttatagttgtttctggttagagcttgttcctctcatgattctgttagcctctatcagcagacctgggatacgagctctctcctgagtttcagtggtcagagcactctctgcaggcaagctctcctcttgcagggaaggtgcacagatatctggcgttaggacctgcctcctggcaaaagaggaaggcctgaaatagggcctgtcccagaagcttttagcttctgtagtccacactctcccctgagcagactagtcttggagggatctgggaaccaagatgagttcccctggtgtacaggcaaagccctcctgggtggggtggacacctctcctctggcagggaaggtgcccagatgtctggagcctgaaatggggtcttcctcagaagctgtcccctagggaccttgggggtgtctgctgactctgcgcccaaggtgacctggtgttggtgcctaccagaaagaatttgtgaccctggtcaggccgtgttttctgcttccctaatgctgtttcaggccctatgcgattggattgaaacagaagttgtgttacactcaccagaggtcctaagattgcatggagagtcctctaaggaccttgggttgtccgctgactttgtgcccaggtgacctggttctggcgccgactggaaggaacttgtcatataatattttttaaaaggaacaaaatcagaaatgaaaaggaggactgtgactttggtatattttttaaaaagagaaaagtaggatatgagtctcaggtaggctgtgccaaggttaggaaacttgaatccttttgagtgggctctggctctccaaattcatattaatatattcatatactttgtaaacaacatatatatatatatatatatatatatatacatatatatatatataacaatctgtcattgcatgaagcagctcagcagtggggaatggagggattctgactgcttaagttgtgatgctaacattcattaaaagcagtggctgtgactatatatatatacatatatatatgtatatataatatgtgtatatatatgtatatatatgc

SEQ ID NO: 4251 - DNA, 2200 bp, mus musculus
ttttctaatttgtattcctttgatctccttttgttgtagtattgctctagctagaacttcaagtattataatgaataggtagggagagagttgctagccttgttttgtgcccaattttaatgggattgctttaagtttctctccattatgataaaagcattatggagatgagggctgaacagatgagcgaaaaagtagctagtagaacagagatcagagagaataggaaaggcttctccttaaaatgggacagttttttccctaactgcaaagcaggcttcttcttactgataagacaacctttttttttttaacagacttgagtttctttaattgatcaatagaaaggtagaatctttttctttttctatgcaataaaggttgaagcttatttttcatatagaatgatagagttcctcggtgctgatgcttgggcttttgcttcggacacacataaaagtgtgtgtgtgtgtgtgtgtgtgtgtgtgtgtgtgtgtgcaagcatgtaagttattgagaaaaatggtgggacccagcaagagtctatgaaagaatacatgaatgtatatgtgttcatcatatttgctttgtaaaagtttttctttttgtgactgtgactctcttctcctgttcaataaaagttaattgctttcagcctccctcctgcctagacagcaagagaagcaaggcttctgggcaagagagaaaggaagacaaagcaatcaattgcagttcagcttctggtttcagagtaatttagtatcaagacaggtaaagattaggtaaaggttattatagaaaagcaaccttacccctttgcaagaccaagtcttgtccacactaacttccttctcctttgctgccttccagagatcttgatcttatatcctgttaattctttgtcctgattactcatatattaccaaagtgtaaacaattgtatttctaagaattgtaccaatgactattgtaacccctgctcactagagaaatatgtgggttcctgaaaatcatgctatattagctaaagtatatgttgttcttagagccaagatactccagtccaaaattatctggaactaaagtgaatgaaagagtattcactagtggatcgcgaagaatgatgggctgtagcctcccccagccttgaagcaggctgattcagactttgctgccactgaatatgagatcacctggggtgtatccttctgacttagatggctatattgttatgtcaactatctctgctcttctctgagactctgctacttgctgagagacccttgagacattctggatacacatcctatcctgcaggtcacctacaggttggctccaggcactaagaatggactcggggtggggggaatgggccttaaccctaataagcatagtctcttagtaaattcgcaggccttaatcagagaaaaatttatcttggcatcattcttctctcaaagtctaagtctctttcagccccagcctgccttccagtagtacctgaggccaggttggcctacaacaacaatgggcagagaagcctagcttaattcttctcttagtttttggaattttgtgttctagtcagtaataatatagtatcccattttaattttaattcactatcatttcttgagtttctcatctgtaaaagagtatagttgaaatgctggcttttctttctctttattaaagcatgtggttctttaacagcaccatccatactataaaaattaatgttattcctactgccattatcattgtaaaacatgagctgtaacaaagcaagtctttgtagaatgcaatttctgtaagtaaacctcactaagtcaattagttatccaaataattgatgtgtgatcaaaaatagaaaggtcatgatgagaggaaagttcagacattgccatctgtggaagaatcaatctaatgcaaaaggtcatacctgtaaatggcaagtgttcagatacctatctcatctgatcatagatcaagaaatggcatcagcagtaacacgagccgaaaaactttacttaaggtgaacctaatgcacttaacacatttacagtctcaattatgcatcctgttgtttctcatgaacgttttgtttgtgtgcacatggggaacaaagaaaaccagccaactgaaagctaactgttttcttcttttggttgtctactctgaggaggacaactgatgggat

SEQ ID NO: 4252 - DNA, 1000 bp, mus musculus
cctcccccttgcctctgagacacacacccaggactaaccctcccctgggacctcaagtctctcaagaattagtcacgcccttctggccagcgccagcaccaggtcacctagggctcagagtcagtgaacacccacatggttcctagaggactttcccctcgatcttaggatcattggtgagtgaaacacaacatctgttcaaatccaatcacgcgggacctaagacagcagtagagaagaggaagaacagcttgaccaggggcataagtcccttctggttggcgccagcaccaggtcaccttgggcacggaataggcaaatacccccacagtccccagaggactctccacacagtcttaggatcactggtgagtggaacacaacatctgttacaatccaattctgatgggcctatttcagcagaaacaaggacaccagagcccttactaaccagaggcttgggttccttctgatcagttctggtttaccttggttttgaacagaccagacagctcgacggtcttcaaaggagacaccacttccaggctctttaacacccccaggatcttaagacaacaggatcccaggaaaacagaggctgagtcacactgactgccaaaaactctgacacacacataatctcaagttcagaggagcccacaatcaaaggatcacagagaaagctagactctgaggagtcctaaataaactgggaatataggaaggacaggctccaatcagatatattgagggtaacaagcacttgagataatcagatggcaagaggcaagcataagaagagaagcaacagaaaccaactttacttggcatcatcagaaccaaactctcccaccatagcaagtcctggatacaccatcacaccagaaaagcaagacatggatctaaagtcactcctcatgatgatgatggaggactttaagagggaaatacaggaaaacacaggtagagggctaggagcctttaaagaggaaactcaaaa

SEQ ID NO: 4253 - DNA, 1000 bp, mus musculus
atgtttataattaatatttacctattatatttgtacattctgttaattagttatttaactcctgatttaacctttttaaccacgtgtattgatttagtatgtgtatgtgcgtgagtacacatgagtgagtatagaggtcaggggacaacttgcagaggttggttctttccttctctcaagtctcaggttgttagatttggcagcaagcagctgaatccaccaaaaagcaaaagaaacaatccaagttttatgttgttgttttgagacagggtccagtgcatccccggtgggccttgagctgtttaagaccaaaggtgaacttgaagtccttatcctcccacttcagtagctgagattacagagacccttcacctcagcagccaccctgcactctaggctcactcgggaccttgcatcaactctaaccagcctgtgtgagttcagagaactctgacctgcaactctcggcccctgtacactcctagcatgcataccctggagatcttggtctctgtagtagccatgaaacatcatacctcatgcccgtattccatatgcacttgagcttctgagaacagaggtttatgaaacactaccacgttacccacacaccaggcattctggcttctgaggtcagaggtgaacccctgccatactgtagaccactctgtgaggtcaaaggccaaactattcctacagttggagaatatctcaactaacacacctatagatcatcactgagtagctctatgactgagcttcagagagcatttatttagccaagccaagaggaaagaatagccaatgagatggatcagggacatatggtagaaagaactggcttccaaaagttgttctctgacttcctcacaagtgccacaggatggacaccacacacacacacacacacacacacacacacacacacatgaggattaaaaaatgtaattaattttttctttaaaaaaaaaaaaaggaaaataaaggcatagccagcaga

SEQ ID NO: 4254 - DNA, 1000 bp, mus musculus
aactctgggggtactggctagttcatattgttgttcctcctatgggactgcaaaccccttcagctctttgggtactttctctagctccttcattggggactctgtgctctgttcaatggatgtccataagcatccacttctgtatttgtcaggcactgacagagcctctcaggagacagctatatcaatctcctgtcagcaagctcttgttggcatctgcaatagtctctgggtttggtggttgtttatgggatggatccccaggtggggcagtctctggatggtcattccttcagtctctgctctgaactttgtctctgtaactccttccatgggcattttgttcccccttctaaggattgaagaatccacactttggtcttccttctttagtttcatgtgttttgcaaattgtatcttgggtattctgagcttctgggctaatatccacttatcagtgtgtgcatatcatgtgtgttcttttgtgattgggttacctcactcaggatgataacttacctgttcttttgagaggaatcatcagaggttttacagatgtcaagcagagttacataagttcaaagtacaacatcttccctagcagaagttgctgatcaatgatgggtaagattgtcttgaaaatcttctcaatgtaagagaggctacagatacaagattattcacatgccaatgatggctaagagttgtactttccaatggcaacctacgacaggcacaactttctgctctgtgattgataaagtgcctcctctagataaaaaagatgggtaagattctctcagagggaagtcccttccggccggcccactgcagcaccgtggtccctggcccgggggagtaggcgaacacccgcaaggacccacacaggatctgccacgggatcctaagacctctggtgagtggaacacaactactgccaggaggcaggttcaaacaccagatatctgggcagcatccctgcaagaggggagcttgcatg

SEQ ID NO: 4255 - DNA, 1600 bp, mus musculus
agaaacacactctcaactagatctcccaggacctctgtaacctgatcccccaaccctcagaaatcagtgtgggggcatctctaggaggtgccagagacatgagactgaggatggggggtgttccagggagtctatgcggtgactctagctgagattcctagtagtgggtgatatggagcctgatgtggctacctcctgtagccatgcaggactcccagtgaagggataaggacaccaacccacccataaaaccttcaacccaaaatgtattcttcctacaagaagtgcagggacaaagatggagcagagcctgagggaacagccaacaagtggctcaacttgagacccatcccatggacaagaaccaatccctgacactattaataatactctgttgtgcttgcagacaggagcctaacataactgtcttctaagagactccacatagtagctgaccaaaacaggtgcagagacccacagtcaaacattaaacagagctctgaaagtcttatgtaagagttggggggcggggggaattgaggaacccagagggatagagactccacaagaagaccaacagaataaattaacctgtacccttgggggctgtcagaaactgaaccgccaacaagagaacataagtgaactagatctaggtcccctgcacatacatagcaaaattatggcttgatcttcatgcaagtcctctgagaactggagctgtggctttttttgcctgtctgtggatcctgttctcttaactgggctgccttgtctggccacagtgggagaggatgtgcctagtcctgcagtgacttggggtgcctcgataggttggtacacagggagggggatctgcccttctcaggggagaagggttgggggaggggaggggtggtgtgaagagaggactggaaggcgagcgagctgtgattagaatgtaaagtgaataaatacattaattaatgaacaaaacccgaacagaagcacaatttctctgagggttctaataccaagtggtttatcctatatattactctggtaatcttttaggtttttaattttattttaattttcttttcttttatttttttatgaaatgagaagaacatgatatttgtcctgacttacatattactctgttactctctcagtgtgagatgagaaggcaggggtagtgtaaacaatcgtaagacacagaacctacatcagcctaggaatgttcacatataactttccagtgcactcacctgctgcaggagatagggtttcccattcttgcctctgcatgtctggccaggctgagaacttcaggtccctggagttctatggcagagcttcctgtgtttctccgtctgctcatctgtatgcagttgatgtatccacatgttcttctgtgcagcatcatcatccgacactgtcattacagtacagtgcctcatatccaaacatagcacactctgttccactgtgtctcacggtggctagacaaggaatcgttagagattaaatatttggttgttagtgggtcaaggtacaggctaatatagatttttataccatatttatttgcaaaaggtgtgtctctaatgtactttag

SEQ ID NO: 4256 - DNA, 1600 bp, mus musculus
gtaacctgatcccccaaccctcagaaatcagtgtgggggcatctctaggaggtgccagagacatgagactgaggatggggggtgttccagggagtctatgcggtgactctagctgagattcctagtagtgggtgatatggagcctgatgtggctacctcctgtagccatgcaggactcccagtgaagggataaggacaccaacccacccataaaaccttcaacccaaaatgtattcttcctacaagaagtgcagggacaaagatggagcagagcctgagggaacagccaacaagtggctcaacttgagacccatcccatggacaagaaccaatccctgacactattaataatactctgttgtgcttgcagacaggagcctaacataactgtcttctaagagactccacatagtagctgaccaaaacaggtgcagagacccacagtcaaacattaaacagagctctgaaagtcttatgtaagagttggggggcggggggaattgaggaacccagagggatagagactccacaagaagaccaacagaataaattaacctgtacccttgggggctgtcagaaactgaaccgccaacaagagaacataagtgaactagatctaggtcccctgcacatacatagcaaaattatggcttgatcttcatgcaagtcctctgagaactggagctgtggctttttttgcctgtctgtggatcctgttctcttaactgggctgccttgtctggccacagtgggagaggatgtgcctagtcctgcagtgacttggggtgcctcgataggttggtacacagggagggggatctgcccttctcaggggagaagggttgggggaggggaggggtggtgtgaagagaggactggaaggcgagcgagctgtgattagaatgtaaagtgaataaatacattaattaatgaacaaaacccgaacagaagcacaatttctctgagggttctaataccaagtggtttatcctatatattactctggtaatcttttaggtttttaattttattttaattttcttttcttttatttttttatgaaatgagaagaacatgatatttgtcctgacttacatattactctgttactctctcagtgtgagatgagaaggcaggggtagtgtaaacaatcgtaagacacagaacctacatcagcctaggaatgttcacatataactttccagtgcactcacctgctgcaggagatagggtttcccattcttgcctctgcatgtctggccaggctgagaacttcaggtccctggagttctatggcagagcttcctgtgtttctccgtctgctcatctgtatgcagttgatgtatccacatgttcttctgtgcagcatcatcatccgacactgtcattacagtacagtgcctcatatccaaacatagcacactctgttccactgtgtctcacggtggctagacaaggaatcgttagagattaaatatttggttgttagtgggtcaaggtacaggctaatatagatttttataccatatttatttgcaaaaggtgtgtctctaatgtactttagtcaaatcaccaagctaagaaacttcatttaaaaatg

SEQ ID NO: 4257 - DNA, 1000 bp, mus musculus
tacctatcctgccacttttgtccccaggttcccccagtttcttcatgaaagaggacgtctagcagtgtgagcatttgtgcacacacatgaatgaacaggctttgtgctagaccacaaagcagacactaacaattcagttgctcctttctttgcctgcacccaatattagtctaaaatagctctcaatagaattattgttcctctctaaaactatatgatgtaggcctccactagattggtgttctcggcatacttatttctatgattccactaaaatggacataagctttgcttccagaattcaatgcccttttagtccaatatactaaatgcttctacaaaataggcaaaggtgtaaaagacatttgatcaggtttatcattaaaatggcccttcttccttggcaccagtttgtagttagtttcttttttattgtgacacaataccatgaccagaagcaacttcaatagaaagatttcttttaactcacaattccaggtcatataccatcccatctgggagccaaggcagctagaatatttttttttgaatttttttttaattaggtattttcctcatttacattttcaatgctgtcccaaaggtcccccatacccacccccccaatcccctacccacccactccccctttttggccctggcattcccctgtactggggcatataaagtttgcaagtccaatgggcctctctttgcagtgatggccgactaggccatcttttgatacatatgcagctaaagacaagagctcccgggtactggttagttcatattgttgttccacctatagggttgcagttccctatagctcctggggtaatttctctagctcctccattaggggccgtgtgacccatccaatagctgactgtgatcatccacttctgtgtttgctaggccccggcatagtctcacaagagagagctataactgggtcctttcagcgaaatcttgctagtgtatgcaatggtgtcagcat

SEQ ID NO: 4258 - DNA, 1200 bp, mus musculus
gcaacgctggcagctgtggggttgctgcttgaagcggcctcctatcattgcatcagacacagatctgagctcatccatttgctcttaactatgggatgtgtgagtggaattgccattctcctggctttgggtaagtgttctgagcctaaggaaggatagattttgttcctaaagacaacgaagatgcatctgccgccaccacttctccttctgtgattttccaaactgctggagagaattgatgtcggtgtgattgtttcatgagtctgcgcattacaagcataagccgctcgtatcagactcacgaataggagctctgagttcctggagctcaaggaaagtggaaagtgggcaacttatccttcactgtgtgattctgcatagctaaggagtcaatagcagcaatgtcctcagatctgagcaaagcacctctcaagagcagagctcaggaggggagctccgggcttttgtgagtctgacacctgggcactctgatctctgagggtccaaagcttgactgttgtttcttaactccttaggtattgcgggtgatgctaagactacacaaccagattcaatggaaagtactgaaggagaaacggtgcacttgccttgtagccacgccacaatcagtggaaacgagtacatctattggtaccgacaggttcctcttcagggtccagaatatgtgactcacggtctacaacaaaatacaaccaatagtatggctttcctggctattgcctctgacagaaagtcaagcaccttgatcctgcctcatgtcagcctgagagacgcggctgtgtaccactgtatcctgagagtagcacactgtgacagacagggctgcacctgtgcaaaatctgcccgatgggggaggggaagcagaggcatccatttcaagaggcctctgcacctcagtgagcaatgagctcagcaggaatctgagaaaacagtgaagcaccaagaagggatggagaaagagattctgcgactgggcaaaaacagctaatagtagtggaaggatggacatatctgcacggtgacagataccacaatttctagacctgcagtaagaagagatgagaacttcagactttttcctttaatagcaacaacaaaaagcttctttctgtataaacttaagtaaaaattatgagaaaatccttatggagccagggaagtgtccaagcacaagga

SEQ ID NO: 4259 - DNA, 1600 bp, mus musculus
cctggactgggcgaagtaggagtgctgggttctgatgatggtgagtggtcttggttcctgttagtaggattcctacgtttacctttcgccatctggtaatctctggagttagtagttatagttgactctgtttagagattgttctactggtgattctgttaccgtctctcagcagacctgggagacagattctctcctctgagtttcagtgctcagagcactctctgctggcaagctctcttacagggaaggtgcgcagatatcttgtttttggacctcctcctggtcgaagaagaaggcccaaaacagggcctctctcagaagctgtgttgctttggcagatcccagaagctgtcagcttctgtggtgcagactctcacctgtgcggactaaaatcctaagttccagggagtcctggaaccaaaatggtgaccactgctcctgaggctgaggccctctcccgagccaggcggacacctgtcctctggtccggatgttggccggttgtctgcggcccgcccaggctgctgcctcagcggctctgtgcttctgcccgtcccagaagctgtccggttctctggcgcaccctctaacctgttcagactaatttcctaggtcccgcggagtcccggaaccaagatggcgaccgctgctgctgaggctaaggccgcctcccaagccaggcggacacctgtcctctggtctggatggtggccagatgtctgcggcccgcccaggctgctgcctcagtggctctgtgcttctgcccgttccagaagctgtccggttctctggcgcaccctctaacctgttcagactaatttcctaggtcccgcggagtcccggaaccaagatggcgaccgctgctgctgaggctaaggccgcctcccaagccaggcggacacctgtcctctggtccggacggtggccggatgtctgcggcccgcccaggctgctgcctcagcggctctgtgcttcctcccgttccagaagctgtccggttctctggcgcaccctctaacctgttcaacactaatttcctaggtcccgcggagtcccggaaccaagatggcgaccgctgctgctgaggctgaggccgcttcccaagccaggcggacacctgtcctctggtccggacggtggccggatgtctgcggcccgcccaggctgctgcctcagcggctctgtgcttctgctcgtcccagaagctgtccggttctctggcgcaccctctaacctgttcaacactaatttcctaggtcccgcggagtcccggaaccaagatggcgaccgaggttaaacttttatctatgagccctgatacaactaaatgcaagtcacatatttctgatggacagtaggtgaaattatgccccagtatagaggactgccagggccaggaagagggagtgggtaggttggtgagcaggcggaggaggtaagggataggtggtttgtggaggggaaattaggaaaggggataacatttgaaatgtaaagaaagaaaatatctaattaaaagaaattatactacacgaagtaggaaataaaaattcttcataggaaaaaataaaggcattagaatttacatattttattt

SEQ ID NO: 4260 - DNA, 1000 bp, mus musculus
gactctgttaaacctgatggttgctaaggactctgtcctctgaaagtgttggtctgtctgtgctggctaattctttttttgttgttgttttttgttttttgagacagggtttctctgtgtagccctggctgttctggaactcactctatagaccagactggcctcgaactcagagatctgcctcctaagtgctgggattaaaggcatgtgccatcactgcccggtgctggctaattcttatgtcgacttgacacaagctagaatcatcagagaggaaggaacctcaattgagaaaatgactacaagatccggctgaagggagacctgtaaggcattttcttaattagtaattgatgagggagggtccgctccactgtgggtggtaccatccctaggctgctggtggtcttgggttctgtaagaaaacaggctgagcaagccatgtggaacaagccagtgaatagcacccctccatggcctctgcagcagctcctgcctctagatttctggatcaagccagtgaatagcacccctccatggcctctgcagcagctcctgcctctagatttctgcccctgcttgagttcctgcccttatgtcctttgatgatgaactatgatgtggaaatgtaagccaaagaaatccttttctccccaagtgtctttggctaaggtgccttgtcacagcagaagtagccctaagtcactgtaattctagagagtgacaggcttcaatgggatctggcttggtgcctctgctttacatctgaacaacggagccctgtgctgttcctttatagagccttagaatcctcttcaccaggggctggtgtgatggctcagcaggttaagagcactgactgctctttgcaaccacatggtggcttacaaccatctgtaatgagacctgacgtcctctactggtgtgtctaaagacagctacagtgtatttacatataataataaagaaaaatctttaaaaaaaaaaaaggaaaaaaatc

SEQ ID NO: 4261 - DNA, 1000 bp, mus musculus
actggcatcttcaccaccatagagaaggctggggcccacttgcagggtggagccaaaagggtcatcatctccaccccttctgccgatgcccccatatttgtcatgggtgtgaaccacgagaaatatgacaactcactcaagattgtcagcaatgtatcttgcatcaccaactgcttagcccccctggacaagttcatccatgacaactttggcatcatggaagggctcatggccatgattcatgccatcactgccactcagaagactgtagatggcccctctggaaaactatggcatgatggccatggggctgcccagaacatcatccctgcatccactggtgctgccaaggctgtgggcagggtcatgccagagctgaacgggaagctcactggaatggccttctgtgttcctacccccaatgtgtccatggtggatctgacgtgctgcctggagaagcctgccaagtatgaagacatcaagaaggtggtgaaacaggcacctgagggctcactgaagggcatcctgggcaacactgaggaccaggttgtctcctgcgacttcaacagcaactcccactcttccacatttgatgccggggctggcattgctctcaatgacaaatttgtcaagctcatttcctggtatgacagtgaatacatctacagcaactgggtggtggacctcagggtctacctgacctccaaggagtaagaaaccctggaccacccaccccagcaaagacagtgagcgcaagagagaggccctcagttgctgaggagtctctattccccaacactgagcatctccctcacaatttccaccccagacccccataataataggaggggcctagggagccctccctactcttttgaataccatcaataaagttctctgcaccccccaaaaatgaaattccaactgtcacataataatcaaaacaccaaatgcacaaaacaaaaaaagaatattaaaagcagtaagggacaaaggtcaa

SEQ ID NO: 4262 - DNA, 1000 bp, mus musculus
tagccccccacttaactcccacttcttggccctggcgttcccctgtactgaggcatataaagtttgcaagaccgatgggcctctttttccaatgatggccgactaggccatcttctgatacatatgcagctagaaacacaagctctggcacaatctgcaaattcatctggaataacaaaaaacctaggatagtgtttcctttttaaaggcttctacctgtttacctgtgttttcctgtatttccttaagggagttatttaagtcctctatcattatcatcatgagaagtgactttagatccgagtcttgcttttctggtgtgatggtgtattcagaacttgctctggtaggagaattggattctgatgatgccaagtaatctttgtttctgatgcttctgttcttacacttgcctcccgccatctggttatttgtagtgctacctgccctctctatatctgactggagcctgtccttcctgaatcctggttgagtcagaactcctcagagttccgttgtctgtgtgatcctgtgattctaggatcctgtgatactgagattctgggtgtgtcagagttcctgggagtcaagctacctcagagaccctgagatcctggtgtgaccaagctcctgggatcctgggtatgctagagtgcctgggagtggagcctcctccgggggggctgtgggactgtctacccagtttgtgcccaaggtaaaccagggctgactggagggaactcaagccattgatcaaggcagggttcttgtgtccttggatcctgctggtcccagttactcccagtggtgttgggacagatgtcgtgttctactcacccctgatcctaagattctgggtgtgttcgagagcctgggagtagagcctactttgagggttatgggagtggccaccgagttcgtgcccaaggtaaaccagtgcagaccagaaggaaccaccagaaagtcttttcatactcaagtgtttcaggttttttttttc

SEQ ID NO: 4263 - DNA, 1000 bp, mus musculus
tccctaagataatcaataaggtggtgagaccagcattgagactatgtccatcagtcacttacaaaaccacggggcgctgagtgtggtggtgcatgcctttaatcccagcactcgggaggcagaagcaggcggatttctaagtttgaggccagcctggtctacaaagtgagttccaggacagccagggctatacagagaaaccttgtcttggaaacaaacaaacaaacaaacaaacaaacaaaacaacaacaacaacaacaacaacaacaacaacaacaacaacaacaaaaccaggggtagaaggagctggagcagccagacatgccttaaccacactgtgtgcagccagacccccttaaccacactgtgtgcacccagacccgccttaaccatactgtgtacaaccagacccccttaaccacactttgtgcagccagacccccttaaccacactgtgcaagccctccaagctgtgctgtcccagctcagccaagcagattggcttctccattgctctgggctgttggcaagcagaacgtggtgatgggaacacatgataagaaaagctgctcacaattgtgataaaaactgcatggtactggtatagagacagaccagtagaccaatggaatagaattgaagacccagaaatgaacccacacacctatggtcacttgatcttcgacaagggagctaaaaccatccagtggaagaaagacagcattttcaacaattggtgctggcacaactggttgttatcatgtagaagaatgcgcattgatccatacttatctccttgtactaaggtcaaatctaagtggatcaaggaacttcacataaaaccagagacactgaaacttatagaggagaaagtggggaaaagccttgaagatatgggcacaggggaaaaattcctgaataggacagcaatggcttgtgctgtaagatcgagaattgacaaatgggacctaatgaaactccaaagtttctgcaaggcaaa

SEQ ID NO: 4264 - DNA, 1000 bp, mus musculus
ccggagctcttgactctagctgcatatgtatcaaaagatggcctagtcggccatcactggaaagagaggcccattggacacgcaaactttatatgccccagtacaggggaacgccagggccaaaaagggggagtgggtggctaggggattgggggtgggtgggtatgggggacttttggtatagcattggaaatgtaaatgagctaaatacctaataaaaaatgggaaaaaaagaaaaaaaaagaaaagctgctcacctcacaatggccaggatccagacgagaagaggccagcctcccagtattcccacccaaggacacacccagtggtctaacttgtttctaaatggaccccagcccttttaaaacaaatttgttacgtgtgtgtgtgtgtgtgtgtgtgtgtgtgtgtgtgtgtgttacttgagtggaggtcagagaacaacttgtgggagctggttctctccttctactacctgggttctgagaatcatgttcaggtccttgggcttggtgtcaagcccctttctttaccctgagccattaagattccacctcttaaagctcccatgctccttcctaaataactccacaagctggtcaaccaacactctgctctatctcagaagaaaatggggaagttggctgtggctgcatatttaatcagcttatacagagaatgttgcccgggaccctctcaggagcagttcttcctccctggccaatgtaagcagcagcctccaggggtttgatacactgactacgctttatctctgggttactttacagtccttctatacgtgttcacctttcaccatcctgaagccattctaatctcacagagatgttctagaactttctctctgctgtacatttatttatattttcattttatgcacatgagtgttttgcctgtctggatgtatgtgcactgtgtacgtacttggtgcatgtggagtttggaagagggcaataaaaatggctgtgagctgccacgtggg

SEQ ID NO: 4265 - DNA, 1000 bp, mus musculus
aaatctaggactgaattattttaaagtacaaaagaggggccttgaaagtaacacacagtgacacacactccagacgctgatgacaaaatgtgggggcactgggtgtctatgagtggttacagtgttcctggtctctccttactctccagtgatggcgatggttaggcttgctgaactggaatgctgtccttgaatccatccactacacctacagcagactcaaagctacacgggctcagacaccagggaagcagtcactaggtacaccacacggtggctaggattcctagatagtgtgaacctggtaatatagaccatgcacctagaagacggccaaggcaggacattgcatccagtccaactgcatccaggatagtttctcaagctaccctctcatactcagtgttaccaggtagttgaacatttgtagcacaataaatacaattaggtcagaaatttgatacatggggttttgaatgataagctgagcaccgtgggagaactagagagctctgagtgtgcccacagtcttttttcccagcccagaactttgtagctcaccagctgaaacacatcatccattcatcacgaggcacatggtcacactgccactgtattaaaggacatgaaagctgaaagactttcccagcagcacttcatgaagggtggctccctggaactgtgattgatggatggtgaagaaggggatggatctccttggaaagtcgtgagtgtccaggatgtcctgaaggagtcctggggatatacgctatacaaaggaaagtagtcacagaaggacagctttgtaggatgccactcacgcaagctctacacaacagtctacatcacagagacgagaggatggtgggcttcgggagccattgggagggtgatgtaagctgctattcactgggtacagacttctgctttcacaggatgaaaagagctacgggggtggacactggtgatggctgagcaaaatctccactgtgcttcatat

SEQ ID NO: 4266 - DNA, 1000 bp, mus musculus
accacatcactttcagaatccagatagtgagagcgagattcacaacgaggatggcgagcaggagaagaacgaataggtataggcagcgcttcctccatccgtaaatgccaatcttgtagatgtgctggttctcgggcctctctatgtgagtgccctcggtgaccgtggtgtactgttctcgaaccatcttctagagaggggaggagggagggaagagaacttagtggtcagtaccgatatatcatgagtctagaaaacaattttaatccaaaccagaagccaggtatggtgtgtacacctgtaatcccagagctcagagcggggaggggaagagagcagaaggttcgagggaattcttggtttcatagtgagctcaaggtcagctgcataagtctctatctcaaaagaagaacaagagagagaggggggggggaagaagaagaagaagaagaagaagaagaagaagaagaagaagaagaagaagaagaagaagaagaagaacaagaagaagaacaagaagaagaacaagaagaagaacaagaagaacaagaagaacaagaacaagaagaacaagaacaagaagaacaagaagaacaagaagaacaagaacaagaacaagaacaagaacaaaacaagaacaagtacaagaagaacaagaacaagaacaagaagaacaagaggagaggagaggacaagagaaaaagaaggaaaagaccttcctccagagaagcacggtttgaatgaccaggtaacatacaatataaatagttttactaaagagctgattttgttgtttgtactgacaccaaatgcctgtgaaaagggaccctagaagttcagataatgagcaccactgggcagaatgccaggtacccagggctttggggtcacacaaagtggaactcatgttggcaaaagatcatgctgatctgaaaacacagagcgctctgtgatctgtttatagccttatacaacggtaacagagggagtgactattctg

SEQ ID NO: 4267 - DNA, 1000 bp, mus musculus
tatactcttccataccctttccattctctctctcctctctctgtctcaggtgggtgaagtaaagggacttcttcttttgcaggaagatttctgtagacaattcctcatccccttcccaatgcctgtattctgtgctattcaatcaatacagagcaaagccctttgttagggacagactcaaggacatggacagatccagacattcagacacatgtagaccagacaggcagcagggacaaatcagacacacacaacaggcagactacagataagccagaccacggtgtacagatggaagacagagagagactaatagagagctcaagattgggctcactcttggtccaactaacctaaaggaagtgtctctgctttcatcccataaagctgaggttatcttgaatgcactaacagacatagttaaggcctagagacagagggaggattgcagctaccagggaagtattcttaaatacacagccctcactggcaaccccttatggaccactatttttatttactctactaaaaattccttggacattcaacaaaatatttcatttcagtctatatgttttagatgtaaaaataggattcattttaaaaagttttggattccaaaccaagttaattcaaactgagggagtttaatggtcagccctgagagatgtctgtacataaacgggatcgggacagcaggtctccaagatgccaaggaccacacttcccttctcttctggataagcagagtgccctcacctgatatgggataactaaccacggctagagtgctattcaagactagccaaagggtcagagatcagctggactattcccagggtaaggacaagccacatggttctggaaaccattcatgctgactagccatgaggctaatctatatatagactcataggcaaatggtgactcaaatactatttgtgatgtttaaataccatcacaagggaagaaaactgcattgaaatataagacaatttaa

SEQ ID NO: 4268 - DNA, 1000 bp, mus musculus
accctgatacccaaaccatataaaggcccaacaaagaataagaattatagaccaatttcccttagacatagatgcaaaattttaaataaaacacttgcaaacagaatccaagactatatcaaaaagaccatccgcaaaaccagactcaggttctttgcctcaagccctggtcaagctttcctgaaaaattttcactccctgtctgtcctggcattcattcccattggaggagaaactgtggtactggtagggaaaccaaggcccagaggtgggaaagagtagtgagtgatccccactatgactccacagagcccaggcagagctatgccctcctgttcaagggttccaggctgggggacatggcctaccatttcactttcaatgataacagctgcctgcagctagcagcttgtgtttttggctattttctctgagctggccctgtgcctaggctgcccccacaccgaatatgactgagggtctttcccaagccagcaccattcaaatttgctctacctggccttactgcctcggtgctcaggtaagcaaatggccttcatgatgagaagctattacaggtgcctcaagatgcccctgtcctgcaggagacctgtcccctcaatgctgtggatggcctaggtaacttccaacccagatccaactctccttcatagctgctggagtcatcctgcccatggaggctttgggtcatgtgagcctgcagctcagctcctgtcctttcagtcttgcaattctttgtggaatatgaacggcccgtggactttgccacgtgctccattggcatgtatctcttcacagagaagagatggtgttctgggcccagcccaggagaccaacattgctgtgttatggtacctgcttactctggccttcattttgggactcagcaggctggcaaatgggactcaggcccaaccttccctgtccctttaagttgctgtctgtggggtcacccactgactcataaatctgccctaga

SEQ ID NO: 4269 - DNA, 1400 bp, mus musculus
ctgaagacccagaaataccactcttgggaatatacccaaatgatgccccaccatgccacaggggcacatgttccactatgttcatagtggccttgtttgtgatagccggaagctagaaacaacccagatgtcccacgacagaagaatggatacagaaaatgaggttcatttacacaacggagtactaatcagttattaagaatgaggacatcctgacttttgcaggccaatggatgaaactaggaaaatatcctgagtgaggtaacacagatccaaaaggacattaatggtatgtactctctaataagtgatattaggagagagagagagagagagagagagagagagagagagagaacacataactcaaaaaggtcaacaggctgaaggacccaagtgaggatgcctcagtcctacttgggagggagaagaaagcaaccacaaggggggagggagagagctgggaggggagggggatgagagggcggagtggagaacatgattgggtattgggtggggggaaaggactaaaatccctgagggccagcagaaagaagggaaacatgaaaccttgggaggtaggaggtttggggggaccctccagaatgtaccagggacccaggaggtgaaagactctcagaactcaaagggaggggccttagatgaaataccctccattggggagagggaacttgtaaagcccatgtccagcagaaagacagcgcatcaagtaagggatggggttgccttctcacagtcaaaactctaacccataattgttcctgtctgaaagaactgcagggatggaaatggagaggaccctgagaacaagaaggtccatctacaggcccaaagtgggatccaggtcaaggaggccccaagacctgacactactattgaggctatggagtgctcacaaaaaaagggacctgtcatgactgccctctgaaagacccaacaagcagctgaaagagtcagatgtagatatttgcacccaaccaatggacagaagctgctgacctctgtggttgaattaggggaaagctggaagacgatgaggaggagggagaacctgtaggaggactagtagtctcaattaacctagacccctagatctctcagatactggaacaccaaccaggtagcatacaccagctgatatggggcccccagcacatgtacagcagaggactgttgggtctgggtttagtcagagaagatgcacgtaaccctcaagagactggaggccccagggagtttagaggtctgattgggtgtgggttgactgtggggacatcctcgtggagagagggggaggggaggaggtatgggatgtggaacagtcggaggtagaccaggagggaaataaaatctggaggtttttttttttcttcttttta

SEQ ID NO: 4270 - DNA, 1200 bp, mus musculus
cccattgcatcctgtcttggtctctgctaattaaagagagagatgtaaagttctgttgtcccctctggccaccttttatatatcaccggaatggagagacacagcaaaggccagacatggccactattgtgtctccaggatggcctctctcccacacctttcccattctttttggaggccatcccaatgaggattctgcttgtccacacacaggatcccctggccctgaaactccagctctccacccttctagctccaaacacctttttgtccaaagtcacaatggcatctctgtctgtactgccacacagaatgtacagcagtttgaaagtgacatctcctgtgtgccctgccccagtgtagccctttcagctctggttacccctgacaactgaggtgaaggggggacacttaaagaaaactcgcaagaaaagcaaactgaattcatcttgttaaaatcagtgcgtgtaaactggtctttggctatttcagagtgtttgtgtaagacactgcaaagtctcgccggcctaggcttcttgatccagcccaggagtcaaggcggcttctgcgggaaggtgtggagggtagcaagttcagaaacctgagcatcaacttctcctcctcattgcttcctttgggaagtaactattaacctcccgctgtacacctggcatggtgtaagacccagggacactaagaatcgaaacagactccccactccatcccctcatgaagtccgagtgtcatataaacaagtgacaagcaaatatttaattttctctcttagagagtgttgtgtgtaatgaagccagggagggatgggaaaggcagcagcgcttcttgcagcttgcagtggagttgtaaaagacgattcatgaggtcagtaggtcaccttgaggccaagaagtacaagggagagaaccttggcaaatacagaaaaaggtgtcgcagaattgaggaggatccagggctgagtcctgagatcaagcgtgcttgcagaatctttaatgacgtttaaacttaacagcaaaggccaaaaagaatggggtcacctcagtctatgtccctggcaccccagggttctcatggggtaggtgggaagctgtgcttgcacagatcagctctgtggtgagagtctgcagagagaaggcatgaaatattgctgctgaagtccactggactagccgctgggaagggcgc

SEQ ID NO: 4271 - DNA, 1000 bp, mus musculus
ttggactctggccccgatgtcagagctgggctgagtgtaaacgccatagtgagtgctcagtcaggccttgctctcagaggcactgtcctcctcttttctcttggaacagcatggcttcagtgacattaaggtggaagacacagccaagggacatattgtcctgctgcaggaagccgagacactcatccagattgaagaagactccactcacatcatctgtgacaatgacgagacactgagggtccgactgcgggaccttgtcctcaggttcctgcagaagttctgagtggcatccgtgacatcctaggcccttcacccagagacagtctggtggtgtcctatgacttccggagaggagaggtgtctccagctaggatctgccagtgtgacttcctcgtactgctgaccccaagaacgtttagaggcctgttcttttcagttctgggctcctgagcagctatgggtgacaacatgacagacatcctttcctaagggaaatgaaaaaaaaaaaatgcctggcctgtgtttttggggctcacagggggtgactctcggacttaccctcctacagtgctacaccgtataaaggtcagcccccaaattagaaggcaaacctatctcgctgttctgtggcccgttttgctaaaaataaacattatttttataaaagtgcccagttctattgcactacagtctaaataatgacttagtatctgggggaaaagtctgcagctacactcagcagtgaaaacgccacagcacatctgccacacctctgccctaatcattaaccctgtctgcagaaatgcagatgcacccagtgctggaggctcatcctctgacacagcaggctcgtggcccccctgggctcataagaccctgtctcaagaagcagaaacaacctggcaggcagttcatggccttttaatcccagcacttggaggcagaggcaggcaaatctcggagttcgaggccagcctggtctacagagtgagttcta

SEQ ID NO: 4272 - DNA, 1000 bp, mus musculus
tcaaattctggggggaagcagggtgaggcaaaatgatggcgcttgaagaggggcgagggtgggttcagggcatcatttttgttccagatgagtgggatatgtcggaggttcaagctgagttatttcttcattttaaaaaatgtttggttttgggagaggaaggtttactggagctcggcttcctctggggctgctctgactgaagaccctatttcagtggatgaaactctgtgaaattttcatctgttcttgttgtatttgcttttcgggactatcttgtctttcttccttagttctgtgcagtcttgctttttctctcttggccctaaggatacagtgagatcatcccctcttccttgccccgccccaccctgaggttagcctaattctaactggctcagcaactggctctaaggcagaggatgcaagcttgcaggactgccacacccaggctctctgatcttgaccagtcacagctagcccccttcaggctcagcccacagccccagccaggagttttagcatcccctcacccccacatatagggatccagagctttgatgtccgtctgatagctgtgttcccacgtggcagcgctgtctttgttttatatctcccaggaaaattatatctgcccaggtgtggaggagcctcattgtcctcaacctggacagttcttggggagactttagaggacaggtcagacagctttaggtcaccctctgaagaccccaaacagggataccctataccccaacaccaagcagcagatgggatgacctgatggtgacctgctggagttctgaggggggaagggtagagatggaatgtgtgggaatctgtctcccctaaggttgggtcctctggggggtgggagttctccctcagatgggtgcttgggagatgagatcatgcaccagatgtggaaataatgatagtggtggagggaagcaaagacaaagggggcaggtcaatgtaaagccagaaggcagccacagcc

SEQ ID NO: 4273 - DNA, 1000 bp, mus musculus
gacacggggacccaagtctgggtcccaagaacacatgtcaaaaaaccactgtgcgcggtgaggcacacctgtaactccaccctgcaagatggcagcttattcttagaagtttgctggccaatgaggactggcacccagaattgttctctgacctccatgtgtgcaccatgcacatgcctgccagcaaccataagcacatgaatacacacacacacacatgtacactcacatatgcatgcacacatgtgctcatacacacaggtagacagaatatcttttaaaggaggaaagggaatgaagaatagttgtgattaaataaggacttgaatgaatttttaagtagttctatgtgcctcctgcaaaaaacgtaattcaaaatgaagggcacaaacagataaaatttcaaaatggcgccatgtgtggggttgcacgtctctcattcccatcacttgggagatggaggcaggaggctcaagatcaaagtcaccctcagccaacatgactaatttgaggtcaatctaggctacaagaacctttgcctcaaaaaccaaaacaacaacaaaaatgtcaactatcctaagtctttgtagacactgcaaagttgagttttctcagtctgttctactgaaatcgaagtctcctggactaagggtgggttgtctagagcagtcttgactaaatcaaaccttccagtgttgtcatttaaatagtaacctttctcacacgctcctaacagctgactttcctcacagtggccatagagaccacggagttcaagccattggagctaccaagatcacaatccagccagttgtagcttaacaggcagttccctgctcaaagacaatgggacacaatagaaactgtcaagtagcggctgactggtttctggtcaggcagaccagccttggaaagtcccaggtaaaaaagaaaatctggcaaaaccaaaccaaaccaaaccaaggtggataaaagcttcggttgtcctctggcctctgtc

SEQ ID NO: 4274 - DNA, 1000 bp, mus musculus
tctagactaagaccaacttcacggaggaaaacagattctagggagtcgaggttgtgtgaggtagagagtgccatgtctacagacttggtgctcatggccacggtgtggatggagtcactgagggtactgtcagacatcccattgacccggtttgcaatgtggtcagtctccatgaccataggaagctccagaccattcccatgaatgggcatcacaccaccatgtcctacagtgtctgctgtaaggctgttgctcacagaatccacagagagaggctcatgacttctggagccacttgggatttgggaatgctctcctgtaacaccgtccattgtaagctcctctgccattccatctgtggagattgggctggtaaccctagaaacattctccatagtgattgttgtgtccaatgctacttcatggccttcattaggatgaagactgtgggtaccatgtgtgtttacagagtgagagtctattgaaacaatgtctagttctaatccaacacttccattggcctgatagagatctagtgctgaagggttgttggtgatacataatgctgtatttccatcaacatttatagagttgggatggatatactgaggaggtggtctgtcagctaaataagataaaatgccaggtagaatggttctgaagtatctgctttctaggtgagggtaaggtggtggaagtagggtatagtttctttcaggtaaaccacacattacccacggggagcatcagagacaaggcagaaggcagagagctcagggacagaccccaggtttggaattgccactggaagtcctggggtagggatggcactgtgagaagaagaggcagccaaacccaggtgacttcctgagcctggcagggcattgctcacagaggatgaagacagtagctccatccccactggactcaaattcctgttcttcatcctgcgagttcagggtggggggcgggcgtctgataggtgcgctctggggccgat

SEQ ID NO: 4275 - DNA, 1400 bp, mus musculus
cagtactccggagacaggcatatctctcagttcaagaccagcctgttctacagagcagagttccagggcagtcaaggctgcatacataaaccctgtctcgaaaaactaaaaaaccaaagaagcaaaaaagcaagcaagcaaccaaccaaccaaacagaaagacggcggctgcattctgtccagtcacagtgaggttctagtgcaagacaaggttctagcatccaggagagtaatgagcaacagacacacagatccatgccttcaagaccccgggtgtgtggcctcctaggttttgtcttatggtagcttttgacagttattaacggagtacgtaagctggagcaggtaagaggttctctgccacttttgtctgtgccaaggtttgcattcaatctgcgggtccaattctccaaggagcccaggctcctcaggacatgggggaagagcattggggcaggagtcaggtagacgctttgtgtctcaaagcaaagaaggccacattattgattcctcacttggcacttgacgcactcatcccgaatgtgcccagcagggggcagtgccagcctgtggaaactgcaactagggactaagcttgcgaggcgcggtgggtgcctggtcctgagggacgaatttctctacctgaaggatctggtggtgaggggcagcttcgggagtcttccgaaccttgggattcccctccggaaatgtgaacacgctttcaaaatatgggatcctgagccgatccctatctctttgcgcccttcaccttcaagagacagaactttctggttgctctactctgagatcacgtgatctcaccaggggacgtggtggacagcttgattggggaaaagtggggtgaggggttggtagctgcggaagtagagcatttggggaagctgggagtggcaatgaaagtccttagaaggctgttggggaaatgctgactaggtttttagtgtcctcggaggaaatgagccagtgggtgtgccccattctgcagggagctctgaatgcctcttagctagctttagctgtgtctgtgtcaccgcgatgtgtgtgcatcattcatccagtaatactacagagcaactgccacttgtatgtccctctctctcagaagctgggattccggaaggttccccagcccctagccccaactcaaaggagcaagcagtggggagcagcagaggcggtcactgatgggtcagggagagaagcgcttgagagcaccacagacagacacactgaggcaaggcctccttcaagagccgctgagccacccaggcggccaggggaaagtgcacaggcaaggaaggaaacagacctgccattgtgggcccgagcaaaggatttacaaagaccttgccacccagaatgggtctctggctctaggc

SEQ ID NO: 4276 - DNA, 1200 bp, mus musculus
cccgcggaacgtgaggcagaagcctcacggactgtgcgaacacctgtgctctgaccaggaagatggcagattgtctggagccgaaaatggcgccgtctcagaggctctgtggctctcgcctgttccagaagctgctggcctctgtgttccacactctcacccgcagaccgcccgcctcggattcccggaaccaaggtggcccccacggaacgtgaggtagaagcctctcgggccgggtggacccctgtgctctcaccaggaaggtggccggttgtctggagccggaaatggcgccacctcagaggctctgtggctctcgcccattccagaagctgctggcctctgtgttccacactctcacccgcagaccgcccgccgcggagtcccggaaccaagccacaattttctaattaataattcaaaatagagaatttgagtcttataagtagaaaaattgtgagtacttgtattaattatttaatttatttacatttcaaattttctcccccttcccagtctacactccacaaatcctccatctctcccccatcccttttgcctctaagggatgctcctccactcacccatccactcctgcctcacccctctagcattcccctacttggggcaacaagcctccacaggaccaagcacctcccctctcattgatgccagataaggcagtcctctgctacatatgtagcgggagccatggactggcccatgtatactctttggttggtggtttcgttcctgggagctctgatgggtccagttagttgatactgttgttcttcctatggggttgcaatccccttcagctcctccagtctttaccctaactttcccattggaatccctgggcttagtcctggtctgtgagtatctgcatctgtcttaggtgctggcagagcctctcataggacagccatattagtctcctgtctgcaagcacttcttggcagcagcaatagtttcagggtttggtgtctgtggatgggatagatcccatggtggggtggcttctggaaactaaaaacaatatactttgaagtttttaattgtgaggctgtactgttaacatttaacgtaaatgggttggtgtcagaattataatctaggccatgatggaactttgcatataatttcacctatcaatgaacataaacacttcacagttgttagtcttctctagatgtc

SEQ ID NO: 4277 - DNA, 1000 bp, mus musculus
aatgccccctggaactgggtgaaagattgctgacttcattgttgtttcaaagatgtatgccttgccttcctttttaagaagcacttcacctcccttgcaggactactcccctcatccctgagagtgaagcagagaagtcacagagagatatcaaagcctgccctgggagcctggatccctccttctttccctcctcctgtgcctctgcagcccctccctcccactgtctctctttattctgatcactaaccttttcttcaaaggctgctttctggaagaggaattgtgcacactttgtctcaaacatgctgtcttttctgttaacagcagccctgcaccaaaagagatcaaaaggggggcagagagaaaaggaaaaggatcgcacccccagagttcataatttaaccctccccacccaagaaagggggttctgggagaaatggggtatcactcaccctccctggggctcaagttgctgtgggttcttattgtttgtttgtttgtttgtttacattccaattgctccccctccccattctcccctcacaggatccctccccctatcctccctccccttatcctctgaaagggtggggctccaccatatcacaaggacaggagctctactatgttcatagctactatgatttttgtttcttattctagctgtcaagctatgcttgccaggacttttggtgaccctatctgaggtgaaggaggagtgggctctgccatcctgggttcccagctcccagccctgccaaccttgtaatctctgatccactcagagttgttttttgtttttttaaactctgctgtcaggtctggttatattgctggaagtgggttttttttttcccattcctgttttcccacggaatccccttgcagcttgaaggccagaagcagaatgtacctgggcgaaagaataaatttgacaatgtgattcccagctctgggagagagagagcctgagacattggggatgttgggagttgtg

SEQ ID NO: 4278 - DNA, 1200 bp, mus musculus
tacatttacattgaatctgaacaaagaaatagccaaaatgtggttcacacttcctggtgaatatttggaatactaaagttaaaaccaaatcatcttgcctgagaataaatggggttaaggcaagcacggtggcatatgtctgtaatcccagcactcaggaggcaaagcaggagaattgtctcaagataggctgataaccatagcaagttcccactagccagggctgcatagcaggaagtggtcttaacaaaacaaaatacaataaaaagtagttttaatgtttttaaaaatggaattgcaggatgtaaatacatcttgctacttagactcactgtacttctctcattatcctggaacaactgtccaggattgtaaaaccccagcatcttttctatgcctcactgcatttcttagaaataaagacttgtacaccattacaacccatggaactaattgataattcactaagtatttttcttgcctgttttttattaaggcttttcagggatatgcattccttttaagaagggaaaaagagaaatatgcagcctcagggggtgggaggtagggggaccctctagaagctaccagagacctgggagttgagagactctcagtactcaatggggatgaccttagccaaaatgcccaacaacggggagagggaactctaagtgtccacctccagtagataaacagggcctcaagtggagggatggggttacaaacccagaactgttcctgtctaaaagaactgcagagaccaaaatggagaagagtctgaaaggaaggcagtccagtgaatgactggcccaacttgggatccatcacatggtggggcaccaaggcctgacactattactgatgttatgatgtgcttagacatgggagcctggcatggttgtcttctgagaggcccttccagcagctgactgaggcagacgcagatacttatgcctaaccattgtactgaagtttgggacccctatggttgaattaggggaaggattgaagaagctaaaggggagggcaaccccataggaagaccagcagtctcaactaacctggtgtccagggaactcccagagaccgagccgccaaccaagcagcacacacaggctggtctgaggcccttggcacatatacagcagaggactgcctggtctggcctcagtgggagaagatgtgcctaatcctcaa

SEQ ID NO: 4279 - DNA, 1200 bp, mus musculus
agtatggaaagtcaatttttatttattctgtgacgaggcagtttgctttaggaaggctgcctgaggtaatttatagaattctcagaaatggagttccttgaactgcctggtttgttttttttttttcccacagatttttgtgcttggcacaaactgcagtggctgtctgggggtaggcgacattcagagcactattgagcctcggagactggattctctaactggcaaaaaaatagccagcctcagctatgggagtggccctcatatcgtccttgcgacaacaggtaacagaaactcaaaggacaggtttgaagcattgcttatttgttaagaaataagaccagtatgccctgaaattgagagcaaactctctgattgagcaagagtggctggctctgccctgtgagcttggccacgcgttgggcaacatgaagcaggacggttctggagcaatggggcaaggtggtaggtaacacacggggcctaaacggctgcaagacgatgcacaaagcccttctgttctcagagtggaatcattgcgtgacaacgctacttattttggagcttaggaagcctacactttgaacttagattcctgggctgggaactgagagaccaaatgttcattttgccagccctctaaatcttagcagtctgtgcttctttcattaagtagtggctgataggagaagtttgccttagcagtggagcgagaacagtctcttggctacgtcaccagaatttaatcacgcctttgagatgtacattccaggaccttgggaggggatgccaggataggcccgattattcagaccatttcttagttaaaaaacgagctcaagcctgaggctggagggatggcttagcagttaaggaaaggtgaagtcaggtaaggatagggtcaagtaagggtagaggagacctataggctgttctgctgttgagacacctacctgcctagctgatgctgagctgtggtttgtacgcttgaggtagagggttacaggttacaggtagctggagtggaataggagatttcctataccctgggactgcaaggccagaccctcagcacaggattggcctcttcctaagggttgaacaggagactttccttggtgaattctaggaaggaaaaggagaagactgagtaaaaccatccctgaattcgcagctatagatctgtgtcacattagactg

SEQ ID NO: 4280 - DNA, 1200 bp, mus musculus; identical to SEQ ID NO: 4279

SEQ ID NO: 4281 - DNA, 1400 bp, mus musculus
gaaaagcagtttgtaacgtaccctgctggcttactccttgcgcttttgcggtgtcgtccgcgctggtgtgaagatgctggccgtcggctacgcgataaagggaggcggctccgccccgaaggcccaactgagtaattgcggccgcgagcggagtctgttctgggtcgccgctgtgccgcccctgtgttggcgagggaggcgtgaggaggagccaggcgtctgcagccgttctcgccctcggcgccccgccgccatctccaccatgcagtcccgggaagacgccccgcgctctcgccgcctcgccagcccccgcggcgggaggcggcccaagaggatttccaagccctcggtgtcggcctttttcacgggcccggaggaattaaaggacgcggcccattccgcagccctcctggcacagctcaagtctttctacgacgcgcggctgctgtgcgatgtgaccatcgaggtggtgacgcctggcagcgggccgggcacggggcgcctcttctcgtgcaaccgcaacgtgctggcggccgcttgcccctacttcaagagcatgttcacggggggcatgtacgagagccagcaggccagcgtgacgatccacgacgtggatgccgagtccttcgaggtcttggtggactactgctacactggtcgcgtgtcgctcagcgaggccaacgtgcagcgcctgtacgcggcctcggatatgctgcagctggagtacgtgcgcgaagcctgtgcctcctttctggctcgccgccttgacctgaccaattgcactgccatcctcaagtttgccgatgcctttgaccaccacaagctgcgatctcaggcccagtccttcatagctcacaacttcaagcagctcagcaggatggggtccattcgggaggagacgctggcagatctgaccctggcccagctgctggccgtcctgcgtctggacagcttggatgtagagagtgagaagactgtgtgtcatgtggcggtgcagtggctggaggctgctcccaaagagcggggtcccagtgctggggaagtctttaagtgtattcgttgggcgcacttccctgcagaagagcaggactacctagaggagctactgagcaagcctattgtgaagaaatactgcctggacattattgaaggggctctccggcagtttcgttttgatgatggtctgcctaaggctttggcacagattccaagcaacagcaacaatagcaatagtaataataatgacaccagcaacactgttgtcccagcagaagaaaatccaccccataggttagggatgtgtgtgaagagaatgatggttttctgtggacaccccaaacatcactttttctgctttgacccatactctgaggaaatttacaaagtgtccttgcctgtga

SEQ ID NO: 4282 - DNA, 1000 bp, mus musculus
agtcccccacaccctccctcacccacccactcccacttcttgaccctggcatttccctgtactgaggcatataaagtttgcaaggccaatgggcctctctttccactgatggccgactaggccatcttctgatacatatgcagctagagtcaagagctccggggtactggttagttcatattgttgttccgccaatagggttgcagatcccccagctccctgggtactttctctagctcctccattgggagccctgtgatccatccaatagggtagctttgttttgtcctaagtcattagtaaggtcttgtagtgacttcttcatattatttggtctctctgtgtgactgagatcagatatctttttcttataaagtgagttagtttctactttaattattgaattttaacatgattttctctaaaaaaaatgacattctgtggaattatgaactttacttcaacatatagatttttttccccagtggggacatacaaatcaatcaaaccaacagtatcaccaaagggggaaacaaatacagtcaggcatgtgaaaatattcacatatctcacccagcatgttatatgtgtagtcagatggagtgggaaggttgtcgttagtactctacagatgattgtcttgggtggctttaaatgaaattggaagttttcatcactttcttatactgccatgagcgtgaacgtggcagctaaggcaatagatccactggtagggttttacaaaagggtgtgattagaagcagcagattttaggctacatgagggtacccatccactagacaatgaaaaaggaacaagagatgaagctgatataatgcttttctggggaggtgtggtatcggtggtggtgggagacaggaaaggagtgttatctttaagcatcataaaatcctgctgcattttgttccgagaattgtaaagagactgagcccaagagtaggcaagagtgagtagggctcattgcagagatttaggcaag

SEQ ID NO: 4283 - DNA, 1200 bp, mus musculus
cacttacaagcaacatattttgggatagccctcttactccagttattcaggacccacatgaagaccaagatgcacatctgctacatatgtgtgagaaggcctaggtccagtccatgtatgttctttggttggaggttcagtgtctgagatccccatgggtacagtttagttgactgttggtcttcctgtggagtttctatcccttccaaagcttacaatatttcctcctattcttccatgtccccaagctccatccactgtttggctatgaatgtctgcatctgtctgagtcagatactgggtggagcctttcagaagacagccatgcttgactcctgtgtggaagcataacagattttatagtgttaatagtgtcagggattggtgcttacccatgggatggggctgtaataaaaacaaaaacattgggaattttgcagaccaatggatggatctttagtgatgtaatgtagttctagaaggatatgcatgttatgtactcacttataagtgaatattagccataaaatacaggatatccgtgctacactccacagacccaaagaagctaaacaagaaggaaggcacaagctaaaatgcttgaatctcacttagaagggggaataaaatagtcatgagaggcaaatggagagagggaactgggagggagaagagatggggaggagattggggagttcaggatcaggtgttaggaatgattgaagggataaccagatggccatgggaatggatagaaatctgcaactgatggggtggggcagtagggggcatcttcaggatatcacagagacctgggataagagaggtgctcaagaatcaatggggatgggcttaggtgtagctcacagttggggatatggagcctgaagagtccacctcctgtagctaggcaggaaccacaatggagacatagggacaccaataccacccacaaaattagaaatgtaaggacagaaaatgcagaaacagagggaatggccaactactaaccgaccataccactgttcttgttagttcctatttgttggttgctgtccatgtcaccaacagagaattttatttgggaaaccatgcattttatcataatcatgaggctttgtgtctgagctcagttccataatttcttggcacaacttcatttcagactgtatttcattttaccaacccatcattttacca

SEQ ID NO: 4284 - DNA, 1200 bp, mus musculus
gactctgctggcaaggtagcccggggcttgagccgagcgggagggtgtcagtttgttttcatttgttgaagttctattgcaattcttgttataatttctatttctttattaaaatgccacatttgtcattataacattttaaatatttaattgaaacatcatttattcttattctttagttatatttattgcagaccttctgtaattgtttattgctatatcaaatattgatttccagttagattctccctcaattgagatatttattctttttttttaaatttaattttattttttaacttattcactttacatcctgctcactgctcccatcctggtcagccactcacacaatcctttccccctcctgttctcatctggctgggtgggggctcccttgagtacccactacccccccccacaacactttcaagtcactgataggctaagtgcttcctctcctactgagaccaaacaaggcagcccagggagaagaacatattctgcatacaagcaacagcttttggaatagctccctttccagttatttggcacccatatgagggtgaagctgcacatctgctacatatgtgtggggaggccagggctagtctatgtatgttcttttgttggtggttcagactccaagaaccccaaggctccaggacagttgactttatttgttttcctgtggagttcctatcctagtcagtgtctgcaatccttcctcctatcttccagaagagtcctcaacctccatccactgaatggctgtgggtgtctgtgttttcctgagtcatccactgggtggaggctcacagaggacagcatgcttctgtctgcaagcacaacagagtatcattaatagtgtaaagtgttggtgcttgcccatgggatgggtctcaaggcaggctggttattgctggacaatacctcagtctctgttccatgtcctgtacctgcatttcttgtagacaggatgaattttgggttgaaagttttgtgggtagattgatttctctattgttccactagggttcctgcctggctataggaggtagtctcttcaggttccattttctcaatatcaggagtctgtctaactcattctctcagaaggtcttttgctttgcacaaaatatgatatagaaatactaaaaatatttattgaaaaaatacaggtaaattaatctaaagttt

SEQ ID NO: 4285 - DNA, 1000 bp, mus musculus
caagtttacgaaaatttaaatatgaagtttggggcttgaataaatattcagattctatgttgtgactttccattttttctatggactgtctgaaaagaaaatcttatgttgtagtaatttttaacattaattgcagttttctaacccaactttgatcattgaattcccaataaatttctcatttagttcccattaaagatataaaacctttatatttgcaataaatctaatggcactagagctgggaagatatcaaccctttaaactattttgcctactatcctgtcaacaccctgagacatgacttaccatggctgggcatagcaagatattacttactgcctggcctcctcttattctgattgactagcccttatggccagtggtcaagatcccttatcccatggcctcctaccctctctcttcctctcccttctctcctccttgtctctgcctcagaccacaagcccagggatttgatgccccacctacatcccttctgcccacctatgaactctaggcatccttattcaaccaacagttttaagttaaggaacaaggttacatagcatcacttgttttacttaagaatttccttgtctctgggacaaccagatcttggggaccagtatttaggattaaaatacatagtaatagaccaaatctcaacaatcttacattatcatcactatgatactattacagtgtaattgttcatttttttgatgcagaacctcatttaagaacacatgaaatcatctcttagggacatctgcatataatctaatcatgactaaaactttgatttgttggtatctattcactagtttttcaatagagctgactgtaaagtggcaataagtatattgataattacaatgaaaaataagttgggcacatgccatctgtcaacattccccttatttattctctagttgtctttgacttaccactccaactgccatgaacacaggtactcagaaactttatttttattcta

SEQ ID NO: 4286 - DNA, 1400 bp, mus musculus
aaataataaccttcaaaggtacctgaagcctttggtacaacaataataaaacatacccaaattagagatgaaataaacaaattcgatataatcaaaacctaaaaataatacagaagagcaattaaatgaagattagattttctttttagtttagttttggttttggtaaagactactaagactgttattattatcaagtctttactataattctatactgaattagtcagtatagaagatctaaaattatgaaattaggagtgcaaagatagtacacaaatattaatgaagtacagaaaattaaaaagacagacttaagaaacccctactaaagatcagctgctcaaaactctctctctctctctctctctctctctctctctctctctctctctcagtccagcttgcttacctcccaggaggtctgaagaaactgaggacaaggacagaggtaagagtctcactttaacttcccacacccatgtaacacccacagagctcagctaatgtgttccactccagttcaaccattcttctggtcttcttccccacccaggccagatcatctggccagctaacttcccacatgcttcagcctgggacagaggaggcctgctctaactagaaacgcaggaggcccaccataaccagagatagcactgcttgcctagaaagggacctgctcttacacaggtcgcagagctctacttgcttccaataaggttggctccagtcagagacacccaggccaattaacgtcagagataaccagatgggtagaggcaagtgtaagaccataagcaacagaaatcaatgtaatttggcaccatcagaactcagttctcccatctcagcaaatcctggatacactaacatgcctgaaaagaaagataatgccctaatatcccatctcatgaagacaatggaggccgttaaggggaacattaaaaaaacaaaacaaagcaaaactcccttaatgatacaggaaaacatagacaagcaggcagaagcccttaaagaagaaacaaataagtcccataaaaaatacagaaaaatagaatcaacaggtgaaggaatagaacaaaatggtccatggacaaaaaatgaaataggaaacaataaagaaaacacaaatagaggtaaccctagagataggcaacttaggaaagagatcaggatctacagatgcaagtatcgccaacaaaatataagaggtagaagatgggatcttaggcatagaaggtacattggaaatattgacacatcagttaaagaaaatagaaaatgtaaaaatctcccaacccaaaatatccaggaaattcagaacacactgaaaagataaaacctaaaaagaatagaaatcgaaaaaggtgaagaatactggctcaaagggacagaaa

SEQ ID NO: 4287 - DNA, 1000 bp, mus musculus
cctggacactattgtgaaagctgggaagtttttgctgaagggagtgcaatatggctgtcacacctgagaggctctgccagagcctgataaatactgaggtgggtgctcacagccaaccactggattgagtgtgggttccctgatggaacagttggaggttggagaatggagtgaagagctgagtgggtttacagccccatggaaagagcaacagtgtcagcaggtcagcccttggatctctgggggaatggaccaccaaccaaagatttcacgtgagttacctatggctcagacagtatatgtggcagaggatggccttgttcaaaatgggtggaagtggaggcccttgggcctgggagtactcgatgtcccagggtaggggaatgctatggcaggaagacaggagtggtgagtggggaagggaagatggaatatgggatttcataaagagggacctagaaaggagaaaacatttgaaatgtaaataaataaaatatcccattaaaaaatagattgaaaaacaatgttctagagaacagagaaagactatcaaatttctgtatgcaagggttaattgtttcccaaaacatagcaagtattttatgttttatatggtccttataaactcttgacaaggttacaaacagtgcttagtttctcaaaatattaaataagataatcttgcaaatgcctgatcatctgccaaattctctgtctcaaggtaataatgacacatgtaaagtctactagcctttttaataatattactcagttagtggaatgaggttgtacaatcccaactaaaatatctaactctgggtggaccagtgccagtacattaaggaagtataatctgtagagagtacacagtttctgaatatgggcaacataattatttgctggctcagatataaaaaagtctgagagaaaaatggtgctgcttgtttgcttggtaatgtttctgattattcttattattatatatctatgccattgttgc

SEQ ID NO: 4288 - DNA, 1400 bp, mus musculus
ctatttttatgtttactatgtaaagatgatgtgatggctatcagattagatacacaaagatgtggaaatctaaagacaataaagacaatagaaaccaatttgtggtctcatccattttttttttttgatgatcatatcaatagatacagaaaggcagctgatagaatttagtgtctttgttaagattaaaaattccctaccaattaactatgcaaaggatatgcatcaacataataaaggccatttccaagggtaccaaattttacattatggttaatgacaaaacgtttaaagtttgttttctaagctcaaaataaaacagtgttcacgtacttggaaattgcattaatcaaatttctaaaaaattgagcagaaaacaagaagaaataaagtcacccaaatcacaaagaaagatgttgtattatcccagtttgcaaatgatatggtcttacatacacattttttaaaaattggatatgttatttatttgcctttcagatcttatctcctttcccggtttcccctctgcaaacctcctatcctatctctccttacagggcttctatgaaggtgctcccccatccacctcacctacttgcagatgtcaagatatgcttgctgacaggaggctgatacagctgtctactgagaggctctgtaaggccctgacaactacagatgggaatgctcaaagccaaccattggactgagcacaggaaccccaatggaggagttaggggaagggctgaaggagcagaaggggccttatatggtataaatgagaggggaggccattggtcctgtgaaggctcgatgccccagtatagaagaatgctaggtcagcgagaagggaatgttctcatacttttgaaaagaaagaaactgtagtctaaatagaagataactttttctgcttctcttgaagattcaactgatttgaggattttagtgttctcactcttggtcattctgttagttcatttctagatctcagatatttcctttccattctacaagaaccaggtcttatacattacagtcttttcaactttgtaaacacactttaatcataatctgtgtcctaaatcagaagagtatttttggaagtcttacaattttcataatatttcttaacataacacattcttttctgaactagagaattcttttttatgttatctaaatgggaggataagaacagagcacatttttactaacttagcagtctttcttattaacaatacacaaatatatttttatatattacctaactaaatgcaaaagtaatgtaatcatcataattaactttcaatgaaatcagagtaactaggatgttattgccaattaacaagagtcccacggactacttgaatttaagtgtttgttgtttttatggttgc

SEQ ID NO: 4289 - DNA, 1000 bp, mus musculus
tttctgctggccctctgggcttcagacctgtcctctccaatacctgatcatgttccctcttcctcccacccctgccccctctcccatccagagctgagagactccaaggtctcaaagggagagatcttggatgaagttgtccacagtgaggagggaaaacatggaaagtccacctccagtagaaagacaggacaccaagtggagagatggagttgccatctcacagtcaaaagcactgacatagaattgtttctgtctgaaagaacttcagggacaaagatgtagaagagcatgagagaaaggaagtccagcaacaggctcaaattgggatccagctcaagggaaggactggaacctgactcttgttactgatggtgtggtatgcttggagacaagaatctatcatggctgccctctgagaggcccaacaagcagctgaaaagagtcagatgcagaaactatcaagtaaacaatggagagaagccagggattccctagtggttgaattggggaaaagctggaagaagctgaggaggagatggccccatgggaagaccagtactctcaattgacctggaacccggagatctctgagccacgaaccaggcagcatacaccaggtggtatgaggcccttgacacataaacaacaggcctgcctggtgtggcctcagtgagagaagatgcacctaaccctcaagggctttgaggccccaaggagtggggaggtctggtgaggtggggtgggggagtggggaccttctcttagagacagaggtggagctggggtgagggaggagggatgagggtctagggacagactgggaggtgaatgaagactggagtgtaaaaaaggattaataataatatccacaatcttatacacagaagagaagacttacttggaaatgtaaagaaaaacatctaaatacatttataaaaccaccatgaccacgctgaatactaataattctggaaaaataatcaatagtataaaaaaa

SEQ ID NO: 4290 - DNA, 1000 bp, mus musculus
cttggactcctctcacatatcctgttattaccctgtttcatggaggtgttgtagatttagatctgtaggactggctccttcaagtgctccagcaattcaatgatgggttacatattagagtgagccaaaccaaagctatggatctgggcctgaaaggtctctgagcaggtcagcccacaagctcttaggttatagatctctgacatcaggctaactagcaaacccctgaaaccagggccaccataccctgctgtccaagtgatgtgcagtcccactctccccagtgttgttctcccactttcatgaccctgagactagctctcttatcaaacatggatggtgagaaatgaaggaacggaaaagaatgtctctctctcatctgaaccaccgcacagcttacaatagtcaaggtcagttctcctgcaaccctcacatccagggccatctctaactgtgctgctcagataaggtttaggaccctgtcttctgagtgatacagcagatgagggtaaaggccagctctcctgtctgacataggtagcaaggagagaaagggtgagggacaacatctcttccttgcctattctgacacacagtagacaagttgggagatctcctacactttgtccttgtggttggctatttgacccacaaatcccatattgagattcagctctaatgtcctgcccaggtgaggtacagggcctgctcttctgagttctttagcttgtgaggagctgggtcagctatcctttccttataaccccatggacaagtctcccagttgccagaggtggtgaggtgcatgggtggaatatatctatccctcatcaatgcagttctcttgcttgttcgctcacttgcttgcttgcttgctctctgtctctgactctgtctctgcctgtctgtctctgcctgcctgcctgtctgtctgtctgtctatctctctctctctctctctctctctctctctctctctctcacacacacacacacacac

SEQ ID NO: 4291 - DNA, 1400 bp, mus musculus
caccttttcaacgtctccacatccattacagcaaaacctggttgattccaacccttggctgattttagtagaactatagtaagaatgagtgactgtctgacatgctgattttattttctataggattcatacatagaaattacggaaggttgataaatagtcttagttttctgcaagatatactgctaaaaatatattatccgtagtactccagagtctcataaacagtttataagtattctttctctatattgtcaccagcatattttatattttatgttataggcttgggttcatgggtttgcatatatatatatatatttgtagacttagatttttttcaaaacctactttatctggaattcttttttttttatgcttgttcatattgttttattgagggtagatgtgggggcatatactttatttggggtgaaccagggattatataattatatacctcttggggaaggaatacccaggaagagaaggtcattggttgaaggcttaggataccaagatgccccattaacatggggaggcactccaggtgttgtgctatgtgactgagtgcccatggttctctcagtggggtgccatggttacatgtcccagagcaggtacaggacagaagcagctcaaccactgttctcaaatctttgagattcctagggtctgagatcaaccttagcaggtcttatgtctgtatggtagcatggtcctacatttttctgtaaaacgggaatcaggaaaaacttctctatcttgtcctggcagagttcagccaggactttctttgtcctgcttgtccacagcttggacagcatgctgtcagcagttatctggaattcttaagtacttcaacatccctgctagcccactgaccagatttaaggaaggttaataaaaaacaggagttgtgatcctactttgaaatagttccttgggttgattccactcttctttgtcatggtacagcagttcagttcaatacaaaagagccaatacatatcagtatcagtgccatgatcaaacagaacatcaaggctcagcacaagtcagcaagaagtagagagaatcagctagaataccatgagaacttatttggcatgtttctctttataagaggaagatgagtgaaaaccagtgaagaccaggaaaatattgcatgctgtaacaatgcaagaacatcctttcattgtttgtggtgttctatttatattctttctaaacatcatgcaccctctcaagtatctaaatttcttcaaaacatctcaagccctctcaaaagacagcttaaaaaaaagaaagaagagaagagaagagaagaggagaagagaagagaagaggagaagagaagaggagaagagaagagaagagaagagaagagaagagaagag

SEQ ID NO: 4292 - DNA, 1000 bp, mus musculus
aacatgaggctcccaggactcaatgggattgactttggccattagggaaaatagaacctgtggtgaccaccttcagtagatcagcatggtctgtgatcgagggttggggccactcatccatctcgaagtttttaagccacgaaatgttcctgtccaaaggaagaacagggacaaaaagtgaaacagagactaaaggaagggccatctgggaatcgccacaccaggagatacatcatgtctgcagacaccaaacccaacactattgccttgttcaagaggtgctcgcagacaggaaccaagtgtggcagttcctgggaaggtctggtcagcaactgaccaatgcagatgtggacccttggagccaaacatcagactgaactcagggaactggaggagccaagggtgattgcaaccccattagaagaacaacacagagtggcctgaaaacccagttctagactaccaatcaaggagtgtacctggagggatccatgactccagatacatatgcagcacaggattgctaagacagcaacgggaggggaggcccttggtcctgggaatgttgggtgccccagagtagggggatgctggagaggtggggcaggagagtgtgggtggatgggggagcactcttatacagccaaaatggagagggcagggcagatgtgggatgggtgttggtggaggggtaaccaggaagtaggatatcatgggaaggagggttggtggaggaggtaaatggaaagtgggatatcatttgagatgtaaacgaatggtatgattaattaaaaaaaaatgatgatacctcatgaaactgaaaacaaaaattcaccttagtagcttttccatggttctagaaacaaacacccaggttaccccccaaactacaaacaatttcagaaatccctgaagattgggttatagacaatggtagaccacccagtatgggtgctgggacctggactaaggacctctggcaaagcagccagctctcttc

SEQ ID NO: 4293 - DNA, 1000 bp, mus musculus
ttgtatggtttttatcatttccttagcctgtgtgtgtgttcctgtaattcttttagggatttttgtgtttcctctttaagggcttctactcatttacctgtgttttcctgtatttctttagggagttacttatgtcagccttaaagtcccccatcatcattatgagatgtgattttagatacaagtcttgcttttcctatgtgacgatgtatcagggacttgctatggtgggaatattgggttctggtgatgccagctaaccttggtttctgttgcttatgttctaattctttccttccaccatctgactgtctctagtactacctaccctccctatatctgactggagcttgtccttcctgtgatcatggttgtgtcaaaactccccagagtccagctatttctgggatcctgttattctgggatccggtgatcattagattcttcatgtgtcagaggtccttagagtcatgctgcctctgagaccctgagatcttagtgtaatcaagctcctgggatcttttgatcctgtgatcctgggtatactagagcccctgagagtggagcctcctctggggggctgtgggattggctgctgagtttgcacccaaggtaaacgaggacagactggaaggaacccaagccactggtcagtcaggtttcctgcatcctttaatcctactggtaccagttactactggtggtgttcgaaaagatgttgtgttctactcacctctgatcctaagcatcctgggcatgctagagttcctgggagtggagtctcctctggatgctgtcaaatttaacatttatatttcaaatatatctttttatttttataaataaagatgtggatttaataaatttaatgtgggaagccagtaaacgccattacaagatggcactggttttaataagccgacgcccatgaatatgggtaaacaaccaatgtgcgcatgtgcagtagagttttttgctgagtcactgcctggcccgaggc

SEQ ID NO: 4294 - DNA, 1000 bp, mus musculus
acttagagaattatttcctttacccactctgcttttccccttatatagctttcataggaaacgttttacaacttagtaataaactctataatcaaatttctaagtgtcttctcttcctttgacttcagactagcagggcgaaagttagagcccagcagtttctgctgagatagaacaaagcctgcattaggctacaggtgttaattgcccaagccagcagtcttttaccctcagaaagagcaagaaaatatttaggactttttagaagttatcaccagcatttcagtataattagagagttagaaagcccggagacactcagactttaaagccattaccagaatcctactctgtgactccaccaccaccctggcccgagccacgaggctcccagcagtagtggatcaagttaattgaaagtaatactcagtccttttatttattatataatgacaaatatgtaattaaaatggaatgaactaacttcactaagttttgttgtttttagataattactaataaaaattctaacatatggtttcactgtataaactaataaaactacacagttaggaaacattaactaatggcctacattcaagtttctctttctttcattgtaatctactagaacttctgtcttaccacatacaattgtacatatgcggcaattttagaactctttagggatgctgccccatatatagaagtgtatttgcattgcaagtaacctgtggactcttaggacatacttaaaccatcactaaaattgttacaatcattcacacatataatttttttaaagtaactgctgaaccatatcattggaaaatactgagaataaaagtcccacatctgtttgcttagaataaatgtaactttaagtctcttgttactttctactttgtttaatctaaagttgcatcaaatcacaaatgtggacatgtgactatactgtctcttaagaatcagctaagtgtgtagcatcataagaaaaatg

SEQ ID NO: 4295 - DNA, 1000 bp, mus musculus
caataaaagagtaaattgaagtaaagacactataggtatgttttcatttttgtaagattgttgcatagggtgtcaaaacaataccagtaaaattttaaaataatggacagtgtagattcaacaggattaattagcttctaacaaagagtactataataaccaaaaaattaaatcaccatgaaaaaaatacacttttaaacagaaatgaaaactcttatcaatatagttcaactttaatatgattgctgtaactcacaatttttgtaggacaatgtgcatacaatatttgcctgcaaacaactctaaacattttatctagaaactgtcatggagaaatttgaaaccagtagggaaaaaacctgtagtctcaatacaagttttaagcatttttaaaaaatcattttatttacacaatagaataaaaaggaaataaataattaaataagtaacatgatattttttaattttaaaagcaatgagaaggtatttaaaagtactaatatgatcacatttggtgagttgaaagaaatatgattagtattttgtcaagaacacttctaaatttttaaactctatagtttaaatttgttaagcttcatttctttaaagaaatgttacataatttaatgttaattttgaatcttcctacctaactgaagtaatgtaatctttatagaattattttcatgtaccttaacatttttggtaaaatataacatccttctttgtaatttaattgcttgtatttcttccatatttttgttatctgatcactttaaatgttgtcatttgaaataacaaatgtaagattagcttctcactcaataactataaattaagctgggcagtggtggcacatgcctttagtcccagaacttgggaggcagaggcaggcagatttctgagttcaaggccagcctggtctacagagcgagttccaggacagtcagggctacacagagaagccctgttttggaaaaagaaaaaagagaaaagaaaa

SEQ ID NO: 4296 - DNA, 1600 bp, mus musculus
tctacttgtatttattataataaaacaaaagataagaaaaaacaagtatgagattaaaaattgacatgaataaacaaaatatcataaactaaatcccaaatactgattattttgtgattccatagggttatttagacccagggatgatgagaacatttgaaatatacacattttaatagtaatttaattaaaagtatatctccactaacacctcaagtatctgagtgtgattgaaggtgcgtgatataagtggttattctgaaggaactctaagtggccagaaaactcaaatttgtctacattttctaagtggtttttagaaatatctatacctacagaaaaaattcctatttttgtgaaaatataattaatcataattcatcttaaagtcttctcttttaataaacaaatatacatgtctacgtgaactaaatgggacaaatatatgttttcccctttcctggtttcacctctgaaaaccccctatcccatctcctctccccacgctcaccaacccacccactcccacttctctgtcctggcatttctctactctggggcattgagcctttacaggactaaggacctctcctctcattgatgtccaacaaggtcatcctctgctacatatgcagctgtagtccctctatgtgtatgctttggttgttggtttagttcctgggagctctggggggtactggttacttcattttgatgttcctcctatggggctgcaagccccttcagctccctgggtcctttctctagctcctcctccattgtggatcctgtgctccatccacaagttggatgtgatcatccacttctgtatttgtcaggcactggcagagcctctcaggagacaactatatcaggctcctttcagcatgcacttgttggcatccacaaataaagtctgggtttggtaactgtatataggatagatccccaagtggggcagtctctggatggcctttcattcagtctctgctccattggttttataatctgctacaaataacttggttttcagcaatttcaaaaaccttagttagtcattgctaccaaaaccatgtttaaaatgtgtaagtttggatcacaaaggaggctaagaagtctctcgctgttcaagcttcatcacataattaaagtacccagatcccacgagctagagggaattaactcacaagagttttcctgacttctccacagcacaggtgtatcttcaaaaagatacactcatgtatacataaccaccctgcacacatgtaaccaaaatagaagtcatttgacagaaataaacaaatttttctaaaacaggaagatatgacaaataaaacatcttcattttcttcaattagttatgctggttttctttaatatctacagagttcaaaagccatctgaatatttcagaacacattgaaacttacaacaataatcaggagttgttgcaaatgtattttgttcacatattttttacatttgtatacatttatctctttgaaacattaatataaacaaccagagtaattgctataagtgctcaacagggctttatttcttaacaaagaaatcatatattaacaaaaggctgttt

SEQ ID NO: 4297 - DNA, 1000 bp, mus musculus
ctgggctaatatccacttatcagtgtgtgcatatcatgtgtgttcttttgtgaatggattacctcacttaggatgatatcctccagatccatccatttgtctaagcatttcatgaattcattgtttttaatagaagacttcgacccttcttagaagggggaacaaaatacccatggaaggagttacagagacaaaatttggagcagagactgaaagcatgacaatccagagactgccccacctggggatccatcacataaacaaccaccaaacccagacactattgcagatgccaacaagagcttgctgagaggagactgatatagctgtctcctgagaggctctgccagtgccggactaatacagaagtggatgctcacagccatccattagacggagtccaaggtcccaaatgaaggagctagagaaagtacccagggagctgaaggggtttgcagtcccataggagtaacaacaatatgaactaaccaataaccccagagctccctgggactaaaccaccaatcaaaggaaacacatggagagactcatgattctagctgcatatgtaactgaggatggcctagtcagtcatcaatgggaagagaggtccttgcttctgtgaaggttctatgtcccaatataggggaatgcctgggccaggaagcaagagtgggtgggttggggagcagggggaggggataaaggataggaaatttttggtggggaaactaggaaaggggataacacttaaaatgtaaataaagaaaaatatgtaataaaaatgttgttggtataaatagcattaagaaatggttgcattgtaaacaacatatttttccccttatgagatacagaaggcatccgttttggcccagaagtcaagagggaatacttgactctctaaaggaaaggtgcagctggaattcatgtagcaagtaatgcagggtacctccaatttaattagtttaaccacttgagtccttctgaatgagctaag

SEQ ID NO: 4298 - DNA, 1200 bp, mus musculus
ggtagtgataatttgaggtattaattttggaaaccagggaatgtttatatataacacacagctcacctaggtatattatttgtaaaaggtcttgaaattatacccatttctattgcaacaggaatattggagaaaaggaatcttccactacctaatgtattataccttctccatcatgaacactacaataaatatggaacaacaatatcaattaaccagtacccccagagctcatgtctctagctgcatatgtagcagaagatggcctagtcggccatcactgggaagagaggccccttggtattgcaaactttatatgccccagaacagggaaaatgccagggccaagaagcaggagtaggtgggtaggggaacagggccgggggagggtatagggaactttggggatagcatttgaaatttgaaatgtatataaagaaaatatcaaaaaaaaaaaaacaaagttacagtaactcatttgtgtccctgtttgctcagaagaattaacaaaaatattttctaaagaaaataggttctaagaaataaatcatagctgggtagtggtggtgcatgcctttaatcccagcacttgagaggcagaaggaggaggatttctgagatcaaggccagcctggtctacagagtgagttccagaacagtcagggatacacagaaaaaatcctgacttgaaaaaacaacaaaaccaaccaaccaaataaacaagtaaacaaaaatcaaaaaacaaacaaacaaaagccaaagaggagtagaccattgatgtgataaaactgatcatattatttatagtccttggaaagtgacattaggagaaagaatatagaaaaactttgtgtcagtgattaaaggataatgagagtgtagtacacttaagtcaatgtgtcattttttatgtgagtttcatatactagagtgctagtgatagtttgggaagtcaaaaatgtttccataagtacttataagtgaacactgacttcataaggaactagaatagtagtcatgcaccttacattttattaaagatcatggagagcttatgaacatgtcctggacaattttctacacagatactaaataccaaagttaaatcaggataagataaactaaacagtcccacaacccaaaaagaaatagaagtagtcattaaaagtctaccacaatacccccccccaaaaaaaataa

SEQ ID NO: 4299 - DNA, 1000 bp, mus musculus
ggcagacacacaggttcaaggagtggccagagcattgtgcacctctgttttactaaatcagtgaagctagttctgctaacactgatgtctatcttgccaatttcagggcttctgtgtccttttacattctgccaggatctttcacttactctttgtaataataatttatgccacatgttcacatgatgcttagagttaactggcttactttttgtgatacacactcatatcatattgataaaaatgtaattttacatgatttcatgatttacatgattgcaattaaaatttcttgatataaacaagattcttttactgaggctggactagctttactctgaataggacaatatctctttttctattttgtttagaggttcttacatacaaaaattgatttttaaagtgtgacatttgcaccagaggaccaatgctggctgtgtttcagacacacagcatctggggaccttgtagtttttcagacctaaatatagttttgaagccactgctttttcagaattctctagtttcgtttattagaaaataattgaagatgagaatttgcattgttttcatttttcatagttttcataaaccaattctttgggcaaaactgggaggaatttttatgataagccatcaacatcattgctgtataaggaaaacacatcaccttgtcctctttatttcacatgcaagagagagccccactcaagggaaatgtgtctgttgttcacactcttcctctacactcttggaaatatcatttaactttgagtgctcagtgtcacacctctgaaacttgctgagcttggcaatcctggcacgaatccttgacagcttgtcaggcctaaggcaaatgcatgtaatcttccctcccggtaattaataattaattattgttcattaatctgtaatgaatggtggtttggaacaatgtagcctcataaaaacgtgaaacaaaaatcattgttattttaaaaggcacattccagctgaa

SEQ ID NO: 4300 - DNA, 1000 bp, mus musculus
gtggcacaaatgtttggcaacaccccaaattgcattccagtgggatttagtgcccacttaacaagatgcatggagctgcaagagtcaacagcaatagaggtaacacccatggcacagtctaaactaggggctctcaacctgcaggtcgtggcccccttggggctgaacaactctttcacagaggacacatatctgatatcctacctataagatatttacattatgattcatagcagcaaaattacagttacgaagtaacaacaaaataattttatggttggggcagagggtcaccacagcataaagaactgtgttaaaaggtggaaggaagcattaggaaggttgagaaccattggtctgaacacttgcctgatctggaaaggcatcaaacatggttcccacgccatccttggagccgaacttggagaccttgaaaggccagatgacatcctgtggggggtggggtggggggaagccaccacaaagtactcctgcatcagaagcagataacttcccttcaaataactgcaagccaaggaaatagaatgagagagggtggcagtgaagcccactgcgactgaaacgtgatcaatgtcccctgcctgatgtctgcggacaggtgacactgtgaaagaagaaatattcacttttgcttcccggaaaccctgttcaaatgacagccaggagctcttaggtgggtgtccagacaaaagacaaagaagccgggaaagaaggtagtaacactttcggtgtttcatttgctttgcttttaaatgaagaatttcttaatattaaaaaaaaaagaagaagaacctatctactactattattttcttaattggaaattgccagaacatgatctgagaatggtgtcctgtgaggataattcagagtgtttgtaagaaaactccacgaaaccaagacaagagtcatatgaccttagtacctgcaatggtacatagttggtttggggataatcatgcttccatagcccctctaa

SEQ ID NO: 4301 - DNA, 1600 bp, mus musculus
atctatagcagtgaaattaagtcaatcaccagacactatgagtaaacaaatagatatttgatcatcaggtttctatatccttggtgtagtgctatatcatgtcacagtcacactgactagaaccagtttgttctcctataaaaattggtgaccagttaccaaactctcaaaggactattgtctactcctgctacatccactccagtagtgacaagcacaagaggcccccaaaacctgggtgctgtccagagactaaaagttcatggaaacttagtctcctggaaccatggtatcctgtataacgaatgctccaatatccttgctatagttggtaaatggatctgtgtgctttcccttaatattgctttattataagtgcttctaatgattgaacttttgacatataactcagttaggttcttcaccaatactaggcagtccttgagctgaccctgggcattcataggtaagctactgccctacacagcaatttaccattatctaggaaaaagggaaggttgtggtctagggaggaaccagagtagatacttagaacatagatagctgaactatacccatacacagaaatttacaatggcctatggggaaggtggactatacaatagactagaacaggaactatggcatgaagcccttgcccctgacttctaagattaagtggaccttaggtggagctgcttttgattcccatttgttaacattgaattttatcccagtttgttcctgcctttcctttgtaggcattcctctgttttgtgtcagatgtaccttgcctgctgtgatatctgactcctttgttttctatgttataaaactggtgttttctttgagacacattacattcaaatccacactcccttctgtcgcgtctgtttgtcacccctcattcccgccgactcaatgcccatctgctggaacccctgattcccacggattgagggggctgactaggcccgatccatggcctacccccacaccatatagtacacttgctttccttttgtatagttcaatgatttacttaaatttaatagatttttaagaatatgtcagtatgatttttctagatattatataattctaaaaaatacacaggagacctcaccataatctcattcaggaaataattaggtacaacattgtttgaagaatatcttaatatgaaatcaaaacacctacagggttgcagttccctttagctccttggataatttctctagctcctccattgggggccctgtgacccatccaatggctgactgtgagcatccacttctgtgtttgctaggccccggcctagtctcacaagagacagctacatctgggtcctttcagcaaaatcttgctagtgtatgcaatggtgtcagcatttggaagctgattatgggatggatctctggatatggcaatcactagatggtccatcctttcgtcacagctccaaattttgtctctgtaactccttccatgggtgttttgttcccatttctaagaaggggcaaagtgtccacactttggtcttcattcttcttgagtttcatgcgtttagcaaattatatgtatcaaaagatggcctagt

SEQ ID NO: 4302 - DNA, 1200 bp, mus musculus
atatatatgatagactcacagctaatagcatcatgagtcaaagaacatttaatacaaaaatatttaaaccaggaaagagacagtcacctattccaattcctcatcaatataatgatcaaagcaataactaaataaaagcaatagaaggaaaataaagaaatgcaaataggaggatctgtacccatagggccaccccccacacacacacacacaccatcttccttctaagtccagcagaggccattaagggctccagagtgctctccatgcagcaggacattgagatcacctcgggttcacaggtgagtggaaaacaacatcagctccaaagaattgtggagggtcttgtgccagcaggaacatggaaaagggaacactgcccaaccagagactgggatccattcaggccagggacagccccgccatcttatgtgtgaaccaggctgagggcatctagggcaccagaggactcccactcctcagaaccctagcacacccaggacctcctgatcacctgagagcatgtgggcaatagaagcaacacagcttcttggtcagggtcctgtcagaccctcaccctcagccaggaggcagagctaagacccagactcctggacacattccttgcaagaggagtgtcagcctacaggacgagttctgacctcagaactcaggaggtggatcagacctccagactgctggacacctgccctgaaagaggacagcttgcctgcagagagtgctctgaccattggaactcaggagagagttggactcccaggagtgctgacagaggctaaaagaatcacaggagaatcaaactctaaccagagacagcttgaaaattaacaccagagatttccagatggagaaaggcaaatgtaagaatcttactaacagaaaccaagaacactgggcatcatcagaacccagtatgaacatcacaagtcctggatacccaaacacaaccgaaaagcaggacacagatttgaaatcatatctcatgatggtgatagattattttaagaagggcattaataactcacttaaagaaatataggagaacactgctaaacaggtagaagcccttaaagaggaagctcaaaaatcccccaaggaattgcaggagaatactgctaaacaggtagaagtacttaaagaactacaggcaaactctgctaagcaggtagaaaacacaca

SEQ ID NO: 4303 - DNA, 1000 bp, mus musculus
tgccacacccactccagtggagtctatgtgacaagtccaaaagcttggccgcagtcctgaggcaaaatgtttcatggaaactggaggccttggcatcctgtaacacagatgtgtttcagatttgtccctgtgatagtaggtggagggtcttgtgtgctttccttcagtattgttttattataggtgcccccaaggaataattcgacttattcagacaaaatgcctctagtgttgaaagagagatagtgaaagaaatcaggcattgcagtttactggataagagtagaaatctcagggcaagttctacaaagtaaatttagaattctcattacagtcaggtatggcagactacataatagaagaaagttggtgggctcctctgataaatggaggttcaccacagatgtttaaaacaacagctaactcactcccatatgcaggaatttacaatggtctaggaagaaggtgggttgtgttttaaggaagaactacagtattgcgttattcatgaaaatgctagcaagagcagaacccccctgctgcaagttttcacaaggctcagaggaatagcataataaggtgcttactaaggaacacttgtgatcctcacctggctcctagaatagctgactttagatagggcctcttttatctcagttgtaatcactgcctggttcctttcagtctttatgtatgcatttctctgttttgtgtcattatgcataagatgacttcaatgtactttggctgatcatctaatgtccttgttttcttctataatgtaagtctgatgctcactttgagaaattacattcagattccacactttcttgtgtttgtgtctatttgttgcttgccaatttcttgcctgcctgagtaccaggaccctgatttctcccccaggttgagggaccaactgtgtccagcccctggcacagagaggggtgtgttatgttatatcctacagaactatcttctcagacagcaagtggatgaaaga

SEQ ID NO: 4304 - DNA, 1000 bp, mus musculus
ttttatttattttatttttccaggaagatctctggccaggcctgttatgagggttcagggaagcgaagcaaatgcaggcaggggcagggaggggaagttacttccctgcttccactagggcatttggctccaccttggtctctgccatggctgtaattctgtgctaccctgcactgagtcgggtcgggctgggcctagaagaagcctactagccggtgaggagtgtggcagagcctcaggccacgtgcttcaggagagatgaactcttcccaagtgttgaagcaaaggctatgacgggattagttcttgcacacctttactccctggatcaaatttacatacagtttgggggatgattcagggtttgacagcaggtatttctcattagcttggacttagagtttggggaaaccttattgcatgtgggagggcttgatgcagctactacctgattgattcctcagagctctcggtaaaggggctgtgggaggctatagctacaggacaggagccaggtgcccaggaggcatggccgaactcctgctgtcccaagcaggtggaaatctctgcccgccagggctctgaggttccagacttatgctccaccaggctatctgtgcacagcccaccactccacataccaggtgcatagattttaattctttcataactttttcatcattgtcaatatgtaacaatttaaataaattagcatatatatgtgtgatggatagttttatgttaacttgacacaagctagagataatttaaaagaaggacactcaatatagaaaatgcctccataagacccaattctcaatcatttgcttagttagtgactgagattccatcccactatgaatagggccacctatagactgatagttctgcggactataagaaagcagactgtgcaaatcccagagaaggaagccagtaagcagcacccctttgcattagcttctgcctcccgggttctcttctgcttgagttactgtcc

SEQ ID NO: 4305 - DNA, 1400 bp, mus musculus
ccgattaggccatcttttgatacatatgcagctagagacacgagctctggggtactggttatttcataatgttgttccacctatagggtacagagctacacatcaattctatagttcaaagttaacacaaagaccttgaagagttcaacacaccaaggtctaaaacaatgcttgaattttcacaaagccagaagtaagggtatctggcaaaatatagctattaaaaatgccgtttcttgtgaatttattccattctataatttaagaaactgtaggatacaaatgtgtctgtgtcttgacagttacttcaagatgaaatgcccaagtgaggaggcctcagtcccacttgggagagagaagcaagcaatcacaagtggagagggaacaaggaacctaggagggaaaggggacaggaggcaggagagaggtggggagaggggaacctgatctagtaatggctgagggaaaaggactgaagccctgagggccagcagaaagaatggaaactggcagcctcaggaggtaagaggttggggaaccctccagaatgcactagagacctgggaggtgagagactctcaggactcaaagagtgggaccttagatgaactgcctgtcagtagggagagggaacttatagagcccacctccagcaggaagacggggcatcaaatgagggaggtggaggcatcccacagtcacaactctgacccataattgttcttgtctgaaggaatacagggatggaaatggaggggagcctgaggaaaagaaggtacagcgacaggccaaaagaggcctgacattattactgaggcaatggagcactcataaaaagtgacctagcatgactgcactctggaaaccccaacaagtagctgaaagagttagagtcaggcagttgcacccaacgaatggacagaagcagctgaaccctgtggttgaattagggatggctgaatgaagaggaggagtatgaccttgtaggaggaccagcagtctcaatctgaacccctgagatctctcaaacactggaccaccaaccaggcagcttacaccagctgccatgaggcccccaacacacatacagtagaggatttctgggtctgtattcattcagcaatgatgcacctaacccttaagagactggaggtcccagagagtttacaggtctggtggggtgggagttggggaaatccacgtggagacagcggagtggggaggaggtataggatgtggagtagaagaagggtggatggggcagggggaataaaatatggagtgtaaaattaataattagttaattattttaaaaacttattttaattcttgttcattgtctgcttttagctcttcttcatgctttgctaattaacctttctttacttttttcacattat

SEQ ID NO: 4306 - DNA, 1600 bp, mus musculus
gattcaactggagttaccagtctttccttaataactatatcttccacaagtagattcatatactcagatacctgaaggttgaaggaggggagaggaacaggacctagaaggaagattaatataaatataaaattgctgctttatttttttagcattgaacacacaataaaagctctattttccaggtttattctcacttaggtgagtggcatgttatttttgagtttttatgacttcacctttcattattaagaaagtaatccagctggctatataggagataaatgcaattataaagacattagccaactactccttcgggaaaaagcaaaggatttgctgtaatatataatttaaagaacttgcaaaatatacatagtagagtactgtgtgaaagcgagatcagcaaaaattggtgtctaccacattcaaagcagaagatgcattcaagcaaacaatatatctgaaattcactgaagtatcacagcagtgataaccacaacgaccatttcccacgaattaaatgactcgttttcttgttttttgttaggaaattattggaatcctatgcttcataattaggtcatatgtgaagccataccaggagtcaaatataattccagaagttgatgagcaaatgtgccttgcagccatcttgccttcagcttatctggacctgacactgatgctgcgtgccatgcacattgtgccagagaaatgatttcacaagaagacagttgtgttgtcagtctgtttccaaaatgtgatcttggctaaacagatgtttttcctgaatatctaccactcaattccactggatatatatttgctttagatgaattttcagtttccggtgtttgattaaaaaaaaaaaaatcttggaaaagaaagttttttagggttactaaacaaggtaatggaaatactgcataaagagaattggaataaaactcagctaaggtctgttgaattcagcgtcattttcctaattggaaaacacagtttttaataataccacatattttagattcctgagactttaatcatcaatttcagcttagcgatgccatgtcaatgtgacactcaaggacttttatatttccgtgatttctcctattctcaccccctttcacaggaaagccaatgtggtttttcctattatcacatatatcattgaatgcacatattttccttgtggacaaaatttatatataattaacagaagaaagcttgtttgttttttctgcaaaatcagagagtgacaaggaataatacattgatcactgcttatcaattaacataatattaatatactcaagtttagcctggatttgaaagactaatttgttaaaatattactttcaattcaataatattgatagaattttgaaaatagttccctaaggatattcaattagttatgacctcttaaaaatttgaaagatatattactttaatatataaagaacattcttaacattttggaattccattctgttgtttataatttagtcaaaaatctaaaaagggtcaaaattttaaggtaatttaggaatacattttctttcttctgtacacaaattacaaagaaactaatata

SEQ ID NO: 4307 - DNA, 1600 bp, mus musculus
taagtgtatagtaatgaattattcttgtatgttcctatctcttttgttgggaaagatactggatattgacttttccactttctactattgatctatatcctcaggcctttgtttatagcttttgagagccagtcttatcagattgttgagctatatgggaggttatccattacccaatatagttcttaaacctatgatctccttcttcagcttcaaggaatattgaaactactgagtacatccacagtaccaggcttatatttcttatactgatgtttcccttccatgttaattactttaggatgaagagaggagggatgtaggaaaaaaggtggtagcatcagttatgggaggagacagggaagatatacagaaggtcaggaatttgaacagaggtgtgtaacaatgggggatggggaactggagtagctaccagcaagtccaagatgccaggaaagcaataggctcacaggtcccaacagggatgaaatgtgcaacaaaggaaaggaagaacctgtagagaatatatccagtggttaggcaaggtccgccgttgggggatggggccactcactcatctccaaatctgttacccagactggctcctgtctaaaagaaatacggagacaaagagtggagcagagactgaaagaaaggtcatccagagaatgccccacctggggatccatcccacatgcagacatgaaacccagttacctttgctgataccaagaagtacttgctgacaggagcctgttatagctgtctcctgagaggctctaccacagcctgaaaaatacagaggcagatgcttgcagcagccaaccattagactgagcactggtccccaactgaggagttagagaaacgattgaagaagctgaaggggtttgtaaccccataggaagaatatcaatatcaatcaaccagaccccccagagctcctagggaataaaccatcaaccaaaaagtacacatggagagacccatggctccagctgcatacatagctgaggatgacgtggtctggcatcaataggaggggaggcccttgatcctgtgaagggtggatgccccagtgtaggggaattccagggcagagaggtgggagtgggtgggtaggaggaggagcacccacatagaagcaggggaagaggggatggaataggggttttctggaggggaaactggaaaaggggataacaattgaaatgcaaatacataaaatagccaataaaaaaggataagacagagaacataattgatagaaagtcacttaaaaattctccaagagtgctgatatgaattatctaaaatgtacagaaaattctgatgtgctctgaagatgttccaccagttatgaatactctaagcacaataggaaatgtgtggcatttatttggcctccatagtgctatgttaagcactatcaatgtggctgaaaacatttaaagtattttataacctcactaaatttctattaattttcacatagttttgtataaattcaaattttaatgcaattttttgtttcatattgtgtcacagtgtcctatgaattgcatacaaaattttattcaaattttattacatgcattta

SEQ ID NO: 4308 - DNA, 1000 bp, mus musculus
cagacactattgtggatggcgactactgcttgctgacaggaccctgatagctgtctcctgagaggctctgccagtgactgacaaatacaaaagtggatgctcacagccatccatgggacagaacaaagggtctctaatggaagagctagagaaaatatccaaggagttgagggatttgcagctccataggaggaacagcaatatcaaccaactagtaactctagagctcccagggtttaaactaccgaccaaagagtacacatggagggacccatggctccagccacatatatagcagaggatgaccttgtgggacatcaaagacaggagaggtccttggacctgtgaaggctctatgccccagtgtaggggaatgccaggccagggaagcaggagttggtgggttagtgagcaggaggaatgaggatgggatggggtgctttcagaagagaaacaaggaaaggggataacatttgaaatgtaaataaagaaaatatctaataaaaaagaaaagaaaatcctgtacaggtattaaaaaaaaattactgatttctgaaagacccatcaccagctagagttagatgcagatatttacactcagccaataaacagaagctgctgaccgttgtgattgaattagggaaatgctggaagaagctgaggaggaagacaaccctgtaggaggaccagccatctcaattaaactatatctccagcctccaaggtctctcaaatactggccaccaaccaggtagcatacaccagttgatttgaggcctcaaacacatatacagctgaggactgccaggtttggactcagagaagatgtatgtaacactcaaaagattttaggccccagggacaagggaggtctggtgggctggagtgtacaggagtggggacatccttgtagatattgggggagatggtacaggaggtgaaacattcagaaggtagactgggagggggataaaaactggaatgtaaaataaaaagatta

SEQ ID NO: 4309 - DNA, 1000 bp, mus musculus
gctgttaatgtctgtggggcattgggctatgcacagacaggcaggtctccagttgagctgaggtctgaaccctgaagggtgataattcaccttcatgacatggtaggcattccctcatgctcctggaactctggctcctgcctaagttaccaccccccacccccagcccctacaagagaagcatggtcagtagtcatataggcaatggcccaagcttctgaccttcaggctaaactcctccccagttacctagcaacagtaaagaccataaaaggggctgttaggcctccacctccgcacctcactctcttacctcttactctcttacttgtcgctcttacttctactctattgcctcttacccctcactctcacccactgtctcctctctctttgtcttctctcctctctcctctctctttgtcttctcctcttctctctcctctcctctctccctcttgctctctctttctctctagcctttcctctctctctctctctctctctctctctctctctctctctttctctcaccatctctctttctccctgcctttctataataaagctctaaaaccatagacagtctctgctcatcaaggttgtactcactctcatcagtgttaggaacctcttcccactctcaaacctctctcccataactctggtagctttagcaaagtaactcctggactcccaggaaggcctgccccttgccacccctccaagagtgggtcagaggcttagatgccctcccaggggtgagtggaaggtagatagcagccctcccacgcctgacagaccagagaataggtaaaattctggcagggtgtgggtcttcccctacactcttttcccttgggcctcctttttagttcccaacaaatgtcttctttatttcctctgatgaatagatgagataagagccatactaaagctggatgaatacatggcttgggctgagcacatgatgttgctttttctcttctaactattccta

SEQ ID NO: 4310 - DNA, 1600 bp, mus musculus
aggcatctcttccttaagtttgggaagttttcttttaagacttcgttgagagtattttctggacctttgacccttttttttttttcctctccttactctattcctattatttgtagatttgctcttctcatagtgtcacagatttcctggacgtttctgctacattctacactttttagatttaacatttctttgatccatgtatctacttcttctggcttgccctcaatggctgagattctctcttccatctctgacattctgttttttggggcttacctttgaggctctagcttgagttccttaattttccacctcgagtttccccccaattttggcttttcttattgattctattttagttttcatatcttgaatagttttcttcttcatttcatttcactgtgtgtgtgtgtgtgtgttttcattgattttatttcacttatagaattattaacatcctcctgctggtcactgatagctattttgaagttctcttgtttttcagctgtattgcatttttcagagactatcaaaagtaaagttcctgggcttttgtggagaaatattctcatccttgttattgattgtgtttttatgctgtggtctagacattgggtatggggattattgtaattctttttgttgatatatgttcttgttgttgggtacatttttggtcatttagtttctgattttctctctgtattttaaaagagttgatggttacatgttgcatagtatgaagtgttcctaagtccctgtcctgtatacaatcttacagtcagcagtagtacttgtttctagtttatgggagttataacacaggaatggaaatgagttagaagtgcagcgagtgagagggtccgcatgaggaaggaaagccaggtctgccatgatgatctgattgcctgtaaagcattgctagcaggtgtccaggaacagtgcctatgatgttggtgggtgacacaaagagatgtggtgaggaaaggaaattgtaggaaagatctgcttctgaagacagcagcttttataagtgatggcaattcaaactcatatcagtggaatgaactcccacaagcattgctaaattatttgctatgttattcatctctatgtgaatgtacctgcagcatcaaaatcatctttgcaatattctttacaaaagaaactgtgaagccctgttcatgaatcttgaaagtagactaatgctaaaatagcatcaaaattagattaagatatcactttaagagaaatttaggtaatgaactaaaactttaccattttttatataaatatacattttaaaatgttaaattcctattgtcataattgtattacttcatatttttgtattacatgaaaaatcattctactcccttattaaaatctctaattagtttattaatgaataaataaagatatatagttcattagtgtcattctcttggtgatgcaatctgactcttagttttcctgtgtttctttattaagtggaaaatctctctcctggatgaacacatttgtaaataagtaataccatgtaagaaattacctgaccattgctttcatcaaatcatcctcctaatctcttccaaca

SEQ ID NO: 4311 - DNA, 1200 bp, mus musculus
gtcttaacagtttaaaatgtggaggcaggaggataacgatttcattcaagttctagtaagaaaataagtaagaaaacaagacaatcctgagcaactttttggaacctggtttaaaagaaaaataggatatagagcagtatcagaccaactgcctaactacctaacaactatcatttatgaggccatggattcaattcctggaaccacgataaattaataaccttcaaatatagatattgttgttaaggaaacaataatatgaactatgtgccaatctcatataaagacaattggccctatttaaggctctttgccccagtgtaaggaaatgccagggccaggaagcaagagtggatgggttgatgagcagggtggggcagggatagggggcttacagaggggaaaccaggaaagggataacatttgaaatgtaaataaagaaaatatctaataaaaaattttttaaaggtgaataatttaagtatataaaaaattttaaaaagcaatgaaaaaataatatgagaaattataggttaataaattgcataattaaaaaatatcaataaacctcgttggaactgactcgtttagaagtacatattctaaatatatttattatatactatgagaatgaaagaaaaataatcatttaaatgaactgaaaaacataaatgaacatgaaaatatctaatattccacaattataaaaagtttaaaaataagtataagggatttctttagcccaagaatgatggttacattataatggtgaaagattgaatgttgctttcaaatatatccatttgcagaaaatttatttgtagtttttttaagatttatttatttattatatgtaagtacactgtagctgttttcagacacaccagaagaagccattagatcccattactgatggctgtgagccaccatctggttgctgagatttgaactcaggaccttcagaagagcagtcagtgctcttaaccactgagccatccctctagtcttgcagaaacacttatatctgtaccaaaatctttagcaagtatacctagtcatactaaaatcaatggaagaatgtataatatacgccgaatgcaacaagagtgtaaaaacatggcatttataaattggttctgattgcttttaatataagatattctgagaatacaactaatattaatgtatatgtcaaattgt

SEQ ID NO: 4312 - DNA, 1400 bp, mus musculus
atataatgatgacaaaatttaaaagctattatatcttatattaaataatgaaaaactaactagtaaattaactaaatatatgtactgtattgtgctgggaattgatctctggtcgtcttcaaggttagaaaatgcctttagccactgatctattaattcagcctctatttagaagattgcagtatttatttccatatttgaaatttctaataacaattgcagagatcaatcagcagagcacttgctgtagagacctgagaacctgcaggcagatggccagcagctaggtaaatattcattgtgtccatatgtacctgtaactacagtgctgtggaagaagaggcagagagacaggatcaccacatcaagttcctgtttccaagatacagcatctcaaggcattaaggcactgcagaccaggaacaagtacaagatatccccttctggcttccacagatgtacatatcagcacacacacacacacacacacacacacacacacacacacacacacacacacacacacacatacactttgatacacatgtatataccacactcatacccaccccaaaaccccatttttaccccccccacacacacagagatagaaagaaagaaagaaagaaagaaagaaagaaagaaagaaagaaagaaagaaagaaagaaagaaagaaagaaagaaagaaagattttataaaatattctgataaaaatcgccaaataacgtatttgggaataagttagattttcttttacttgtttgagccacatggagcgcacagccatctccctcccttaccatattttttatgtaatgtggtttatagagcaaaaattcctcaacatttctgtctacctgctatgtgttatggatatgattcttccccgcagcccgtctgtcttttcacctgctctttaaatttaggtttgaccactcaaatgccttaatcccaaaagtcttccagagcaccgttattccctaacactattccgatgctcatactttttgtaactggttaccaaagaaatgcagttacacacacttctgtgcaattcacttatgcaatcagtacagcaaccgactcaggacccagagaacactcaggatttttccctccagacctgagtgtctgtagtaactctactaatctgttatcaaatcattcaactctgtctgatctagttaataagtcctccccttcttttaactcctgccttactaccttgcattccatacgttacatttctcccctaaactgtacaaatgtccttaagtaaggcaccaatcccaacattcttttgtgactttatccatttccctcttacaatctgaatctgaagacatgaatatggcagttcacatcacaggggaaatacacattaacttacagttttct

SEQ ID NO: 4313 - DNA, 1000 bp, mus musculus
ataggccttaaaagtaatttgatatagaaataatgtcagtagcaaacaaagaaaattgattttttccagttttggtctaaaaatcttttatctttttatatttttaaattcactttacacctctatcactgtgcccactccaggtttaccctcccacagtctctcccctgtcttctctccccttctcttatgagaaagtggaggcctcatctggttatccccccattatggcacatcttatctctgcagaagaggccaatcaagacatcacagatgggcaacacccttagggatagacgttgctagtttttcaggacttacataaaaaccaaactgcacatctgctacatatgtgccagggcctgggtccagcctgtgtgtgctctttggtttgtggttccatctctgagaggccctaggatccaggatagatgactcttttggtctttttgtggcattcctctcccctctgtggctcttagttcttctaactcccccataagaatccctaagctctgtccaatgtctggctgtcggtctctgcatctgtctgagtcagctgctgggtggagcctttcagaggacagacatgttagactccagtcttgcaagcatactagaatatcattaatagtgtcatggatttcttcatgtgttagaattagagttcaagtcactccaatacctcctaaatagatagggatcagggttatattattgatgctatttactgaagaactttcctggatccatggttgatcatgagtgtgctcataatctaaggtagacagatcagagctgaacacatccttccaaaattgttcacagttttgagatttatctgttcacgtttcctatcattgagtttgcttgtaatcaaagctaagataaaaagtagttgatgctgtttcattttaagaagtgttttttaactttaaaagtttatgtgtttgaaactgcagattgcattttagatcatgttatgtgtaatgctgaaaaa

SEQ ID NO: 4314 - DNA, 1600 bp, mus musculus
acattaaaagcatggatcctgtgaaatagaaaaacagttcatggtaccttctttaggtatctcccaagatgatattcagtattcaaaggagattatataccttcataagttacaattatttaaggattccaagatattaaaaggaaaatgactttcatagtcaatgaattaatgctacactaaaatgtaggtgtatttaaccatttattagcatgattaaattataaaatgtcatttttatagggctatgttctattacttgtgaaactgggtgctgatctgatagcttgattcagagtgtgaaaagaaacttatgaaaaggttaaatgggagagagaactggtggaggagatctgttgtctcacaaaacctgtgtaagtccccgcaaagttttcacatgtgttgtagagttcacctactacattgtgattatgcagaaaataaagcaactggagtggatttgttccagttaatttgttatacggtttttatttgttatggtgagagacaaaaaggtcttaacgaattaaagcaaagcttctctttgttcagccattgaaaaatcattaagcagggcttaagacataaaagaaagcccgtgtgcctgtccacttctaaacagtgaagaagacaaatgaagagctgccttcaaatctgaagcgctctcaaatactccctcatggaaataaataatagaaatagaactttaagttcgtggtcagaacagccacccttgtgtgagctgttcccaatgatttcatctgcatttagctctttctgtttgcttagcatccacccttgtcacagccacacagccacacagccttctgcaaagaaggctttatctgtatcccaagcttctagaacataataaaggagcaagctcttctgcacaaagcccccttgagttctttaaattgctttttgacaaagggagaatgacacgaagaactccataaagaacagaagcaaattttcatgctgtgaaattcaaatgttaatgtactcattcctagaattatcatcattatgtattcaggtataccctgtactattttgggggtatagtccagtatgtcttggccactaaacatctttgaaagatgatttacaatttcttagaaaaaaaaacattaaaattttatatttcacatgttagacagggaatgagaagaaaacaattataatcaaatagtgaggaagcttagctttgcacctccactctgatcattttatactactatccatttttctatttctggaaagacagaaacacctttattatgtatattttcaagataatctgaaaattaaaaaaaaaaatctaagcaatccaggaattagtgagattgccaggtagtttggaggtactgcctcaattactaaaaactgtatgatcgatgcagctacttgatatatcatacttaaaagaaacactatcaaacaaaataattactttgcaaactattgttttatatttattttttaattattacatatgatttgaaatatgaaaattatgagcctaggctgtgagttgaaaatatcacaatgttttttatctgtttccttataaacttaaacttcacaaaatatactg

SEQ ID NO: 4315 - DNA, 1400 bp, mus musculus
attttagatatttatgtgactctttatcaggtaatttgtccccaaattctgcatgaaatatttcatcatctattgaagttaagtattggtgattttatagaaacttggcatgaaagttgctttaaggtaaagcccatggaactcaatacttcaggatctactaagacttacacttcatattgtattagaaaatcttgtctccttcacagtaagtcccagtctagtggtcttagcctgcttactaggttagcaacaatgaatactgagggatatgttggaggtcctgagctttcttcctcaaactattttaataggctggggattattccatgatgattttcatttatttatttatttataatctattttttttatccagactttgtttccttccctgtccaccctctgactgttccacatcccatacctcctttatcccacccccatctccaaggggatgctcccaacccctaccctatcagattttcccactccctggggcttcaagtcttttgagggttagtggccacttctttcattgagtccagaccctgcagtcctctgctttatatgtcttgagggcctcatatcagctggtgtatataccgagcttttgtccccgccagcaagaacacactcaggacaaccagaatcttctgcggaaaaagctttattgcttacttctcaggaagaccccgacctcagaaaatggagtctcttatatagccctcagccatggtgtttcagcacctgatatggcatgtcagctcctgatttgttgctcacccatcaccccattactaagccctgagatgggcagtgactaggagtgagttcactctcgcacctgcgtacaaggcttgtttactagttaggcacggaggccagcgccatcttataatggcgattgctcgctgctcgtgattgctcgaggcacagctctccaaaggtgtatgttgcctggttggtggctcattgtcagagagatcctggggaccaggatagagactgctggtcttcctatagggttgccttcctcccctgcttcttccagagccaagattctaacacacacacacacacacacacacacgcaagatgttattttaaatatatcttgttcatttctatctataagactaacaaggcacttcagttttagaacatattatatattgtgaatttcaatttaattcaaatttcacttatggatgaataggatagtggtttagtttgtttattagtatagatactgcatagaggatacttttgtagttggaggaggatgtcaccgctttagtatgatcagtatgggttttagttttcttacccaaaatatcattgactagtttttgtttcagagtaaaattcccttcatagaaagaattactagttacttt

SEQ ID NO: 4316 - DNA, 1200 bp, mus musculus
gattaaagggtttgccattaagagctagatcagaaaagtactcacttcggcagatagacattatataaaatgtagccacataaaaggaaaaagagtagaatgtaaatggtgataatctagaacaagatgaaagttagaattggagtattaaagtgagatgacaactatagtttataactgtgagtagttaataaatgctgaataaattacatgaacaacctacataaatggttaatgatttttattctcaaattccaaaaaacgggcctactactatagctatagtagttagatatgataaggcgatttcaggttctcatgatttctgggaaactttgaattatgttggtgggatatagaatgagtctgtgatgaccacgtttaaaagttattgaccctcttcctgtaagcggccggaggtgacctgtgaagatggttcactactcccttgacccagaaaatcccacaaaatcatgcaaatcaagaggttcaaacctccgtgctcactttaagaacacccgggaaactgcccaggccatcaagggtatgcatatcctcaaagccaccaagtatctgaaggatgtcactttaaagaagcaatgtgtgccattctggcggtataatggtggagtcagtaggtgcgcccaggcaaaaaagagtgctgaatttttgctgcacatgcttaaaaatgcaaagagtaatttgaacttaagggtttagacgtagattctctagtcattaaacacatccaggtgaacacagaacctaagatgcgccgacgaacccacagagctcatggccagattaacccatacgtgagctccccctgccacagtgagacgatcctcactgagaaggaacagatcgttccaaagccagaagaggaggttgcacagaagaaaaccatatcccagaagaaactgaagaaacaaaaactcatggcacacaaatgaattcagcataaaataaatgcagataaaagtaaaaaagaaaaaagttattgaccagcctctttagtcctatttctactgtaaaactcaactttgtgtggatattagaaagttaagatggcttattatgatgcatcccaagtctcataagaagaagtctctaaaaccaaatatcattccatcctcatattttcagtgcctagtaccatgctagtatcattgtaaatgaagactcaacaaccctttgcta

SEQ ID NO: 4317 - DNA, 1200 bp, mus musculus
cattaaaatagatgaccattggggtggggtgttatttcaccaaaatcataagaaataaaagaaacagataacagatactatatgaacttgaaattttgattttatattgtagaatactcaaaatacagagaaatgatgtacagaattggagaaaatacctttaaaaggattgggagcagagactgaaggaaaggccagggactgacccacctagggatccatctcacctgcagactacaaaacccagacattattcctgatgccaagaagcacttgctgacaggagcctggtacagctgcctcccaagaggctttgccagagcttgaccaatatagatgcagacacttgagccaaccatcggacagagcacatgggacacaatgaaggagttagggaaaggaatgaagtagctgaaagggatttgcaactccataggaagaacaataatatcaaccaaccagaccccatagagttcccagggaataaaccatcaaccaaagagtgaacatggagagacccatggctccagctgcatatatagcagaggactgtcttttctggcattagtgggacaggaggcctttggtcctgtgaaggctagatgccccagtataggggaatgctaggacagtgagataagagttggtaggagggtgggggatctccctcatagaagaatggaggagggggatggaatagggagtttgtggaggggaaaccaggaagggagaataacatatgaaatgtatataaataaagcaaacaattaaaaaaaggaaaaagaaaggattggcatccaggtattgtgttataataaggttatgaaaatataataatttttggctgtgagcctagcttttaacgaaagagccatctctccagagtgggtgggtaggggaagagggcagagggagggtatagggagcttttgggatagcatttgaaatgtatataaagaaaatatctaaaaaataaatgaataaaaaaaaaagaatgttgaacatagctttaagagcttctcaaactgggaaggcagtaccatttgaaatgtaaataaacaaaataaccaaaattttttttaatttaaaaaagaaaatataagaaaatataaaaatataaataacttaaaaggatctgatggtgttttggatttcttcaagatctgttgttatgtctcccttttcattcctgattttgtt

SEQ ID NO: 4318 - DNA, 1000 bp, mus musculus
gctacatatgcagctagagacatgaactctggggatactcgttagttcatattgttgttcctcctatagggttgcagaccccttcagctccttgggtgctctctctagcttctccattgggggccctgtgttccatctattagatgactgtgggcgtccacgtctgtatttgccaggcactggcatagcctcatacgagacagctaagcagcagaactactgctgcagtattctgctaggtttccactgcctgtaaattctaagcacattgtttctgcagtctcttcagagggtagcagtttctccacaggtttcctttgacccttgcagcagtacacaagtcaaaccataactcacctgtgtccaccagcagcatttccttctactacagtttgctccctgataggcttctctgtgctccatttttattttgtataaaatacccttaaaataatggtttgtttgtttcttctttctttctttctttcttttgaaattttttattagatatttatttacatttcaaatgttaaccctttcctggtttacactccgcaaaagccctatctcatctcccatcccccatccctcaccctgcttctatgatggtgttcccacatccatctaccaactcccactttcccatcctggcattgtcctacactggggcatcaagccttcagagtaccaagggcctctgctctcagtgatgcccaacaagtgatgcccgctgctacatatcatgggttgctctatgtgtactcttttggttggtggtttagtccctgggagctctggggggtctggttggttcatattgttgttcctcctattggactgcaaaccccttcaaggactccatcagtcctttctctaactccttcactgtgaaccccatgctcagtcaaatggttgcctgaaagccaacctctgcatttgtcaagttctggcagagcctctcaggagacagctatatcaacctcctgttagtaagcacttc

SEQ ID NO: 4319 - DNA, 1200 bp, mus musculus
tcccttcaggtccttgggtactttctctagctccttcactgggggccctgtgatccatccaatagctgactgtgagcatccacttctgcgtttgctaggccccggcatagtctcacaagagacagctgtatcagggtcatttcagcaaaatcttgctaatgtatgcaatggtgtcagcgtttggaggctgattatgggatggatccctggatatggcagtctctagatggtccattcttttgtatcagcttcaaactttgtctctgtaactccttaccctggagctcttgactctagctgcatatgtatcaaaagatggccttgtcggccatcactggaaagaggtccattggacatgcaaactttatatgccccagtacaggggaacgccagggccaaaagtgggagtgggtgggtaggggagtgggggggaggggacttttgggatagcattggaaatgtaaatgaggaaaatacctaataaaaatattttaaaaaaagaagtaagcaacaatagaagctgtattttatggttttccttaagtatattttcatatttctatatttcacatttctgtttactttgcctaggaatttggtgggccagagacacctgtttaccttggaaatgaaatggaattatttaatagaaataaaaaacatggaaaaaaacttaaaagaaatggcttgtggatcaaagaaaacgtttaaaaaacacggagtgacttagtgtatatgctactgggacatacaaaactgagactacaaactgaccaccagatttaacaacgtgatgatgaaagaccctcgtttcggggaggctctcactcaagtcccgggatgagccaacacctcaataactcgagagaaacaatttttgatgtgatattgcatgaggtttattcagaaatcagcatgttgaggccgagctcgtaacctgcaccggggcagaggagatcgacccccaacagttgcattagagggtttttaaagaataaacagtaaagcgaggggaggataagatcacaaagactaggtaagttgagtgaacgtcgtaaaaatgaggatggtggattacagctcatctctcacggaaaggttacaggctatctttggcaaacattcttggtcccttacactatgggtcaggcacctgggtgggtcacccagtggtcatcattctctcaggatgaaggcgaa

SEQ ID NO: 4320 - DNA, 1000 bp, mus musculus
taccctgctgagcttccagggttttgaatcctaaaaacagcatgtcaagaaggttatagatcttgtgtccccagtccctatgagaccagtctgagcaggtgagcgcatggactgtggagggtgagggagcagactgcagaagctacacagcttctggaacagaccccatttcaggctccagatatccagggaccttccccgccagaggagaggtggccgcctggaagggctctgactgccagagcaggtgagggaggggtcttgtgtagcctgtccctctgagaccagtctgctcaggtgagcatgtggactgagaaaggtgagcaagtggactgcagaagcaacacagcttctgggacagacgctgtttcaggctctagacatccgggcaccttcccctccagaggagaggtggccacctgggagggctccgaccaccagagtaagtaagggagctatctagtgtcccaggtccatgggagaccagtctatgcaggtgagtgctcagacttcagaggaaacacatcttctgggacaggccctgtttgggccttcatcttcagccaggaggtaggtctgaatgccagacctctgtgcaccttccctgcaagaggagagcttgcctgcagagagtactctgaccactgagactcaggagagagctggaatcccaggactactgacacaggctaacagaatcacgagaagaataagctccagccagagacaattttaacaactaatgccagagattaccagatggtgaaaggcaaacgtaagtatcctactaacagaaaccaagacgactcaccatcatcagaacccagcactcccacctcaaacagtcctggataccccaacacacccaaaagataagattaagatttaaaatcatatctcatgatgctggtagaggacttaaagaaggaaattaataaatcacttaaagaaatccaggagaacactgctaaataggtagaagtccttaaagaggaaacac

SEQ ID NO: 4321 - DNA, 1000 bp, mus musculus
tgaatctgtcatatcttcattctcttctgtaggtcagtatcatggtccctgaaggtgagctggtaggatatcaaatattccctttggtccctgtgaccattcctactattagactgtcctttcttcctgttttccacaattgtatgatcatacttcataataatcaaaggtatccaagtgatcccagtctctagcctcaactctcaagtgcacgcacatcacatagtgtgaagaatctgcactaaatggttaagagattctttcttttcagtaggatgacttgtttttgtttttgttttgttctgttgggagggggggggcggagttgagacagagtttctctgtggcatgctctaccatgcctggctcagtttggcttggttgttcttacacctgagctcttgtcactttgttccatgctaattaattccttcctctctttcgtccttttatttcatctctgtggcttcagaagcctgccaggaatgccccctttaaattagcagccatggccataccttacactggatctgcatagtgcctaacaccatgatcactgctcaatttatggtcttcattagactacagagcacatgaaggaagaagcactcctgcctggcttaggactatgccttgggagttagggcacttcagagtggacaatatcccatactgtgtagcttggtagacgaggcagtcagctggctgtttggatggcaggatgattcaccatgattggctcataaaacaaattgagagccctgcttgctgaaagcagataactgcatccgaggcataatacttagaagcatctggccctgaaggagtctgatttgtatatccaattttagtcagtgacagaagaagcagccacactagcagagaagacttaggtactaatacaatagagattacagagctctgaaggagaaaaatgttcttaagcacaaagatgtcctgatgttcagaaggggaaaaatgtactttgcacaaagcaaaa

SEQ ID NO: 4322 - DNA, 1000 bp, mus musculus
aatgattcttgctgcaagttcatggctattttaccttccaaattcctagtggagattgagtaggtacatttcagatgttttgaccatcccctcaagaatcaggtcagggattgtgatggtttgtatatcctcggaccagggagtggcaccatctgaaggtgtggccttgttggaataggtgtgacctggttggaatgggtgtgtcactgtgggtgtgggtataagatcctcaccctcgttgcctggaagtcagtcttccactggcagcctttggatgaagacattgaactctcagctcctcctgcgccatgcctgcctggatactgccatgcttccaacttgatgataatggactgaacctctgaacctgtaagccagccccaattaaatgttgtttttttataagacttgccttggtcatggtgtctgttcacagcagtaaaacccgaactaagacagggatggacacagaactttgtaaagagccacaaagagaatacttaggtaatatatctgggagtcaccatcctctgaatctcataccacctagccacttttggtatgattgattttgcaaggtgttttggtgacctgtgtttattctttaattctttttgtttgtttgtttgttttttgagacagggtttctctgtatagccctggctgtcctggaactcactttgtagaccaggctgacctcgaactcagaaatccacctgcctctgcctcccgagtgctgggattaaaggtgtgtgccaccatgcccggcttattctttaatttttatactcttgacagaggaactttttcattcttttataaaatgaattgaataaaataaaacattctataaaatgagttatatactcaatataaatgcttggcaaatactaatttaaagtaaagatacagatgttttatcacttattatttaaaataaaattatttcaaaatctacaaagatggcttcttggatttgggttttggttgatgtttgagg

SEQ ID NO: 4323 - DNA, 1400 bp, mus musculus
tgaaatcttctgcacctgagattctctttcatctcttgtattctgttgcttgtgctggcatctatggttccagttctctttcctagggtttctatctccagtgttgctcattttgggttttctttattgtgtctacttccgtttttaggtctagtatagttttgttcatttctatcacctgtttagatgtgttttcctgtttttctttaaggactcgtacttctttagcagtgttttcctgtatttctttacgtgagttattaaagtccttcttgatgtcctctaccatcatcatgagatatgcttttaaatctgggtctaggtttttgggtgtgttggagtgcccagaactgggtgagttgggagtgttgcgttctgatgatggtgagtggtcttggtttctgttagtgagattcttatgtttgccttttgccatctggtaatctctggagttagttatagtttagttgtctctcattaagagataacttgttcctcccgtgattctgttagcctctatcagcagaccagggagactagatctctcttgagttttagtgatctgagcactctctgcaggcaagctctcctcttgcaaggaaggtgtacaaatatctggctttggaccagcctcctggcagaagatgaaggcctgaaacaggacctatcccagaagctgttagcttctgtagtccacactctcacctgtgcagactagttttggagggattagggaaccaagataacttccccaggtactctggcaaagccctcccaggcatggaggacactgaaactgggtctgcctcagaatgtgtcctctagggaccttggttgtgtcctctgactcctcgcccaggtgaccagtgctggggtcgactggaaggggcttgtgaccctggtcaggccgggttttctgcttccctaatgctggtcccacgtgattggaatggaacagaagttgtgttccactcactggtggtcctaagatcacgtggagagttctcttgggaccttgggggtgtccgccgactccgtgccaaggtgacctggttggataagtttttagtatagggtataaaacactactaataaaaactaattgtgcatcacctattttcataatatagtgtatttaaagatgatgcaaatgtagaaacaactattatgttgatatttgaatttcttcatgcaaattatttaggaaaaataccactttgaggaacattgaccttaaattcaagataacagaggtttaaattatcttaaatccaaatgacttctttttgatatctgaaacatctctgccattgtacttatcaacatagatactaattctagtcatataagtatgtatttgatctttgtagccttgcagctaaccaatatcaattagtatt

SEQ ID NO: 4324 - DNA, 1000 bp, mus musculus
aaaaaatatttaaattaaaaaaaaaaaggaaaagaaaactcagacactattgttgatgccaagaagtggttactgacaggagcctgagaggctctgtctcctgagaggctctgccagtccctgagaagtacagagttggatgcatgcagccaagcattgtactgaacactgggtctccaatggaggagttagagaaagaactgaaggagctaaagggtttcgcaacccaataggaggaagaacaatatcaaccaaccagacctcccctcccctgcccaagagctcccagggaggagaggcccttggtcctgtgaagactgaataccccagagtaagggaatgccagggcaaggaggtgggagtggggtagggtaggggaacactctcataaaagcaagaggaggagggtgagatagggggctttcagggggaaatcaggaagggggataacatttaaaatacagtcaccaaaagcaaacactattgtggatgtaaagaaatgcaagctgacaggggcctgatatggctgtcttcttagaggctctgccagagcctgacaaatacagaagtggatgcttgcagccaaccattggactgaatacaggtccccaaaggaagagttagagaaaggactgaaggagctgaagggatttgcaaccccataggaagaacaatatcaaccaaccagatccccccaagcttccaaggactaaactagcaagccaggagtacacatggaaggattcatggccccagctgcatatgtagaagaggatgcccttgttggatatcagtaggagaaaaggcccttggtcttgtgaagacttgatgcctcagtgtaggggaatgctagggcagaaaggcaggagtgggtgtgtgggtggggaaacaccctcacaaagcagaggggagggagaatgggatagaggacttctaggaggaaaccaggaaacaggataacatttgaaatgtaaataaagaaaatatctaatgtggtaca

SEQ ID NO: 4325 - DNA, 1000 bp, mus musculus
aatattagcataaaactctaagcacctgcagaatcattccccagcaggtgacaacagctgcatcttgacatctgattctcctgcatgacaggtgcattggtgccatggcaaggaaaggtccaaggtccctgctgatgccacagcagctgctgttgagagacagcatctataacagctgggactgagagacagcatgaagtcattttctatgactgattaactgttttgttgggggctggtctgactttgatccctaaaccatgttcttcattcttctgagaaattttctcagcactgtgccttcaaacaatagccctttgtcctttgtcagcctgagtcaacttctattacatgaaactttaaaacctgaagattaagataccttagtaatttcattaaggttttaaaaaataataaataagtaaactatatccttggcaaggctgattatcacatgaaacacatcgttgtgtctataatcaaaatcagttacatggttatttctttaaaatattttccatttgtacaattatgcagacatgggcggtcaagtcatttccatcttagagtatgttagcagaaatgacattcacttagataacattttatttttacattttctgtttttgtcctaaccaatgaaacttataactcataacataaattaggtttatgtggaaatttaatgagtgtattaattatattactctcctctttttctccattgagaaattgtgcatatgtgttaacatgtatgtgtttaggtttgtgtgtatgtgcatgtgtgcatgtgtgtgtgtgtgtttcttgagggaaggagtggagagagagagagagagagagagagagagagagagagagagagagagagagagagagagagattgattctctccctgatatggaactcagaacactagactaactgcaattggcttataagcctatatctttctatccccagtgatttgattctaagcatgcaccactcacaattttt

SEQ ID NO: 4326 - DNA, 1400 bp, mus musculus
gttagttaatgaatgggactcagagcatggatatgaactcacctgtgcaaaggaaacagagatctgaaagttccgatgaaagtctaaaccaaaacaaaagtgaacatcagtttctaagacgtgaaaaagaagacgtgaatgtagtaagacaacacagacagattcttgaatatgagaaaaaatatttcacagaattgtgttgatcttgcacatgattatgtgcatgagagaaggcatgagaatgtgttaaagatgaaaaatcctatttcctgattgcatttgcttaagaatatacaaaaagaggacttgtttaaacggacctccagtgaacatattattgtgcaagcttgaggacatactatgacagatatagatgtctataactctggtagtgtaagggtttacttatcttaaactccagattttattcccctccccgtctaccttataactgtgccatgtcccatacctcctccccattcccgactctccacaaggatatctccccacccccaccccaccagatctctaaactccctggggtctctagtcccttgagggttaggtgcattttctctgactcaacccagaccaggcagaagtctgctgtatatgtgttgggggcctcatatcagctcttgtatgatgccttattggtggtccactgtcaaagagatctcaggagtccaagttaattgagactgctggttgccctccttctcagctttttccagctttcccctaattcaacaacaggggtcagctgcttctgtccatcggttgggtgcaaatatttacatctgactctttcagctgcttgttgggtctttcagagggtagtcatgataggtccctttttgtgagtgctccaaagcctcagtattagtgtcaggtcttgggaccacctcttgagctggatcccactttgggcctgtctctggacattctttacctcaggatcctctccatttccattgctacagttctttccgacaggagcagttatgagtcagagttttgactgtggcactacagcccctccctcactcgctgccccgatgagttctacaagttccctctctccactgtaggacattttatctaaggtccttccttttgagtcctgagagtctctcacctcccgtgtctcaggtatattccggaggttactgagtgggggagaaggactgaggccccgagggtcagcagaaagaatagaaatattcacattcatatatgtaaaactctgcacgtactcagagacacaccaatcacacacacacacaaaaaatctataaacaatttaaaaaaataacttttactcctctgtcaaactctataaacaaatattttgtccacactgtgactgagaatgtaattcaaatgaaagttggatggcg

SEQ ID NO: 4327 - DNA, 1200 bp, mus musculus
cttgtctggtttgtggaatgactcttagaacagagcctttggtgtgctgaccaggaagcttccaaacctcacgttcccctcaattattgacaatgaactccaccaagccaagtgggccctctgtaaggagatcagatttttctgtaactgcacagttccttttctttgtttggtcttgtttgtgatactttttaaaattacccaagagtgtaacacctgacatattgtttacttaggtatgaggacagggaatgctctgactacatgggtggcatataagacacactctttggaatttgacttggttgtgactcttctgagagcccatgcagcaatgtatccatcttttaaacgcagtttttttcttttatttgtttgtgtgttttgttttgttttgttttgtttcttccatcttcattttgtttttgttttgttttcattttattctttgtctctaaatccttcactatgggacatctggatctctttgaagggatattagggtctgttccttcccctccactccctctattgattctccttaaaaatgaagatctatctatgactattagtttgtttaaagttttatttaattccttgagtgttgctctgtttcatgttcagaggaaaatgatcacaacttcatctattgaccattaaccctttgacaatattttaactcatttcaagaatttttatacaagatagaagtctcaattgggacaagaaaaactcaggaactgcccttggagccctgtacctgcagcttggactttaacactgctggagaagtcagagacttcttgtctgtaagagctactcttttttaaacttacattatttttttacttacatttcaaatattatctccccttcccagtttcccctccacaacctcctccaccctctcacctcctcctgcctctataagggtgctccctaacccgcccacccactcctgcctcagtgccctagcattcctggatcatgtgtcattgagccttcacaggaccaagaggctaccttaaagaggaaaacagctgtttggcttctcagcctctctaggaaggaagctgatgtcttgtcttactactttctgtgactattaattttggattcagtgggtagtaacatgcttttccctagaagtgagaactagaatgtaataaaattttgtctgtctattcaaaatttataagt

SEQ ID NO: 4328 - DNA, 1000 bp, mus musculus
caggacagcaagaggctcctgggacccaaccggaataagattagttaaaatgctcaacaaaggggagaaagaacctgtagagatcaaatccagaggttaggcaagtcaccaagttggggcctggggccaccctctccaaatttttaacccggaattgctcctgtctacaggaaatatgggggcaaagtgtgaagcacagactgaaggaaaagccatacagagactgccccacctggggacccatcccatatacagacagcaaaaccagacacttttgcagatgccaaaaagtgcttgctgacaggagcgtgatatagacatctcctgagaggctgtaacagatcttgacaaatacagaggtggatgctcacagccaaccgttggactgagtacagaacaacgatggagatgtctgagaaagaactaaaggagctgcaggggtttgcaaccccataggaagaacaacctttttattattaattattattattaattattattttatttactttaattagatatgttctttatttacatttcaaatgccatcccgaaagttccctataccttcccccctgccctgctcccctacccacacactcccacttattggctctggtgttcccctgtactggggcatataaagtttgctagaccaaggggcctctcttcccagtgatggccaactgggccatcttctgctacatatgcagctagagacacaagctctggggttacttattagttcatattgttgttccacctatagggttgcagaacccttcagctcctgggttctttctctagcgcctccattgggagccctgtgttccatcctatagatgactgtgagcatccacttctgtatttgccaggcactggcatagcctcactcaaacaacaatatgaagcccagattccccagagctcccaggtactaaaccaccaactaaagggcacacatggagggacccatggctccagctgcatctgtcccaga

SEQ ID NO: 4329 - DNA, 1000 bp, mus musculus
caagttgtcctctgcaattgctgtcctgttgtgtctgtaaataacacaaaaattgagattctgaaattcagtattaaaagaaattatttgtcagtctgaagaggtggcccagtgttaaagggcatttactgttcttatgaagagcctgggggttccttccagtcccctccagtaccaggccaccttgggctcaaactcagcaggcagtcccagggtctccagaggactttctttcccacaagtgccctaggatcttaaaaccactgctgagtggaacacaagtgttccagtagagctgagggtgcctgggggcagctggagcatagacacaggaaccctgcatgatcagtggctcaggttccttccagtcaacgctggtcaaccttgatttagaactcagcagacagacccacagtccccagaggaagtatcacttccaggtgctctaatacattcaggatcttaggatcccaggggcttggtcacaccaggatctcagaggaatttgagtgccaagaactctggcatatccagaatcttagcatcacaggatcccagaatcacaggatcacaaagaaagttggactctgagaagttctgactcaactgggaataaggaaggacaagctccaatcagatatatcgaaagcaaggagcacttgagataatcagatggcagaaagcaagtgtagaaagagaagccacagaaaccaaggttacttggcatcatcagaactaaactcccccaccatagaaaatcctggatataccatcacagcagaaaagcaagatatggtattgcgtcccgctcgactggcaagaaagacgcaacaaaccagaatcttccgcggcaagagctttattgcttgtttctcaggaagattccgaaccgggaaaatgcgctgcttttataacccgcagcgtgacgtttcagcacctgatatggcgtgacagctcccgattcgttgcttgcccatcaccccactattacaccctgaga

SEQ ID NO: 4330 - DNA, 1200 bp, mus musculus
agatgacatatttataggcttttgaaattatgatgaggaatattctttgggtaaatgttgggagccgctcccacattcgccgtcacaagatggcgttgacatcctgtgttctaagtggtaaacaaataatctgcgcaagtgccaagggtatttacgactacttgtactctgtttttcccgtgaacgtcagctcggccatgggctgcagccaatcagggagtgatgcgccctaggcaattgttgttctctttaaagagggtttggggtttcgttttctctctcttgcttcgctctcttgcttcgctctcttgcttcttgctctcttgcttcttacactctggccccataagagatgtaagcaataaagctttgccgcagaagattctggttgttgtgttcttcctggccggtcgtgagaacgcgtcgaataacaattggtgccgaattccgggacgagaaaaaactccggactggcgcagggaagatccctcattccggaaccagaactgcggatcacgtttataaaggttcccgtaacacagactgttgagaaggattcaactgccgaattcagaactcatcagctggggaacgacggtgataaaggttcccgtaaagcagactgttaagaaggattcaactgtatgaattcagaacttttcagctggggaacgagagtaccagtgagtatgtttggccttgaattttttctggtgttaggagcccttttgttctttttcacatgctatcaagtgattaagatagggctgaaaattctagaggaaattcaggacaagctatcagaagtaaagcgggaagaaagagtaggaaaaaagaggaaatatgatacacaaaataagtatacaggcctttccaagggtcttgaacccgaggaaaagttaaggttaggtaggaatacctggagagagattagaagaaaaagaggaaaaagggagaagaaaaaagatcgattagcggaggtctctaagagatactcgtcactagatgagctcggggagccagctcttagtagctctgaagcaggtgaagaatcctcctttgaggaaacagactgggaggaagaagcagcccattaccagccagataattggtcaagaaaaaagccaaaagcggctggcgaaagccagcgtactgtccaacctcccggcagtcggtttcaaggtccgccctatgcggagc

SEQ ID NO: 4331 - DNA, 1800 bp, mus musculus
atcagtttttctttataatatgttcaggtgtgtctgttgaaatttagaacagattagcttaattgtgggagttttacaaaggataagacacataaatcgaattcaaaattcatggaagtaatagctaatttaataaatactcatagaagcaaaaataaataagcataaaataaatatgcaaatgaaacagatggtacaacacttagatattgtgaaagtcacagtgaaacatgactctaagtatatggaatagggaattatttagatagggtagttgtacaagactctctatgcagaaaaaaattggagttaagtagcatcatataatagaaattacaaaactagatacatccaggaaaggcccatagaaaagttgaatggaaattaattgaccaaattttagctgagagcaaaagagaaagaaacgatatatgtgagatatacttaaccatgcatggacgtgtatatttatatttatatttcttctgtaccagaaggtctttgaggaatattacatgaatgtataataatactcatcttttaaatacaatgatccttcaactttgtaaaatctactttggaagaatcaatgtttcaagctccaaacctatgttaagagtattttatcaagattgctatgtattatacagctaagggtaaatgctcactaccaaccactggactgagcacaggttccccagtgaaggagctagagaaaggactgtaggagctgaaggtgtttgcagtcccatagtaggaactgaaatatgaaccaaccagtacatcccagcattcccagggaataaaccaccaaccaaatgcacacatttaggcacccatggctccagctgcatatgtaatgcagcatgaccttgtggaccatcaatgggaggagagcttcttggtcctgagaaggcttgatacccattgtaggggaatgccaggacagggaggcaggagttttgaattctttgttgcaccaaaccattgatgacatttttccccaaaaaactttcttagcacatccagatcctctgttattttggtagaatgccaaatgtgatgatatgaaagggtcaattgtttgttttatgcttttgggttctttttctttttctttttttttgttttctttcttcctttttatttttattataaatagcacacagcaattatttctgtgtaactctgactgtcctcgaatttgttttataggacaggctggcctcaaggtcacatagagttgcctgcctctgcatcttgagtgttgggataaaacacatgtaccacttgaggcctgttgactcccttgaccaaaacttcagtggaaagaatacattataaaagtgaagctgagattggtttatttcaatgaactatggtttcagagaacaggataatctgcacatgtggataccactgtccaaaataatattccatgttatattttctagttagcttatagaatagtagtttgtatatttccatacatcatatatatatatatactaaagatgcatgcaacttgatgttggacattagataattgaatgatagaaataaatatatagaagagggatgggcagggattttgagatgcatagctcagaagcataggcagaaaaacaatgtgtgtgtgtgtgtgagtaaaaactaattcaacataagaaagaatttaaagaatacagaaagacaaatttgtgactttatatagttccccacagtttatgcacatgttaatgaatgatttctgtatacatgagaatgactttggcagaagataacacaattaagacttct

SEQ ID NO: 4332 - DNA, 1400 bp, mus musculus
ccatctcttgtattctgttgctgatgctcgcatctatggttccagatttctttcctagggttcctatctccagcgttgcctcactttgtgttttctttattatgtctacttccctttttagcccttggatggttttattcaattccatcacctgtgtggtcatgttttcctgcaattctttaagggatttttgtgcttcctctttaaggtcttctacctgtttagcagttttctcctgtatttcttcaagtgagttattaaagtccttcttgatgtcctctaccatcatcatgatatatgcttttaaattcgggtctagattttcggatgtgttggggtgccctggactgggcgaggtgggagtgctgggttctgatgatggtgagtagtcttggtttctgttagtaagatccttatgtttaccttttgccatctggtaatctctggagttagttgttatagttgtctctggttagagattgttcctcttgtgattctgttagcctttatcagcagacctggaagactagacctttcctttgagttttagtggtcagagcactctctgcaggcaagctctcctcttacagggaaggtgcacagatatctagcattcagacctctctcctggccgaagatgaaggcccaaaataggaccgttcccagaagctgtgttgctttggcctgtcacagaacctgttagcttctgtagtccacactctcacctgcacaggctagtctcagagtgatctgggaaccaagttggctcctccaggtgctcctgcaaaggactcctgggcagggcagacacctctcctctggaagggaaggtgcccggatatctggagcccgaaaagggggatgcctcagaagctctgtggctcccacctgtcccagaagctgttagcttctgtagtctacactctcacctgtgcagaccactctcatcggagtccgggaaccaagatgtctctctttccatctttttatatggtgcattacattaatggattttcgtactggaactatccatacattagatggattatggttttgatgcattccggcattcagtttgtgaaaattttatttagtttctttgcatcaatgttcataaaagaaactggttctttgttgggtttttgtatggttaagtgtcagcgtgaatgtagcttcatagaatgagtttggcagtgttccttctgtctctattttgtggaatagcttgaggagtattggcattagttcttccttaacaatctattagaattctgccctaaaattatctggccctgggcactttttggtgggagatttttaatgagtgattctatttctttaggggttctaaggctacttaaatagttttcctggtcttgatttaactttggtaaatgata

SEQ ID NO: 4333 - DNA, 1000 bp, mus musculus
aatatatatatatatagaaaactgttgtgagttcacagtacagatacccacttccttgctgtgtctagaagcatgtccttgtagtcattctgacagtctgccctcctctgactctttcatttttgattctccatcttctacaatgagccctgcatctttgaagaaggagctgagatatgtatctttttctttggactgagtactctaaagctccttattttctgcacagctgcaagttgtgagtattcatattagtcactatctgtttcaaatagaagcttgtgaaaaacattaagagaagcatgaatctatgaatgtaattgtaagtcattaggaatcaataattactctggctattttttttaagtttttttgtattagatatttcttcatttacatttcaaatgctatcccgaaagtcccctatacactccccctgccctgcttcccaacccacccattctgcttcctggccctggcattcccctgtactggggcaagaccaagggactctcctcccaatgatggccggctaggccatcttctgctacgtatgcagccagagacacgagctcctatagtattgcagacccccttcagctccttgggtacattctttagctcctccattggtgtccctctgttccatccaatagatgactgtgagcatccacttctgtattttccaggcactgtcatagcctcacaagagacagctatatcagggtcgtgtcagcaaactcttgctgacatatgcaatagtgtctgtgtgtggtagctgtttatgggatggatccctgggtggggcctgaggaaaagaaggtccagttacaggcccaaagtgggatccagttcaaggagaggtctcaaggccatggagtacccacaaaaaggtacttaccatgaccagactctggaagcctaacgagcaccctaaagagtcaaatgcagatatttgcacccagacaaaggagagaagcagctgactcctgttgttgaa

SEQ ID NO: 4334 - DNA, 1200 bp, mus musculus
tttattttgaactgtgatcttccattctccccacaaatctgcttctatgcctttggctgtctttctatgctcaatatttgtttgtaagttatgaaatttacagtatcaaaggcattatacacagacttataaattatacattgcatagaattttagctttatattttcagtgttcgcttgcttatatttttgctaatgaactttttaatattaagtccccttcatccagtgattggcatgtgtatctgaaatacaattacaattttattacataacaaaaaaaaaactattttttttttgcccataacaaaattacaaccaatttcttgctatgggttgacatctactttatgtcaaatttccaaatacttgatttacttctatcatgttttaaatatttttattgtttattttatttatttacacttcaaatgttatccctgttcctggtttccctccaagaacaccctgggaaccccctatcctatcccttttccccctgcttttatgagggtgttaccccactcacacaccctctcctgcctccccactctggcattcacttacactggggcttcaagccttcacaggctcagtggtctcccctcccattaatgctagataatgccatcctctcctacaaatgtgtccctccatgtgtattctttggttggtggtttagatcctgggagctctggtgggtctggttggttgatgttattctttctatggtgttgcataccccttcagctccttcagtccttcctttacttcctccactggggtctctgtgaccagtttgatggttggttgcaaacatcctcatctatattggtcagtttctggcagagttctcaggggacagctatatcaggctcctgtcagcaagtgcttggcatcaacaacaacccagatgtccctcatcagaggaatagatacagaatatgtggcatatttacaaaatggaatactactcagttattacaaacaatgacttcatgaaattcacaggcaaactgatagatatagaaaatattaccctgagtgaggtaacccagtcacaaaagaacatacctggtatgtactcactaataagtagatattaggcaaaagctcagaatacccaggagaaagtttacatattttgattccttttatattacttaaggaattgatctgagaaggaattaaatgttgttt

SEQ ID NO: 4335 - DNA, 1000 bp, mus musculus
gctgtgttccactcaccagaggtcttagggtcccgtggggagtcccgtgtgggcccttgcgggtgttgggcaagactctgctggcaaggtagcccggggctcgagtctcgagtcgagcggaagggacttgtgccccagatcaggcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtcacgagtcgagcggaagggcgtaagagttactcttacctgcgttcacgcaccaactcttacccgcgttctctcgaccggccaggaaagaagcaacaaaccggaatcttctgcggcaaagctttattgcttacatcttcaggagcaagagtgcaagagagcaagagagagaaagaaaaagaacaagaaagcaagagaaagaaaaagaacaagagcaagaaagagaaaaagaacaagaacaagaaagcaagagagagaaaacaagagagagaaaaagcaagaacaagagagagagaaagaacaagaaagcaagagtgcaagagcaaaagcaagagagagaatggcaaaaccccgtcccttttaaggagaattatcctccgcctaggacgtattactccttgattggctgcagcccatcggctcagttttcatcacgagaaaggcagaacacatggcgggaaaactgcccctgcacgtgtgcagattatgtttaccacttagaacacagctgtcagcgccatcttgtaatggcaaatgtgagggcggctcctcacagcctatttctcccactcttgaccttcctttgttggctatgtttctctgtgtagggatgaaaggcaaggaggatatcacttcttaatctttctgcacattgcacatattgagatctcagtgactagtttcttac

SEQ ID NO: 4336 - DNA, 1000 bp, mus musculus
tatatcgtatatcgtatatcgtatatcgtatatcgtatatcgtatatcgtatatcgtatatcgtatatcgtatatcgtatatcgtataacgtgtaacgtgtaacgtgtaacgtataacgtataacgtataacataatatataacataatataacatgcaacatacaacatacaacatataatacataatatatatatatatataaacttagtgtcaattatgtatttgaatatatctacattttcattttcttcccagtcctgcttcacgagttacccaccctatcacccctactttcattctaagagggtggtcctacaccgacaaaccaatcctaccttactcctttagcatcccccttctctgaggcaacaagcctccacaggaacaataacttccactcgcactgagtacaaacagtgaagtcctctgctacatatgtacctggggtcacagaccagtctatgtatgctctttgtttggtggcttagtctctgggagttctgaggggtctggttagttgatactgttgttctttcaatggggttgtaataccgttcaaccaatctaggccttctcctaaatcattcataggggctcccaggtacagtccaatagctggctgtaagtatctgcatctgtctcagcaagatgctggcagagactctcagaggaaaaccatgcaggctactatctacaaggatatcttgtcatcagcaatagttttcaggtatagtagcctctgaccaggctcttctatctttcatagtctgttaaaaattctggtgtagaatcgagcaccggggtgccttgccagcggaattggcagacacccacaagggcccacacaggatctgccacaggatcctaagtcctctggtgagtggaacacaacttctgccaggaggcaggttcaaacaccagatatctgggcaccatccctgcaagaggggagcttgcatgcagagagtactctgaccactgaaactaaggatagacc

SEQ ID NO: 4337 - DNA, 1200 bp, mus musculus
aatcatcgctcccatcatatgttcttaaatataaagacaagagtcttaaaatttcacatttattttatgtatttgagcctatttatttctcatattggtttctatttaaagatttttcccaagtctgaaaagcagctgtttacttattttcaatgacccaaatattcagtcttctatgtttagaagagttctcctgctcactgacaaaatccaataggtacataatttttgccattttgtttctctttctagcaatgtattttccaatcattgtcatcatataacaatacacaatttggtttctttggatcctatcccttaatatttcagaatatacaccttctatatgcttgacacttgcagagtcttgtttactggaccgggaagctctggctttcagaatgtttggagtaatgtaccaaaagcctttacagcaacttcagaagtaccacagcctgaatcataggctgtactgtaaatggcagcatatggctggagagtcagagcagcaggataatgtggcagtgcccagattccagctgtaggcatcaaaacaaccttttgatgttggtactcatagctcctatttacatcaaaacctaaataggatgactattaaagagtctgttgtctttaaggctctattaagttattgcccaaggtggtaaaggaaaacaatgtctacatatgtttgccagattcatacaactcctttattcaggcactcctggcaggtgtctctttaagtacttattctaaatggaacacaactgggagacatcaaaaagggcactgttgacaactgtcatagcaggttccagcttgaatggcaactgagcagaaggtctctctccagagtccttcagatcatcctaatagaagcatcatttccaccaggaacccagcgtctaccaagaaggagtgctgggaaatactgctcgtggtgaaaactcagctcatccctggaaaatttccatgccactagatttcccacacaacatacctacaaagctcctgaaagactctttactttaatgttaaaattgcaatatttccttttttctttttaaattggttattttatttatttacatttcaactgttaacccttttctaggtttccactctggaaacctcatatccctttcttcatccccctgcttctatgagggtgctcccccacctgcccacttactccca

SEQ ID NO: 4338 - DNA, 1800 bp, mus musculus
atatagctttaaagaaattaacttctctctaatcatgatacccaaagcaaaggaagttcttcctcacacctccaataccaattgcattccgatttagtggtaacactgagatcaaaagctaatctctctatgtgaatttgagcttgtaacttaaaaatcagagtttccaaaacaaaaatccctaaactccagcttaattacaatgccaatctaataatacgcctttacctaaatctaacacctaataaacaatataatgtttgccatcaaagcagaaaatgcacctttaatcaataggctatgtgttgctccaaaataaagatgatttaaattttatgactattgatattaacaaaacatttctaactcatagtagctttcagttcaaattttagaacatgaaaagcagaaaacagctgagtcctcacaactacaatgtaagcaactcaagatttaaaactataggtgctttgaattacaaattagtcttcttaaattgtgttatatcaaatatgtatttttcttcttttattaagtaatttctttatttacatttcaaatgtaactccctttcctggtttctcttctcccctccccctgctcaccaactcacccactcctgcttcctggccctggtattcccctgcactgggtcatagaatcttcaccaagagaaccaagaggaccaagggcctttcctcccattgatgactgactaggccaccctctgcttcatatgcagctggagccatgagttacaacatgtggactctttggttggttctttagtccctgggagctctgggggtactggttagttcatattgttgttcctcctatggagctgcaagcccctttagctccttgggtccttcctctagctccttcactggggaccatgtactgagtccaatggatggctgcaatcatggttacttctttttctttttcttgtatgaccatgacagatttgggggttttaaataggaatggtgttgatcaagccataccgtgatacatatccaaaaacataatagacaaaaggtaaggatgctattctaaggattcacctcctttaccaaataattgactaccaaaaggaattggttaaattattcctactaagctatttgtaccttcaaatttaccatcaactaaacctgtagtgttatcactcaaatgttttatcagaatgcatccaatgtaagatttaaccaaaaaaaaaatctaattttagtatatttctaggatagtatgttgtagatctctgagggatcttataagttcaatgtgtgactgaaaagaaatttagaacatgttattaaaattatagcaagggaagaataagcagctggtaatattctattatagaaatagatgaaagaagcatttttttttttaattttcagggataaagctggaaaaaatgctctaagaaactaagaactaagaggtttgcggaggataaaccggtaatggggataatatttgaaatgtaagtaaataaaataaccaataaataaaagaaactaagaactaacaatactataaaatagtaaaataaattagaatatattgtgcttaaatggacaagggaatgcatcttcagtgtgtgacagagtgagctggggagactcagggtggtgagagctggaaaatttttattgaagagaacaagggttggtgttttttgggaacttagaggtgaggctggaataaaaataattaaaagcagaaaataacaaaaccaggaaaggagaaaaaaaaagagaaaaaagaaatgtggggaagaaaaagaaa

SEQ ID NO: 4339 - DNA, 1200 bp, mus musculus
ttaagtaaaataatcaaagaacactagaaccataaaactgtatgcttaaaatatgttaaaatgagtttagttttatcattacattatttttcccacatattgctaaattaaggaaaacaacacacattcacttgacatcctgatcactgctgcctatcccagttacccctcctacaatcgctaccccaactccctcctcctctaatagggtaaggaacccctggttattccccaaccctggcatatcaagtctctgcagagtctcggcatatctgctaccactgtggccagacaagacagcccagatagaataaaatatcacacagacaggcaaaagcatttgggataactcctacttcagttgttcaggaccaacgtgaaaatcatgctgcctatctgctacatatatgcaggggtcctagctccagcctgtgaaagctttttggtggttcggcctctgagagccacaaaagcctagattagtttacactgttgatctttctttggcattcctatccccttccagtctttcaatccttgccccaactcttccataagagtccccaagctccacccactgtttggctatggctgtctgcatccacaatcagctgctaggttaagcccctcagaggacagccttgctaaactactgtctgcaagaataactgagtaccattagtagtgtcagggattgatgcctgtctatgacatgggtctcaagttgagccagttagtggttggttatttccttagtctctgctccatctttgtccctgcattacttgtagactggataaattaggggttgaaagttttgtgggtgggtttgtgtccctatctgtccactaagatttctgtctggatacagaaggtggcctgttcaggtgtgagtctcagctaaggtcaaccccctttgattcttgggtacctctcctatccctggtctctatcatgtcctttagatgcccatctccaagtcagtttcagatttccattcattatcatggccttctgttcatctctcctgtcccttcaaacacatgatcatgaaccatctggattcctcagcccatcccttcttctacccagattcctccctccctctgcctcctactgattcaaacaccctactttaggatttccatcttatttagcttctttgggtctatggagtgtagcatgggtatagtaatattt

SEQ ID NO: 4340 - DNA, 1400 bp, mus musculus
ctttgatagtcttctagagtacatttttacatttccaattaatagaaatggatcagtgactcaaaattagttcaaagaggcatgaaatgtctatgcaaatagcaatgcaggcagtacaatttgtaaatgctcggacaaataaatttgaatgtgattatcccgcacaaggatcttttccggctaaagcaaaaccaggcattctgggccataaggacaagattactttcaagatagaagcgaaggattgctgaatgtttaagactagtcatggatataaaacaaaccccaggcaaccttgagctacgagatgttcttccatcaaaagacccaacaagtcaataacaaaaacaacaaacatgagtcaaattataatataaacagataatattaaaatgctatgtatttcatatttaccttcaactttacaatatttttgtagagtattttatttatttacataccagatgttatccccattcccagtttctactcaggaaaccatctatccccttccctccccctgcttctaagaggggagcacccacccaccaactcctgcctcccctctctggaattccactacagtggggcattgagccttcataggaccaaggccatttcatctcattaatgcccaacaaggccattcactgctacatatgcaggtggagccctgggtcgcttcatgtgtactcgttagttggtggtttagtcactgtgatctctgggggggtctggttggttgatattgttgttcttcctataggttgcaaactacttcagccccttcagtcctttatctgactcttccattgtggtccccatgtttagtccagtggctggctttgagcatccacttctgtatttgtcaggcactggcagagcctctcaggagacaactatatcaggctcctgtcagcaagcacttcttggcattcacaatagtgtctaggtttggtgtatgcatatggaagggatccccaggtgggcagtctctgaatggcctcttcttcagtctctactccacactttgtatctatatttcatcacttaaatattttgctcttccttctaagaaggaccaaagcattcacactttgatcttccttctttttgagcttcatgtgttctgtgatttgtatcttaagtatttcaaaattttggactaatatttacttatcagtgagtgcataccatgtgtattcttttattactgaattacctcactcagggtgatattttcttgatccatccatttacctgcgaattttgtaaagtcattgtttttaatagctaagtagtactccatgtgtaaggcagaatagcttgactgtgacataataatccagtataattttcaaataggtataagaatagattttacacattttcattggaca

SEQ ID NO: 4341 - DNA, 1000 bp, mus musculus
ggtatggcctttctggtaagtatgtctccagggtgggatttgcgactttaaaaccgccccaaatgttctttctgctttgtgtttgctgaacaagatgtgagctatcagtgtgcatctccagatgtcatatcttcactcatcccatcatgaactctgaccgtcttaagctgtaagcaaactaacactttcttctacatgttgcttttgtcactgtattttataactgaagcagaatggtaaggaacagagtcctttgatttgaatactgtggtcactaaagaacataagatagcatttgagtggataatttagtgacacaggtgcatgggtttaggactgaaagttactgtaaaatctgttgtaacacaactataagtagtgatcaagcaagatgcccctgtggttaggaaaaggctagtatacctttttaaggacaggcacatatgaattttattctcataactctgagaaccgctctgcccctccccagaatgacagctaccaaggaattttttctactcgagcaagtagtcatatgacaaaatcttcactaagtaactaataagaaaaacatctttgagcatattagaatagtgattaatatatagtataattacatttaaatacatttacaagcaagtaagggcatgaactggagaattcctaaagagaaattataccaactgtgggtctcatatacaaagaatgtaattaaaatcatgaaattagctgaggtcaaatcagtgaacaaatataaaaggactaaggcctgaggaaaaatttcttcaggataaaattcaaagacattaaaaagaagtggaaatgttaatagtcaatataatggtggaaatgtcagaagtatatgtagtagaggaatatttaaaaatataatactggggaaaacataaaaagtagcaataactaatacaatgccaaattaattaaaatttaaattttatttgccaaggtttgcaatgtagagaggtaatgtaggagtgga

SEQ ID NO: 4342 - DNA, 1000 bp, mus musculus
attataacactgcagtcatccattaaccagtttttatttctataagagatacacataggtaatttagtgtgatcattaaaagctgataattattatgtgtgaatattctcaaaataagcaaccatcatcttgccgagtgcagctatgcctccttgtaaaaagaataccatagctcggtttgatcactctacatatcctcatcgcttgaggaaagcctgccaagacccttacatgagtgtgcagccttgccgggcactggtggcacacacctttaatctcagcactcggcaggtggaggcaggccgatttctgagttcgaggccagcctggtctacagagtgaattccaggacagcagagctactcagagaaaccctgtctcaaacccacccccccacacacacacacatacacacaaaaagagtatgcagcctttctctcccactgttgtatgcaatgctatattaatttcacatgacctttgggagagtttagagcagtgttcctcaacctgtgggtttcaatccctgctagtttgaataacactttcctcagcgttgcctaagaccattagaaaacacagataattacattataatagtagcaaactataggtgttgaataataacaaaaataaatcctgagaggaataagtacaacacgaggaaattttaaagggtcacagaattaggaagtttgagaagctctggctcaactatataggcctgggaagaccagggttgttagagtgctatcagcccttgtgggtaaagacttttcagcatggcatttataggaagaactcacacccatgtaggtaaattattgttttccctcgatagactttagtgtaatcattaatcattttgtcattgggacataaggaaaaagaaatagacatggtttgtatctaccccattgtagaaattttagcgatacagttataaataatgagaattagatctacaatctaggtggattggttctatggactttcgtgc

SEQ ID NO: 4343 - DNA, 1000 bp, mus musculus
tttgaggagtttggagctgtggactacagaattctagaatatggaaaataatgattaacagtgaactctgaagaatagattgctaatgaaggacagacactaaaaactgtgctcatgaggactcaaaggcacacaaataattggatgggaattggtctagacaccattcaagttatagtctagtgttttccaagcctctgtccctatattagaaacatgaatgaggctgaatcaaatgttattgactaaactctctggcagagaacaattaagactgtcgaacatttagactgcaacatggtcgtctatcagtttctctattggagtgctatgttgagaaattaaagcagatagctatgaattgtgtgcaggtttgggatgacaagagcaggagagcatgtaaaggtgaggaatgccagcagattttataactattgaattgtagcacaattaagattggcaatgataagaaggaatctagaacctagaactaaaatagtaagaaaggtacctggagatcacctccacgcaatggaaattttagctcaaaggaaaaaatacattctttgaatgaagatgaaatatgttctgaatatcactaactgttctctggataaaacctaccacctaggagagtagtttttccatgattaagcacgtaagaatgccagtcacagagcagtgagagtagtaagatggaatatatttacttcagtagattttgctagtgttatgtagatgatgcttggttatcaaaatgcaaaggcaaatgtttttgagtcttagacgttcaacaggcttgcagaagccattgagaagcatgcatggtaagatacaatctgcaagaaagtctttcaaagatatattgtgaagctgtgtggtttaaatttaagctacaatgctgatgcaaggcagtgaaacttctgaatcattaaggcttctacagaagaaagaagttaagtctgattaaccctattcaaagctacagaagatggatata

SEQ ID NO: 4344 - DNA, 1000 bp, mus musculus
atgcatggtatgtactcactaataagtggatattataggaaaacatacagaatgcccagtatacattccacagaactcaagagggctaataaacaaagggcttaagtgaggatgcttcattcccacttgggagggataagaaagcaatcatgggaggcagagggagggaggagactgtgtgggagagaggagagtgaggggaaagggagaacgtgaacaggtattgaggggaaccagagagaatccctgagggccagcagaaagaatggaaacccgcaacctcactgggtgggaggttggggagtctcctcctagaatgtaccagagacctcaagaggtgagaaaatgtgaggactattaagtgagggatcttagatcaaatggccaagtgtggggagagggaacttgtagagtctacctccagtagaaagaaaaggcatcaagtggagggatggggttgccattccacagtcaaaaactctgacccagaattgtttctctctaagagaatgcaggggcaaaaatagagaagagactgagggaaaggaggtccaatgattggtccaaattgggatccagctcaaggggagctgacactattgctgacactatagccactagcatggctgcccgctgagaggcccaataagcagctgaatgacacggaagcagatacttacacccaaccaatagactgaagtcggggacccctgtggttgaattaggcaaaggccagaataactgattaggaggacaacctcataggaagaccagcgatcacaagtaatccgggcctctaaagatctctcagacactggaccaccaaccaggcagcttgtctgaggcctctgacacatatacagcagaggactgcctggtctggcctcagtgagagaagggtagcctaagcctggagatccttgtggccccagagagtgagaaggcctgcagtgaggtggggttggaggagtggagacatcctcttggagatagcagggag

SEQ ID NO: 4345 - DNA, 1000 bp, mus musculus
gaactgagagctacagatagtagatgattacaaggatcagtgtcttctagacacaggaggacagcttacatatgaactctcacagtggtgtaaaagcatgacaaggactcaacaaggccaagccagatcaaacaccaatgtggaatgtgagatgtacaagaagtctgaccttcagcacagaagccatgaacaactgactgaagctcagaagagaggataagcgttttatcattgtaagttggccttgctctagtggaagtcacatacccagtaatatttgggcagggtaccctgttagagaagatgagttggaaagtatgaaactaatcaagatgtgatatgcaaaattatacaaacacactactaaaagatatagataaacaaaccaaaccaaacaaaaaaggggtaaaataatttctgatgcatacaaaatattaatagagatatgaaagtgaattgtacagtatatcagtgtacaaataagggaagtttattgaatacatgagtaagtgccaagtagctaaactctgcatatagccaattacttggttgatatatttaactcatttgcagatccatcccataatcagcctccaaacgctgacaccattgcatacactagcaagattttgctgaaaggaccctgatatagctgtaatttgtgagactatgccgggacctagcaaacacagaagtggatgctcatagacagctattggatggatcacagggcccccaatggaggagctagagaaagtacccaaggagctggggggatctgcaaccctataggtggaacaacaatatgcactaacctgtacccccccaacacctcggagctcgtgtctctagctgcatgtgcagcacaagatggcctagtcagccatcactggaaagagaggcccattggacacgcaaactttatatgccccagtacaggggaacgccagggccaagaagtgggagtgggtgggtaggggagtggtatgggatgatatgg

SEQ ID NO: 4346 - DNA, 1200 bp, mus musculus
tcctagataaatgttctttagaagtgactatattatcctaagaatggcatttcataggcttgcttttttctgccagaattccagaatataaaaatgctaatgaattttccattttggtcttgtatcctgacactgctacaatggtagaatgagagtctttaggactttcataggtctcaagtaggaaataatggccttctaatatttctcctttttcccctttattggatattttctttaatcttttatggatttcccctctggaaaccacctatcctgttccccctcctccttcttctatgagaatgctctcctaccaactcacccaatcctgcctccctgccctggcattcctctacaatggggcatagagccttcacaggaccaaagggcctctcctcccattgatgcctgacaaggcccttctctgctacatatgtggctggagccatgagtcactctatgtgtactctttggttggtggtttagtccctggggactctggggactctggttgatattgttgtttttcctttggggtttcaaaccccttctaacatttctaattctcttatttgattgttctaagaattgaaccactttgagagtggggacaaaggtcattcttgcctcatttttatttttgaaaacaagctctcaatattttcctatttagctgaaggttctctatttttattatttattagtatcaagtgttttaagatagcaaactcgtgttcatagtttctacaggagtatatttttattagatattttctttacttacattttaaatgttatcccctttcctagtttacctccaaaaatcccctatccccccccccccaacccctgctcaccatcccacccactctggcttcctggccctggcagtcccctctagtggggcatagaaccttcacaggaccaagggcctctcctcccattgatgaccgactaggccatcttctgctacatatgcagcaaaagcaatgagtcttaccatatgttttctttaacttttattcaggaagcaatgccatttattgaatgacttttctgatatcttgagatgattatgtgatttccatcttatagtctatttgtattctgtgttacaataattgatttgttatttttgaacaaaacttttactccagttatgaaaccaagttgatactactatagttcttaatgcat

SEQ ID NO: 4347 - DNA, 1000 bp, mus musculus
agctagcgaggccatggaacctactgtcactgctttctacagcagtgtattctagctacgtattctaaatgcttattcttaacccacagagaagcttagtcctcacccctccccatatgagctgcttcctgtagcaaaggagatcattacatgaaaccacaactcataaaatgcagagcacaaccgcctgtgggatgcctattcctagttaataaatttacaacatgccactacatattaggctcaggatacatcatgggagatggggcagacaaatggaaagagccagaagaccaggacacgaggagagacatattcatttctttaaaaacaatgattaaaataagaaaatatttttaaaggtacaggatttggagaacggtaggaatgatgaatcgatctagaggtggctgggaggacaggtgggagggaatgtgattcaaatggttgtacaaaattctgaaagtattgcttggccaattcggcgtgttctctccaccaccattggcccagcacatcttgcaagcaggacagatggcaggtgaggggttttgtggttgggttcatgtccaggcttctcttttcttaatctgaagattatcctatcatgcacaaaagactacaatttacggctgaagcctccacccctgcatcagttcaacctctttttcttcaacgagttattcttggaaatggagcacactattagtttatagagggcacccttctgtctcttccctcagagattaggaaacctcatggaaaggggagagggatgactgtgggagtcagtggggacagaggacaagagatgacagccccctgaataaactaagccggactcctttgggctcaccgatggatatggcaagcactggcactgcatggtttgccagagatccttagcctacgtgtatgggcgttaacttggtgttcttgtgaggcacctaataggaggagcggctatgactctgctgttttgctttttctcgagactctt

SEQ ID NO: 4348 - DNA, 1200 bp, mus musculus
aagcaaaacaaaagtaaaacaaaacaaagcaaaataaaccaaagacaatggccctggaaaaaaaatgaacaatttgttttagtttacagcacagagattcttctcttaatgttagttgtgctcttggtttcagcaataagtgaaggaaataagatcttgcccttttgaagttctgaggggaggtgtgggtgtccacgttagtatggttggataggatctgctatccttgtaacgattcaaggttggaatggtcttctattcactatggcatccatccacctgctcctggccttagttccagatcttgaggaagctgtcccaggatcctgttgccacagccatgccatcatcagtcacccccaagaagctgacttggttgtagagttcagctaagacacctgctctctcagctttgagtgcatcctagacacttcagttgaaataatcatgcccagcaaggaggacggggccactcttggagaaggaaacaaatgttacaccacagataatgttgtcataggagtaggtcatgacctcctggtctgcatggagatcaaacagcttgcatgtaccatccactgagccagtggcaaaggcatggccattgggaaagaaacagatggcattaattttaagcttactgctaaatgtggtatacctaatgagactccactggagaaaactgtttgtttgcttgtaagtggatattaacgagactcttgtttattcccacattgcttggaacccacattgcttagacccttgcagccagtgttcatgctaccacagtctcattgagttcattttttttaattagtattctttccttcatgctgctgaattagctatatgagcctggaatttttgttaatttcttgagatttaatacataaaaaattgtgcatgtacaagtaacaatagtactgttttcttttctgtctctatgtaatgtaatttaatcaccatttactgttttaacttgtttaccataatctaagtaattagttgttgcacaaaagccaacctcaactatagtccatcttaagacaaatgaatctaatttcttaacaccataatttaagtgacagacattatgcactagtgttcagttgtgaaaatagaactctggttctagtttaccaataagtgtgcttcgtgtatgtgtgtgtctgtgtgcatgctcatttgttaagccccagg

SEQ ID NO: 4349 - DNA, 1000 bp, mus musculus
ggggaccctctataatgtatcagagactgggaggtgagagactctcatgactcaaagggaaggaccttagttcagattctcaatagtggggagcaggtattaccagttgaaagacaaggcatggagtggagggatggggtgattgctaactcacagtcaaaaactatgacccagaaatgttcctgccaggacagcgaagcaggagtacatggctggtgagcagggagagggaaatgagataatggattttcagaggaaaaacaggaaagggaatagcacttgaaatgtaaataaagaaaatatctaataagaaaataaaataaaaaatacctgtagggtccaaaaatggagaagagattgagggaaagacagtccagtgatcagctcaccttgagatgcatctcaaggcctgacactattattgatgctatggtgtgcttacagactggagcctagcatgactgtcctctaagaggcacagcaagcagctgactgaaacagatgcaaatacttaacacccaactattggactgaagtccagacccctgtggttgaatcatggaaaggctagaagaagctgagaaggaggatgacccaataaaaagaccagcagtctcaactaaaccagacccctgagatctctcaaacactgagccaccaatgaggcagcatacaggagctggcctaaggcccctgacatatatacagcagagaactgcctggtctgacctcagtgggagaagatgtgcctaaccttgaagagatttgaggatccagggagggaggaggcctggcagggggaggatcctcttggagacagggggaggattaatggagtgaggaactgtggaagggcagactaggagcagggtaatgactggactgtaaaaaagaaaaagttaccttcttaaatagtgggattagagagtataaaattgaaaaatatattataggagcaagtaattgatatttctttcataaacattgtcaaaggctacct

SEQ ID NO: 4350 - DNA, 1600 bp, mus musculus
aacccaatcaaaaaagaactcacatgatatgtactcactgataagtgggtgcccagaaacttagaatacccaagatataggatacaatttataaaacacatgaagctgaagaagaatgaagaccaaagtgtggacactttccccttcttagaattgggaacaaaacactcatggaaggagttacagagacaaagtttggagctgagacgaaaggatgaaccatgtagagactgccatacccggggatccatcccataatcagcctccaaatgctgacaccattgcatatactagcaagattttgctgaaaggaccctgatatagctgtctcttgtgaggctattcttgggcctagcaaacacataagtggatgctcacagtcagctattggatggatcacagggcccccaatggatgagctagagaaactacccaaggagctaaagggaatctgcaaccctataggtggaacaacaatatgaactaaccagtacctcccggagctcgtgtctctagctgcatatgatggcctagtcggccatcagtggaaaaagaggcccattcgtcttgcaaactttatatgcctaagtacaggggaacacaagggccaagatatgggagttgggggggggggaggagagtggggggagggcatgggggacttttaggacagcattggaaatgtaaatgaagaaaatacctaattaaaaataaaggaaaaaaatgggaaagtgtctcacaagcaggcaaaagagtcagagacgatctagtcacacacacacacacacacacacacacacacacacacacacacacacacacacacacacacaactgaagtccagtaaagtccccaagctaaacaaccacaacatacaggcacaggacctagcacagagccatgctggctcactgtgtcactccagtctctgtgaggccctttgagccttgttcttgtggtgtccttaacacttctgtacctaaaattctttcttcttctctaatgtagggtacccttacctcacctattgttagactgtgacctcttatcagttgctgcatcaagcctctctaatgagagttggactaggcatggatcagaatattagaacatcattaggaacttttcagttaattgttgctgttgttgattttgtttgattttgccatttgtgtttggttccagcctaggtctctggttttgtatggctctctcacttcttttcttttttttttccttctcacttcttatatattagggaaagcacacgttctttaataaatgattttgagaaaacaataaagttgtttttcacaaaaaaaattacaatttttcagattttcttcatgtgatttctactgaggcataagttattgcataaatataaaggagactactattatatataattatctacttatttgtgtgttataattcattatgaagacttaccattatttagagaaaaattgtttgagttactttccagatattatggcaaaaattacaaataattgtgttattaagtcattatcaatttgcatttggcaatttgtgtaattacatttctaggtgataaattaagtgttttaaatgatc

SEQ ID NO: 4351 - DNA, 1400 bp, mus musculus
caaaactgtagtagaaacatatgcacatgcagagaaatactaaaggaccaagcctgcttattattcttattcgtttattcttattatttgcttatgaaattttcctcctatgaacacatcagttacactcaaactctgagaactcagtaatttcatttttcctgtgactacctggtaatgatattaacatgcatttaaatgcagcaagatgaaccaggacatcagtatattttttaccaaaaagatggctactgtggactctgtttggggtatgcactatgctgagactatggcagatatgtgaccaggtttcctttggaaaactgagattctatacacagggccttcaatggaggagctagagaaattacccaagaagctgaaggggtctacaaccctataggtggaacaacaatatgaactaagcagtacccccatagctcatgtctctagctgcatatatagcagaagatggcctagtcagccatcactgggaagagaggcccctaggtcttgcaaactttacatgccccagtacaggggaacaccagggccaagaagtgggagtgcatggataggggagcagggcggggaaaggtatagggaactttcaggatagcatttgaaatataaataaagaaaatatctaataaaaacataatttccctattttcttcttgctagccactgataataactaaagtctccttttttctctatgaatttgatttttttaagttttaaaaatttcacttattattttttttgtttgaggctgtgatgtgtgtgtgtgtgtatgtgtgtgtgtgtctgcccacattcatttgtgtgagtgtaggatctgtgagccatgcatagcatgtatatagacaatgtcaggtgccattccccacattccaccttgagacccagaggcagctgggcaaacctgcaagcttttgggaattctcccgtctccacttcccgttttgttgtaggtgtactgagttcatagaaatatgctatccttcccagggttgtgtggattctcgggatttgaactcagtttcttgtgattgatggcaacacgttgacccttttatccatctctctcattcaaatctaaccatttctagtacctcgtagaatattcagatagtactgagaacaaaggaagtgtttgtgaaaaatcctagaaagtacaccaatatcattctattgagtaattatacaaaaagttaacatgataaagtttgcattatacatgttttattataaaatttaaagataatttatagtgaaaaataatggtattttagtattaaaatactgaaagtggcttgaaaatcattccataaatatcttgtcttcactgtatttaattactttcatttctgtgtccaagacatactggctaagtt

SEQ ID NO: 4352 - DNA, 1000 bp, mus musculus
gttccagaagttctgaatgatgtaatacttgtcaagccattctctgatctgtaacttagtttgttcattttccaaatgaaagtaacttcctagaactgttgcaaaaattatgttaggttttagacacaattttccaaaggggacctaatacacccaggtcaacatgacatgcctatgccaaagacacttcattttagagaaaaattctcatatttaaattattgttatactacctaaggcatgtttcacatgtttaagtccctaagtctttaagtaatcaatttagtggtgatagattaaaaaaaaaaaaaggagcaatggaatggagtgtcttaactgttgaatagagagtctctaagccattcagtttagtatttttaatcttcaaagcactgagactgggttaagatgagttagtaaatgacagtaaacaaaggagatgtctaggaacatgttcccatttcaacagggaatgatgctaaagaatggaaaaaaaattaatcaagtcaaaatacaatatgaaaactcatgtaaatatccagttagaacagtaccatttgttgaaggtgttttctttttatccactgtatctctttggactttttgtcaaaactcaagtgtccacatgcatgtgagtttatttctgaatcttcagctctatcccatatatcagcgtgtctgtagactgaacaccatccaaagaggatgcaagggctggacctagggctcttacacatttgcagcagatgtgcagcttggtcttcatgtggttcctctcacaattagagcaggggttctctgtgactctgctgtctgccattggatccccttctcatagctggactgcctggtctggcctcagtgagagaggacatgccaaagccaagtggtttctaagggtgacttccatttctctgaggagaaagagaggaagtagtgggggaagtgtttgtgagggttggacagggaggaggggggtatgctgctatcaggatataaa

SEQ ID NO: 4353 - DNA, 1000 bp, mus musculus
atgagtggtgccagaacagctcagggcattggaaattgcacgccatctcattcagatttcatagatttcccctcctcccaaaaatggtggctctcccttagttgagaagtgctctgctacatttccaagggccacttttgttcttaaactccccaaatctctaaaattacacataaacctgtacatgttgggagagaaaacataatttttttaaatgaaaagagaaatatgtaacaaaatttcaccaaagatatatctcttagaaatgcataaataaaacatttaatcacctaatgcaggatgaagaaaataaaatcaggccctgaaaacaatgaaaccaacaaggttgaaatttaataacattcaacaccttcattctgagtatcaagtagaaactatgcatagacacagtactggggaacaagacccaagggggtcccattatcaaacagagcagttttccaaagaacaaagaatgttctgggtcctcgtggaaacctgggtaaagagtagtggagctcaagggcggactaggtagaaaccacgctgaaatgagcaccaggtgaaaagccaagaaagaagccgggcaatggtggcctttaatcccagcaagcgggaggcagaggcaggcagatttctgagttcgaggccagcctggtttacagggtgagttgcaggacagccagggctacacagagaagccctgtctcaaaaaactaaaagaaaagaaaaagagagagagaaaaaagaaaagccaagagagttaaaggcatcaggaagaaagcagtccagttctggagtgaactgcaagttcaagcccagagagacagcagcccaggccggttcccactcaagagtctctatccaccttgtgagcaaactacaatcatgaagggaaggatccatgccagacaactgggaactaaagggacagccactgctgagtacagacagctgagtaataatgctgctattaggtcagaggagcatagacccatct

SEQ ID NO: 4354 - DNA, 1000 bp, mus musculus
atgcctctctctctagtagttggtgtgtttgaaatgttacatagtctctgaaccgttgtgcagaatggctgcagtgagtatgggcatggcaggtctcatcactgggcgttggtatccagtgcgcagcacatgcatgcactcaagcctggtgagaagcgctgtgctgtgacgtaagcaacacgggctgcagaggagatagacactgtgtgcaaactatgacagtttacaaactctatgtcccagggccactgtacaaactgcctgtccttcactggactgcacgtgcaatcataagggtttgcacatacagtgagcacatcaggcgtgttaggtcctgtatttctttctctatgttacaactcgattgaggaaggagaatttttttaggttaagtgactcaaataagcttagttttttgttttgcttgtctgtttgttgtttgaccccaagtttcatctgtattaaaacataaagagaaacgcatgcccagtcatattatctcctaagtattccctgttgtgaccttctcccactggagtaatttccttagctgcaaccttgtcaacagttttagttcctgctgtcatcataagtggatgacgtatataatgtgggctcatattccttgagccatgaatattaaccatcatctcagcagaactccatgtagccattcttggagacacactggcttatgaccaactaaaattctgccatagaaaatgtttttatgtctaaggccaccccacgcagcctctgccccatgtcacattgcagaagctgagcagggttaggccaggtcagtattggatggaagcctgccattctggtccccaagccccggtctccatggcaatgtctagtctactgtaggcatggcttacatttaatctgttctctgtggccctctgtcctttggctcttgtcctcccaattcatcaacattctgtattaacttcattcttgtacagctaagactctagacctactgtgtcagctg

SEQ ID NO: 4355 - DNA, 1000 bp, mus musculus; identical to SEQ ID NO: 4354

SEQ ID NO: 4356 - DNA, 1000 bp, mus musculus
tcaggaatataccactttagattatttcaaacgacacagagaaactaaaggcttgtttttttccctgctcttcctccacaacaatgcaacccagcctagattggaacctgctatcctgccagctcaggctcttggctgatgggcatattgggcacaccccagagcatggcttctaacttccttttttcagtggctacatttctgaaataattttaatgtttcctacattttgagttcttctaagtgaatccattgtatttaaaaagcaagaggacagaaatttactttggacctgattaggctgtaacaaaaccctcaattgtgatgttttgtgaaatatgcgctagaagataataaggtatataataaacgtgaaattctttctgtaatccataaattttccacctggtgcttaggaaaaggtacaagtggcctcgtgctgtgatcctcaagctaatttacattttgcttttgagatgagatatttgccttgcgtcttcttaagcaaccctgtggacatttgcatgtctgtttcctttgcattcggcatgcttagctgacctgtgtgagtcttaccagcattttcaaccaggagaacctcttggattcccgacagcagaacctcaggtcattcactggcttcattaatcaagatgtttagttgagaagtgctttacatgagaggctcagaagcaagtcttttcctcacaggcacctgagttatatgctatgctagttatttttctcattgttgtgaccaaataacctgacaaagagcaacttaaaagagagagagagggtttactagggcttataattcaagaagggaaagagttccatcgtggcaggaacacatggtggctggagccgaatgtcacatcagatccagcgtcagtatgtaaaaggctgggtgagcagtggagatgggctatcaaatctcctgcaccccgcctcccatcaggcaagagtccatttcctaaggattcaatgacctttccag

SEQ ID NO: 4357 - DNA, 1200 bp, mus musculus
tgtaactaagacctctgagatgctggggtgttttttacaatccctttagtaagtatgaaaatcggtaatgtgagtcctcagtggagttattgtaggaaagtccttctattcattattgcttttctcctcaagaagagcattatttccatctctgctttgtctcgttttcatgttcagtgactttgcctgggcagctccacctcttaccgtggtgccagtgtgtctaagaaagcccccctctcctcgattctttgtaatcaaacactaagggcaggaggagatggtgcctaggtgacagaacaccgcaatttgaagtgggacagtagttattattattgttattattatttagacaggctcttcctattcaactacggaatactctgtcagtccatgccagggcggagcaggactagtctttgagaaactgctctgcccctctgctggaactgatgcacaaaaacagaatagaaacagaacagaaacaagcaacaacaaacaaatgaaaagactcaatgttggttcttttgggggatggcatgaggacaaggtatgagcgctatctagcacagagggctacttctgtgtgcctttgtttttgggtaacagagtgcctccaatagccccttcctttctagtccatgctgcttgctggtaacagactgggtgtgtgttctagcttactgagataggaactgaaatcgttgtcaaaaggggctagggttagggtgagggtggaaaggaagaatcatccaaactgagaaggtctcctctaaccatcaatttgcggtagatgacctttaaagggactgatagcagagtgtctgccagctcagaaaatgtacaagctacaaacatcttttcaatggcagaggacatagcatggaaaacaatgcctgtctcttcaggacctgaggcgctgaactcccaggccagcgtgaacgcagacggctctctcacgcgtgtggtcatgatggggggttaccttcaggccgaagggagaagggttccttcttgttcctgctctggtttcaggcaccgtgggaatggcggtgcccttgacgttaacactgtagagggagctcagccctgctgagttagttgctcctgaagagacccagctcttgcacgtagctggaccggagccttcctcacaccagcatgtgcctcctacggtgcagtgccaggtggtctgacctc

SEQ ID NO: 4358 - DNA, 1000 bp, mus musculus
ctatttctctggtgtttcaattcaaaactcaaggagtacatttcttaggacaagctgtggaagcagctttgcagtgtcaaaatgaccagttagcatgagaaatgctgttggcaccaccaatgtggccagtcacagtggagagcagagagacatacatagtgaccacgtcagtttgcattggaaaagtaccatgaaacaataaaggtagcagtgtcaaaagcctgaaaagagagctgaccactatttaagaacactgaggctacagaaaagatagagtcaacacctggccacacatttgcacttcaaatccatgcactgcctctactgtggagaattgtaccagttgcagtagatagggggtctgagtaaggcttactgtgataggtggcaggagataggtgggaagtatgaacatgaagaggtacagcacaatatctgtccctaaaaccttatgatgaattctctacttatcctgaggagagggaagagatcacaaaaaaactgtactgcaacaggactttttctgaggagaggcaacacacctgtctccacaccccaggtagggagcacacaacagaccaaagtacagatatcagctaagtccaattttgtaaacccatgagttttattggaattacaggaatttgggtgaggggttacttgtaggagcagaaatgatgccaagacaggttatcattgaagcccagcccagtatgggtgacagctcacaaaggtagaagcctgtaacatacgctcctgcctgcaggcagctcagcaagttggagaccctcccttccaggtggctcagttggtctatacctattcaagacagcttcagatggcctctgcttcttccaggcagctggtctgatttcaagattcttctttgaagtttggttctcctgagagtgactctccagagtctttactgtttactcttagaaaggcttagtgaatctgatcagtttcagggacttccagaagctattttgagtagttt

SEQ ID NO: 4359 - DNA, 1000 bp, mus musculus
atctatcattcaaccagacttaataattactctgtgcctaccacagagctaggtactaaataaatagtgagaaggggcatgggttgccttgaagtgtaaagaactgagaaaaagtttaggaaggctatgataacaaaggctattgctacgttcttctttaaaagttgagatttgaaggactggaaaaaatggctcagtagttaatgatgcttcttattcagagaaccagagttcaatacccagcacttatatcaaataggtagcaaatgcctgagactccagttcaggagattcaacatcctcttgtgacctctgtaggcatgtgcacacatcatacacacacacacacacacacacacacacacacacacatacacttacattctctctcttctctctccttaatatacatacaaactcacaaatgacctcataaaattaaaattaatattaaaaattatttagaattttgccccagtagttacctcagtgggcaaaggcacttgcttccaaggctaaatttgatccctgttttccacatggtggaaagaaagatgctataagttgttttctgacctccacactcatgccttggcatacattcacaacccaccacacacaattaaataaatgaatactattaaataaatttaaaatagatattttaatttaaatgtaatgaatagcctaaaactaaagtaagagaatgcatggcctgatagttgaagtgttggaagaatgattggctccagatgaagcagtgatttttctcaggttcagttgagaacatatctggttttatgttgaggtttttgatccacttacacccttctgtgcagggtgatagatagggacttatttgcgttcttctacatgcagacatccagtttgactagcaacatttgatgaagatgctgttttctaatgtgtatttctggcttctttatcaaaaatcaggtgttcatatgtgttagaatctatgtctgggtctccaattcca

SEQ ID NO: 4360 - DNA, 1400 bp, mus musculus
atgattcctgtctacaaactctttatagcaattatctgagcagagaagcacttcttccactgtgtctctgtaatcataactttcacacttaaagacaaaagcataaaaaaaaaccaaataaaaagaactgtccaaaattatatggcaaaatacaaatagcagatatttcaatgatataactttaatttatctagacattttaaggatttataactataaatacattatattataataaaatattgaaagggattttaacttccttccttatagtccagactttatccacctcccagtttgccccctgattgcactgcatcccatacctcctcccttgccctcctacccaatctctaagatgatgtcccaacccatccacccccacttttccaggcctccccactccctggggcctcaagtctcaagggttaggtgcatcttctctcactgaggccagaccaaggcagtcctctgctgtatatatgtcagggcctcataccagctggtctatgttgcctggtagttcagtgtctgagagatcttgagggtccaggtcagttgagactgctggtcttcccatggggcactcctcctccttagcttcttctagcttttccccaattcaaccacaggggtctctagcttccaccgattggttgggtgcttgtatctgcatctgacctttcagctgcttgttgggcctctcagaggcagccatgctaggctcctgtctgcaagcacaccacagaatcagtaccagtgtcagggtcctgggtctccccttgagctggatcccaatttgtgcttgtcactggacctcctttctctcatgctgtgctccagttttgtcccttgcagtaccttcagacaggaacaattctgggtcagagcttttgactatgggatggcaaccccatccctccacttgatgttctgtccctccacttgaggtagactcttgaagttcccactcccactttatccaaggtccttccctttgagttctgagagtctcttacctcccaggtttctggtacactctggagagtcccccacctcttacctccccaggttgcttgtttccattctttctcctggccctcggggcttcagacctgttcccacacacacactctgccaatacctgattatgttccccctgtcccctctcccacccaggtccctcccttcttctgccccatcctcactgtgattgctttcttctctatcccaagtgggactgaggcaaccctacttgggcccttcagcttgttaaccttcttgagttctatggattgtatcctgggtattctgtacttttggggctaatatccatttattagtgaatacaaaccatgcatgtcattttggatctgagttacctcactcaggatgatatt

SEQ ID NO: 4361 - DNA, 1000 bp, mus musculus
taaatgtagagcgtgcctactaagtggctgtcctgaagttcacacccatgtgtctctgtagaaagtgctctgtaaggaactggcctttgttaagctagaaaactcaattgctcatacaccagttgaccaacgtccaggttttcacaattgaaaagctgccctaaggaaaatgctgggggaggggaagtataaacattacccgcagctaagcgtggtggtggtggtggtggtggtggtggtggtggctccgtacttgtaacccctgaactgggagactaaagcagagggaatcactgcaaattccaggcccagtgagactatctcaaaacagcaagcaccgctcaggcctgcctctccagggtacatgctctcatttcacttgcctggttttttatggttcccatggttttcctttgagccttctgctatttttttctcagttatgataaactgatgtcttaaattgaactccacaaatagatacaaccactaatgtctagaaaaatcactagtttggggaaacttagcaggtccctagcctcaatatttttatactaagttgtgtttgagtggaaaagaaaacggcatctaaaactgaagagtcgagagaggagatatcaactaataatcagggagtgacagttcatatctttgttaccaaggatgactaagccaataaatcccttcgctaacaccagctgcccataatctaaatatatcagcaaccatcccccagcagtgtgcactaaactgctgagaagcattaattttatcaaagcttgtggagctcaagttcatgcaggtttatacccgagcgggttccaagaccactgcaagcctcttcaaggtgaccgaaagcctccaacatctattatggagggcctggggtcctctgagtctcttcaatgtctcttcaacactacccagcagcagggagctgagcagagctcttgcaaggaaagtctacaattgtctcatagtgcgaagccatgccttacac

SEQ ID NO: 4362 - DNA, 1400 bp, mus musculus
cccttcagctccttgggtcctctctctagcttctccattgggggacctgtgttccatcttatagatgactgtgagcatccacttctgtatttgccaggtacttgcatagcctcctacgagacagctataacagggtttcttcagcaaaatctttctggcatatgcaatagtgcctgggtttggtggctgattatgggatggatccccgggtgcggtagtctctggatagtccattctttcttcttagctccaaactttgtctctgtaactcctttcatgagtattttgttccctattctaaggatgaatgaagtatccacccattggtcttccctcttcttgatattcttgtgttttgaaaattgtatcttgggtgttctatgtttctgagctaatatccacctctcagtgagtgcatatctaatgacttcttttgtgattgggttacctcactaagggtgatatcctccaaatatatccatttgtccaagaatttcataaatccattgtttttaatagcttagtagtactccattgtgtaaatgtaccacattttctgtatccattcttctgttgaggaacatctgggttctttccagcttctggctattataaataaggctgctatgaacatagtggagcatgtgttcttattaccagttggaacttcttctgggtatatgcccaggagaggtattgctggatcttctggtagtattattcgaggctttttcacactttctcctttttttaaattagatattttctttatatacatttcaaatgctatcccgaaagttccctataccctacccccaccctgctcccctactcacccactcccacttcttggccctgacattcccctgtactgaggcatataaagtttgtaataccaaggattctctcttcccaatgatggccaattagaccatcttctgctatatatgcagctagagacacgagctctgagggtactggttagttcatattgttgttccacctatagggttgcagaacacttcactggcggttatcatgtagaagaatgcgaattgatccattcttatctccttgtacaaagctcaagtctaagtggatcaaagaactccacttaaaaccagagacactgaaattaataaaggagaaagtgaggaaaaggaagatatgggcacagggggaaaattcctgaatagaacagcaatggcttgtgctataagatcaagaattgacaaatgggacctcataaaattgcaaagagcattgtaaagcaaagagcactgtcaataagacaaaaaggccaccaacaggttgggaaaggatttttaccaatcctaaatctgataggggactaatatctaatatatacaaagagctcaagaagctgaactccagaaatt

SEQ ID NO: 4363 - DNA, 1000 bp, mus musculus
cgttgaccacactagttaacccaccctaacctcatttcaaagtccatatcctcccatttgcaagcaatacattacaaagatgaagagccgcaaagttgggaagggcatccttgtgcgccctcctagccttagcacaaaggttagctaccgtaagccatcagtaaatgatttaactccttaaactacacctgcaattttcatgtttgtgttctgtgtatgccttgtttcccagaacttagcacggttccacgcacccattaactcacaggatccattcaagcgcctgagaggaagtcagggttactaagcaactgaggacacagccttgccctcatcagagcttgttgtcaagtgctgacctggatggagcaggtgctcaaatatttattaaagaagtcaacaaagccagacagtttacatacacttctgaggaatactaatgccttcattcttaaactctctccagcacaacctctctcacttctgcttttaaaaacttcccagtttcttcaggaccctacctgaattcgcttatttagagaaaatgtagggcatgttgttacagaacctgtaactgagaaactggtcctagaagtgactctctgaatccatggttactgattggacggacactgatattcaaacttggcttttatttcaggttttatgtatatttattactggctttctgactcagggtcaacccttggactacatgtgtgccttgaactgtgtactcgtggaagccaaagggcaacttgcaggaattgtttctcgtcttgttctatgcctgtccttacgtagagcaggctgtcaggcttgacagcaagtgtttttactcgctgagctatctccatggctctgtttctctttgtatgatgtgcgtgcgttttcgtgtgtgatcacagtgtgtgtataccttggagcacttgtggaagctggctggggaaggccagcacttgtttgacagcatcttgccatctgactatgttgcttgagg

SEQ ID NO: 4364 - DNA, 1000 bp, mus musculus
aatatttttggtgaaaacaatcaaggggttttacatagagaccgtaagccaattttaagaaatgctcctacggtcttatcattaaaaatccaggaagatggctcagcggttaagaacactgactactcttccagaggtcctgagttcaattcccagcaaccacatggtggctcacaaccatctgtaatgggatctaatccactcttctggtgtgtctgaagacagctacagtgtactcacaaacattagatagatagatagatagatagatagatagatagatagatagatctttaaaaaaaatccagtgtatggagctggagaagtggctcagtggtaaaaacatttgctgctcttggaaatgcaataaaaaattcaagacacaaatgaaaacaaaacagcttttaatgcacagttcataccagcatagaaaataatagccaacatacaatgtttttcaaactgtccaaacctgagaaattcctgtcctctatgtcttgtaggctgagacttgcaactgccaaacacccccttgctttggcttaggacacaaagtttcatccagtgaacaatttggggtttaagacgatttgatcctaggatcagtgacacaacaaactacctatatagctgtcaaagtcccgactcaagcaggttccagcagctagctgggagagggagtggcccagtgcccctgcttgcctgtaacgccagcgaatcctaagataatctgtactgaaattggaccataacaatctgtttcttacactgctgtggcagaggacccatactgggtttccagcacctacatgaaagctcacaactacccttaaactccagtatctgatagcatcctctggtcttcatagtcaccagacatacatgtggtacacacacatacatgtaggtgagacactcatgcacataaaaatgactaagtcatttttagtacatagtgtattcagtacatagtgcattgataaaaatttaattattttca

SEQ ID NO: 4365 - DNA, 1000 bp, mus musculus
gggcccttatacatgattggtgagaaggtaaactagtctagccacacatggaaaacaatctggatgttcctcaaaaacctaaaagaaggtctgaaaatgaccagccatccagtcctggggggtttccatgagcgttccaaatcaacctcacagagacatctgcacattaatgtgtaccacagcactgttcacaacagctgagctacggggtcatcctatgtgtccattaacagagggatggaaaagaaaatgtcatacactagtacagtggagtttctttagccacaaagaagccaaaactatattagttgcaagaaaatgtatataactaggacaatagatcatataaagtgacttaaaccagtctccgaaaatatgttttctcagttgtagattctagatttttagatagatacataagatcaagtatgtatttgacacaaaagtagaagtgaaactttctagagaaagcgggattaataggaggaagagaaggaagaaaggcagtgtttgaacatgtgtgggcaatacgctcaatgtacagtacatacaagtgtgaaaatattctcatataacatagcaccctgtgtacagcgagtgacacaataaaacattcctgaaactaataaagtgaaaccgaagctaaatgaattcatccttttgatcttcctctcctaaagtgatcagcccaaatcccttagcactaaccaaattctctcaagcataatttaaaacaaacaaacacgaattctccaaccctgcatgcctttaacagaatagttggtcagtcctcagtgtgtgctgacccttgttctagccattgcggatggtagagctcttgagtctgttgtgaagaagttaggtgatgtcattgttcaagtaggaaatgtagcgtcaacgctcatgtagatccccagctgatgttaccaatggaaagactatggaggctttaggattcgaggcctatgttgaaaactggagttgctcacaggagatataa

SEQ ID NO: 4366 - DNA, 1200 bp, mus musculus
taaataaataaataaataaataaataaatacctttttattgattctttgtaacttcccatcatgcaccccaactccactcatctccatctccctagtatctgcccttgcaaccttccctccagaagaaaaaagaatcttgttttggaagctatagtatgttgcagtgtgtcccaaagtataacgttttatccacacatctttacttgcaaatgtccgtggcaatgaatcattggtctggccagagacctctggcttctgctcaccaccaaattatcaaaactgtatccttatctggactcctttcagatatactattgttgccctgtgtcatgaggatccttctgtcttggatctacagagccaagccttcacatgttccatcagttcatagatgggatagatgttgggatggaccaactcaaagccctggatctgggactggttggtagctgatctggtcagcccaccagcttttccacacccaacccattagggtgagctctccagcacttccctggctggctcacctaaagtcacaaacaacaaggggtagagtcagcttcccagttcttaggcactcagggctggctcactccagaggcagctccattgtgctgcccaggcaaggtatagggctctctctccagcctgcttgccacaggctgcaagggatgggtggggggagcaaatctgtaccccagtctcagtggaacaggaccagcaatcctgagtttctgttcttagtgctggctcacctgcaacattcccctctttcctgcaaacagggccagctctactatacttactgagcatggtgttgtgttgcagctgctgaggggtggggccagctctgctcagacagcaggcccaaaccagggatatctgcttatcctttggtgttaacgaaccttgcagctacagggccatggacccagacatggttctcagcacagccttagatggtgttgctggctactcacatccggattttccttactaccctcaagtctctagttccatctctcaccgttttgcacacaccagttatcttcttctctctctttcctctctcaccagttacttgctcatctaagtgactctctgggcagctgagccttcagggtccaatcaggatttctatggcccactcctgcagtatggaactgggccgggaccatctgcccatctgggtccaatca

SEQ ID NO: 4367 - DNA, 1200 bp, mus musculus
ttctggtggtgaaaggaattctcttagaccactggtgtgctcaggtttcataaagcgtatacagtgttcattccctttgcttgtaaaagggactcagagggagctagatgacattcaccttggcgaaagctgttgatggattcagacaaaacctctaaaggatccttttctgaattactcctatcctggaaaacacaggatttacgaaagactgaacccttcgatataattatcagggaatataattacaagagacaaaatctacagacttgctaatgcagttcccttcgttttctggatgatacagtgagtagcctcaaggtcacacagccttatttgtgtcctttccaccaaactacagtccctcattgcaacaaatgacaagaaggacaatgaccttcagtcattgctcctggacctactagaacagagctgccccctccctgaccttggagtgcagaatgccctagtaagcaagcaactctatggagggtgggagcaatctttccctgagatttggagcatatagcaacagcacacggggagcctggactgacccctccaagaatccaccggctgccttttcccaggtggggacatatagttcatctatcatgctcctgcttcggaagaatgagtcaccatcacctaaggccattgaaaagtcctgagagagcaaacactggaagaaactctttggttggtatcggtagccactgtggacaaggctgcatatagattcctagaaggctggaggtaggttgtgcttctgaacctgaggaagttcttttatcccagcaggctttgaacatagcaagtccccgaagacacgcggctagaagcatttgccagtgggttattatgtctgtttgatgtgcacaagcaagaaagttaaaaaaaaaataataattcacaggttgcagtgcagaaggcagaagctctgcagccctggggttcattgtaaggagcctcctgaagggaccccgaagacagggagaggtgctgaaggatcaactggcaagagtcagatagcacagctatgggactccactaactggccaggtcttccatcatcagctggacatctcaaacaacagaaacaaatgtatttatttgttgtatttgtaattcctataattaataatgatctctgtgtaggggttactgggtgatgttttgatatgtgttgtgtaacaatta

SEQ ID NO: 4368 - DNA, 1000 bp, mus musculus
ccgggagccatgttgctgcgcctgcatctggactgtgtctctatagatctcctcagtcttgccccgcacaaagttcaccaggctcttccgaatcggtggtgggcctgtgtcccgaggttctgggcaataggctaatccatcttggtgaccgtgagcttttggctcagccttcttcacggaagtcttgtgtctccttttcccatgggagctgccctcacttcctgttctggcccgactggagtccctggaggagcgtcttcttttcctgggtgcttccaccatctgagccgattcttcggtctgctttctggaattgcaggctgatcggctggacttccgctcccttttcctttgtttggatcgtgatgtcctgtcagaggtgctctgtggcccggtagggaggtccagcggttgagaggaagggcctggatggggggtttcagcatccatgttcaggttgaagtgaaaggctttctctcttccaggctggggttctggctcagtcagcagtggttgcttgtgaacagaacgtcaaagagtcctatagccgttcacttcacagggctggttgtctaaggcgatcttcagtatatgctgaaatcacaatcaagtctgacgtgaggccagcggaagaagatacttgctagcaagccagcaaagactgaggcttccctttttggtgttcctcatataggcctctagctgaaggtgtggcctggattatgggtggggcttccctaattaaattcagtctggatgaaacctgtgtgctctcatctcagagatccagactagaagtgggccttcccacttcaaatgatttaatgaagtgaaaatcactcacaggtgtgcccagatgcatttgggttttagtgacttcctgatatagtcaccttgatgccagcctgctgcagatgcctttgttgttgttttggtttttactgtttgtttgtttgttttttaaaggatattttctttattaacattgtgggctttctgt

SEQ ID NO: 4369 - DNA, 1600 bp, mus musculus
cggacacctgtcctctggtccggatggtggccggctatctgcggcccgccaagggtgctgcctcagcggctctgtgcttctgcctgtcccagaagctgtctggttctctggcacaccctctcacctgttcagactaatttcccccattaatttcttagctacaactaaccaacatcaattgttccactaatgcaaaagtttcatttcagtgatgctggtctcttgttaatctcatgtcgcacccgctctcgaccagcaagaacgacgcgaccaccagtccttctaacagcagtttattcagtcctgattcttcttgttcatatctcccccgaaccctgtgcctctcactccttttatactctctctcatccacgcaccgcaggccatgccccctcgccagtcaggaggcttcagctaatcagggcagcaggggcaaatctccaccaaattggattcacctgtatcctggtacacctgcgcagcactcaagatgtttgtgtcttatatgaggaagtcaggtgcaagtcatatgacttagctgcagtccctggcgcctttgggactgccgccacacccgctccccaccatctcagctgactccagccccagctgactagaatgacagaatcttaattgaaaatagcagacagccctgttagaaactttaaactttcgtctgaaatttcagtcaggcccctgtcatctgcattgctctcaacattcttatcgtccaagctacttaagaacatcccactgaactcttaacatttaatggctcttctaagccaaagttcgaaggcccctccacaatcctccacaaaacatgtccaggtctgtcacatcaatacccaactatgctgttatcaacttgtcttagggtttctattgttgggataaaataccatgaccaaaaagcaagtagggtaggaaacagtttattcagcatacactttcacattgctgtccatcatcataggaagtcagaataggaacagggcaggaacctggaggcagggaactgatacagaggccatggaggagtgctgcttattggcctgcttcccctggcttgctcagcctgctttcctatagaacccatgctggactgggccttcccctactcacaactaattgagaaaatgcagctggacggatctcatggaggcatttcttcaacccaggcttctactttgatgactcaaacatgtcaagtttatacaaaaacagccagtacagttctattgtccaaagctggtctgcttaacgtagcttgctgagagaaaagggtgtaggaactggattaactttaagaaataatatggctatcaaactacagtcattagttgtgttcagagataagataaactgagtcaaaactttgtttctagtttgactttatctctattcctccaataaagagggggggggggaaaccaagcagagggaacatagtgaatttctacagtgtattaggtatttgagcaatgtagagtaaaaataattaagtacatagtgagactctttttaaaatggcttattactctaaatttaatgatctttttaaaataagtagtggaagtgtattactagtaccagttga

SEQ ID NO: 4370 - DNA, 1000 bp, mus musculus
aatttgttttttctttattacttttatttccattttcagatcttgaatagttttatgcatgtctttcacttgtttggttgtattttcctgtatttctttaagggattcattaatttcctctttaaagacctctatcatcttcataagatttgcttatgaaggtcatcttattttgattcttccatgttaggatatccaggactttttctgttgtaggatagctgggctctggtggtgccatattgcgctgggtcttgttgattgtgtttttttttttgttttttttttacgtattttcctcaattacatttccaatgctatcccaaaagtccccccaccctccccccaccctcccctacccaccaattcccattttttggccctggcattcccctgtactggggcatataaagtttgcctgtccaatgggcctctctttccagtgatggccgactaggccatcttttgatacatatgcagctagagtcaagagctccggggtactggttagttataataatgttgtacctacagggttgcagatctctttagctccttggatacttatgctatcctttagctatctggttatccctggtgttggttagatgtaccgatgtggccaggactcctctttgaggcatgcagagccttgggtctgacagtggaactcaggaaacagcacactgctcacctctgctggctgtgccccaggtagacctagcaagtttgggattgtttgggaggggcgtctaaccttgaggtttctagagcccagcaggtctcctcagtagggaatttgatggaactggcaatgaagaatcatgtgtagcacaaccctctgtaggacattttccataatttacaaactgagagacaagacattcttcaacaggccaatgacatgaactgcaatactatttaagaccataaggaaaatagctatgaaattatgagttacaacagggcaggaagaagcttgaagacacattactaaggt

SEQ ID NO: 4371 - DNA, 1400 bp, mus musculus
tattattgtgtgagtggggatcaatgtatgatttcagctttagtcatgcttcttttaggaatgtgggtgcccttgcatttgaggcatagattttcagaattgagatttcatctttgtagattttttttctttgatgagtatgaagagattcctcatctctttttattacttactgttgaaagaatgttttattagacattagaatggttactccagcttgttttctgggtccagattgggaaaactttttcttgctctttaactctgtggtagcatctatctttgttgctgaagtgtgtttcttgtatgctgcaaaatgacgaattacttcacttgtttgattgtatttttctatatttctttaaggagttttttttttcccttttaagggtgtctacctctttgattatgttttcctttgtttctttaaggaatgtatttatatcctctttaaaggcctctatcatcttcatgatataaaatttaaggtcacagtctcattctttaggtgtgttggatatccaaggcttgctgtagtaggcaagctgggttcttatggtatcatattgcacttgcttatgttttttatgttcttgtgtttgcctttctccatcaggttgtctctggttggtgttggcaggcctgcttaatcctgagagaaaaaggtctctgggactggttgtctgagatagttgcaggcctctcacaaggcaggcagagcttgggatgtagagtatagatacttgatatcaggtataggtatgggccagaaggaagatggcacttcaatagggcaaggtagagcccacagctgcttagcatgctgggctccaggtgggcagggagggcctggatgtcttacctgtgtgtcctgggttagaacaggcatttggggacaaagacagaactgtgtggtgtggagaggtgtgctgaaattctattgcaggtgtaggaagtgtgaactataagctcttgtttaaataataggcaagtggtacctgttcagtgtccatatatctacactaaatagagaggtaaggtaaggctaagattcagatggcttaacgtacagcactgtcttccttttattactatcatatctttctcagtagttgcggtaatgcacaagggatacagctaaagcacaagcttatttatctggaaggcaatgaacggagaaattttgattttgtaatgataataaaatgacatggctatccatcattttctggaaggacaatggaaaggcaacaaccatccttatcttgatatagtgctttgaaccagtggatttaggctttgggagctcaggcctatgttatctccctatgttagtaggtagagctgagttatttagaaagcagaggccacctggtaccaccaagagtgaatgggttgta

SEQ ID NO: 4372 - DNA, 1600 bp, mus musculus
ggcggcagaaagaggtaagaaccagaggacatggaggacaccaggagacaaagcccactaagtaaaccaagcaaagctcatatgaactcaaagaaacctaagcagcaagtgcagggcctgcttgggtctgcactgggttctctgtgtacacatgattgatttcactttagtacttttatggtacttgtgaatgtgtgatcaggtgctcctctagttctgtttctgctcttgggatttttcctttgttggtttgccctgtccagcattgatgtgttttttgtttgtttgtttgtttgtttgttttgttttttttgccttagtatattttattttgttatgctttgttgttttctcttatatgtttcttccattctcatgagtgtcagaaaggggtcactataggagaagtactggagagtaactgggaggaatatagggaggagaactataataaatatatattctacgagaaaagtatcttttttcaataaagggaataagcaagtaaataaatgggaagacaaaaaggtcaactatgattgaggctatagagcactcacaaaaagggacttagtgtggctgcactccagaaggcccaacaaacagctgaaagagtcagatgcagatatttacacccaatcaatagacagaagcagctggccctgttgttgaattagggaaggctgaaagaagctgaggaagagggcgactcctgtaggaggaacagcagtctcaattaatctggacccccaagatctctcaaaccctggaccaccagacagatcgcatagaccagctgatattaggccctcaacacacacacaatagaggacttccaggtctgtgttcattcagagatggagcacctatccctcaaggactggaggcaccagggagtttagaggtcagatagcatggacatccacatggagataggagggtggggagaagatatgggatgtggaacagtagaagagtggacagggggaggagggaataaaatgtggagtgtaaaattaattaattaattaattaaaaaagacaaaagagccaaaaaatgacccaaatctaaagttaaaccccgtttattatcaaattctcaggtagatgttaaggaactagtccaaaatcattaatttttgctttaaaaattgagttattagaaagttaactctttccaatgctttctaaccattgcaaattggctttcagaagttgtagaccgtggtatcttttattgacctattgctatctaggtatgtattgatgtatctatgtatttatgcatctatatatctatgtatctgtgtatctatcttaaaaccactgatttgatgagtatttctcaagatcattcctaatacattttatattaaatattaataacaataggaataagaataattattctagttatctatacatgattcaatgtgtcttttgttatgtttattacttagattaaatgtcaagggactcttgacattcatagagaaaatagaagtttggttcttatcatccatttcacaaacacctattactctagaggacacaccatcctcttcttgcctctggagattactaacatcagtgaaacaca

SEQ ID NO: 4373 - DNA, 1000 bp, mus musculus
tcaaatgatggtttgctggggcacacaggtgaaaggatgttttactaaagcagaccacaggtgaaaggatgttttgctatagtagatgcaagaaaagatgcatgatgtttggaaagaatagatagaactccatggagagtggtagcttgagcgttgtttcactttgctcagacttgctatccttcgctgactacacacatgtattggttccccttacattgtattgctgactttgcttgtggtgactgcatagaaaaaaactcactggagaacttcttgtgagtttctagcagctgcttgctgcttctgcagatttgggtaagttggcgagcctggcattgtcttctggattgaaatacccttgctgatttgtgtatggtgtctgctgagtgtactggactgcacctgctgattcatgtttctgtttgctgagtggactggattgagaacaataaagtttgcaatctgaaaggactgtatctaagcaagtccacttctcccatattctaggaacctttcgaacttttctttttttttttttttgatagatataatttttattctgtttgttcaaagggtgaccatcacacaggaattcataacaagctcattcatgggctctgtccagatgtatgaaatcagaaggtttactctcagcgatgtaaaatatataccatgcaagaaacaaacccagttattttttctttttttttccatttttattaggtatttagctcatttacacttccaatgctataccaaaagtcccccatacccatccccccacttccctacccacccactccccctttttggccctggcgttcccctgtactggggcatataaagtttgcaagtccaatgggcctctctttcaagtgatgcctattaggccatcttttgatacatatgcagctatagacgagacctccggggtactggttagttcataatgttgttccacctatagggttgcagttccctttagttccttgggtgc

SEQ ID NO: 4374 - DNA, 1000 bp, mus musculus
cctgtgattggacagggaaagaggaggtggtgctaagagttgcagagacagaagcgtctgaggagggggagggaagctaagatggaggatgagggtcaggaagaagaacctgaagcagcatggctttaaatagccacaggtagctatggtatcataaaggttagaataattgggataatttgtctaatcttgtgggcagcttttatcattatcaattgcttctgaaactattgtattggcatcttgtgtaatgagaatttatttatatataaatctaacttgttaattataaaccttaagagttttgtttctactgggttgctgggtgttgtggcagcactgggtgagctgtcattgcctgggcctcgcgtggcagcgaagggaactcaggagctcctgcccagctggagagctggagggcagagagctgactatgctagggcagaaagtaactggataggtgcaggaacgtggaggttctacttggtaactggaatataggaccgctgactacaggggtttatgtcagagaaggagctagcagctccagggacaagcgaaacagagctgggaagcctgctggtctttttaaaaaatatttcccacaacataccataaatcaactcctttttttttaaattaggtattttcttcatttacatttccaatgctatcccaaatgtcccccataccctccaccacccactcccctacccacctagtcccacttcttggccctggcattcccctgtactgaggcatataaagtttacaaggccactgtcttctgatacatatgcagctagagacacgagctctggggagtactggttagttcaaattgttattccacctatagggttgcagatccctttagctccttgggtactttctctagctcctccattgggggcactgaatcaactcttagcaatttctacagtttgtcttattatagagtacacaacaagccctatatttatacaggaccttggcagtc

SEQ ID NO: 4375 - DNA, 1600 bp, mus musculus
agctaaaatgaaaatgaaaaggccagatagcccagaaatttgcaaaattaataataaccattctcaaaatcaagcaaagacccaaaaatccacaaaaaattaataagattgacaaaagcttagccaagtacctaaaaaaatcagagagagtaaatccaattttacaaaattggagaaaaaaatacagacgtaaaacagacaaacagagaatgccaaaaatcatgagaacatgctttaaaagcatacagtccaccaatttcgaaaatcaaaatatgaatgatttttcttttatgtaaaatctaccaaagataaaaattagtacttaagtaaatctctggtggaataaaaacaaaaacaacaacaacaacagcctatgtgcagataattttaccaccgaattctaccaaattttcaaagaacattcctcaaattattccacataaaaaaagttgaaaaatgttcacatcattttatagggcctgatttattgtgatacatatatcaggtttattttttaattggatattttatttatttacatttcaaatgctgtcctctttccattttcccttctgaaacctctatcccattccccctccccctgcttctatgagagtgcttcccacccactcacccactgctgcctccctgccctgggaggcattcccctaccctggggcttccagccttcacaggaccaagggcctctcctcccattgatgcaataggaggctggagccatgggtcactccatgtgtactctttggttggtaggttagtccctgggagctctggagtgtctgattggttgatattgttgttgttcctatggggctgtaatcccctcagctccttcagtcctttctctaactactccactggagacccagtgctcagtcccatggttggtggctagcatctgcctctgtttgtatggctctggcagagcctgtcaggagacagctatatcaggcccctgtcagcaagcacttcttggctccctcatagaagccatagtagggggagggagaagggatagttttggggaggggggtcaaaaccgggaaaggggataacatttgaaatgtaaaaaagtaaataaataaaaataaataaaacagatacactgaaactaatagaagagaaagtggggaagagcgttgaacacatgggcaatgggaataactgcctgaatagaagaccaatggtttatgttctaagatcaacaatagacaattggaacctcataaaattgcaaaccatccataaggcaaaagacactgtcaataggacaaaatgtatatgagttaaagacaaaacaaagaaagaactacattccagtgtgtgttatgaaaatacatacaaagttacaatcaattacttgcaaacaaattccatggaaatgtcaaaaatgggcttcctgtcagagaggcagagatgcttcaacataagtaaattgatcactataactcaatatgtaaacagaagaaagagcaaaaaaaatgaaattacccatgagcatcacattagattcagaaaagacaattagtaaaatctaatgcctcttcatgataaaaggtctagagagataagggcatcc

SEQ ID NO: 4376 - DNA, 1600 bp, mus musculus
tgcccaggaacagatggattcaaaatagaattctgccagacaccccaataagtattaataccagcatttctcagtttattacacagcatagaaaaagaaggatgatttcatagttctttttgagtctacgtttaccctgatatccaagccacataaagactcaacaaagatcattaattacaaagttatttccactttcatgtctttattttttccatttctgtccactgtttgtgttttcatagattcagtcaatggatttatttatacttttaacatattcattttattgaacatatttataataaatatgtttaagtctttgtgttttgacttagctatattgcttttcttggaggctacttagtaggattgctgggatctagtagtcacacattgtcctggcaagtactagttgtctttttatgattgtaggtagtagtcttggcttcaaatgactaaaaatccaggtgttgatgtcttgtttttgttgggtgggtattctaatccttggattctgttgccctttctgtgtcttaggaatgtgtgctggctgtgggtttcttggtacagaatgcttctaaatccctgacagttgtggatactggtgcttctgagtagaatatgttactgtgtattagtagatgggtaaaagaaatagggatgggatagaccaggaataaagtgtggcagaaatggctaagatggcccacactatggagtaaagctgggtctgccattaagttctatggagtacctaggaaatgaaattcaggccctggcagatggtcagttaaggggttgggatgggactggaacattggaaatggggagagagacctcaggcctgacttttaggtctgtgtggcagtggatttctagggagagtgtctttcctatttgctgactccctggcagttgttacctgtggtaccccgtgttggggctttaaaagaggctcaattacttgtctgttatgtgttaaatctgtttattgggcaaatatttaatctttaaatgaatctattttgtgccccctccttggtatttttcagccaaatgtaggtgttgtaggcgtataaccatatcacatctggaaatgcttactaaattatcatcttcaccagcatagtgaccagagcttcctcttttactgttttattataagcacatacttctctatctcctctcatcttatagcttttcatattcatatgcaagaaaccagcattaacataatatccctagatattagattgttttattttgtttatgtgattttgaggagtgagccctgggcatttcaagtgatatacatatgttctactgagaacagactcacttttaattgtctatttatgcctgttatataagcctctagatcaacaaattctgcttatagtaaagatatcaagaaatattagttgaatgagtaaatagtcacttatactttccctaaattatcatctgccacacagtgtttaactattccctttgtgagaacagtgcctctgtaaaattaattccattagaaatatgagtctgataaagatttctgactctatgttttcatataaacagaactcacttcaaaataaat

SEQ ID NO: 4377 - DNA, 1200 bp, mus musculus
tttaaaccctgagccatctgtcaagtacaaacctcacttgattgataatgtatagttccacctattttcccacaagtatagtaatgatattttttagtaacttagtaaaatttcaattttctatttgctacatcatcatgatgcatatttctgttgattgacattgctggaaataattttactgattcatgatctaaccgaacacttttagttcagaaagggtttattttatttaccattcaatgttaagtccatcatattggatgctgggacaacaagcacttgaagtacctgcttgcattgaagtcacaactaggaaacagtaaaagatccataaataaatcttgtctaattcctgttcttcagttacaggaccactgttcagcacgcagcaggagattggtgtgacccgtccagcaggtccagttattcgagggtcttgaggggaccttctcctaagaaccaaatggggggatagagagagatgaggaacaagtgcaagaatgacacggaaacattctgagtcgcatcaaggtcccactgtattgagaaaggctcaaggcttaaatgcacaagcaaagggggaagtacttttcagcaggaggggtggggcagtggaaatttttcttttggcagttacacggggaagcagaaacttggtggtatcagggtgtggtcaggacatctggcgctgacttagggctggaacattctgtggttgttctcgaacggtgcatcagtggcccgcttttgacccccttttcttctcgggggagaggcccaattcagagatcaggacaattgtgttgtcttaatagctcccaacattggtgcaatgcacagtggatgtgtgggatcttgccacttatcatttctcaaagttataccaccagtatcaggtctcccaagagattttctgattttatgtcctatcaatttgacaatgaatgcaaatcatcactgatatctaggaaagtactgagtactgaaagatgactgttatgctggaaatcatacgatcaaaaagagcttacagctagtgttcacaaagaaaacccattttgattataaaattgttgaatttacagtaataaataaaaagtaaaattgacagcactaaatgctactacaaatgagaatcacatgacctttcaaaagctgatgaagagggtgttgcaagctgcaaaaatgtgagaaaac

SEQ ID NO: 4378 - DNA, 1000 bp, mus musculus
gaatccacactttggtcttccaaaaactcacgtgatatgcactcactgataagtagatattagcccaggaacttagaatacccaagatacaatttgcaaaacacatgaaactaaagttagctttaaggtagatttttggaattttcagggcttactgtaataggataacgggtttcttgtggggacaaacttctctagctgttgttgactgtgttcttaacatgttgtttatgcatctcagtttgttatgactgattataagtcttggcatcactgagttttgttttatattgttttgttttgtcattgttgtttttgtatgggtgttttgttccttggcttctgttttctctctgtatttttagtcattgtggcctagactagccacatgacacatcgcagctagcatgacaagtggcccaacagagagtctctgcccaagttgagaggtaggacaaagtgaaaaagagagaagacagaactggggctagtgttggacacagagacagtgaaaagaatagcacttaggctgcctttctggagctttggtggccagtgtggtctcagttccattaggaagtctctgtctgagttcatctacctactctggctggtgtgggctgatatgttcttcttggagaggtttgcacctgaacaaatcatttcaaccagagttgaggacaggggcacagcagtagaggctggctgtgggagtgaaaaggctgtcagtgagttggatctttgggacatgaattgagattgtaggagatttccaagggaaaaacttattaaaaattcatttttacattaagcagaagtgaaatagctaaatcctcaattaaaatactttttaaaggtcacagatatgaccaattaaatgctattcccaagattttctcaaacaagagaattttacaaagataactaaaaggaagaacttcacacacacacacacacacacacacacacacacacacacacacacacacacacacacacc

SEQ ID NO: 4379 - DNA, 1000 bp, mus musculus
ggtgtttaaattgttccttattaacagtaatgcttgtctatttattaaaaagagggcttttctttattttttaagaattatttatttattttatgtatgtgagtacactgccactgtcttcacacacaccagaagagggcatcagattctgttacaaatggctaaactcaaaacatctggaagtacagtcaatgctcttagccactgagccatctctccagcccaagagggtttttcttaagaaaagaaaataacttgtaataacatcattcagaaggcttagaaaggaggattagtacagttagaggctatgaggatagctaggtctgcatagtgactttcaagtcagcagagcactaatgttcatattaccagaatgtaatattcaatctgccaaaggagaaaccatcaactgtttccccagctgtgatgtgttgaattacaataatgaacagccctgcaagacatttcagtttggcaaatgtggcacacacgttgtcttggtaaccaacagctgtctaatagaactttctaaacaggagggaaagaagtaatacaatgatatcaggcttctcaggcctagaacaaagtatgtgaaaaatattatgtctaatgaaaaaatacaggtatcatttacttttgttatttttcaaagtagtgaaattacattaaaatattacaacatttaaatactaaggaaattgtacttaaatctgattattatgaaaataagaggtaagtttatccacataaataatatcaattaaaatatgacctattgccggatgtggtggcacatgcctttaatcccagcactcgggtggcagacacaggtggatttctgagttcaaggccagcaaggtctccaaagtgagttccaggacagccagggctatagagagaaccctgtctcgaaaaaccaaagagaaaaaagaaagaaagaaagaaagaaagaaagaaagaaagaaagaaagaaagaaaagaaagaaagaaagaaaga

SEQ ID NO: 4380 - DNA, 1000 bp, mus musculus
acccaagtatttatgtgtaaacacaaatgatcatggataaacaaaatgcctgtggaatgcaatttatgtgatatatcaatatagttagccataaataatacttattatgtatgtatgtatttatgtatgtatgttcatcccagtctctgctgtgcctcctggattccccctgccacatatacacagagttcctccttccattcccatgccctatctctgaaaggcttcaccccttccccctcagcatcatgtccctgcagggttaagtacattctcttccactgaagcgagacaaggaaacatattttcgaacagatttctctctcagtcaggcaactcttttaaggacagcccacagtctacctgttgggagagccacatggagactaggctacacatctgctgcatgtttgggatgctaggtccagcctgtgtatgatctttggttggtgtggctcactctctgagagctcccaagggtccaccttagttgactttgttggtcttcctgtagggttcctatcattcccccaactcttcaataggtgtcctggatgtctgaccaatgattggctatgtgtatctgcatctgtttcagtgagctgctgggtagagcttctcagaagactgttatactatggtcctgtatgtcagcataactgagtatcattaatagtgtcagagagtagttcttacccatgagctgggtcttgaattggacagatgattggttggccatttctcctctgttccatctttgttgcttcatttcttatagacaggacaaatgctgggttaaaagttttgtgggtggtttggtatccttatccctccatgggaggtcctgcctagctatttgggaggtggcttcttcaggttccatatccccactgctatgcatctcagctaaagggatccccaacattcactcttgagagctttctccattccaagtctctaggaattcctagagattcccgcaacccaagcctgaaactat

SEQ ID NO: 4381 - DNA, 1400 bp, mus musculus
aaacaaaaaatccaacatagctaaaagagcccatgatgatgacgatgatgatgatgatgatgacgacgacgatgacgatgacgatgatgatgatgacgacgatgatgatgatgatgataactactgaatatcactatcctcaacctaaaattgtgctaccgaggaatagtatttaaaaatatggtactggcacaaaatcagattgagcaatcgattaaatattaaaatttaaataaaatgtattccattgtgtaaatgaaccatatttttctgtatccattcttttgtcgtggaacatctaggttgtttccagcttctggctatcacaaagaaggctgctatcaacatagtggaacacgtgctcctgtggcatgatggggcaccttttgtgtatattcccaagagtgttatagctgaacatcaaatgagagatggggttgccatctcacagtcacacctctgactcatagctgtttctgtctgaaaaaaaaaatacagggatggaaatggagaggaccctgaggaaaagaaggtctagtgacaggcccaagtgggatccagctcaaggggaggtcccaaggcctgacactattactgaggctatggagcgctcacaaagagggacctaacatgactgccctctgaaagacccaacaagcagctcaaagtgtcagatgaagttatttgcagccaaccaatgatcagaagccgctgaaccttgttgttgaattagggaatgctagaagaagctgaggagaagggcaattctgtaggaggactagcaatcttaattaatctggacccccgagatctctcaaacactggaccaccaaacagacagcatacaccagctgatatgagccccccaacacatttccagtagaggacttccaggtctgtttttgttcagagatgatgcacctaaccctcaagagactggaggccccagggagtttagagatcaggtggggtgggaggtgagggcatccacgtggagaagggatgaggtggggtggagttgtgggatgtggagcagtcagagggtggatggggagggacgaggtatggtataaaaaatgaaatacaaataaaaataaaataaataaataaagcattccacacattaatggacatctgatttttgataaaggatccagagtacatgcgggaagacatgcagcatcttcaacaatgtgtattggacaaactggatgactgaatatagaatacttcacacttatgacattttaaaaaactgaactccagatgggtcaaagacttcaacatgaaactagatacattgatatgtatgttttaaaataattcatttttaatcttaccttacttatctatagagaaaaaaatggacataacttttttccaagtaacaaaatgattga

SEQ ID NO: 4382 - DNA, 1000 bp, mus musculus
tgcaagcaagatctccttttacagggaagttgcacagatatctggcatttggacccagatatagctgtctcttatgagactattccagggcctagcaaacacagaggtggatgcacacagtcagctattggatggatcacagggcccccaatggaggagctagagaaagtagccaaggagctaaaggggtttgcaatgctataggtggaacaacaatatgaactcaccaattcccccccacccccgcccgcccccggagctcctgtctctagctgcatatgaatcagaagatggcctagtcggccatcagtggaaagagaggcccattggttgtgcaaactttatatgcctcagtacaggggaacgccagggccaagaagtgggagtgggtgggtgggggagagggtggcgggcatgagggggacttatgggatagcattggaaatgtaaatgaaataaatactcaataaaaaaaaaagcaagacactttttttaaagggactgtgttcagatccagccacccatagggttgtacacaactacttgtatctccaattataaaacatcattatggtctggattccatgggcaacttgtgcacatggtgctcatgaacacatgcaaacacatgcacatacacatatataataataaataaatataatcaatacataaataaatataaaaggaaagcatcaatgtcatactttaaaaaaggttacatatcttctgctgccattttaaatctagacctatacaatgttccaccacaactatgtgccagcaccccctttgccaatgggtctaaacctatgcagtacattaatgggtacagctacaaagaggaatttccatgatcaatgctagcaagcatcagctagataatggtaaacatgttaattggaggctcatgctggatacaagcaagggaaatattgaataattgtcttgtttaggaaaaattgcagattgcagaattaaaaacagacccagcccctgg

SEQ ID NO: 4383 - DNA, 1000 bp, mus musculus
tccaaactaagagtaggattccagcaaggtaaagatgtgccacaaagtcatttaaagaaccatctatgaatcatttgtcctccccagcaatgggcaaagagaagatgacagccttttcctcttgctagcttgatgcctgacttggtaggcaaagctatcttatgcctagggctcacaaaaatcaaatcaaatcaaggcagcacagcatgggaagagaaagacagagagagatcaacatgtcacccaaaatcctgctctccagtgcatagcacaggcaaggaccatagacatctgcttcccagcatgccacacagatgaaaattttaagagagttaaagatctttagaaagtatgcaacttatccttcagtactgacttttgatgccaaatgaaaataattaagtgaatagatagatactggattgacaaaaaattgagtattaaatacatgaatgttttgggagccggccagtggctcacatgaactgggtttcacctgggaggcaaactggggctgaaagaaaaggaaactaggtggagaagagagagatgaagccaagacagtgttctgatcaaggctcaaatgtttaatggcggacatgctttataaaggagcagggaggcccattcctgccaattcatccttggagcccagctgcaggtgaccaagtgctaagacatagtctctggaatagctgggcagcctcccagcagggagcatcgacagtggctgaacaatagagtgatctagggaggcaggctccaccctaggtaatctccttagtggcagcaaagtctaggtctggttcagcctgcttcaggttagaggggaggttacatgtatgtagtcaagtggtggactgtttaagacattcgataagcaaacgttaatactgtaaacattaggtattcaatgaaaatggtatacgattagaccaatctaatccaacaactgtttattcactattttcacaaaactgatgctactactctgaaatta

SEQ ID NO: 4384 - DNA, 1000 bp, mus musculus
agggagggaggaaggaaggaaggaaggaaggaaggaaggaaggaaggaaggaaggaagaaagggaaggagggagggagaaaaatagagagagagaaaagagaaagagagagagaagagagagagagagagagagagagagagagagagagagagagagagagagaagagagagaggaaaagaatttcagagctggggaatttgtttcaatcagtaaagtaccggacatgtagcttgaagacctgagttcagattcccagtgccagttttaaaagtcaagtgtagcactgtgcatctgtaggcttgtagagcttgctctttaacacacggaaccagcccctcatccccaacctatcatttctggcatgcaaaatagacaaaaaataatgtaaatcttcagaaaagtgtaccagaatacagcaattttggttatttacttagaatgatgaatacagtaaggcagaatggtactggtgaattcttgagatagaatgatgttctcaatctggaacatgtcgatatagctcaattataaatgaaataaatgctgtgctaatggctgtggtataggatgaggtttgaagccatgttcatgtctttgggctgttcctatgcagaaaggttgagtgcataactgatctgagggtcctgtgctgccacctgaaaccatggtcatgtgcaagccttgcagcagtgttatgtattgatgtctgtggcccatgataccactgaaggtcatgttgatcaccatggccttttctgcagcctgttgcttttgcagggatccatattgttgtaagtggtctgcctgccacctgagttgatattcataattcattccaccttttagggtattgtgtgggttagtcatccttggtcaacagggggtcatattgtggtttgtatcatcaccagaatccacgaggatgcccaggactgtgctgcttcttgctgactgtaaagatcaaggaagctaccttggcagtgatactgattactcc

SEQ ID NO: 4385 - DNA, 1200 bp, mus musculus
aaaatatatatacatgtatatatttatatatacatgtatatatttgaacatcctgagtgaggttacccaatcacaaaagaaaacacatgatatgcactcactgatatgtggatattagcccagaagctcagagtaatcaagatacaattcacagaccacatgaagctcaagaaaaaggaagaccaaagtttgggtccttcggtccttcttcgaagggtgaaaaaatacccacaggaggagacacagagacaaagtgtggagcagagaaaaggctatacagaaactgccccacatgcagatccatcccataaacagtcaccaaacccagacactattgcagatgccaacaagtgcttgctgacaggagcctgatatagctgtctccaaagaggttctgccagtttctgacatatgcagaggggttggcttgcagccaaccagtggactgagcacaggtccccaatggaggagttagaaaaaggaccgaaggagctgaaggggtttgcaaccccataggaagaataacaatataaaccaaccagagctccagggaactaaaccaccaaccaaggagtgcacatggagggacccatggctccagctgcatatgtagcagaggaagacattgtagggcatcaatggaagaaaagccccttggtcccagtgcaggggaatgcaagggcagggaggcaggagtgggtgggttggtgggggaacaccctcctagaagcaggagggggtgggatagggggtttctggggggatcgggaaaggggataacatttgaaatgtaaataaaaatacaaggaaattgttttattttataagcatataaattaaagtacattagagaagacatttttcatacttatctttagaatatatatatatatatatatatatatatatatatatataatatgtatgtatatatatatatgtatatataaaatgatataaacttaatttttgtgtaaagttctatgtaactgctctacattttaggaaagactatacatcctgaagtatacattccatcattcttatagttttctaagggtacatattaatactagaggaatatttaccactctagcagccatatagaacactttgaaattaagattctattttatttcacatctgtaactagacaaggaatgatcattaacctacgtggtttcatgctggcaacttagt

SEQ ID NO: 4386 - DNA, 1600 bp, mus musculus
tcagccatgaaatcattaaattcctgaacttaataaaaactccagaagagggaggtatttactctcaagtgaaaaaaaatgggcatatgtgaatgaataggattgaaaattgtattctgtatgtaatgagtaacaaatgattaacataaaaatatgcagttaaaattctaacttctgtggcacatgattggttcttttgttacttggagttttagtttaaagaaaattacattcaccattaaaacaatttccctaaataatagcttgacaatataacatttaaattttggtgcatttcaaataaagattaatattcatacttaaatgtatttgcatacatacttaataatcaattgtatagtaatgctcgccttgtttaaattacttaaaacttatgcacatgctataatatcagtttttttaaaattgatcatcaaaatattcatcaatgtttatggatatgtaacttttcatgcatataaattctaagcaatttataatcaataataatgagtgcagtggttaaatttccagttttcttttttgaaaagaaaacggaatgaaatgcaatagaaaagtagtatatactagctcagtcctttctgcagagacagaactctaactggtctgctccagtgaagacaccttattttgagacatcctagaggatccagtatactcagagcagttggcttcctatcatgagccatcagcactcagagcaatcaggcaactgacaccacagcctgaagcatcccaagagatctgctgcagacagggcttctctactcccctctgaaaaactcccagtaggaaggacccacaggtggtctgctacagacagggcttcaggactactgggagcctgaagtaacccagggacaaaagaggcagaatccagacagtcacccagagcaacaaacaccagggataaccacatagtgagagacaagcacaaaaccataagcaacagaagccaatatacgtgggcatcatcagaacttagttcttccaccagagcaagctctgaatctatcagcacacctgaaaatagggaagatgacctaaaattctatctcacgaagataatagagtcctttaagaaggatataaataactcactgaaagaaatagaggaaaatacaggtaaacaggtaaaagcccttaaaaaggaaaacaataaatcccttaaagaaatataggaaaacataatcaaaaaggtgaaggaattgaagaaagcaatccaagacctaaaagtggaaattgaaacaataaagaaaaaacaaatggatgcaaacctggaaatggaaaacctagggcagaagtcaggaattacagatgtaagaatcaccaacagaagtcaagatagaagagaaaatctcaggggtagaagatactgtagaagatattgacacacctgtcaaagaaaattcaaaacatgaaaaaaaaaaaaaactcctaacccaaagaatccaggaaatttaggacacaatgaaaagaccaaatctaagaataatctaaatagaggagaaggaagattcccagatcaaaggacctgaaaatgtctacaacaaaatcatagaagaaaacttccccaacc

SEQ ID NO: 4387 - DNA, 1400 bp, mus musculus
cattatgaaaagacaaaaatctctgaataataggaatagaggaagaagaagaaacccatatcaaatacagagaacacaatttctataactaatggaagatttatttttaattaaatattattacttacttaatcactttatatcctgctcactgccccctcttctggtcactccctcccacaatccttcccctaccctctgtacgctatcctttaggagagtgctgtcccacctcccacatggttatccttctaccctggtacatcaagtctctgctgtggagctaggcgcatcctctcccactgaggtcaaacaaggcaatccatacagaagaacatattccacagacaggtagtaacttttgcaatagctcctaatccagttgtccgggacccacatgaagaccaagctgtgcatctgcaacttatgtgtgggaggcctaggtccagcccaggcatgctatttggttggttgctcagtctcagagatccccaagagtccaggttagtagattctgttgatcttcctgtcaagttcccatacccttcagggacctcaaggtcccttacccttccatgagagttcccaagctccatccactgtttggaagtggatatctccatccatctgagtcacttgttaggtgtcctttcagaaagcagccttgctagactcttttgtgcaagagggactggtgcttgtcaatggtatgggtctcaaattgggcaagtaataagttgcccattccatcagtctctgctccatcctcatccctgtatttcttgtagacaggaaaaatattggattgaaacttttttggggtgggttggtgtccctatccttccactgtggttcctgcctggctacaggagctgagctcttcaggttccatatcgccactgctgagtcacagctaatgtcaccctcattgattcttaggcatatccctaatcccaagtctctgtcacatcctggagatgccaccctaacacttccacataccagtcagttgcagatttccatttattcgcatgtccagctggttttctcccctgtccctcaccacacatgatcatgaagcagtcctaattcccctcctcatcgctcccacccagtttcctccctccatcgccctgttgtaagtattgtatttccccttctatgtgagagtcaagcatcctcactagtgccttcatccttgtttagcctttttgggtctgtggagtgtacttgggattgatttaaatttggtaagtagtatcagtctagataatcgtccatgtcatcaagattctccaattctagtgtatgccccagtacaggggaatgccagggccataaaaggggagtgggtgggtaggggagagggggtgggtggctatgggggacttttggtatag

SEQ ID NO: 4388 - DNA, 1000 bp, mus musculus
acatggatgctgtgaagaactctttatagacaaacacataaaatactacccctggaatctattaatatcaatcgcgtataatcagactataaccacaataagttcccattagtgaaaactgagagacttctatgtatgtttaaaacataatttcagaatagaaaaattaaaattcacttgcatggccaaactggccatctaagacagtttgaagcgaatgagcagcctgctctgggcccctaactcaaaacaattttcctttgctccttgtgaaggctgcaggccttaaattcttaaaacgtaaaacacatcctatgaatatacagacctcctttaggggaggaagttgtctggtttcctggtagaagccagtcatacttactatagagttgatcagcagttcatcaggtgagtcctcaagtaaagtgtcatgagacactgcctctatttcggttctttccagatttctagttcgcttagggtattcatttttctctctgctcaatcactccgacatacttagaaaaagtgattctttaaaaaaaaaagataaaaataacacactctttatagctaggatgagccactccctccagggtcccttactggagacaactcacactgccacaaagactcttccaaagggcagaagcatttgggcaaacggctaccggtaagagtcatctgtccctgatcgccaccaagcctaacactgtcagggttatttccagcccttcctttccgagaagacgagtgcacactcctacgctccagttgcgcacatggtccaagactcctctgtctccacgaatgtgacatctaagggggttctggctatgcctccagagcccagggacgccttcgccctcggctgccacctaccggccactgggctcctgcttcgccccgggccatcatgtctgctgcagcttggctcgcaccagcggcgcgacaataaacaagtgccgcggaccgggccctgcacccgctacccagcaga

SEQ ID NO: 4389 - DNA, 1000 bp, mus musculus
gctattgtggggacattaaatatttgctgtgtcacatgtattgtggcctctgctaacatcatgactatgctttgctgttcctaccagcgcttatccacagagagtgcggtaggtgactttgtctttgtgccttcaacttgactgtactttcagagactcacatagctataactccactacaaaagacaaggtaatgggaccttcttagtgatttcattaattatttcaacttaccgagcattgtgtatgtaaaagaagactaaattatgcaatttaaatatctcacaatatattgaagaaaatatttcaaaaataatatctcaaaataaaaatatttaatactataataatcttctcaaccaaggctatcaaaagagaaacataaattattaatattttgcagattagcttgtatgcatcattgtatcaatatttccctgacacaatctgtttactatttaccagggtgactttcaatcgctttctttttatttatactgactatacttatgacaataaaaattatgcatttgtaatgatgtctaatttgatagggaaaatctagaattacttcatcttgattatattattaacaacaaataaccagccagatgttagcctacacttatagattacatatttaagtttttatttataatcacttgataactgattaagatttatttattttcttttttctgttttcttttattgaatattttctttatttacatttcaaatgctattccttttccaggtttcccctctgaatagctcttatcacatctctcacccctatgtctatgagtatgttccccagccacccacccacacctgcctccctgccttcacatttccttacattggacatcaagccaagggcctctcctcccattgatgcccaacaagagcatcctcagctacaaatgcagctggagccataggtccctccatgtgtactctttgcttggtggtttagtccctgggagctctggcaggt

SEQ ID NO: 4390 - DNA, 1800 bp, mus musculus
taagaaatgaagcacactcagtactgcctataggtcactttgtacttagcaactttacttgcataaccaatacttcacaaatttccttagcttcttttcatgcatgttattttatacttcacagtaaaatactttcatgttttatcaatattatttatttatgctaagggtaattttattagtaatattagatgatttctgtattgcagaaaaataattctgaaatgttttaaatgcttaccgttggttttaacaccatattaatcacatataagtaacatattgattttgacatcactcaactcagattatttgtttcaatgtctgaagtaaacataaatataacgggatcaaacagaacaagaaaaaaaatttggaaggttaaaaaaacttgtgtgtgtgaaatttacagaatattggtgaaagaaatcaaacaagacttacattaaaaagaaaagatacaatttaaaagaattagtgttcttatacctaccatgttatctaaacattatacaaatctaataaataacctgtgagcccaagtgcatgctatagagagggagaaataattttgaattcatttggatccacaaagaattctaaacaactaaagcaatcattaaaagatataactgatttgaacgcattgaacagaaatttttttaaaaataagggtagcatttctttgtcatggaaactgaaaacagaatgaaaaattatagagctcaggaatgtatggctggctgatgacttagcaacttccaagtacaaacaatgtgagggtgccttgacctgtagggataatcagttgggacctagggcaaaggagagagagtgggagggacaagaaacaccttgagggctggagagatggcttagcggttaatagcacctactgctcttctgaaggtcctgagttcaaatcccagaaaccatatggtggctcacaactacccataacaagatctgacgccctcttctggagtgtctgaaaacagctacagtgtacttacatataataaataagtctttaagaaagaaagaaagaaagaaagaaagaaagaaagaaagaaagaaagaaagaaagaaagaaagaaagaaaaaaagaaagaaagaaagaaagaaaggccttgaaatatgagaataaaatgagagcaagtcaattagactgatcaagatctggaaaaatttattcaagagtgataatataagcataagcaagaggaggctccaaggaagggggaaagagcctgggggctctctgaaggtcaggtgtcaatcttcagatccttgaaccaacagtgacagtgtcctctctacccacaatcattcttactgttatgaccacaaatgttctctcagggttatgtaagctagaaaatttccataagtcctggctgaagccatagctcccagcatgtaggaaggaagtttttcagtgctgtgaaatacatgcacacacatacacacacacacgtgtgtgtgtgtgtgtgtgtgtgtctatttgagagacacacacagagtatggatgtatatgagacacacatacggagcagagagagagagagagagagagagagagagagagagagagagaaagagagagagagagaaatgaaacatgatgaagtgagactggaatttaccacatacagaaatcaattcaaaacataaatgaccagcgtacactatctcaaactatataagtgataaaaaatgtcaactgtacatgcccagttatcacagtgattgcttatggttgactctagattcaaaaaagtgaaagcaaaagtataaaaa

SEQ ID NO: 4391 - DNA, 1200 bp, mus musculus
gtgatttaataaatcttatttataaaacacatgatgatatcatgtagactctgtgggagttttcagaactaacagaaatatttggtttatatgtagatgaaccaaacagataacttcctaaaataaataacattgaccatcagaatgcttgagtagctttataaatttacttttattaattaattattttatgtgcatgggcatttggtcagtgtatatgtcttcccacacatatgtgcctagagcctgaggaatctagaagtgagcatgagattccccagagcttgagttccagagagctgggccactacttgtgttcctggactccaatgtgggtctttggaaggaggtgttagtgatgttcatggctgaagcatagctctggatgacacctgagtacttttggaaaaaaggaagcagtgacagaacctgaatccttaggtagaagactgaactgagagacaagtgggacttccctgtgggactctggaagactgaatggcaaaagcaccaggaaggccatgcacacaaagcaactcacgcatctctcacggtgggggaaacttcccagaaccttgaccatttcagtcattttgtgtactttagtaagggtgctgatatatcctacacagttatcacctttgggagttttcttagcagacgtgtttaaacatggatagacaaagtcaaaagcagtgatgttatagcaatgtcagaggtgcgcacaggaactcagaagacccagcacgttacctccctttcttcagcagttacaagcagacagagacatgtcttagaagtaccctgctctagctgttgatatctggggcacaggcaaggaacattttacagcgataaaattaataacatctttccgggcagtggtgacacatatctttaatgccagtacttgggaggcaaaggcagtaggatttctgagattgaggctagcctagtctacagagtgagctacaggacagccaggatttccaaaaagatgtgcccagacctctccactctctggggcctcaagtttctcaagggttaggtgcttcttctctcactgagaccagaccagactgacatctgatgtatatgtatcaaagccctcctatgagctggtatatactacctggttggtggctcagtgtctgagagatctcaggggtccaggttacttgagactgctggtcttcctat

SEQ ID NO: 4392 - DNA, 1600 bp, mus musculus
accagaagttcttttatccttgagaagagttttcctatcctaggttttttgttattccagatgtatctgccaattgccctttctaatttgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagacttgaagttcttatcataaagatctttcacttccttagagtcacgccaaagtattttatattatttgtgactattgagaagggtgttgtttccctaatttctttctcagcctgtttatcctttgtgtacagaaaggccattgacttgtttgagttaattttatatccggctacttcattgaagctgtttatcaggcttaggagttctctggtggaatttttagggtcaatactttgtgaactactgatattctgtaaattggaatccaactagtaagtctttccattatgttctggattttaattaattgtaccagggagatgttcaggaaagctaaatttcaaggcctctttcttatagctctctaggaattttaatctagcaacatggctggcaaagggatcactgtcaaaaactttctagatctttgtgatccgtctagaatataaacacacactggattacagcatgatctggctggaagacagacacagccttagtacacaccttcatgcccaaacaatgtaagtaagatagacgtaaacagtcaggtgtgaaagtggcatctcatgggagggcagttcagtgagcggagttcaattgaattcagttaagtcaggtgagggagctgagtggactgagtcaggtagttcagttcacacagttctgtcagtcagtgcagaaggcagtgcagtgtggatttgaactcagttccattcacttcgggcagcactgaagccacagatttaaaaatgaaccagaagattagaacaaattgccagagctattttgaggccacatgggataattcagtgagaaactgagagaagccagattgaatccgtcagcatggagaggagtttgagccagaaaagtttagttgaatcagaaaggcagagttcagaaagaactagaaagagtgagtcattcaacagtaatcctttgagattataattgcttcaggtgaataaaagatactttttacgcagctcatccaagatatactttaaatttcttttgatgatgtgaaaaccttgatgaacagaactattttcaatttaaaaaccaataaatttaataaaactgaaaaactagcatttctcaacatcttaaaactcttgcacattaaaataacctgaaaaaatgttcaacatccttaatcatcagggaaatgcaaatcaaaacaaccctgagattccacttcactccagtcagaatggctaagatcaaaaattcaggtgacagcagatgctggcgaggatgtggagaaaggggaacactcctccattgttggtgggattgcaagcttgtacaaccactctggaaatcagtctggcggttcctcagaaaattgg

SEQ ID NO: 4393 - DNA, 1200 bp, mus musculus
ttatctagattcattaaaatctcaagtagccacaatatcaaaagtagctggtaagggttcttttccatcaaaatcctcctgtaaggtactttacttggtacttatgtcataccttactgtggcaccatagaaggaaatagcattgttccctgaaacactgctttgatccatattgttggtgtgttatgtagcttcttaaaataaaagtttggaaggacacctgggctggtaactgcaacctcccaaagtcagcatcctaaaaaacaaagaacaagttttatttactggtctctaaaattggaactgagttatgtttctgctcttaggagcagacatggcatcctggaattcttagaggatgtgatggcttaaatattcttggcccatgggaactgacactattaggagatgtggtcttgatagaataggtgtggccttgttggaggaagtgcctcaccatgtagggtgtgcattgaggtatacacttaagctctgcccagtgtggaagagaccctcctctagctgcctccagaagagtctccttctggatgccttaggatcaagatgtagaagttctgacttctctagcagtatgtctgacagcatgctgccatgcttctggccatatgataatggaatgatcctctgaaagtgtaagccagcccaaattaatagttgtactttatatgagctgccttggttgtgatgtttcttcacagcactggaaactctaagacagatggccattgataatgattgtttaaagctgttccccggaaccctgaagtgtatgactgtgtagcaaaaggctttctgatcgaaagcactgggtttatgacattctgaattgaactccatccaaacaggcttgtttggcatctggacagaagaaaggactacacggatgttccttgtctagaggtttggagcactatgatcgctgcatggaagtagatcatggctccttgaatattgtcagtttctgctgccaaaagagcgcattactatatatgctgaaatactacccatttttatttatttcacaggacacacacaaagaatgcaaattgacattggagactttgtgcactctagcatggttgttcttggtgaggtgatcaagccagaggaagtgattaaattcatacatggtgagctagtactactttatagacattgtcttttttttttcaactcatg

SEQ ID NO: 4394 - DNA, 1400 bp, mus musculus
catcctctgctacatattcggctggagccatgagtccctccatgtgtactctttgatttgtagtttagtccctgggagctctggggatactggttagttgatactgttgttcttcctatggggttggaaactccctcagatccttcaatcctttctctactgagcttgtgagatggatcactgagtaaaagtgcttgctgtctctgtaatgatttgagttcaatcctcaaaaccacatggttgaagaagagagctgactcctgaaagttgtcctctcacctctacataaaggctgcagcacaggcatatactgtaaaaccaacaacaacaacctcatgcgttcaaataaatgcaatgtaatgtttttacatcaagaaaatacttgaaataacattaaagttatgttgtattggaaattgttaagcccatcctatcccataaaacatcgtatacactgccgggcatggtgtcgcacacctttaatcctggcacttgggaggcagagacaggcggatttctgagttcgaggccagcctggtctacaaagtgagttccaggacagccagggctatacagagacaccctgtctcagaaaacaagcaaacaaacaaacaaaacaaaaacaaacaaacaaaaaagcatcgcatactattagcattaagtacaatatgacactctgtcactgctagcagctattgaaaaccatgggttaacttgtcacaacttactaaaactttgaccagccaaagtacataatttacaacatacttacataaaaacaaacaagaaaactaaacaaagtgaggctttctgcttccatggagacttccaagggaaactgggcaggactgacatctgaaggatgggggatcaagggagcagcatcgatcttcattctcatgagtgtgagttcctaagctgcctcagcttgtgtgtgcaactactaatctctagtttatctttttgccggcacagatagatccaatcacctctagctgctgatttcctctttcagcttcttcagcaactggtcctcatgatcatccaacatcacacttgagaacatcagcttatccccaaagcacagcaggcatgcaggcgatgagaaacagggaggttccagactgctattgctttccccacttcacactcatcattcccctccagatgtcttttcttccagcttcagacctaatcctacaagcaaaagcagatttcagcatcatgttccacaaatgcccaaattgcctgtgaacagctattatgataaacttcatattgtatagtcttccttgtatttctgtttccttaacacatgaatgtttacaacgacaaaaaaaaaaagcgcttagttttcttggtaggattcccaaaactctgcactaattcttttagatttt

SEQ ID NO: 4395 - DNA, 1400 bp, mus musculus
acagagaaaggagcttcagttgaggaaatgcctccatgagatccaactgtaaggcattttctcaattagtgatcaagggggcaaggccccttgtgggtgggaccatctctgggctggttgtcttgggttctataagagagcaggctgggcaagccagtaaagaacatccctccatggcctctgcatcagctcctgctttctgacctgcttgagttccagtcctgcatcctttggtgatcaacagcagtatggaaatgtaagccgaataaaccctttcttccccaacttgcttcttggtcatgatgtttgtgcaggaatagaaaccctgactaagacactccccatctcaggtcatcccaaatttaaatcagcaaccacatcaccagcattggaaaatacaatttaatgtttagcaatataaaattattttatttgctctgggcagatactcatgtctaaatgaaattcatgtcagatgggtgttttgtgatcagcatcatgtgtcttggggtttgtactgttcatttcagccccatgggagtcttctgaaaaacaaggccctcactcgttctccttgggcatcttttaaattctgaggtaagagattataaaagtgtagactaggatgagatcactttgacccttaggtatgggttgaggccataaagagcagcttgtggggcatacagtagttggtctctcatagaaattcaggactggaagaatgatcagtgctcagcaaactagccccctgactgatggccattttcacaagtagggtggggctgaggagatttgaaactgattcatctctcatgtctcctccagagaagagcgatctctgtaaaatcagagcactagatggagacaggaacagatgggcatgctccattatgtccccatttcagccttttactttgatgagtgaggtgaccaagttagctctcacaaaaccattcagctgactactgggggttcaggcgctcactcccagtgtcagggttctaactaagttatcagccctggacaatactgcttattctccttcacaattatttaaaaacccttcaagaatcgatgatgtacaagtttactcttcgattttccccagataactattgctattgtatcagaaagctaaagggttttaacataattaccgatgagtagtattaactttttgcaaaacatttgcaaaatcactacaaagcttatgtccatcataagcctgactagcaaaataagagagggttaatacagatcattttcttttgcaccacacctccaggaatggacccaatatcactataaacaaacagttttgaggatgcttaatatttttttaaaaaagctattttaaatttaaaaaaaaaaaacatagtgcatttattcagatcaac

SEQ ID NO: 4396 - DNA, 1400 bp, mus musculus
ttgtatcatagatcattctggaaattgcttctataggcagcaacctaataaatatgttaaatgttgtcagccatatagagcctcttacagctacatcactttgccttgccagtgaagagatatcagcaaacaatctgtaagacaatggctcggactggttgatgctgcgcttcacgctgaagtttgaatttaacatacttcaactcacaaaaaatattcctctgcattctttctcctagctcaattattgagaaatgcaaattcacattctttatttacagtccatacataaccatgaaggcaaacatgggctctcagcctatatatagttcatccttgtgtaagatgtttcagagcagtggagacattaaactccatcaactgagtaaacctaaaaatggttgcataattgaatgattttaaaagtagagtttagcaactagttataaagcagggagactctgcaggagagacatggagggcaagggtttgggccttggagccttaggggatcatgagtaagggagtgtgtaccacatgagtatttttggaagttcatattccctacttcatgcctatgtgtatacctatgagacaactctctgtacaagtaattcctgttgaactttgggccaggacaactaagacaaagccctatcattcatattggtattacataattaatattcagagggactccgggcttgcttagacagtgtcaactcaggttttattaccatctgtcttaacttcctcaagtgaatccagctgagcgtttgcgatgctctcaggagaggcatatacaattaaagtgagtgtcagctagccagttgctcctggagtgaggtgttgggtcctctgacagcaaccatttttccattttccccttagtaacattctcttcactagttgacataatttttgtgctttattgttgacttgtaaagtccagacttgctctaatgttgtcagctatttgatactggtattgaagctgtaggaccctcagtttcttcattttgaaataagaatatggtcctaacttgcagggatatcattttaagtgaaagaactccaagtccttattaaacatataataaagtatttgcatgtagaaaactaaaggatgattgacttttactactattattggtgttatagaaagaaatttgtttttctgacaaagttttagttactttttataagatgagataaaaattaggaagaggagaaagttaacttagtttagaaaaaaaaatagtctcaaaattctaggaatagtagagataacttgatacaagagaaaatttattatgaccttatgacattttgaaagaaagaaataaactgtttaacatttcaaaagattaatttatgaaaggttaatttcttttactgtg

SEQ ID NO: 4397 - DNA, 1000 bp, mus musculus
tgtcataatattcagggtttgctgtagtggcatccctgggctctggtaatatcattttgctctggctcttgttgactgtgttcttatgttggcctttagcttctgggtttcggtggtgtgatagatttaggtcctgattatttctgagtttatctttgttggatgggtggtttttagttgtttttcccgttgcgttctgtctcctctctggtttttggcctgagtagctggggttctggtgactagcaagtcttcaggtctagtagtgtgtttgcccttgagttttgagccctgtgtggcctctgtggttttgggtgcccaccttgcctttgtgttccctagactagcatggcttgcagtcactggcatcagaaaggccaccaggaaatcaggcacttgtgggactgctttctgggtatgctttaggggtacttaggaggcaagagtttggggaggggaacagtcttatgtggctgtccctggtgctggcatgccttgaggaatgcaggcagagttgtagtccatataatacagtacacagggtatagtttatagctgttcggtgtgctttaaggagaattgttgtaaaagttgaattattttttaatatttattacaaacatatgaaacttcattctaccaggtactcactcctttaaaccaagcagttgtgagaaagaagcaagtgttgctcagagtgtgaggccagtcttgtggatagggtgaattccgggacagccaggacaacacagaaactctgtttcaaaataaataaaagcaaaaccaatcaaccaacttaccaaccgagcaaacaaaaaacaaattgaaatttcattctacctcacatttaatatgtttttaaggtaattttttttctcatagacgatcagacctaatgtatgaagtcacatagtagacagaactggactctgggaccttagaagaagacgtcttctcaggaactgtgagcagtagaatccaaatcgactgtgccttggaa

SEQ ID NO: 4398 - DNA, 1000 bp, mus musculus
atgctccaggcctctactatgcttggtaaatagttggtaaactattgatttttaaaaatttttttatctataattttctgaatttaaacattcatgagtaaatggatatgtgtttaaggaatttttaaaaggaagtaaaaattagcataatgaaaaactcaagagatacagtataattatttaagctaatttaaaatttttttctaaatggtatcagtggatctaggtgttgcaaaaggtaaagtaattttcaataggtagaagctgtatttattaattctccctctctcctttgattaaagagtttctgttctgtgtcaagaagtgctgtgagccaggtggtggtggtggtgcttgccttaatcctagcacttgggaggcagaggtaggcgaatttctgagttcgatgccagcctggtctacaaagtgagttccaggacagccagggctacacagagaaaccctgtcttgaaaaaacaaaacaggcgaagggcaggctgcacgggtgagggtgtggaatacagaggccagccgtttctgggacaggcgagagccagagagcttctgaggcagcgccatcttcggctccagacaaccggccaccttcctggtgagagcacaggggtccgcccggcccgagaggtttctgcctcagactccagtgggagccaccttggttccaggactcctcggagggcaggctacatgggtgagggtgtgaaatacataggccagcagtttctgggataggggagagccacagagcttctaaggctgcgccatcttctgctccagacaaccggccaccttcctggccaaagcaacacagcttctgggaaagatcctgttttgggccttcatcttcagccagaaggaggtccaaacaccggataattgtgcaccttccctgaaagaggagagcttgcctgcagagactgctctgaccactgaaactcagaggagagagcttgtctctcacctctactgctagagggtaaca

SEQ ID NO: 4399 - DNA, 1000 bp, mus musculus
gctgacccagcagctaagagctgagatcgtactcataaattgtaggcagagagggaaagagaccagttctggtatagacttttgaaaacccacggtccatccccgttgacatccccattctctatgaaggccatacctcaggaatctttccatacaattccaccaactgggaaccaaggtttcaaatgtatgaacctgtgatgtcattctcattcagaccatacaagcaaatacgtttgagtgtctgttgacatacaacatttagggatttaataccagttgggtctttgtcaaggttactattgctatgacaaacaccatgatcaaagcaacttggaaaggaaaaggtttattcagcttacacttccacattgctgttcatcaccaaaggaagtcagaacaggaactcatatggggcaggaaacaggagctgatgcagaggccatgcagggatgttccttactggcttgcttcccctggcttgctcagcttgctttcttattgaacccaggaccaccagcccagggatggcaccacccacacctccaccattggtcacttattgagaaaatgccttacagctatatctcatggagacatttcctcaaaggaagctcctttctctgtgataactccagcttgtgtcaagttgacacacaaaaccagccagtgcaagttgtagttagagtgactggaaatgattattaaggtacataacttgtgggcttctgaggaggcatagtgaataggaacatttgctatgcaagttcgagggcctaacttcagatccacagcatccacatgaaaaactcggtacaaggcacatctgttacaccgttactgagacgagggtgtggaggcgcagacaggggaatcactagattcaggggcatgctggcctatctgaaaaacagccagcttcatgttcaataagagacttgtctcaagggaatatgcaaagaaatgatacaatgcattgtctactatcttcatttagcct

SEQ ID NO: 4400 - DNA, 1000 bp, mus musculus
agtgtatggctatggctatgaaatggcaggggtaggtttcagtatctggttcatatatacaccagagaaaatggaaatgtacctggttggggcagatgcctaggaccactcccatgtccagggatcacgcataactggccctgcctctcactggatgcatgttctggagagctggttccactgctcacagcttgcagtacttgggtgagtaatccctgttcctttcccaggcagcacagtggaactggctctgatattgagggtgagggtgcatcttctcgaagggtatgcatgtgggagagctaaacccaccactcatctgctgtgagatggcacagggacaaaggagatgtgctccctgaccccttgccacagtcagcagtcagggaagctgtgcattgggtcatgagctccggactgctatctctgcttttcactagctgcagcatctgcaagaggcagctctggggtcatgagagtttggtgagctggtcctgtcccttgttggctgaagcacttgaaaagagcaagacctgtaccttgcctgggcagcacagtagagctgtagggaacacaggtgtgccgtctctgaaggctcaagcatgagagagtcatgaagtggcatggttgtgggagttatgacgtccccttcaccaccgatggtagtatggagagctggccccaaggacatgagaaggggagaactaaccctgccctctcacgggttacagcactgatggaaacacctcacttgggcaaaagagtggagtgattccaatagtgaagaaggcactggtgagccatccccaaggaagtaagagcaggagagctagtccagtccctcatccctgcaaccctgagagtagacactgctccttgcctgggtagcacagtgaggctgactctgaaggcattgtgtgtaggtgagctggccctgtgggcaggagagctgaccttgttcctgctgatggtgacactgggtggcctagccagaactgtg

SEQ ID NO: 4401 - DNA, 1400 bp, mus musculus
gtacaccctgcatccttaacatgattaatccataaaggtccatagaaccaatattaaatcacaagcattaaaataaaataaaaataaatcacaagcgttgactataatacagaggaaacaatagataattttagatatatggctatgactgcttagatatgatatcatctgtactgactgatttgtcaaataattgataaaatgagggtaattaaattaaatgtggtagcctataaggataatcaagagaataagatcagccatatattgagaaacatatttgctaaacacatctgataaaggattattttaaaagaaatagacaagccttctggtcagaacctgtgccctgaatggaccttgggtctcagcacccagttctacaacaccaagaggaaggttgagtcccaagtgctctatcacacccagaatcacaggtgatgaggccacaacattggcaccaacaccatgagtagctgggaccaccaggatccagggattcagcaacccccacccggccagtggcatgggttacttccagtttgaacctgcacccagagcagacctggggcagtggctatgtacacactcttagaacacccagagggatgctgactcctaggtgctctgaaacacccaggatcacaggatcacagaagaagttcaactcccaggacattggacacacccaggtgcactggagctctgacagactcaaaatcacacatgaggccatcttttccaacacccagaataactgggactgccacaggaaccagagaaacacaaacccccacccagctagaggcacaggttccttccagcttgctactgtacccagaacaaacagaggactctggttcctcgcccatacctgcaaaactcagagaaagcttgacttccaggagctctgatacaacagaatatctggagcttggtcacaccaggatttcaggatcctagaggaagcttgtctcccaaaagctctgaaacaccaaggatctaaggatcagtggattccagaatcacaggatcactgagacagctgtattccaaggagtttgacacaaccaggatcacaggagtgacaggcacaggtcacaggcaacaagtgcaaatagcactagaaataaccagaaggtgagaggcaatcacaagaatataatgaacagataccaaggctactaggcatcatcagaacccagttctcccactacagcaagtgctgaataccccagaacactggaaacgcatgattcagatttaaaatcacatctcataatgatgatagaatattttaagaaggatataaataactcccttaaagaaatacaggagaatagagttaaacaggtagatgcccttaaagaggaaacacaaaaattccttaaggaattaca

SEQ ID NO: 4402 - DNA, 1200 bp, mus musculus
gtacattgcaattggttcagtggaaaagagaatactgacaaaagatatattggtggttttggatgatagccattacagtaatctagacacaaacgttaaaaacgaagccatcaggagaaaaaccataatcctgatataagctcgaagtcatggaggttttgtctttatcaataaatacactctaagaatttctgagcaaaatcagccatgatctatttgggattttaaagaattgttgaaaccgttataaagagtcaagccatgctcacatgatgctaacgctcatacttgaacccatggctaggtctatttttattttagaccagaatgttaagaggaagggctggcagatgctctcatattagcaaggagcacctgagacgtgcactgggcattgacgcaagcttaatggctggcatcagagctggtaacaggtggtagagtacacagtcgactcacaaaggcagagctgtttgcacttcctgtgtaatctcgggcttttatgagtagatataattcccatgattataaggattttttgttgttgtttttctaaacaggctttctaaagcatcaaaatatttatttattcataatgattcacaaagtacaggtttttaatctatggtatcagaaattatgatagctgcatttacatactctttgatacgatatggattccttcacgggcaacattttcttttgttccccgactcttagagtcaatctgacattttcaaagaatgggcccattcttgtggttcaatcttataatgtcagctaacattaaatgctgggctaagagggtgacaatttaaaacgtccctgggctacaatgagctgaaaacctggaaggttaccttcgcaagattcatcctcaacatttcaagtggaggatggatgtactggagttattaacgttattgcctgcctaccatgtaaaaagccctgggtataatccccaggacctctcacaaaaaggactgtattaagagcctctgtcacatcgcttctctaccttttggctaaagtcaactgaagaacttctgtcactacctagatatgtctctgttgtgtgtttcctgatttagaagcatcccatctaccaaaatactattgatagtgatgatcattgttataaacacttgctggttttcttgcagcaagtaatattttggactggtcattgaaatgatcata

SEQ ID NO: 4403 - DNA, 1200 bp, mus musculus
ttaaatctacttctaacatacactgagcatgtggtgttttagcacaattctccagcactcagattatcactccataaacaaatatgtttatctcctgtttattgaggtgatgtcttggttagggtttctgttgatctcatgaaacaccataatcaaaagccacatggagagggtgagtttattttgcttaaactttcataccaccgttcaagatcacaggcaatcaggctaggaagctgaacgcaggagctgatgatgcagaggctacagaggagtgctgcttactatcttgctccccacagcttgccagcctgctttcttagagaacacaggaacaccctccctgttgacaggtgtcttcatccacaatgggctgggtgggttttctcacttcaggctcccagcttgtgttgagctgacataaaaaccgccagtatagatgaagagaaaagattagcatgtgcaccatcagtacagaatgcttcatcaatgcaagaattcatagacattgatccttccatccttctatagatattctgaagctatgagtgcttcttattggtacagggaacacagatgcatccagtatttcatgaagggagaagcttgagtattttggaaagtgagggttattgaaagagctaagatgcagtctagctactcaggttgtaacaatttctctgactttttttaaaattctaactgaagctatctagagcagcaattataggaaatggattactattaggcaaggctattattgttaatgtctgctgagactggagctcttctctaccttaaagacaagaagataagcagcaatgggccttcatgtatggcactcacgttcacatgtacagggtgatgaaatactttttaaataattataagagatggatggatggataatgtgcttgatgtaaaagtgtgaggacctgggtttggatcctaagcacccacataaaatctggtttcagcagcacacctctaactatagcagagacagtggatcacagaagctcactcactgggcagtaaccccaggacagagacaagtggatccaagttgttcagtaaagagccaatctagctaaatcagtgagctctgggttcagtaaaaacaaaacaaaacaaaacaaaacaaaacaaaaccccctattttcaaaaagaagaagaagaaggagaaaagggaggaggaga

SEQ ID NO: 4404 - DNA, 1000 bp, mus musculus
ctgactgttacgttcagccagggcgcccagtggtgtgctcagaggatccctgggtcctgaggggatgtgaccttgactgacaaaggtggccacatgatgtgaggagtctatgggtgctgaggtgaggacaggaccctagttcaacgccatcacagcagtcctaagaaggacacaggagggtaggactccgagatatgaacacagatgcaggagctggagtgatggaaggccaagagtcaggaaatgtgcatggctcgtggaaactggaggaggccgcaaatcaggctctcccctagagcatccagagggaaaggacttgctggcacaatgccagcagtttcattatagaagctctttcaacatatagaaatcatgtttaactcttgtgttgaattgctctccagaaaggtaaaaatcctaacggtaaagcactatccaatatcttcaagtcaccatttgtggcaacctgccgtgccaatagtcgtaaacacgcactgatcactcaccatgtatggtggtctgcctaggagcggctcctgtaggctcctgtatttgaatgcttggtcattagggcatgttgttgcttgactggattaggaggtgtggtcttgttagaggaagtgtgtcacgtgttcaagcctggtccagcatctctgttcctgctgtggatctatgcagacgtggatacagcaccatatctgcctgtgtgacaccatgcttcgtgccatggtgacaagggactaagcctctgaacctgtaagtgttccagttaagtggtgtactttatgggagttgcagtggtcacggtgtcccttctcagcaacagaacacagtcggctaagacaccccagttgaacttttccccttggccggggctgtacgaggactgtgcttttaataactgactcactcagaattcaatgaaaaaacgagatattgttttcattatacaaatgagtgaaagtaagttcaaagaggtgaaatgagtgtaatttatgta

SEQ ID NO: 4405 - DNA, 1000 bp, mus musculus
tcccctccgagccatcttctctgccacaaaaacagtcttaggtaccactcattcataccatacttgaccttgcgagtaacagctcggtgacttgatcgtaagaagatatctgtgccatggcacgtgtgaggccctgagtcccactgctagcacatcacattgggggtgggtggagtgtgtgtggactgtttggttggtagcctacagagagcagaaaagattggaggcagaagtgccacactcaggctgggcaccaagtgagagtggtcccctatgggcctgtagccgatggccgagagactggagaaagaggggaataatcaaatgaaccggcctcatgaggtgtggcatctaaatcgacgtatcctccagagtgatctgtcacagcacagacaagatggatgacactcttctaggtacaatgactcctggctaggcaaatgacagtccaaggcagagagcgctgagcagaacccagctgagtcattagggcaaccaggacagctgtgctcatgggtgacaaggaagccattttatgggtgggtcagcctagactctctaaaacaaaattcagccaacccggtgtgagaacagaacaggagctgtggagaggtcctctcctctggaggtcctccgctctggctcattttctgtcgaaacaggccaccagcacagtgacagtcaatgatgtgaaaccaaaggccatgagaatggggacacacaggttcttctcctcctctgcccataatctcctaaaactgcctgtcttctacttagtaggcctcccctatctattggacactcgtgtagagatttccaaagaggtctgcaggctatgaccaaactgctcatgttagaggagacaaggaccagtcatccttgctgaaggggctgcagcgcttcccaatgggtctgggggtcacctgctcagacttctggggacatcttatgccatagtagagagaaacatgaccaacctcgttcttcaagatagatagct

SEQ ID NO: 4406 - DNA, 1000 bp, mus musculus; identical to SEQ ID NO: 4405

SEQ ID NO: 4407 - DNA, 1000 bp, mus musculus
ggcagcttatgcttgactgcgagaggacagatttttttttttttttttttttttttttttttttggtttttcgagacagggtttctctgtgtagccctggctgtcctggaactcactttgtagaccaggctggcctcgaactcagaaatccacctgcctctgcctccgaagtgctggggttaaaggcgtgtgccaccactgcccggctacttaacatcttagggttttactgctgtgaacagacaccatgaccaaggcaactcttgtaaggacaacattcaattggggctggcttacaagttcagaggtccagtccattatcatcaaggtgggaacatggcagcatccaggcagccatgactctggaggagctgagagttctacatcttgttccaaaggcaaacaggagaagactggctctcatgtggttaggaggagggtctcattgcttacccccacagtgacacattactccaaaaaggccagccacacttcctaattgtgccactctctggagcaagcattttcaaaccaccacacacagtaacttcttcttgttggagaccttaactacagaagctgagtctctgaatacaatctctgtgttcttccctctttgagctttgcctgtgtgggtagcattacttactgcacttcaagcttcacttataaaagtgtacttccccacaggtccaagagtaaggtctatttacctggcttctgcaagagctctcttctgggtttcttggcgagaaggcagctgtcctgctattatgctcacaggcctccctgcatgctcagggatggatgatgtgaagagtggaagactgcagaatttctccttaccccgcccgcatgtgatgtgactacggtctcttctgtaagcactcatttagctttacctttgtaggccctgtttccagtcatgctgataggtagagcttgaattcatcaaagcacacttcacgtgccacaacataaactttataggtaacagcaa

SEQ ID NO: 4408 - DNA, 1000 bp, mus musculus
cctagataagtggctgaggcaggaggatctccagctatcctggccacacagtggcaaagatagtctgccgcaaacaaggtagaaaagtttagactgaaacctgtcctctagaccctacatttctgcataggtatgcatgtgtattcataaacacaagcacacacgtgtgtatgcttatgcacacacacttacacatcacacatctctctctctctctctctcacacacacacacaattcaaggagattggtggttgccagggtgagatggaaggaagaaaagggggtcttgttttttaatgtacttttgtactttaagttctggaaatgggcggcagtgaagcctacaagcatttgaatatgtacaaacatggttaaaatagaatatttgaagctaagaagatggtaaaatgattaaagtgttgagaatcatgcgtttggaccccctgcaccttgtaaataaatgtcaggagaacgtcgagtttcaccactatttccagtctgagaatgcagagacagggaaccacaaagcaagctggctagggagaccagttacgcaggcgagcttagggtttgatggagagaccctgcctccctggagaaaccctgcctccccgaatgatgtggtagcgtgattgactgaggatgactgctgccatcaacctctataggctcatgagcacatatgtgtgggaatatgtaccacgtccaatgtgcaccccacatgtggaaacaggcatacacatatgtacactatactcgcacatgaaaatgaataaaaggtaaatttatgttttgtatattttgctacattcagaaataatttgacaaagtcttcaatgattacattttccttttcttatcaagatagagccatcattcctagatattaaccataaaactcaccggagccctgaaatgcagtctttactcttgttatctcagatatctgaatctgtgagttttagtgatttccctccccccccaacccccaaatacat

SEQ ID NO: 4409 - DNA, 1000 bp, mus musculus
ccctgagacccttatcacaaagacaagcaatctctcgatgcttagatcttcagagttagtctttttggaacattcgatgctcttaggagtctttagagaggagccccgaatttgccttcaagggatacggggaattatgtatttcaaacaattgggaccagacaatggaggataccctgatagtaaaatctttctcgtgaagtaataagagaatgctttaatccacctgtcatttatgtggtgcttataatattgccagcatgaaaacacatataggtctggttctcattgcatggagttgaaagtctccaagttgcatgaagaagtaaacagcttgctattataacatgtcacataggctctgacagaggaattgagagcatggcaggatatgaaaagggtggagggaaagctcaggaaatgggactcaaaaatacagattttggttcaccattaggagtaagccttagtaatggcacacaagaatgactgtaatgaataatgtatttacaaaatacacaaggactttcatttatgtcgttaatgagagaaacgttttctagaagaaatgatggttaaaccaaacttcttatttaagtaggagacaagaaaaggaaatagagcaatgagcatgtttgtaggtcttggagccctagaaaaacgttaaaaagccctgactgaccagaacttagagtgttacaaaaactgaaagagatgagcccagggttgggcagagaacagacttctgttttcttgcaagccctgatgtaggagcttacacttggtcctggtgccaagaaactactaaagatgctcgggagattcagatacaatctaagttattagccacttctggctgcagggtggacgatgtgtgaggcagaggtgatgcagggagatgtggtaggggtggctaaggtatcctaccaagagcccagggtgtctttttttttttccaggaagtgcttgagttgagttagaatggccaatctggaggttg

SEQ ID NO: 4410 - DNA, 1000 bp, mus musculus
ggtattcctggatcatttacctgatggataggcaaaatgacagataagaaagaatttgcttcaaaataaggtggatctggagaactatgtccctacaagtcacctctgacctcaataggcatgtgatgtggcacacatcacactaaaaaaacaaacaaacaaacaaacaaacaaaacccacaatatgtatgtgtgtgtgtgtgtgtgtgtgtgtgtgtgtgtgtgcgcacatcacagaagaatgaagaaaaaaaaaaaaaaaaagaaaagaaacctgaggtggcttttgagttttgtgtacttggtaagtctgtctcgaggacataatgaagtggacttcccttatccctgggcatgaagggttgcataccaggattcagtagctgacaacaggccattcacaaagactttgactggcttatgcactagtccccacagaattttgttactgttctcattacacacacacacacacacacacacacacacacacacacagacacacatatacacacacactgaaaaaagagaccatgaatttgaaggagatgtacagaggtaggtacatggatgggttttaaaggagttaagaggaaaatagaaatgtagttatagttgaggggcggtgcagccaccatgaatgcccttactggtcatgtcaatcgtgagtcagtgcttagatgttctccgacctctttgctcctggcctattggatgctgtcggggagacacctttttcctacgggcactcctagcagcaggtcctgagtttggtaatggaaagagtacagtagattctgcgtaggttgagagatgactccctcctgcaacagcaattgcttctccaaatgactgaaccttgccgaacttctgtttcattaggacgctcctttttgctgggctggtttctgcccttctgacctttggtctttcggtccctgccaattctcgatccttcttcatcaataacaaatatttagtgactctccgttctgtgcag

SEQ ID NO: 4411 - DNA, 1000 bp, mus musculus
aaagagggaatctaggtgggtagagaaataatggaaccaagacaagctagtctgctcaaggttcaaatttttaatggtggacacactttataaaggagaggggaggcccattcccgccaagctggaggtgaccacgtgtaggatcatatgtagactccagaacagactctcagcaggtggcagcagcggcagtggctgaacaatagagtgatccagggaggcaggctccaccctaggtgatctccttagtggtaagcaaagtcaaggtctggctcagcctgcttcaggcttgtcgggggaggttataccggaggaagacagacttgaaaaaatgtcatatgcccaacgtcactccaccataactgcggccaagagactactgaagacaggcaatgtcaagaaaggattcgcttagagttgagacaaagggggtttttaggaatgagcagttcacctacttcccattgtcaaattcttcatctagatttgtttgagaagcagtgattgagacaaaagcccgatgcctctgggcagctgccctcacatggtgttgctgtacatgctgagtatgggctgagagccgatgcagccaaccattaccgtgtagtgtgtcaaacacaaacaaatgggggcgggggggaggtgtgtcagaaaactgagactgttctgtgacatttccaggcttctagtgctaggaggagcagagctggggttaaatccataggtgtgcacttggagctattgtgagtgcctgaaactgactctcactccactcagagtgatgtcacagtgatccggtgttatgcttttcccaggacacacttctcatcatgatctgcacatctcctctgcatgtgtgcacggccctgggtgttcaggctcatgtgtttaaatgcttcctaaagtcatcctgagcagttgttccccaggcacctctactctcctatcagtgagctagggaggaccagggtctaatgggaaagatggctggccagtgaag

SEQ ID NO: 4412 - DNA, 1000 bp, mus musculus
acgatgaagtttctatacacgagggactgtggtgtttataacgtgtgaggcattagtctaaggatttgatgactaggttatttaaactttgtaaagcaggcattaccatgattcctatgcaaacggaccccaagacatggaaactgattgtgcttcctaatgagcgaagctgggcacactcaggcagagtggcttgactgctcatgttttcatggtccctccacctcctgtgactcaattgctttcatttatttctattgctccctttactcccagtcacctatgcaccatcctcttactgtccctgccaagtctttgccttcccaccaccttgtgacaacctcctgccttcaccaatggtgacactgatcaactggtcattgtctttagagctatccacagtgcctcttgtcttggggcagggcacccagaggaagcccagctttggtcaggaactcatgaaatgacacacggctcagatgggagacagcatagttgcagttgggaggggcttggcaaagagatcacacttcgtgtacctctctgtgagcatcttctcagtgctctgtgctgggtcggttttcatctgtgacacactgacttctaagtatgtttattgtatgtataatagtaggcttacatcattactaccactggccactggaagaccctagagtgaattaaaaattcactagagtctccccctccctcccctgcacttggtggatgagagtttttgggtgcaggaatcaatgtgaaaagacaatcttcctagtgggccatgagtcactcagagattgccagttatggtgctggcctgattgctcgttccacggagtgctactgttccattccacaaagtacttcctgaagatttcctggagacctgggagcctgcacaagtgcagtggggttacaaaaagccaccatagggggctccctgcctcctatggtcagtatcaatagcattatcaacagagacttaaaaatcaatgacaca

SEQ ID NO: 4413 - DNA, 1000 bp, mus musculus
tatggaaggaaaagagagagctgacctggcaagaatgcatgcaaagcatgctctttactgtgggcatgacttgctggatcaagatcctgatgccttgacctccatccaatgatgaaccaacggccaatatcaaattaaatggagacatacttgaagcgatcccactgaaattagggacaagacaaggatatccactccccccatatctattcaatatagtactcaaagtgctagctagaacagaaagacaacaaaaagagatcaaggggatacaaattggcaaagaagaattaaaggtatcacaatttgcagataatatgagagtatacataagacaccccaataattctaccaaagaacttctccagctgataaataacttcagcaaagtaaccagatataaattaattcaagtaaatcagtagccttcctttatgcaaatgacaaacaggctgagaaagaaattagggaaatgcctttcactgctgcgtcctcagccatgagtagactcaggctacagaagaggcttgcctctagtgtcctctgctgtgggaaaaagaaggtctagttggatcccaatgagaccaatgaaatcaccaatgccaactcccgtcagcagatcaggaagctgatcaaagatgggctgatcatctgaaagcctgtgactgtccattcccgggctcattgccagaaaaaaacatcctggcccaatggaagggcaggcatatgggcataggggagaggaagggtactgccaatgctcggatgcccgagaaggtgacctggatgagaaggatgaggatcctgcgccggcttctcatgagatacagggaatctaagaagattgaccgccatatgtatcacagtctgtacctgaaggtcaaagggaaggtattcaaagcaagcggatcctcatggagcacatccacaaactgaaggcagacaaggcccacaagaagctcctggctgaccaggctgaggcttgcaggtctaagaccaa

SEQ ID NO: 4414 - DNA, 1200 bp, mus musculus
ccccatttgttgactctctgcgcccctgtccacatggtacaaatgaccctgcctcaggaataagccagcccagctaacggaggcagccttggtgctgcttgcaagcctgagccttggctttattttcacgtatcctaaagaacaaagcatttcttagacttgttgctgggtgttgggaatgctccaccatttatgtagcggtggtaagataccttcaccaggccaggcgtgatcatgcatctctgtgagctcaggcttaggaggagaggcaggcagaattctatgaggtttacattagtactcaggagaagtatttttcactcttataagttcttctgtcatttcatgtatatttatttatttatttattgtgtgtgagtgttggtgggggtgggggggcacatactacagcagccatatggaggtcagagaacatttgggagtaattctctccttataccctgtggatcccaggaactgaactcactgcccacaccccacctcaaaacagggtctcactgtatagcccaggctggcctcaaactcacagagatagcctacctctgtctccagagtgctgagattaaagataggtaccacaatgcccagcgtcttgtacatgtacttatttataattttttatgagacagagtttcatgtacctaggctggcctcaggctcactatgtggttgagtatgttgcattcttttaaatcctttccatttgttttctctctgtgtatgtgttcaggtgcacgtcttacctgtttttatttaagtgtactccatgcatgcatgcctagtgtccacagagtcagaagacagcattagatcctttgacactggagttacagatggttgttagccaccatgtaggtgctgggagctgagctcctatcttgtgcaagggctcttaactgctgagccatctctccagcctgtcttgaactcaactcttctcttctcttctcttctcttctcttctcttctcttctcttctcttttcttctcttctcttctcttctcttctctctttctccctctctccctctctccctctctccctctctccctctctccctctctccctctctccctctctccctctctccctctctccctctctccctctctctttgagacagggtttctctgtatagccctggctgtcctggaactcactttgtagaccaggctggc

SEQ ID NO: 4415 - DNA, 1200 bp, mus musculus
gggcagagtattctctgctggcaagctctcttcttgcagggaaggtacccagatatctggtgttcgaactggactcctggcagaagttgtgttccactcactagaggtcttaggatcccttgtggaatcctgtgtgggcccttgtgggtgtcaggcgactccgttggcaaggtaccccggggcttgtgtggaatggaagggacttgtgccctaggtcaggcccgggtagtctgcttccctatgtactgcagtctcaggttcctcacgattggattggggcaggtgctgtgttctactcaccagaggtcttaggatcccataggcaatcctgtgtgggcccttgcgggtgtcgggtgactctgctggcaaggtaccccggggctcgagtggagcagaaggggcttgtgccccaggtcaggcccaggtattctgcttccctattactgcagtctcgggtttctcgcgattggattggggcaggcgctgtgttccactcaccagaggccttaggatcccgtggggaatcctgtgtgggcccttgcgggtgtcgtgcgactccgttggcaaggtacccaggggctcgagtcattcccaattttctaaggaaccattatcctgattccatagtgctgtacaagtttgcaccccaccagtaatggaagagtgttctccttgcttcataccctcactagcatgagctgtcctgtcacttgtgttattgatcttagccattctgacaggtgtaagatggaatctcaaagtagttttgatttgcatttccttgatggataagggtattaaacatttcacagtcatttgattttctctattgagaattctgtttagatctgtaccccatttttaactggattgtttagtttgctgatatcttagtttcttgagttctttatatattttggatattagccctctgttggatgtaaagctggctgccattttctcctgttgacctgtcctttgcctcacatcagcttttcagtttcatgaggtcatttgccaattgttgatcttagcacctgtgatatcagttttctgtttaggaggttgtctcctgtgccagtgagttcaaggtgagtttccactttctcttcttacaggttcagttgatctggttttatgttgaagtctttgattcactgaatgttgctcagggtgatagatatggatctttttgcattc

SEQ ID NO: 4416 - DNA, 1000 bp, mus musculus
agatcctaagaagttaaacaagaaggcgggcccaagtgaagatgcttaaatctcacttagaagggggaacaaaataatcatgggaggtagagggaggggtctgggtaggctaggggagatggagggaaaatggggtcaggaccaggtagagggggaggcaggagagaggcccagaggtctaggggaatgaatggaaatatgcaactgcttgctgggggtagggtgtgaagtgtaagagaacctataggaagtcccagagacttggaatgggggaagcttccaggacttgatatggccaaccttagccaaaatgcccaacagtgggataaggaacctgaagagaccacctacagtagccagacaggacctctaatgaaaggatggggacaccaacctacttacctacaaaacttttgtcccaaaattgttcctgtctaaaagaaatgcagggataaaaatggatcagagactgaaggaatgtcttccttgcaatctgcccaacttgggatccatcccatgggtgggctccaatccctgacactatttctgatgttatgttgtgcatgcagacagaaatctagcatggttatcctctgagaggatcttctagcagctgactgagacaggtgcagatactcacaggcaagcattggactgaggtccaggactcctatggaagaattaggggaaggattgaaggaactgaaggggatgacacctgtaggaagaccgacagtgtcaacaaacctagacccctgggagatcccagagactgagacaccagccaaacagcattcatggactggtccgaggcctcgggcacatatgtagcagagggctaccctatctggtttcagtgggagaggatgtgtctaataatgtagagaccttatgctccagggtagggaatgtgcaagtgggcagtggtggtgggagacactctctcagaggtgaaggaggtagggaatgggggaagaaccctgggaagggggactgaggg

SEQ ID NO: 4417 - DNA, 1000 bp, mus musculus
tcataccctatctatggtcttaaaatttctacatgttcaatgcatgtagtttgcaatgtgtggggagcgggtgtggcggcagtcctaaaggcgccagagactgcagctaagtcatatgacttgcacctgacttcctcatataagccacaaacatcttgagtgctgcgcaggtgtaccaggatacaggtgaatccaatttggtggagatttgcccctgctgccctgattagctgaagctgcgtgcctggtgaggtggcgtggcctgctgtgcgtggatgggaactgagagtataaaagagtgagaggcccagggttcgggggagatataaacaggggagatataaacaggggagatatatggagaaagaagaaacaggactgaataaacgtgtgcagaaggatcctgtagcagcgtcgttcttcctggctagttgagcgcgcgtaacagttggtgccgaaacccgggacctgggacccaggacaagggaaaagaaacatcttcaggcaagagcgaagaccccctgctacagggaggattcagaactgcataacggggaagaaggggttaataaaggttcccgtgaaacagactgttgagaaggatccggcgtggattcagaactcttcagctggggaacggtactgatgaagagaaagaagaaagatgaagactgaataaactgctgttagaagtactggtggtcgcgtcgttcttgctggtcgagagcgggcgcgacaattggtggcctgtaaggggaaccgactcctccaccagttcagaactttcagcagtcagtggttgccggcagggtaagttcacggtgagtgaaacttgcgaccccaggagtttgggaaggacctcggataaagtagaggtgagcataaagttgccaagaagtaggcacaaagtaacccaggagtttaggaaggacctggataaaatagaggcaagcataaagttgccaggaagcaggcacaaggtaacgaaaggttcccagtt

SEQ ID NO: 4418 - DNA, 1000 bp, mus musculus
tggcttccggtttcagagggttagtctgttagcgtcagagcaggaagcagggcagcaagtaggtaggtatggtacagaagcatctgagagttttacatctcaatctgaaggcagtaggagactgtgtgcttcattggcatagcgtaagcatagaagacctcaaagcccactctggtggtggcacacttcctccaacaaagccacgcctactcccacaaggctgtacctctcaatagtgccaccccttatgggccaactattcagacacatgatttggacgggggcatacttatgtaaaccaccgcattctactccctagcctcataggcttgtagccataatataatatactgaaaaattcacttaatccaacttcaaatgtcctcatagattatcacagttttaacaatgtttaaaagtccacagttcaaagtcttttcggagattaagtgcaataccctatgaaatcaaaataaaaaaagcagatcatatacttccaacataccatgccacaggatattcactgtctttccaaaatgtaggaaagggggcattgtgaggaaacactggaccaaagcaaggccaaaaaaccagcttggcaaactccaaactttacatctccatgtctgttgtcaaaatgctcttcagatctccctccaactcttttaacttttattgacacttctttccctttggcttgttccacaccctgtttgcagctttcctcagcagctgccccatggttctagcctctctcaccttctgggatctccaaggcaatgcaggcttctgcttcaaggcttcacaaaatggcctttcacagtttcacacaatagcctctcttgacctcagtgccaggacacccttgccacatatctgggcttggtgaattttcttagttgagtaggaagattctataaccctccctttgtttttttgtttgcttgttttgttttgtttttaaccttgactctaaagccagaaccatagggctaaattt

SEQ ID NO: 4419 - DNA, 1000 bp, mus musculus
cctcccaccctggcatatcaagtctctcaagggctaggtgtatcctgtcccactgaacccaaatgagacagcccagttagaggaacaggatccacaggcaggaaaaatatgtagggagagacacaatccacttattgagggacctgcatgaaggccaagctccatatgtgcttcatatgtactgggttctaagtctgacccatgtgtactctatggttggtggttcagactctaagagcctccatagtaccacattagttgactctgttgttcttactatggggttcccatgccctctgatgtgaatggtttggtgacctcatccttacactggggagtcatgcctggctacagaaagtggtgcatatcctagtgctaggagtctcagctaatgtcacccacttagactcctgggagcctccctgattccagaactctggcatgccctagagatgccccaccaccaaccatcactagctacagatttccattcatttttctgatacactggccctcttgtctgtccacatacctgacactgaatccctatgaaatcccctccacttaccctctctcacccagttctctccctccctctgactcctatgactgttttattcccatttctttttctttgtttttaggtatttatttcatttgcatatccaatgctatcccaaaagtctcccacacgctcccccacccactcctccacccaccgactcccccacccacccactcccacttcttggccctggcgttcccctgtactggggcagataaagtttccatgaccaatgggcctctttccactgatggccgactaggccatcttctgatacgtatgcagcttaagacaggagctctggggagtactggttagttcatattgttgttccacctatagggttgcagatccctttagctccttggtttactaaaatttataaataattctatgatattacaaaaatgacagcttattgttttacaatcaaat

SEQ ID NO: 4420 - DNA, 1200 bp, mus musculus
ttctttttaatttccactatgagtatccttcagtcattgatatctaacaccatgaatactattcaggaagaaatattcataaaatagaagtaacaataagaaaacaatttcatgtgtaggtctcttcaaaatttcagtttatgggttagccagaagtttttcagaaagatgaaaaatgaaatctaaacaaccaataagtcatcctttaactttatgttaatattaacgtaaatttgctaatccaagatcttataaagttttaaagacttgactctgtagcatgagtgtgtcatcctgtataaatgaagacaacaatttggtataattggagggaggagggaggaagggacgtggaagggaaaagggtcagagaggggaagaggggatcatgatctggtgttgggtcggagtaaaggactgaagccctgagggccagcagaaagaagggatataagcaacctcaggagaacctccagtatgtaccagagacttgggagcagagagactctcaggactaaaagggaaggaccttagatgaaatgccctacagtgggaagacagaacttctatagcccacctccagcataaagacagggcatcaagtgagggatggggttgccatcccaccgacaaaactcttacccacaattgttcctgcctgaaagaactgcagggatggaaatggagaggagcccgaggaaaagatgttccagtgacaggcccaaagtgggatctagctcaagggaaggcttggaggtctgacactattactgaggctatggagtgctcacaaaaaggaacctatcataactgccctcaaaaagacccaacaagcagctttaaaatgtcagatgtagatatttgcacccaaaccatggacaaagctgctgacccatgtggttgaattagggaaaagctggaagaagctgaggaggaaaccctgtaggagggccagccatctcaattaacctgaactcccaagatctctcagacactggatcgattaccaactaggctacatgcaccagctgatatgaggcccccaacacatatatagcagaagactgccaggtctggacacagtcagaaaagatgcacctaaccctcaagagactgtagtcccggaagagtttagaggtctgatggagtaagattctcaggggtggggacatcctcatggagacaggggattgggaagag

SEQ ID NO: 4421 - DNA, 1000 bp, mus musculus
ctgttccagaggctgtcaggttctctggcgcaccctctcacctgttcagactaatttcctaagttcggcgggtcccggaccaagatggcgactcacaaacatcattcttttgattatgctataaaacaagcaatttaaaacattcaatatgtattttcagcagtttccttctttttaatcttgcattgccaccaaagaatgctaatggttaccaaattgctcttggctgaattgcttaatccttaagaaaaaggagaagaaaaaaaaaaaaaaaacagaaaaggaatagtgggggaaagacatgttgcaggatgtgattgtagcacatgatagctgtgaacgctgaccctgagcatatggtgactgatctgagaacttaagctaagaagtcacagaagcatccctctgctttgggttatggacattacagtataatgagcgatttctctcatggcgcctaatagacaacttattaagagggcagtgtgagttacagatcatatcctaacttatccttgagttctttagacttttcctctggatgtcccagtttatttcaatcagagttggtcatctcagcaaccaagcattttgtctcaagaagtaggcttttcactatgctctgtaaacaagtgtcagatatcttgccccatgcactgtgaagggtgcaagtccgtagagcatggctttgtttcctgtcactggcaatgattagccttccccacctacaccaagctgctcatgataaagaaaatgcatgtgtgataacacattccttagtgacagtagttcattccagttgattttagcagtggtgccccagcaccttccctggccaccaagactaagatgaattcataataggagaaaaggtggtgtgatgtatggtggatggctttttttcttctcctttatagaaaacatatggcagtgtctatatagaagcagaaaacaatagcatactgctatcaagttagcaatagctaatggaaccatacat

SEQ ID NO: 4422 - DNA, 1200 bp, mus musculus
taatcagaacaacaaatgcactaaataaagatagaatattaaaagcagtaagggagaaaggtcaagtaacatataaaggaaggcctatcagaattacaccagacttttcaccagagactatgaaagccagaagagcctagacagacattatacagacactaagagatcacaaatgccagcccaggctactatacccaaccaaactctcaattaccatagatggagaaaccaaagtattccatgaaaaaaccaaattcacacattatctttccaagaatccatcccttcaaaggataataacagaaaaaaaaaaaaaaaaccatacaaggacagaaatcacgccctagaaaaagcaagaaagtaatccctaaatgaaccaaaaagaagactgccacaataaaagaatgccaactctaacaacaaaaataaaaggaagcaacaattacttttccttaatatctcttaatatcaatggactcaattccccaataaaaagacatagactactcgagccccaggctaccttgccagcggagtagtccgacacccacaagggcccacacaggattgcccacgggatcctaagacctctggtgagtggaacacagtgctggccccaatccaatcgtgcggaacctgagactgcggtacatagggaagcagactacccgggcctgacctggggcacaagccccttccgctccactcaagccgcgggctaccttgccagcggagtcgcccaacacccccaagggcccacacaggattccacaagggatcctaagacctctagtgagtggaacacaacttctgccaggagtccggttcgaacaccagatatctgggcaccttccctgcaagaagagagctttcctgcagagaatactctgcccacttaaactaaggagagtgctaccctcccaggtctgcttatagaggctaacagagtcacctgaagaacaagctcttaacagagacaactataacagctagcttcagagattaccagatggcgaaaggcaaacataagaatcctactaacagaaatcaagaccactcaccatcatcagaacgcagcactcccaccccacctagtcctgggcaccccaacacaaccgaaaatctagacccagatttaaaaacatatctcatgatgatgatagaggacatcaagaaggactttcataaatcacttaaaga

SEQ ID NO: 4423 - DNA, 1000 bp, mus musculus
tgttgcttgtttgcattttgagatgaggtggtgtttgtttgcttgttttggccaagctctttgtttttagacactttctttgtgtgtaactcaagcaggccttgaacccactatgtggcttagactggcttctgaatggcgggtgatcaggcagacctcccaaatactgggaggcactgacactttcttaggtctctaacactgtgctactgtcatcctttgtaaactgcttcccacatccctgcactttgactggctagcttctcagggctaccggagaagtaaaacatgcagtacttagtaaaattaaacctccactgtcacgagtacttttatcgcaacagcctagttttattaagaaaataatttcttcctatttctactgccctttctttcttccttccatgtgtccttccttcagccattccttccctgactcttagctttcccctctttcagcaggggacctgtaagcccaggcatttatttctctttcctgtgccagtgctaccttagcctaatgaggagtgccgtgcagtgaccacccatgctcagctctgctgtaatacagaaaataattcttgaaaatcagtttatggtcgagactgttggtccctgtagttgtaaataagatgttaatgttcttgtgagacttgaaagcctttgggtaaatgctcacctgattttttactctcgtttttattgtttaaaaggaataaaaaacagtatatacagataatgctccagtgcacacaggaactcatccagaatattgagtttaggtaaaaagaaggttgagaaattaaagacaagctaaactgtaggatagaagattaaaaacggaatcttgaaagtattctcgaagctgctaaatgcagtcagcaatatattaataacagcaccatgctcccttatcttatttgtaccattaaattcacatatattaataacagcaccatgctcccttatcttatttgtaccattaaattcacattagttt

SEQ ID NO: 4424 - DNA, 1000 bp, mus musculus
gcatctaagaatggcccattcatctatagtagcacacaatatttgcatttgtgcgacagtataagggacaattatgctatcaggcatttttccaaagtgagtaatcgaagtttttatacctttgtgtgccatgtttgctaccatggtgggataatcttacacgcgttctcgcgaccggccaggaaagacgcaacaaaccggaatcttctgcggcaaaagctttattgcttacatcttcaggagcaagagagcaagagagcaagagcaagaagaagaacaagagcaagaaagcaagagcaagagaaagaacaagaacaagaaagcaagaaaaagaatggcaaaaccccatcccttttaaggagaattatcctccgcctaggacgtattactccctgattggctgcagcccatcggcccagttgtcatcacgagaaaggcagaacacatggtgggaaaactgcccctgcacgtgtgcagattatgtttaccacttagaacacagctgtcagcgccatcttgtaatggcaaatgtgagggcggcttcctacatatcccccttttcttttaataagagcaataggccacccatattaatgagagtggagatagaggtcaaatccccagtgtgcaggtaaaggagccatgtacaggattagctcttagactcacaggcttttacccagagcaaccctgacctgctcccgtgtcgtttttcctggggagaaggacacttggacactcaaccttctggaaagatgacatgcctccctagaataggctcatatatgccgcagagcccttctactgcagtgcttagccgtgcaactctcttgggctgctgaagcacactcactctatcccgtgcaatgagactagcctcgtggggtgcaagagctgagtggccagcgacctattgcttaagcatagatatatcaggggaagcaccatgttctagagctgcaagtgcctgggcaataaccaccttgtctctcctagtttg

SEQ ID NO: 4425 - DNA, 1000 bp, mus musculus
tgcactgttgtcttcagacactccagaagagagcatcagatttttgttatggatggttgtgagctaccatgtggttgcagggatttgaactcaggacctttggaagagcagtcggtgctcttaaccgctgagccatctcaccagcccgttgttgttgttttttaacttgttattttatgagtgttttgcctacgtgtatgtatgtgcaccacctttgtagctggtgcccacagaagccacaaaagagtgtcagatgccctggaactggagttactcagggttatgtcgtaggtgctgggactctgaaatcgggtcctccacaaaggcaacaactgctcttaacagcgcagatctaaatgttggttcttaaggcattctcatgccaagctccacggagagctcggaaactcaaaagtcttgcacgaggggaagccagggatggatggagagagaaaggactaccgagctgaggagagagcaggagggcaggacagactcggtggaggtaacccactctggcaggcttgcagcgctctcccagaaccccggcgcaaagctggctacgccgaggaggcggggcgggcggggatccgtcaggtgcccgcccacggagcggcatggagcatgcgcagtggggcggccccgcccacgcgtcgcctggacacggctctggggtggcgggcgcggcctcctccagggctcagcggcttcgcagcctctgcggtcctcggtgggaggtggcggccttgggaccttccccaggggctcggtccccgtgccccccgcctcccagggtctccgggctagctgtggggacttccgttttcctcgcggccgcccgccgtcccgcccaggtccttctttgggtcgcaggcgtcccctccccgccgtggcccctcacacctccacaggggacctccgggcaggactctgcggccacagccacgaggaaacctctgaggagaccccagcggacggcagagcagtgagggatggacgc

SEQ ID NO: 4426 - DNA, 1000 bp, mus musculus
aaaaattacaaggatgatagtacatttgtacaaagagacaaaacatgtccctaaggaattatacacacttgcatttcaaagtgcagtggactgtacagtactggacgttaaaagctgagaggtaaatgcgtgtaggatttgtctttctctgtgcctccctccctcccacctccctcccaccaccctcccacctccctttacaacatggctttcatgtgctgataggcttttctcttttgtttatgtacacagttgataatgagcagtacactcaaggaactactttacttcaaatcccactcagtgaaatcgcagtcttgtacctgaagtagtaaaacacattttgctagactagtgaacaatgtctgaatagaagcacagtgcatactagctcagtgcgttttctttgatgttactaaagaggacactgcagtaaaaatgttttcactgtaaagttttgtataaaatgatttttaaaaactcaacattaagaatgtgagatatttcatcataaaaaggaattcataaaagtgcacatgttaaaagtggaatagattaagggttacacaccaggctgtggcacatgcctttaatcccagcccttgggaggcaagaggcaggtggatttctgagtttgaggccagccttgtctacagagtgagtttgaggacagccagggctacacagagaaaccctgtctcaaacaaaacaaaacaaaacaaaacaaaacaacaacaaaattaagggttgcaagaagagtgaaatttgatttctttttggatagtacttccaaatcagtggcttttgttgctagagacttggaagcccaggcaggtttggcaccatttctgggtctcagccctgtgagccatcctcctgccctcctttctcctgccaagggatcatgctctcacctccatttccttccatattagccactgtaacaataacaaagttccattctcaaatgatttctgggtggagatcaggtgaggtcttg

SEQ ID NO: 4427 - DNA, 1000 bp, mus musculus
aggagaaaggagagagaaatcacagtcagaagattttgtatgaaaaaaatctgtgttcaataaaaataatatgaaaaagataatcaaagatgttcatgagaatatagtgaaattgaaacaggaggtaagaacataagcatgcccagtacaacatccacaataaataataaccccagtggaaaaacgcaaatattcttctactgataaacaaattgcagcatttcatacccatgaatttgaagatttccagcaagtaaataataatgaacagaaggctcatgaatgagactcaaaactttatcctaagtgggaaaagccaaacatatgtgccccttttctgacatggtacacatacaagtcttgaatatatttattcaatacatagtaagcaccgggtataacaagtaaattgggagacaggaagcattcaggcagcatggcctcagtatcacaaataagaatgtatgctaaaaccaagcaaattgtgctataaactttcaaatgaagggttacaacctgaacttatacttcagtattattgctaagacaaaactctgtatctttaataatagacttaaagatattgtatatttttacaacaacaataataataacaacaataataatattttactaagaaaactatgttacattatgtttcttctccttaatgaaggaagaattagggtgggagagatggctgaaatattaagagtgtgctactcttacagaggtcctgggttggagtcccagtacacagaggcaggtcacagccatctgtaactccaatctcagggcgtttgacaccttcttctgcctctgtgagcattgcatggatgtagttcacaggcattcaggcaaatagtaataaattcaaacaacaatcaataaaaattacaaggataaaagaggaaaaggaggaagaggaaaaggaagcagaagaagaagagaaagaaggaggaggaaaaggacacagaagcgaaagagaaagaaggaagag

SEQ ID NO: 4428 - DNA, 1600 bp, mus musculus
cttccaaaaaagaaagaaagaaaaagaaaagaaagaaaataggtagaagaggctgtgtggctgagtgcctggcttacacagatttgaaaacagcatgatgaaacacttccataagcttccaagaggaaaggagagaccagcaggggataaggatgggtatgaaaagttaagaatcactggtcaccttggaacttctaaacctctcccttaatgtttacataaccttggattgtttttataagagtatagcttcattagttttaagaaaaaccccaaatctcagaattgtggcttacttagacctggtggtgcttcacgtctattgtttaaatgtgtgccactttaacatacacagtgaagccaaggagttaatgccaacataacgagcactggggagaaaaccaagaagctgggtttagctatctcaaaagtatgaggcacagccttaagtggcagcttatgttagacacttccaaacactgatgagtggaaattgcagagaagcaggtcttagcccatggcaggagagactctcccagctgggcaagataccgtgagccagtgagcatgcctcacacactggaaacgcgctggccaatcctgtatggatcaccagagattagggtgagaatatgaagtttgcctcttgactctcgtgttctgttctggtgtcatgttatgtacaccctggagctatggggtgtccataagggacaggcaagagatgggtaagaatgtcttcctaagaggaatcttcaaaggctggtgtgttggatagctttgtgtcaacttgacacaaacgaaagtcatccgagaggagggaacctcaattaagaaagtccctccataagattaaactgtaattaagtatgtatggcatattaggaatattagttattgatgggggacggtccagcccactgtggctgatgctgtccctgggatggtgattctgggttctataaggaagcagacagagtaagccaagttgaccaatccagtaagcagcaccctccatggcctctgcatcagctcttgccatcagattcctgccctgtttgagcttctgtccttcctcaatgatggactgcaacatggatatggaagccaactagatccttcctttcccatgttgccgtggtcatggtgattcgtcataacagtagaaactcaaactaagacaactgggtcattacctctcgctcagcccaaccacttttgcacacgtgtcctatcaagtcatctttcctcaattgcctatgtccacagtccactgtagcattttagacttacccatcacttgggttgagtgttcacttcccagagggtgaagcagtggttttattccattttgactttctatagacctctctcaatttaataagcaatgcttgtatcatcctgccattcaaggctgatttatatagcctttttctaatttcccttattaatgctacagcttcatttagattaagctttctagaccatgatcctcacataccaaatgtttcacacatgaaagcctgagtcaccttgataacgtcagtgtggttctttgaatctttttcagtttcttgaatcagagccccaagccttctgc

SEQ ID NO: 4429 - DNA, 1200 bp, mus musculus
attgaccacctctattccacgagtccacccttctttcaaatatttattgaatgccaggcactcccgtggtgctgtggagatggcagtgtacaaaatagacaaggtctctgcctgcatggtgcttacataagcccagcggggctgatggaataggataaataaatacaaataatattgtggatggtgatgagtgctaagaatgagtaagtggaggatgtgagagagaatcacaagggaacttgctttagatagaaggaactgcagggtgtaaagtgatggcagagatacagcctctgccctcaaattgctaggagcccagggggtggctgggatgtgtattctgagagccattactcactagtgtgctgcttctcagacttctgccaaatccccactcttgcgagagagatgttaataggtattttatgaaaacaatcaaaagttctgttattaaatgtatctggaaagcaatgtagaatctcttggagatttacagcacagggcagcacagtgcactctaggtgctgggaagccttacggtaataaaaaaaatatataaatttgcttaatgctatgtttcaaaaatatttttgaccttgatttctgactcagtccagtaagtgctttagcatataatgaattttaatgctatcatggagataaaggtacataagtgtcacgagacatagcagcctaagatgaaacaatgtattttgtgaacgggaataatagttacaggaaattcagcgatttttaggctttgatcatagctatcactgcccagtggtgtgcctgacaaatatagaagtggatgctcacagccatccattggactgagtacagggtccccaatggaggagctagagaaaggacctaaggagctgaaggggttgcagccccataggaggaacaacaatatgaactgaccagtacccccagagctcccagggactaaaccaccaaccaaggagtacacatggagggacccatggctccagccacatatgtagcagaggatggcctagtcagtcatcagtgggaagagacacccttggtcctgtgaaggttcaatgctccagtgtaggggaatgccagggccaggaagcaggagtgggtgggttggtgtaaagggagaggggggaggggacatgggtttttctgaggagaaaccaggaaaaggaataaactttgaaatgtaaa

SEQ ID NO: 4430 - DNA, 1200 bp, mus musculus
ctatcttacctcattagtcacttatttatctacagcgaggctccagaaatggaaataattcattcattattactgaatataaattattcaatatgattggaagtgataatgtttggaagtacaaaggtagttcctgtgttttgaagcaggcagtgatttctgaacagatctggccaatagggtgatatttaatgaatccttgttggatcaataaactccagaatctcccaaatctatcatgtaattttaagattctagttacactgtgcactcactgctactatcctttacagaagcagcagttgcatcaggagctgtagaagtagccacagccattgcaaccacagctgtggtggtggtggcggcagcaggggcagcagcagcagcagcagcagcagcagcagcagcagcagcagcagcagcagatagcaacagtagcagcaaaatttcaggattagagatcatttaaatcacatggactgttcctgtcctccccagcctgctgcagaataacttcagagaaagcactgtgcatatttctttgtcttttgatcataacctcagtgatatttgcccgagtctctctgttaatagtgacatgtatcaacttcacttcacctgtgaggaacctgtctgggaattgatggatctagaggagaggctagccaattaggtaatggcctccagcaagagcggactccatagaagactcgcctttgaacttgtggagttgaactaaagggcacagctgttacataaatcagagtgaaaagagcaaggttacacctgtaggttgatgcaacggctatattttccctgcccagatagcagagcactataatgatagctaatacaatgcttagattaattaagaaatcttgactgcaattatttagataactcaagagagtagggaattattattcacaattaaagtgttaattttagaaatagagatgttgtcttaaagctctctatcaggaaacaactcatgggaaatctcttactaaaagatgtaaaagtttaatggcaaaaggagttatcaagcaggaccaggtgttataaattgaaagccagagataagatattaagtttgttaagtagacacagagaacatgtcataaacatgtctgtagacctacgtctgtgagaaattgctaactccaatttcaatctaagcatggctaagaacttagtatc

SEQ ID NO: 4431 - DNA, 1200 bp, mus musculus
aaattgaataaaaagataaaagaaagaaatcaagacatggaagatttttgtgtgtgtgttttgtttgtgggtttggcggcaaggtaataaatgaatgtttccagttaattggctaagatcgaaagtagggcaatcatacaagtaagcagtgctagaattaaaagaatagtcccaggactggtctcatcgacatttagaggtgatgagaggctagatatatagattagtgcagcaagttgtctagagtgcaggaggcctgaagcacagcgtgcaacagtgaacaacagaaggattatatggggagctagagaaaggacctgaggagctaaaggggtttgcagccccataggaggaacaacaatatgaaccaaccagtagcccccagagctcccagggactaaaccaccaaacaaagggcacacatggagggacctatggctccagctgcatatgtagcagaggatgatcttgtgggaggggaggatcttggttctgtgaaggctttatgtcctagtgtaggagaatgccaggacagggaggaaggcaggagtgggtgaatgggtgggggaacaaccttataaaagcaagggaaagaggatgggatacggggttttcagaagggaaaccaggaaaggaggtaacatttggaatgtaaataaagaaaatatctaataaaaaaagaagaaatttatttatgatataaataataaattttacgtataaactaatttgattgcttagattaaacaggctaattccttcaaatatgcaaactacaaaaagaatagttaatccaagcattcccacatatcaaaaagaaattgaatcaatataaagaaagagctagccaagatgaattcaatgaataatttcaaaatttagggaagacgtaatctgtgtgtgtgtgtgtgtgtgtgtgttcttttgtgcctatgtgtgcatgtgcatgtgtgtgtttctgaaaactgaagcagaggaattatcatctaattcactcagtgaagctaatattacattctccccaaactaagcaagcacattataaaaaaagaaatctataatttactctctttcatgaatactggtataaatattcttaagaaaatctttgaaattactttttaaaatgtacataaacatttcatttccataggtaagtggaatttatcaagggccctagaatccagggtgtgacaagta

SEQ ID NO: 4432 - DNA, 1000 bp, mus musculus
aaattaaaattcttatcagtcttccacccatacacctcacttccaaaccaacactgaaaacctttctgactcaaaattggtgttcaacactttggctcttccaaatcccttataaataaacttactagcattcctttgacagaaaattaattatgctttagaattatttttcttgtaactccctcttcagctagaagacccagtgcagatctcagctttggcagttctcaaactggggctgatctcatgatttcccttttcagccattagacctagaccctgcccctcatgaaagtgattgcctatcttcttagctctgacaatcttctttccttttttactgtgcggttgctctagacttttatgactttgcacagcacatctgattcattcttgtgaatcatttccttctttcttatggagactcttgtttttgattcacagagaaactgaaaacctcgggtgagaaccctatgatgctctcaccctataaaaaaaccttgttgctatctagtccatgtttaatgctgctgtgtttagtgttaatcaaagtccaatagtgtctgtgttcaggaatctttcgattcaaaaaaatgttctctcttttctctcttcttctctcttctctcttctctcctctctcctctcctctgtcctctcttctcttgttaatatgacctttgatttcaatctgacccaaaaaacacatagtagcaaagactagccttaaacacaggatccttcagtaagctcaggctcccagttacaggtggtataaaccttcagcgctagagtcagttacattttggattcatgagccatagtagtttggaggataaaagtgtaaggattttgaagtttcctgagtcaatggggccttctagttttgcttaattacttaaaagataagagtaccgtgccttttgtcttagtcctcaggtagcttggaccatagcttcaagaatttattctggtgcattggcactccttctacaaacca

SEQ ID NO: 4433 - DNA, 1000 bp, mus musculus
tcagtggtcagagcactctctgctggcaagctctcctcttacagggaaggtgcgcagatatcttgtgtttggactgcctcctggccgaagaagaaggcccagaacaggacctttcccagaagctgtgttgttttggcaggtcccagaatctgtcagcttctgtggagcacactctcacctgtgcagactaagtacctaagttcggcggagtcccagaaccaaggtggcaccctctgctcctgaggctgaggccttcagagccaggtggacacctgtcctctggtcgggacggtggccggctcaagttctctaattctaagtgcttcagaaggtgatgtgaactgtgaaaagtcatcacaaagaaagcctgttaagaagattagacctgtggtttagtccctgggagatctgaggagactaaaccaccaaccatgggctggcccaaggcttccactcatgtgtagcagaagactgccttattgggcatctgtgggaggggaggaatttggtcctgtgaaggcttgatgctccagagaagggcaatgctagaggggtgaggcaggagtaggtgggtgggagagcaccctcttagaggcaaagggaaagggggggtgttgggggttgtgaagaggagaccatttgaaatgtaaacaaacaaaatgattaatgaataaggaaaataagagaagattaggccatgaaggagcagggtgagctctacatacagtgggactattaagcaaaggaagaaagtcatttaaagacaggtagagattgagaacctggccatgctaagagatggcccaggaaagagtaaaagttcaagtataattagagagtaatatgacatacttatggcaaaagaattccaacaatttctgctcaacaccagaatctatggaaaggcaatgaatggaacttccagataaaatcaaggaagaggctgacactctgatgacactgtcctcatggacatataggactgaaaagcactttagcc

SEQ ID NO: 4434 - DNA, 1000 bp, mus musculus
tgggtccagcttttcaggtgtgttggggtgcccacgactgggtgaggtgggagtgctgcgttctgatgatggtgagtggtttgtttttctgttagtaagattctttcttttgcctttcgccatctggtaatctctggagttagttgttatagttatctctggttagagattgttcctgttgtgattctgttagcctctatcagcagacatgggatactagctctctcctctgagtttaagtggtcagagcactctctgcaggcaagctctcctcttacaggtaaggtgcacagatatattgtgttcatacctgcctcctggccgaagatgaaggcctgaaaccggacctgtcccagaagctgtgtagcttcagcctgtcacagaagctgttagcttctatagtccacactctcacctgtgcagactagtcttggagggatcttggaactaaggtggatcctccaggtgctctggcaaagtcctcctgggcagggcagacacctctcctctggcaaggaagatgctggatgtctggagcctgaaacgagttctgtctcagaagctgtcttctagggaccttgggggtgtccactgactctgtgcccaggtgaccaagtgctggcgcagactggaagggttttgtgagcctggtcaagcagggttttctgcttccctaatgctgtctcaggtcccatgagattggactggagcagaagttgtgttccacttactggtggtcctaagattgcatggagagtactctaggggaccttggtggtatccgctgactctgtgcccaaggtgaccaggtgctggcgctgacaggaaggctatctacattttttcttcccaactttgaatttttgttttattttgttttgtccaaagagttcactcaacattgacagtttgtgtatgagtttagggccatctactggaatatataacaaaatgcatatattgcatgtgtggtaccaaacatacacacaaaaatgaatga

SEQ ID NO: 4435 - DNA, 1800 bp, mus musculus
attcattccagtattaacatagcagatacttatttcaaaaacatctatgccaactattgtaagatttgttattttatttaaaaaaaagtaaattgaaactaatgaatttttccatgtaatatttgaaaatttaatcaaataagaccttatcaaggtctctatatatttctctaagccagtaatagacaagatgacatatgccatattagagcagaaaaacatattttttgaaatgagatctaaattgtttattccgaactactctgataatatctcagaaaatactaatagaaaatttctattaaaaattatacgtgttcttgacattctcacctttgaaaggactttcactcaaaacaaatgtaagaacatactgtgattcttttttttaatattttaaaatgaaaactaatttatgtttaaattttcaagagaaaatagcagtgaaaagagaacgcctcataagctaggtcaactaatataaaatatgacaatgaagatatttggtcttttttacatacattttaatacagtacctattagggaagatcaactcacaccaaaaaatccagttctgctttgctggcatattttgtgttgactaatcaaagtaactaggatcttttttctcacagggaaatctcccccttatattttcatataaaggggacatttacatctacctgaattagtgaaaagtgggtgaagtctgagtgttattcacctaatatttgccattatacttaggaaagatttcccaaataagagagaggatgtgagtctggtgcaaggcccaggtggaagctctcataggtacctattatctgagagaaactatctgaataacaagcaaagcattgatattgcacagctcacctgccaatattacatgccctgttaaccatcccaacacttctgcagcccacatcccattctttcatttatatttaaggctcaagcacagtgcagcttttcttaatttctcataattgtgatgtggtttatttatgctttctgcattaatatgtttatatgtttcccgttttcaatatactcacagttcatagattttagaaggaaaatgttaaatttaaaactttactctagaaaaacattttatattttattttatatacctatttatatatttagaattttatctctatataagtatctttcattacatttaatctaatgtgtaggagctggtgagtaagtcaatcatctttgaactgaaatctgtttccatagaaaatatagatgctctttacaatgtaatatattgttaattccatgaactcattaactctgttcttatttagatatatcaattaaaactgattgaaaaatattttgttttatctttataattaacttcactgatcaaaaaggaattatatgaaagagtaattccattgttgtgaagttaccccctcaaaatagaacaggttaaaggagtttattctatctcagggaaatggttttgtagtgatgaaaactgtaaggaatccaacattttctctggaacataacaacatggtatcatttcatttattgaaactctatgtgactacatgatagagactagcaaagaatgctacatatttagctccagctgtaagaacgacttccttctccagtttctctttactaaatgatcattagtgtctcacacaatgattatctttcacaaatatatatttttatgatagattcttctttcatgaaaagcatcccaacaacattctgacctctattcattttgcccatccctactctcttcttcccttgttccgctct

SEQ ID NO: 4436 - DNA, 1200 bp, mus musculus
ccattgctttaatcttgtatggtttaaaaaatttgaattccagagtttcccattatagaaacaactataaaatcacttgtacatatgaatctgttcttctggccagtctcagtcaacatatttggaaactaggcttacagaacaccaacatattttgtttaatttttttaaagtaaagtacataaatgcttctgcagggtcaacctgtcattgctggctgtatatattaggatcaaaacaaaaaagttaactctcttataagtggagggatggggttgccatcccacagttaaaaactctgacccataattgttcctgtctaaaacaactgcaaggacaaaaatggtgcatagcctgagagaaaagaggtccagagaccagcctaaattgcgatactgctcaaggggagtctccaaagcctgattctattactgatgctatgatgtgctttcagataggagcttagcatggctgctctctgagaggctcaacaagcagctgaaagagtcagatgcaaatacgtacacccaagaaatggacagaagacagggtccccagtggttgaattagggaaaggctggaagctgaggagaagggagactccttaggaaaagtagcagtctcatctaccttggatcctagagatctctcagatactgagccaccaaccaggcagcatacaccagctgatatgaggtcccttaacacatatacaacagaaaactgcctggtctggtctcagtgagagaagatgtacttaacttatgttgacatgaggccccagtacatggagaagtctgttggggtgtggaagtgaggacatcttcttggagacagggtagaaggaagggaatgaagaactgttttagggcagaccaggaagaggataaagactggactgtaaaaaaatactaaagataattttaaaaataaaataaagataaaaatggaggttaagactctatatcttgctgaggtgaaactacctcatcaatgtccattgctgctctccaaacaatgagaaggtagtggaaccagcctagatgtcaactgatttagtaacaaataatgagtcaatatgtaaaatttagtacatttacatgatggtatgtcactcaactgctaaggagataaaccatgaaatttgcagataagtagaaggaactgggaaaaaatcctcttgagttagttaaacaaaat

SEQ ID NO: 4437 - DNA, 1000 bp, mus musculus
aaattccttcttgatgtcctctaccatcatcatgagatatgcttttaaatctgggtatagcttttcgggtgtgttggggtgcccaggactgggtgaggtgggagtgctcggttctgatgatggtgagtggtcttggtttctgttagtaagattcatatgtttgcctttcaccatcttgtaatctctggaggtaattgttaaagttgtatctggttagagcttgttcctcttgtgattctgttaacccgtatcagcagacctgggagactagctctctcttgagtttcagtggtcacagcactctgcaggcaagctctgctcttgcagggaaggtgcacagatatctggagtttggacctgcctcctggcagaagatgaaggcccctaacagggcctgtcccagaagctgttagcttctgtagtccatactctcacctgagcagactagtctcagatggatccaggaaccaagatggctccctctggtgctccggcaaagtcctcccgggtggggcagacacctgtcctatggctgggaaggttcctggatgtcttgcactcaaactggggtctgcctctgaagctgtgtggcttctgcttgtcccagaagctttgtaacatctgtagtccaaactttcacctgcacagactagtcttggagatatccgggatcaagatggctcccccaggtgctctggcaaagcacccctgggcgggtcattcacctctcctctggcagggaaggtgcccggatgtctggagcctgaaacagggtctgcctcagaaactgtcctatagggaccttgggggtatctgccgactcagcgcctaaggtgacctggtcctggcgccgactggaagggaattgtgaccctggtctggctgggttttcttcttccctaatgctgactcaggtccctcgtgattggaatgggacagaagttgtgttctactcacctgtggtcctaagatcgattggagagtcctctaggaaccttgg

SEQ ID NO: 4438 - DNA, 1600 bp, mus musculus
tcatactgtaccttatgagctagctgtaagtgtaaaacctaaaataaatgaaggacaccatgaaattaaggaatcaaaataaaaagataagcatgtttgtgaacactcagagactgaggaagcatgcacaggctccacatgagtgcaactggaactgaaataaatgacatccaagagactagaaaaaaattgcctattatacatctgacagagagtatttagattatgcaaagtattcaaaatatgaacatcaattaagtaaataactcaattaaaactttgagtatagtgttaaagaattctcaaatgctgaaacaaaaaggtttgagaaacatcttaaaatgttaaacatctgtaggcatcagggaattataaattaaagttgtttagggatttcatttgattacagtcataatagctgaaatgaattttaaaaaaagatacctgatatgcaaaaattataggaaaagggtaaaacttactcattgctggtgaaagcacatattggtaaaacctctgtgatgatctttgtagaagtcttttaaaaacctgaccataacagagactgccccaccttgggatccatctcatccacagacagtaaaccctgacaccattgctgatgccaagaactgcttgcagacagaaggccagtaggactgccctctgagagtctatgccagtaggtgactaagacggatggagacacaagcaatcattggactgagcccaggaggaccccaatggaagagatatgaaagactgaaggagaacaataataccaactaacaagatcctcagagctcccagggactaaacaaccatccagaaagtatatatgggttgatccatggctcctactacttatgtatcagaggactgccgtctctggcatcaatgggaagggagttgctaggtcctgtggaggcttgttgccccagagaagagggatgctagaggggtgaggtgggagtgggtgggtgggtggtgtaaaggggaggggtaatagaatgtagagtttgtgaaaagaagaccgggaagggggacaacatttgaaatgtaaacaaatagaataaacaacaacaacaaagaacaaaacaataaaaacaacaaacaaccctgactatatatttaccacagaatctagcaattaaattcctcaaagcccatgttaagtgatgcatcttctcctacaaggccatctctccaaatcctaccctaacagttccactaaccagataccaaggatttaagtgtataaacctgaagggtccatttgaacaatacaggtagtaagtaagggatgaccttcatgtatggaccactgaggaactccccaaactagggaaatagaaaataatgacataaaggaactgtagtgattcaaatgagaatgaatccatgtttgagtacttgttctgcagtaggtggaactgtttgggaagaatctgaaggtgtgattttgttataggtggtgtgatactgggtgtgggttttgaaatctgaatatcttaaggcattacaagtatccctgctcctcagctcttagccagccttgtacttttggatcagatacaagctcttagctacttccccattg

SEQ ID NO: 4439 - DNA, 1400 bp, mus musculus
cctggctgtagttgattgtgtttttacacttgtttttaggcatctgggtctgggatggttgtaattctaggtaccttgtctttgttgaatgaataggttcttccctcattttttccccctctgtgttctttttttctttttctttttttcacttttgatagaatttctttcagaaacacattatagcaattaactcgtttttatcagtctcgactgtcgtggcctcttaaaccatgctccttcagtgcagttgattgagtgcactggcttttccaatagttgcattggtttggagtaggtttaaaactgaatttcattctgcagtgtttattaaggacttttggttattttgaacctttcccgttagttttgccctttattcaagcttgtgaatttacaacatttaaaaaaaattattaggtattttcttcatttacattttcagtgctatcccaaaagtctcccatacccgccccccactcccctacccaaccactcccatttcttggccctggcgttcccctatactgaggcatataaagtttgcacgaccaatgggcttctctttccactgatgatggcgtactaggccatcatctgatacatatgcagctagtgatacgagctctcggggatactggttagttcatatttttgttccacctatagggttgcagatccctttagctccttgggtactttctctagctcctccattgggggccctgtgatccatccaatagctgactgtgagcatccacttctgtgtttgctagtccccggcatagtctcacaagagacagctatatcagggtcctttcagcaaaatcttgctagtgtatgcaatggtttcagcgtttggaggctaatggggatttttggtaaagtatttttgttaggtacttttaactgacacgtaggtatagggatggggtgctgtaaccgttcccatgaagccagaaagcatagtattccaccagagtcttcttggtctcctgggattgggggcagagaaggagggagctggggcaactcagatggagcaggtgcaacagagctggcgatgggacagggtatatggatttagaggtaagtagaagaggtgaagatttaagttaccctacctgatttcttgtcccgggtcagtttggagagaatattatggtggtcattgttttcaatatggtcattgttttcaataggccaaattgagttcacatttgttggaagcatttttataatttgtaccatttaagggttatttcactaattaatatcatgtttgtatcatcatgtaacatcatgtaatgtttcatggattctttctgtaactgtgtcagggctcttttatactatatatagacttctccttagagaactaagcatattactagagaaaa

SEQ ID NO: 4440 - DNA, 1400 bp, mus musculus
tgtctcctcgtggcatactctcatacccactactgcacctgtaccccgaagtataatgagtctacttctcagaatagataaagtaagaagaaacattttggaaaatctatgcctgacttttatctaactctcttcactgactcttctatgttaatagtaacgtctattaatgtatatattcattaaaattggagaaaaatattgtcccattatttatttacttatttttatttacattattttatttacttatattacattccttgcccaccttggtctaccctctcagagttcctcatcgcatttctcctcccccttgcctccaagagggtgcttctccccactccccatcaggcttcccccttccatggagcatctcttgaaaattaggctaaacttctcctaaccaggcagacctctagtacatatatgctagggatcttggccaggcatgctcctggttggtggctcagtatctgggagctccctggggtctgggttagttgagactgctggtcttcctatggggtcactctccctttcagcttcttcaatcctttccctaattcaactataggggtctgagatttcagtccaatggttgggtgttataggcaggcatggcgagatttcactgacaggaacacaggggacatgtctctacctgagtcttttggtctgtaaaagcagtcaggctggagcccaaagcccacagtgtgtgtgagggggtggagctccctacactatgagctgcctactctggaagaaggtgaccagaaccaatgtggcctcagggccagtaccagcagcaggatgctggctcttcagctctgtccttgcctgtgtgcccagtggcaagtgcccttatcagagaattggcagctgtggctcaaacctttgctcattcaggtcgcaggagtaaatctgtgggtgcacaggggatacgccagaagaacccacggtagagcacagtgttgagcacctatggaagaacagactttgggggcagtcggccatgtccttgccagttatgtattttttgaggttacaatataaatacatcatctcccctttatttctcaaacccttcccaaatgcccatcttgtcatttttcaaattcaaagcctccttttaaaattactgttacatttatttatgaatatagtatataaataaactcttaaatatataattacaatctccttagtctgtataatttaactatattcctatattcagggctgatatttgatatcatattatcaattgatgtgctcgggaaggatatctctcctactttcagtagttcatagatgtctacagatctttgcctaaggctgaggtctccttggtgtttgatacacacagcccacactcacatgactagtacagggttgtc

SEQ ID NO: 4441 - DNA, 1200 bp, mus musculus
catacgcagcatggaaagtgtctggcttatgctttaccactgatctcaacattttgaaatccattaatggttcctgtcactcagattatgtgtgtgtcatttccttggaaatatggtgacaacatgttattaaactgagaatgcaaaaattaattcacccaagagtgatgattcaagcggatcccttctctgcatccctgtgcatcactttcacttacctttggagtgtcgatgtgagagaatgatgatcacaaaggacttttataatatggaataaaaaatgatggacttgagtacatatcgaaatgttgtcaaattattactttgatatctaattcaattaaaatttcaaaatgaaaagaggtacatgaatcagaatcattttatcagggagaaaattacttgctttttgatgtattagtaggtaatatattttcaattgtttatctttagacactaccttacttatagagtacattgccatattgggctcagtcagataatattttcttatatgtttctcaacaactttaaagaccctttcaaatttaattttattatatcacctcataccatatttatatgtatttatttttattacatttattttttcagtggagtatatgtatagatagatgcatgtcaggatgtgtttacaggataatctgtttgagacaatcatctacttctaccatatggattcctaggaataaaatttatgttctcagactgtgtggcaagtgccagcttgctggccctaattaatcacattgtaaacaaaaactctttgtgagtaataataaagaaagatcaagccaggcatggtggcacacacccttaatcccagcattctggaggcagaggcaggcagatttctcagttcaaggccagcctggtctacaaagtgaattccaggacagccaggactatacagggaaaccctgtctcaaaacaagacaagacaagacaagaacaataacaacaacaaaacaaatataaggccgggcatggtggcacgtgccattaatcccagcacttgggaggcagaggcagatggatttctgagttggaggacagcctggtctacagagtgagttccaagacagccaaggtacacagagaaacccagtctcaaaaaacaaaaacaaaaacaaaaaaaccacattcacgttgaaatcatcataataatgcaacatagat

SEQ ID NO: 4442 - DNA, 1400 bp, mus musculus
atgcccgagtttcattcttccatctcttggattctcttggttatgactgggtctgcagttcctgttctctttactagggtttctatgatcttggaccaatttattcatttgctttgcctgcatgattgtattttccagcaattctttaagggattcttgtttcctttttaagtgcttctacatgttttattatgtttcactatatttctttaagacaattattaatatcctctttaaaggcctctatgactttaaccagatggtgtttaaaatcacagtcttagtcttcagttgtgttagcataaccaagatttgctgaagtaggagtgctgggttttggtgatgtcatattccataggattctgttgattacttgtttgcgctatctggttgtctctgctgttggtaaacctggatgtcatcagttggagtagggctcctgagaggtaggcagaactgtgtggtggagtgtagtgctcgggttttgattgcagttatagatgcaaaccagaaagaagattgagctcagacaggtcatggcagaatgaacaactgggtctgctactatcccagcaggcatggggattgaggtaaggggttcacctgtgtgtctccagttagtgcagctctcctgggaactgtggtggggttgggtgaatgatgcagatctacaagtgcaggtgtaggtgctgactagaatgtagaagtattttaaattcaatattccattaataataattattaattactattaataattatattattattattacttttttgttgttttgtttttttgagacaggttttctctgtgtagcctttgctgtcctggaactcactctgcagaccagactggccttgatctcaaaaattcgcctgcctctgcctcccaagtgctgggattaaaggcatgtgccaccactgcccgatttattccattaattctttacttgtttttcttcattgaatattccatatgtgaataatatagaaagttaataatatgtagtgattgtttttttgtatttttgttttctatgtaaagtggactgattttcatacatgtgcaggtttataatgaattttgaatagaattgttacttttatcaaaacttaattgatgttaacaagtactaaattttagattctagttttatcaaagtaaatgcaaaaagaggattttactataaatccatgtaaattttataacatctataaaatttatagaagccatatggagagcaaaatttcctctgacaaggtaaaccatataaatattgttctgtatatgcacaaaacaatctgacttaaatttaatttttttctaaattttgcattatatatttataatataattaagttatctgaaattacataatatattattttctttgtct

SEQ ID NO: 4443 - DNA, 1200 bp, mus musculus
ttataattctgctttttctataaggtaaatgtgccccagctagttttatgattgtttgtttgttaattttgttttgactcaggaataacaaaaaaaacatgaacaatagctaagcttaacatattgaataaagttagttaaaaaacagacatagcagcaaacttatcctagtgatccatacatctagaataatacatgttattcccttttggccattctttttaaaacagtatattagaacaaggttttgcagaaaataacacaaaataaaactatgttttaaacaaaatactcaagatactgtttgtaaaacacatgaaaatcaagaaggaagaccaaagtatgaatacttacaaaatacccatgaaaggagttacagagacaaagtttggagcagaaactgaaggaatgaccatccagagactgtcttacctgaggatccatcccataagcaaccaacaaaaccagacactattgtggatgtcaacaagagcttgctgacaggagcctgatatagctgtctcctgagaggctctgccagtgcctgactaatagagaagtggatgctgagagtcatccattggatggagcacagaggtcccagtgaagtagctagagaaagtaaagtacccaaggagctaaaggggttcgcaggcccataggaggaacaacaatatgaactaaccagtacccccagagctccctgggactaaaccaccatatgtaggatggcctagttggtcatcaatgggaggagaggcccttgttcctctgaaggttctatgccccagtacaggggaataccagggccaggaagcaggaatgggtgggttggtgagcagggggattgggaagaatagaggattttcagaggggaaactaggaaaggagaaacatttgaaatgtaaataaaaaatatctaagaaaaaaaatttaaaaaaagactgtgtgtatatgccatccacaaggagttctaaactatgcatattataaaataaatacacatgcagataatgaaatactttgcatataaccatagatagatagatagatagatagatagatagatataaatattgatataattacttatatatacatatatatgtacaaaatattacacaatatatttgcctggtaatttagtttcataatgtcatgttaatgtcctacatagtttacaggtttgacttaggtctc

SEQ ID NO: 4444 - DNA, 1200 bp, mus musculus
aactgaaattctgtcattagcatcaaagtatacaataggacaccatcaaagttatttgaaataaatcagatactgaaaagcaattttgggggctcatgagtttgcatgtgtgtaatagtatatttgtgcatggtgatgtgtatatatgtgtgggctggtgcatgaggaggccagagaacaaaatcatgtcacattgctcaggcactctccactttgttattatagacagggtttcttgatagcttggctaggcaagctaggctacttggacaagcaagccttgaggatctgacagactttagctcctaagcactgagcttaaaagtctaagttaccaaacacagcattttgacttgactcctggggactgaacccaggtgctcacacatgcagagcaagcattttactgacttagctgtctccacacacaagtgttcatcccagccctgccatcgagtgaatacgtaatgaagagacgaaaaagaaagctaagctgagaagtttcactcactgaggagagaggtggaactgaagataacaggcaattctggtgaggaataagcagataggagaaacctgcacaagcacctgaacccatgatgatcacagaacctgagctgcgcccaggggccatgtttggatctgtagctctttcacatctaaatctgtattgatgtctgtgatctgtgttaccactaaagcccactcagatgctgatggtagtctgggctgctgcagcaggtggggagcagaggggtgggaaggtgtgagggtggggcaaactaattagagtagcctgtgttgctacctgaggccatggtgaatgcctgggcccttggtgttgctgtagctgtggtttgtgtcaaggtctatgttcctagttaccaccacaggccatgagaatgtctatgctctaggctgtcacctaaagacatgttgatgtcccagtactgtggtgtgcctgccccacaccttgcaagcaggatgtcagagaaaagtctctgtggggctcaggtattgatggtattgcaggagtcagacagattaaactagaccaaaggctcattgtggtcaacatttgcaaatgagccattgagacaaaaaaggtatactgtgtaacaaacatgtaacattttaaaacaagatttttgtttgtttgatttttcatctcagggggacaggttacaagatatcaaagaa

SEQ ID NO: 4445 - DNA, 1600 bp, mus musculus
tttgccattccctttctagtataaatttattcaagtggtatctctgtgtgatgcttcagattttgtgagtatgctctatcttagaaaagggcatccaactccatagaattataaccattgtagtgctcaacaggaagctcccacggaccacctccctcatgtcacaccacttcatatctgcactgaatattgtcttaactatgggttctgtcacctgtctgctttattgtgatcagtcattcaatgtgtataacctgaagtttgtatcttgaatttttaagacttttatcttgaaagcttaagatataccagtcaggttatcaactgatcttgccaatatgtgatcactctcattacatgcaaggaacataattagccattcatgtgcctaattgttcatatgcctattataatgtgtttgttgttagatgtttctccatcaattgtttttcaagtgtaattcaaagatgtctgcagtgcagctatattctcttgattgctcagtattaaattgggcattagcaccatttctgttaagactcagggaacaccatgggagatggggactgagaggtcataagagccagcagataagtagatagactgtgaaatactgtcttctgaacacagataatgctttcaagacctcccaatagtagtggtggccagcactgaacctacaatctgtgtctacctccatttgaccgtggatctgagggggccaactgctctctaatatggctgcagttgagaacctaccaggttacaatatatcattgcacacccaaggtctgacaaaacatcctgttgagtctcaaagattttcattaaaaaataaagtagaataaaaacaggacagtaatactcataggaagtaactagtatggaaggagctgtccataaaacagggttaggagagagtataggaggaggttataataaccagaatgattgttgtatgtataccatttttaatgaaaaaactcagtaacagtcaaaattatgtctttgtgggattcatgtaaatgttaaactgtgttactaaaacaccatagaatagaatattttttaagaagcagtagaattgaaaagccataaaacaaacaaacaaacaaacaaacaaacaaacagaacctaatgtgctttagtggcagagactaaacaagagggaatggaaaagactaattaaaaattacaaataaaggaagaaatagatgatgggcaaatctacagacttgggagaaaagtcagttttatggcatgtaccattgacagacaacagatataatttcacgtagagcccttatttaactcagccctcctttttaagtgattaatttattgtttgattaatgaaagcagagatgacagtgagaactgaaaagtattttgaatcccagagttactgtagtccttgaaaagagatgaaaaattcatatagaaaagtcactcaacaaatatgtgcaaatgtattgaattgctgaagtggatagtctctgaaaccctgtttctaacctccagttatttatatacacagagaattatgagcacatcaagatcagcccaaagaaaaaaatcacagaccgcatttcagtgtcca

SEQ ID NO: 4446 - DNA, 1000 bp, mus musculus
ccatgggatctttcttcttccacgttttcaaaatcaaattattttttccttctaaaaataatttaatataacaaaagtaagttatcagtcatccccattaccttccttccagtttctttctcaggctccctaccactagtccttttcaacttcgtgcatactttatttaaaatatatacttagaagagcactcagtgctgatgtattgcataagagctgggctgtgtattgaaacatgagtggcctctaagggcattcacttcccctaagtaaactgactcccacccccaggagccaccactccctagtagatcctcagctaaaggtggaacttcatgacacatgccctgttcatgctggagttttgtctgccttaatcttgtacagatcttgtgcccaaagttacagccattgggttttgtgttgtatataagctctataatggacatagaaccctgtgtggatggagtcatgcactagctttttctcttacaacctttgcttctgtttacctgcagttatccctgagccttgacagaagagaagttttatagctatcctattaaaattacacctattagctgctgctgctgcttcttcttcttcttcctcttcctcttcatcctcctcctcttcatcctcctcctcttcctcttcctcctcctcttcctcctcctcctcctcctcatcctccttcttccttcttcttttgcatgcacgtgagttcttgaataatatagaatgcatgtggagattagaagataacatcctggaatacattttccttccactgaggattgaagtcagattgtgattattgttgaatcattatgtaagcaaagtaaagaactgttttaattttagtagaggacctctctgccctttatacataaaaggataattggtatttttattttagaaatttataacagatgtatgtattttagcataaatagatattaatgtgttctatattgaaagaaattagtattctaaatat

SEQ ID NO: 4447 - DNA, 1000 bp, mus musculus
ctggaagttgatacttctcacctgtcttggtagattacacttttagtgtagagaggaagtctgctctttgcctttgtgtgcatgtgacaaatattgtagagaaacagtatgaaggtggaaagctttagttcagctcatggactcagaggtttagtccatggtcacttggtttcattgtttatgggttgtggtgaaacagaacatgaaggacaggaaaagggtgaacaaataatcccattcaggggtgaacaggaagcacagaggaataacaacattgagacttttccagatagagaattcaaaggcatggcacagctacccacttcatccaactatggccatcgtaacaacttcaccactttctatagtctgcaagcactacaaattcatcagtggactaagccttcaattagatctgtatgcttgtaatctaatggcttctggaaatccagtcacattagataggtgctgtagaaatctacaaatgtctcggttcaatcaagctcacaagatttaacaaaatggagaaaaaaataagctgcagcaaaattaaattactattatacctgatttctttcttctgcttggttcacatacacctgggaagtattgactgaagacttatttcaagggcatagagagatataatcttacgatactttggaagaatttcactagtgtaatctttatgtccttcaaatatatcaagcaaaactttcccctattagtgagtaaacaaatacaacccttaaatttgagtaattcagttaaaatgcaagtgttattgtgctcatttcatagttcccaatatagttttgagaaaagaaatcccactttgcaattaagcaaacctaactgcatggcttacacagatgagggtaggggaacaggaggagaaagagagtggtgcttgggaggctgcagggatagcaagatagcaccagcaaatgagcaggaagaacgggaggaggagaggagggatgggtaacataggctacaa

SEQ ID NO: 4448 - DNA, 1000 bp, mus musculus
aaattctgatattaggcaatccattcaaaatcctttctgccccctgatgttctaacttcctatttcttaatccaaaggccatctgattcattactgacagatgccacatccacacattcatacagacagctctacatcttgactgaaaggaagccagaagaagagtccctctttttccctagatggagcctaaaacaaggacctcaaagcctatccccacagtgactcacttcctcaaacaaaaccacacatcctaagagtcccagttcccatggaccaaagctattcaaaccaaaccaaattgatacaaatatacagtaaaaaaataatattgtaagtggggtaatcttttgcttcttaatacatattaattttagggcacaactgtcaggcaaacctgattgaaatgaatgtaaatcaatggatggctcaagaacttcccatattctatttcatgtggattgtcagaagaaaaccaaataagtgtaataaataatgtgaatgcttagtttctttatgctaaatttctaaattaaatgttctgaatgagtaccataagtagctaaactttttttggggtgttcaattatatcctatttctttaattgcatataccactaagtaatagctgatgggaaacctctaagcatgatagaatttccaatatattttttatgatataaggtaaatttaatatgccattcttgctagtgaattaaatgtgatgagtattatataatgtttaaatgtaattatagataagaagtaaataaaatttatgaaaaaccaactgaacataataaaagtaggtagtttattctatttttatagtacttgatatacagcagaatggagaagtaaataaaataactgaatttagtttggggttgtctactgatattatagaactgagatggactgtggagacccaaagattcaaatgctgtgagtgtctgaactccattttagctgatgctctgcttcacaaacatgttacttg

SEQ ID NO: 4449 - DNA, 1000 bp, mus musculus
gatgacttgtggggttgtgggtgtagaggaagaggggaataggagagagtgcccccgtccaaccagagttctggtgctctaggcaggcagactcaggaggactgtctcacactttccacatggccccaggtgggcatctggctatgtgaagccactgaccccacaaagcgagggggtggacaagtggcagctcctggtaccaggttctcaggctctggcatcccatgctggatgtggcagaggagctgagaacagaataggggtcccggggcagcactaggccctgaagatacaggaagagagggcaggaggggaggaggggggatactaggtgtttcccatgctggtgagtgtcttttgccagggacttgatgaacagagatagtctatggttttagagctttattgtaggaaggcagagggaaagagaagataaaaagagagactggccatggccaaaaggtgagaaggaggaagggaaagaaagaaatagagtcagagagtaagaaaagtgtgtgcttagagagagagaggaaaatgctttgagagtaagagagcttagagagagagtaaggaaagtaaaagcttaagagagtaagagacggaggtggggccaagcagcccctcttatagtgtgtgttgttttcttgctgttgctaggtaactgtggaggattctagccagaaggccagaagcttgggacattgttagtgtgactgctagctacaagcctttcctgtgggggttgtgggggcagtgatatcgataggagccaggggtccaggagatataagggaatacctattatcccatgtaggtggaaattatcacccatgggtcccatgggcttcaagaactcaactccacaggagaccaggctgtggtgcatagcccattgactcacaatgacttatagtttgtagtccaactagcccaccaatggtcagctgtgaatgggaagtccaacaatctagtagttcctcagtcccaccagagtagg

SEQ ID NO: 4450 - DNA, 1400 bp, mus musculus
acattttaatgatacattcataagtgtttcaaaattttgcttgtccttgatcatcagcagtagaaattttcataagatataaaataaatcacatcccttgataatgaaatatttgaacacataaagctcaaaaagctattaatccaatcacaatgagtgagattagaagttggacactaagctaccagatttgagtttacactacaggaatttgctttgtgttcatcccatatgttctaataatttctttatagaataagaagtgtttgccttatttgtagatgttacaggagcctatagttaaaatattttgggtggttaatgaaattttctattttcaaaatgttatttttttaaagactgtgaaacatttgaaaggaagaactgtgtcctatattatagtgacatgtaggcttagatttattattcaaaacctccttcatttagggttctcaagtgcttcaacctgccatctcacccactgtccagactgagaggaaaaagaaggttaataggaaaagggtgttgcagacctgtatagaagtagttttttggggtgattccattcctcattatcaggataccagcactcaaattcagtagcacacaccagacacactccagcagaaacaaggctctaccaaatcggcaggaatcagggaatcagccagagtaccatggcaaatcctttggtactgacatgtttttctctatggagtgaagacccaagaagaatggtgaagacaaggaagatcagcgaatctgtgcatgacatagcaatgtaaaagcctccttccattgtttgtggggttccatttatattctttctaaacatcacatgctctgtcaagtgtctgcttccaacaagagatggcatggcctctcacaagtcagatttcagaaaaacactgtgtgacacaactgtattgttatcgaaaaccagaaatgttcacttcatatcccctttctgttttaaagaaaaagaattttctctatcattaccaatctacacacaataggaataaatatgagaaccataaaaatagaaatttaaattaaattttaaataagctgcttatgtacaatatatcaaataatagtcgagcaaaacaaccttatatttctatcacaatgcaataatgaaacaaaattaaatttcagtagctaaacaataatcaaataatacaaccttaagtttctatcatcatacaataatcaaacaaaacaactttacatttctatcaagatatattaatcaatgtcaaagtaaaatagataagctggtggttaatttattattttttatattttgttattaatttttccctcttttaccccattgttagataaaagagagagacccctgatttaatctttattttgttttctccctgaccata

SEQ ID NO: 4451 - DNA, 1400 bp, mus musculus
aatccagcaattatccatgtttattttaaattttatgcttcatcttgcaacaaatctaaaggaacttaagaaaagaatgtttattctattcacaaacctcttaattcagcttcttaaatgtttacatgcttaatttcatcaatcagacatttagaatgaaatgaaaccaatcctccagaagatttcacttcccaggtggtgttaggatgaaatgttctggaagtaatataaattatctatctcggagccactgaagagtacaatgccagttacagataaaattaaaatttccaatctcttcatatttaattttagcagtgtatatatgattaactttgaaactcaaatatttataagaaatgaaactgaaaaggttgactttcttaaatatacataactagaatcttcaaacataaaaagggaaaagctgttgttaaattaatttattttttaaactccatatttcattccccgtcccctccccagtcaccctctgactgctccacatcccacatctcctccccaccccacccagtctccacatggatgtctcccttcccctacccgacatctctactccctggagcctccagtctcttgaagattaggcgcatcatctctgaatgaacacagacctggcagttctctactatatgcatgttggtggcctcatatcagccctgtatactgtctgtttggtggtccagtgtttgagagatctccggggatccagattaattgagactgctggtccttctacaggatggcccttctcctcagcttctttcagcctcccctaattcaacaaaaggggtcagctgcttctgtccattggttgggtgcaaatatcccattcagctgcttattggttctttggggagagagggaaggacctgggaaggaaagtagactggggaggggaacctgacctggtattgggtaagggaaaaggactgaagcccagagggccagcagaaagaatgaaaacaggcaacctcaggaaataggattttggggagacaccccaagaatgcaccagagacctaggaggtgagatacacccaggactctaagggagagacctttgataaaatgccagacagggagataagtatggatcaatttgcattcttctacatgataacaaccagttgtgccagcaccaattgttgaaaatgctgtctttcttccactggatggttttggctcccttgtcaaagatcaagtgatcataggtgtgtgggttcatttctgggtcttcaattctattccattggtccacttgtctatctctataccagtaccatgcagtttttatcacaattgctatgtagtaaagcttccaactggtaagaaggacacatgctccactatgttcatagcagccttatttataatag

SEQ ID NO: 4452 - DNA, 1000 bp, mus musculus
tgtgatactattaatttcgagtattgtaatggtttggattataatgttccatcacatacattcacatacttaaacaattggtctcctgtggctaaggctatttggagccagctgggaggtatgaccttactgaaagaaatggatctattgggaaagacggctttggtgctgaaagcctaatgctactttcagtttgtgtgtctgtttgatgtttacagttgaggatataaggggcagcttcctactcctcctggcatgcctgccacttgcgccaccccttcatgccatgatgaacatttcatgttcatgaagcttaagtcagaataaagtctttcctccaaaagttgctttgggccatggggttatatgaaaaacaatggtcttgtaactaatacaagggtcagttttatgtggtttagaaatatggatatgtgacaggcccaaattgggatctaggtcaaggggaggtttcaaggcctggaattatcattgatgctatggtatgcttacagacagaagcctagcctggctgccctctgagaaacccaaccagcatgtgaaagagtcagatgcagttactagcacccatccaatggacagaagccagggacctcagtgggtgaattaaggaaaagctggaaaaagctgaggaggagggcgaccccataggaagaccagcagtctcaactaacctggaactcctcagacatgacactgaaccaccaatcaggcagtataaaccagctgatataaagcccacaacatatgtacagcagaggactgccttgtctggccccagtgaaaaaagatgcacatcgagagacttgaggtcccagggagtggggaggtctggtgaggtgggcatggggatggcgacatcctcttggagacaggggaggaggtatgggataaggaacagttagagggcagaccaggagggggataaaaactggactataaaaaatatttaataataataataataaatagaaatatggat

SEQ ID NO: 4453 - DNA, 1200 bp, mus musculus
gtctctaacatactcttatatcatatcatatcatatcatatcatatcatatcatatcatatcatatcgtatcaatctgcctatcatctgccatccatctatcacctatctaatgaacaaaatctatagcatttatatcttgtaaatactcgatatacttactatacagcattctttcaagttaaaattaatcatagtggatattctttgttggggattggttctaatgctttgaattaatccacccgcccccaacattgggaatttgcatgtccaaatgtgaaggtcactttccccaatcggtttttgatcgatcaataaagaggccaatggctggcaggtagactgagccgggatctttagatttgcctgggataaggactgtgagagagaaagaagaatcacgatgtctcagaaggagtcagatcagatttagaactgcagaagaaaattcatccaaaatgtacatggaaagagaaagcggccatatagaaggaagggactgcctagaaggtaagagggcagcaaggataaaacataaatttatagatctagaaggccctgagctaggagtaatggagggaagtgtatgctagctgggcagaggataagaactgcccaccctttgagctagtcaaggcatattaaaaattaactggtgtgtgtgtgtgtgtgtgtgtgtgtgtgtgtgtgtgtgtgtgtgtgtgtgtctgtctgtctgtctgtctttcatttgtgaagccagattgcacttgggctagtgcgtatgtgttatcagttggaagctcaaagcagtttagcaaatccactattacagttctttgaggtcaactgctgtaaattaacatttttctttttaatagttctatagcatttgctcagataccagtttctgatggacattatctattgcaagttttatatgctttgatactgtgtttaacaatgttaaaatattttcaatatttgaacataaataaaaacagtggttttatgccataatatttgtgtaaatatttggaatacatatcctttgttttcaacatattatttacagtttgtttttcaaataaaatgacacttttctggctagagaaactatagtatccaaatatattacaatcatttaattgaatatagtcttaagttaaaagtattcattattccattgtgcaaaagggacatatttagaagaagcaga

SEQ ID NO: 4454 - DNA, 1000 bp, mus musculus
aaagtgtcccttttccttcctgtgacttccaactacaagaccacaattagagcagcacagtttctgctgagaatgagaacaaagaactaatctgcctccaccccctgcttccccatgttaggctaacatgtgtcaatcaactagcagtcttttactcttggaaaaagcaagaaagcttttaggactttttagaagttattatcatcagcagttcaggatagttagagagctagatcatccagaggcactcagactgtaaaaccacagcatcgtcctactctgtgccacctccagtaccctctccaagctgggatgctcccagtacacctacagaaatatccaatcaaatagataaaggaaatgaatagaagtatccaagaactaaaaatggaaataaatgtaatttaaaaaaacacaaattgtgataatcttggagatggaaaaacctgggaaaaagaacagaaactacagacacaagcatcaccaaaggaatacaagagatagaagaaaatatctcaaaaatagaatataaatcagaaaaaatatatcaatcaaagaaaatccaaatataaaaagattataatatctgagatatttgggaccctatgagaagacataacctaagaataatagcaataaaagaaaattcccagcgaaatggtccagataatttcttcaacaaaagtatagaagaaattttccataacctaaagaaagagatgcctataaacatactataagcttacagaacaccaaatagattagataagaaaatcctcctgccatgtcataatcaaatcactaacaacaaggaaagaatattaaaagtggcaagggaaaagggcaaagtaacatgtaaagacagacctatcagacgtacacttgttttcaacaacagagactctacaagccagaagagcctaggcatatgtcttgcaaactctaggagattgagaagacaaatgtcagcacagaattctatattcatcaaaatgttcaa

SEQ ID NO: 4455 - DNA, 1000 bp, mus musculus
tggaatacagggccccccaataaagaaactagagaaagcacccaaggactgaaggggtctgcaaccctataggtgaaacaacaatatgaactaaccagtaccccagagctcatgtctctaactacatatgtagcagaagatgtcctagcctgccatcattgggaagagaggccctttggtattgcaaactttatatgccccagtccaggggaactccagggccaagaagtggaagtgagtgggtagaggagcagggcagggggtgggtatagggaacttttgggatagcatttgaaatgtaaataaagaaaacatctaataaaaaaaattaaaaaaaacaatagaggaagaatttggaaatattaaataacactgcagacatttttgaaaagttagaaaagatacttattactgttggtatttacacacacacagacacacacacacacacacacacacacacacacacagtttaaatggagttataatataatgaagcaccaaacagaaactaaagtatgaggctatgtatgtcatatatctcttacctctattagagttgttggcaagagttttcctgagatccataaattttacaggttttctacaattttattggtcaccctaaggacaaaccccattgctgaagacaccacatacttgaatagtagaacatgaagaaaccctggttttatgggaattaaattttcgtcctcgctggtaactttaataatgatttaaattaccctacagtgcacttgcactgtaggataattttaaaaaataccaaagttaccaagttcaaagcctgggagctagtccaaaaacttatctagcaaaacttgccctctggtaaaatagtagaaatagcacaagcgtagacagacaaatgtttgtttgaagacatggtcgacaatatgaaacctacacctggcataatattaaggccaagaacaggtgactatacagttcttgggccctctaagagaactcattacta

SEQ ID NO: 4456 - DNA, 1200 bp, mus musculus
gatgatcaacacatgttcctgagatatatccaaatgttatataaacttcactgagtaatatagattctatatagtaaaggagcaaattctttggcaactcagcaaggcagaaagaaatgtaacaagaccagggttcatgtcactagaaaactatttttggagagaacatggtcactggaccctgcaaaacagggacaaagaatctagaaacatgaatttattaactcatcaatgaaaatgccagactaagaggatataagtcaactttcatgctaaaagaataagaagaaaatgaaaatattattcaggaaaccaggaaacaaagattaatacacactggctgaatgaaattcttcccaaagaggtaatgccagtcataataaagtttgaaaaagctttaaagttaaacttaaaaaaatcacatcacagagacagcgccattttcggctccagaaaaccagccaccttcctggccagaggacaggtgttcgcacggcccgggaggcttctgcctcaggttccgtggtagccaccttggttccgggactccgaggcaggcagtctacacaggtgagagtgtggactacataggctagcagcttctgggacacgcgatagccgcagtgcttctggggcagcgccgtttttgggctccagacatccggccatcttcctggccagaggacaggtgtccaaccagcctgggaggcatttgcctcaagatccgcagaagccatcttggttcgaggactctggggaaaatagtctacacaggtgagagtgtgaactactggaacaatggcttctgtgacaggccaaagcaacacagcttctgggaaagatcctgttttgggctttcatcttcagccaggaggaggtccatacacctgataactgtgcaccttccctgaaagaggagagcttgcctgcagagactgctctgaccactgaaactcagaagaaagacctagtctctcaggtctgctgatagagggtaacaaaatcaccagaagagcaatctctaaacagagacaactataacaactaacgccagagataaccagatggcgaaaggtaaacgtaagaatcttactaacagaaaccaggaccactcaccatcatcagaacccagaactcccccttcgcccagtccagggcaccccaacacacgcaaaaagctagacctgaatttaaaagcat

SEQ ID NO: 4457 - DNA, 1000 bp, mus musculus
attttaacatatcatgtaatccttaaagtgaaactgtaaattaacttaagaatattttctttccaattctataacttattcctatcatatgtagtttgataacaaaaacatatatttgtccttatacaaaaaagaatgtaaatctagagccattcaacttatatcattgaacactgcaatgccatggtgtaggaggaaggggaggtggatgccttggcataaatgccaggggccaggcagctgcaaaggcatctcgtgcaggaggacctaattcaacacagtctgagagatcaaggactgctgacacagaaaatggcagcaatcgggaactgctgtttggaagagatgcttgcttgtgacaagtgggttacagtggagagtattaaaggaccttgcagcagccttcatttgcacttgcagaggcattctctcctgcttctagagtctgactttgattctgtgccacctcatctccaacccccaagggccagtagggttgggcagcaggctgtccaggaaacaagcagcatcatgcatgttataaataatatagcattaaagatacaattattaatgctaaggatgttgggtatgttctttctcattgtcacttttatgcttttgtacacatatcatatgcaatatttcttgggaatgcaaatccttgggaactcattccaaattatcacttaggtattgtaaaggcataggaatagaattgcccaagtagcttttctgttctagttagatgttctgtatttcaagacgatatatttattttaaaatttattactgagtattatgttttcatatacaggttatctgggtagcagcattttgagtactaatatctactccttgaatggagttatattcatcttgctctggtccatgccttgacacagaaagcataagttctttaactctggcttcttcttgcattcagttgatggcattatataatgtgtgtgagcgtacacacaacagctactgaattctt

SEQ ID NO: 4458 - DNA, 1400 bp, mus musculus
tggggtgcccaggactaggtggagtaggagtgctgcgttctgatgatggtgagcagtcttgatttctgttaggaggattcttacgtttgcctttcagcatctggtaatctctggagctagttgttatagttgtctctgtttagagcgtgttcttcctgtgcttctgttatcctctatcagcagacctgggagactagctctctcttgagtttcagtggtcagagtactctgtgcaggcaagctctcctcttgcagggaaggtgcccagatatctggtgtttgaacctgcttccaggcagaagttgggttccactcaccagaggtcttaagatcccgtggagggtcctgtaaggaccttgggggtgtccaggaactctgtgtgccaggaaccctggtgctgtcatagaccagaaggtacttgtgcccctgatcaggccgggttatctgcttccctagttaatgcagtctcaggtcccttgagattggattatagcagacgctgtgttccactcaccagaggtcttaagatcccttggggaaattgtggtgcacagaggtctgggttctgacttgcttcctggctgaagatgaaggctcaaaacagggtccgtcccagaagatgtgttgcctttgcagtctgagtgctcacctgcacagactggtctttgagagacctgggacacaagatagcttgctcacatactcagacagtcagagccctcccaggtggccacctctcttctgtcggggaaggtgcccagatgtctggagcctgaaaagggatctgtcccagaacctgtgttacttctgcctgtctcagaggctgtgtagtttctgcagccagcactctcacctgtgcaaactggtctctgagggaccgggaacacaagatggctccttcacctgctctggcagtcagagccctcccaggcagccatttctcctctggcagggaaggtgcttggatgtctggagcccaaaatgggggtctttcccagaagctgtgtcgtctctgcagtctgcactctcacctgcgtagactggtctctgagggatcagggacacaggatggctccctcacttgctgtggcagaccccactccgtattttagtggtattattattcaattgtctgcagcctttgttgtagagtagaagtttatttaagacctaatttagaattaatggtaaagtaattaattaattaatttttactaacatatttggagagagagaattgtagggtaatcactctgaagctcctattgctaggtgaactgctctaaaattcagttgattggattctgttcaacaaatttaccttcatatatagaaaagaatgtatttcaatcaaaattttaagacatgtgattagttactatcaaaaaagagtaacttct

SEQ ID NO: 4459 - DNA, 1200 bp, mus musculus
cttttactaaccaccagcttacctactccattttcatagattagacattgtcttcaggaatgggattttattgtcagtctgtggaaaataatttacagcactggagaaggccaggttctttggggattccactgagacccatttggccaaaacctgaattagatataacccattccctgtcctgaacgttttatttgttggcaagatatgtacaaaaagggttgtccctctggcccctgtctccaagaggatgccctaacccccatttgtgggacaatgggctatgcacagtcagcctggtctccagttgagatgaggtcttgaacccgggtaggacctgtggtagtaatttccatctacataggatggaaggcgttccctcctgtctcttggacccctgactcatgtcgaagttaccgcctccccagcccccaaaggaggggcctggtggctatcagccacataggaataccaccaagccttcccatatgcaagtaaggtttccctcaaactctcacttcaagtaatgagaggtacctgctgtcaaacccagaatcacccccagaactgtatataaatccttccagggaattaaaggtactcgagaactattccttcgtctgagtcttttgttccacgagctctatgtaacacttgggaagggatctctcccgaagtgccacccaaggtcccgatgcactccttactggatggttggctttcccaaggcccagccggacctgactcagatcagagcagcttggagttgccaagtgacctggaaggcgtggcagagacttcttcctgcctgcatttgctttccttcactggaaccctagcacccagcctgagcagagatctatctctgtggaaaatctatagtacccaggcccacacccattcccaacccacaaggcttccccatttcctgaggcctcgagtcttttgagggttaggtgcaccttctctgatggagtccagaccctgcaatcctctgctgtatatgtgttggggcctcatatcagctggtgtatgctgcctggtgggtggctctatgtctgagagatctctgtggtccaggtcagttgagactgctggtgttcccatgaggctgcctcagcttcttccagctttttcacaattcaaccaagggggtcaccagcttctgtccactggttgggtgtaaatatctgcatctga

SEQ ID NO: 4460 - DNA, 1600 bp, mus musculus
atagaaaactcttcttgtacaaggtagtcatagccacagtttgcaaaaagtacagctattgattaattaaacaaaatattaactagatatacagtcctggggcttttaatctcctgtagccttgtctttttaaattaaataattttttaactaaaatatatattgaagggttaaaatattaaaaattactagatcttggaatctattcaccttcctttcagtttgcttgagccttgccaagtctctaggagattaaagagatgataagagttttctaagcctcaaatttttatgattctcctgtcctgacaagagatcatttcagcttaaactaaatcgtaagggaaactactatgtcctgttatataattctccgtgtgcagtatgttttggggttaaaaagttttaatactagaagatcttcaattaaaacctgtagcttttaaggctctaacctaacagggcatgatagtaaggctgtaaatgttcagaaatacatatgaagccatgctaagtactgatgcagttaataagttaaagcattatttagtctcctgtttcatgtttataatgtaaaatttagagcagatatctaaaacagataaaagttgttcaactcagaaatactaggataaaactggcgttcaaactgtcagaggtctgatgagtatggtatgtaatatgtttaaacttaccatgatggacagagattgcccaaggtgtccaagaagaggcaggcacaatgctacccacctgaactctggtataataaccactggtcttaactcccccaatgcttcacttgttgccagcacctggtctgaactgtagataaacagagggctactggggaactgattgccacatgttgctttagacaagataaggtcagtccttctcaggttcatcactttctgggcttgatggccaaagattgcttctgttctcagtgcctggggcagggagaaacctgcatcaactgtctgggtaatggaatacggataagtctgcctcatttcaatttatccttcaaattctctgattgcactgatgcttatttgtagcttagcagctaagaaaaaggcacctagcttcttacatccaggtaatctactattgtgttagattatgggttagtttgttagttaaaactactagttctcttgtttaaaaactggcaaaaaggttttctttattatcagacttcaaattgaaacataaacaggtttcagatgtagctctttactgttcatttatttaaacttgcttgcaataactattttcagtaataactactcatatttttgataaatgattagttggaaagagaaagatgcaaagctggtataatatagggatttaaggtatctgaaaaaaatggaaaacatttcagatttgtttccctcatctgcgttattattaaactacaatttcaaaagttcaccattttaatatagatcaatggaattttggtaagataatggaatattggctgttaacaattcagtcacaagttcaaaagatctgtctaatttaaggacattatttttgccatactttctaaatattcatatatactctaagacttgagtggatttgc

SEQ ID NO: 4461 - DNA, 1000 bp, mus musculus
gaagggacagtgaggagaaaaggaaaacaggatcaggtattgggggagtggggaataggattgaagccctgagggccaactgaaagaatggaaacaggcaacctgggggtggggggtaggaggtggggtgaccatctggaatgtaccagagacctgggaggtgtgagattctcagtacccaaagtgaggggccttagatgaattgcctaacagtggggagagggaacttgtagagctcacctccagtagaaaaaacagggcatcaagtggagggatgcagttaccaacccacagtcaaaaactctgacccaaaattgtctaaaagaactttagggacaaatatggagaagagactgagggaaagaaggtccagtgccaggcccaaattgggatccagcccaaaggcagaccccaaggcctgacactattactgatgctatggtgtgcttatggacaggactctagcatggctgccctccgagaggcacaagcagcggaaggggtcagatgcagatacttaaacccaacaaatggaaagcgatgttgggccttatttggccagatactgaggcctactgaggaagcctgagcttttgatcgtgtttagacttgtcttgctcacttcagtgctggagtgactcagcaggacttgcttaagcctgcctttgcctagctacactgatgtagaataactttattggccctgtcagtcacccaatacccttctctgcacccagtcatctcacctcaccaaaattccccacctacttcctcaaccctatataaacaaaaactgatacaataaaaccagttcctgctttgacagactcccagccagggtatttttgttttgggcccagacactccaggagagacttggctgggctgggttctctcctcttgcctggacctgctggcagagagcctgggaccactgtcttgaattagggaaaggctggaagaagctgagcaggaatgggatgaggaactgtcagtgggt

SEQ ID NO: 4462 - DNA, 1000 bp, mus musculus
ctgcattggacagtagtctctttctccttgcaacatgagattgaaacctttgtttagctttttattttttaattaattatttttatacaccatattttattcctccttcccccatccatcatttgactgttccacatcccatacatcctccctacccccctgtctccacatggatgtccctatcccccatgccacctgacctctaaacttcttggggcctccagtctcttgagggttaggtacatcacatctgaatgaacacatacctggcagtcctctactgtaagtgtgttgggggcttcatatcaactggtatatactgcctgtttggtggtacaatgtttgagagatcatagggtaccagattaattgagactgctgggactcctacagggttgcccttctcctctgcttctttcagccttccctaattcaaccacattggtcagctgcttctgttcattggttgggtgcaaatatctgcatctgattctttcagatgcttgttaggtcttccagagtgcagtcatgataggtgtctttttgtgagtgctccatagcctcagtaatagtgtcagaccttgggacctccccttgagctggatccaactctgggcctgttgctggaccaacttttcctctctggcttctcttcatttccatccctgtagttctttcagacaggaacaattatgggtcagagttgtgactgtgtgatggccccctttcctcatttcattctgtcttcctgctggaggtgggctctataagttccctctctatactgtctggcatttcatctaaggtccctccctttgagtcctgggagtctctcacctcccaggtctctgctgcattctggagggtcccccaaactcctatttcacaaagtttgcctgcttcctttctttctgttggccctcaggacttcattctttttccctctcccaataccagagcaggttcccctctcccccaacaccttcccttctacatctta

SEQ ID NO: 4463 - DNA, 1000 bp, mus musculus
ggcatgagatttaaagttaggtgtttcctcttggctcagtttgagatgttagtgatgctctaattccatggggaagctcttatgtgcttactggtagggtcctctcagtgaggtgtcgtggttacatgttccagatcaggttaaaaaaaatgggtagagagcagctctactgcagatctcaaatctttgtgatgcccaggatctgagtttactcaaccttaccaggtcttctgtctggtagcacagtcaactggccctacgtttatctcttaaaaatctgacctatccaaactgtttttacatggcatattatgattacacaggaaaatggaatttgtttcaactatttatcctaattacattatcataagtagttttcagagtatggtaattaggcagtgtaaaggggcaagaaataacatattatatgatttacagaaaagatttcctcacagtgtgtgtgtgtgtgtgtaatctgctaaagaaataatctatctaataaaggatagaaaattcaaagaaatattttaacttgagttgatgacagctccccagcaataggataatagaacgaattatcaactttcctttattttttttggttgtttcttccttttttatttcctccatttttctaagatagagctttatatgtcaggggcatcggaccagctagtgtatgctgcctggttggtagctcagtgtctgagagatctcagggcccctgcttaattgagactgctggtcttcctatgggatcaccctcctccttagcttctcccagccttttgttaattcaaccacaggggtccacagcttctgtccactgactgggtgtaagtatctgcttctgtctcagtcaactgcttgttggacttcttagaggagagccatgcaaggctcctgtctgtaagtacatcatagctgtgttagtcagagtttctattcctgcacaaacatcatgaacaagaagcaagttggggaggaaagggtttattca

SEQ ID NO: 4464 - DNA, 1600 bp, mus musculus
tcaaggaaaacattcatcccaggtttttattaattactatctggatatatttatttataatatttattattaattactatctggatgtattttacagttaaaattacataattaacttttcacataaaaattgcttttgatcaatgtatacattttggtagcatacatgttttctaaggtctaaaagcaggaaacatttttacatgaggttattattctattgatatcatctatcattcctattttgtttgtacaatgaacttaacttcaagttaagtatgaaattcaaacactagcttgacaaaaccacttttgtccatgataaatcttactttacaaagtataaatattttgaattataatatttatatatatgcataagtggaaataaattaaaatgaagtgtattacattgacaactgtatgtttcttttccaaatttgctatttattaatatttattatttttctaagaatacaagagtaacatgaatgatttttttttttatgaacctagtagtcagtatatttaacttgtcaccacaggtatcttgggaacaagcttaatttaaaaaaattagtcagattgctcttacaaatgcaaaaccataaaaacaccatgctgacatggttaacataaggagatcttccaaaagctgcatgacatctgctaggtatccgcaagagtatacggatgagtagcatgcctatcaaacccattgagatcactggacatcactgttctattttattatccatgagtctatttatgtccagtctccctctagctgtcaagtgtggtggtttgaatatgagtgagtagccttattcggagttgtggcctcattgaaataggtatggccttgttggaggatgtgtggccttgtggtagtgggctttggaacccttgtcctagctgcacggaagacattttctttattctacctttggataaagatgttggacttctatctccttcttcagtaacatgcttggctgccttgtttcctgttatgatgataatggtctaagcctctgaaattgtaagactgccccaactaaatatttgccttcataagagttacattggtcattgtgtctcttcagagcaatgaaaacccaagttaagaagttggtaccagtgactggggtattgttgtgatagggctgaccatgtttttgtttagaggagtgtggatttgggaagttttgatttgggaaacaatggaatgctctattgacaatcctggtaggaatatggaagacagtcatgctgtaggtggtttgacctctggaggctgctggttcaagagacttcagatgagaattttagcacatgacctagagactgttcttgtgatattttggtgaagaatgtggctgctattttgcctttgtctgaagaggctccatgaaaataagctgaagataattcagattaattgcattgacaaaggaagtctcaaaaatagtccagcatggacttcatgctctggtttactttcactataagaattctgaccaaacatcacaaggttagaaagaaaactacaaaatgtaaggttcgactattaaagggacaccacaatgtggaatggagc

SEQ ID NO: 4465 - DNA, 1000 bp, mus musculus
ccctgagggctagaagaaagaatggaaacaggcaactgcaaggagtaggaggttggctggaccctccagaacataccagagacctgagaggtgaaatactcttgggactcaaaatgcctaacagtagggagacataacttatagagcacacctccaacaggaagatagggtatcaagtgaggaagggggttgccatcccacagtcaaaactctgacccatgtttgttctggtctgaaagaactgcagggataggaatggagaggagcctgaggaaaagaaggttcagtgacagggccaaagctggatctagctcaaggagaggtcctaaggcctggcactgttactgaggctatggagcgctcacaaaaagggacctagcatgaccacactccagaagacccaacaagcagctgaaagagtcatatgcagatatttgcacccaaccaataaacagaagttgcttcttaattcaacctgtgattgaattaaggaaatactttaagaagctgaggagtgtgaccctgtaggaggaccagcagtctcaattaacctggacctcgagatctctcaaacactggaccatcaaccaggcagcaaataccagctgatatgaggtctccaacacatatacaacagagtacttccaggtctgggttcaatcagaaaagatacatctaaccttcaagagactggggggctccagggagtttagaggtctggttgggttgggtgtagggattggagacatcctcatggagacggggggcagggggtaggaggtataggataaggaacagttgtagagtggacaggactgggggagggaataaaatctggtgtgtaaataaataaatagacaaaaatgaaaaataagttatatttatattcaaggagtattaaaaggaacttctgtgacatgtaagaaattaaattatttatcaaattacataaaaagtgtgctacccttagaaattaagggcatataatcttagtaacact

SEQ ID NO: 4466 - DNA, 1000 bp, mus musculus
gtattccatgataaaaccaaatttgcaaaccacaaacccagccattcaaggataataaagggaaaactccaacacaaggagggaaactgctcatggctcaatatacagaaatccatcaatgtaatccactacataaacaaactcaaagaaaaagatcacataatcatttcattaaatgcatttgacaaaattcatcatcctttcatgtgaaaagtcttggaaagatcaggaactcatgacccatacctaaaaatagtgaaagcagtacacagaaaacctgtagcctcccccagcctgaagaaggcttgtgcagaccttgtcaccactgaggtggggccacctgtggtgcagctttctgacttggttggtttcttttgatgtgtcaagatgggccttcccccttttaatcacaatctcttagtaaactcacggaccttgatcagagaaaatttgtcttggtttcattcttttcttgccatctagtctctctttcagccccaagcctacatttcaggattacacggttcatgtaggctgtggtcagcttacaattacaaaaacccatagccaacatcaaactaaatgaagagaaatttgaaacaatcccactaaaatcagggacttgacaaggctgcttattctctgcctgtctagtcaatattgtacttgaagttctagctagagcactttaacaataaaaggatgtcaaaggaatacaaatgggaaagaaagaagtcaaaatatcattatttgcatatgataagatagtataactaagtgaccccaaaaattccaccagagaacctctacagctgataaacatcttcaacaatgtggctggatacaatattaactcaaagaaatcaatcacctttctctactcaaagaataaatgggctgagaaagaaattagggaaataacacccttaccatagccaaaaataatattacataccttggtgtgactctaaccaagcaagtgaaaaatctgtatgacaag

SEQ ID NO: 4467 - DNA, 1000 bp, mus musculus
cagattatagggtatggtaattggttacgaagattgaggaactaaacagagtatatgaatattgtttttatgaagtgttgaatgtgaagatataaatttattataagtcagacagcataaatttgttattttagtgagtgataatgatgttaattatcattgatgtgtggcatgacatatgttgaaggtataattgtacttgaaaaatgaaaatacacagaaaaattatttaaggaattacatattctacattgaaaaaaaaatattagcaggaagagaattacaaagttcaaggaaaacatgaaaaacaggataaataggtgtgtttaattttcaaaaggtttaaagagaatatataaagttataacttcataaactccaagttatttatagaaaatatgggagtaaatttggaattgttgaatattgttgaatctattaagtgtgatgaacaatctattaattgttagaaatcctaaatccagaagtttagtgctcagcaatgttactgaaggtgacgagggatttgcttctagtattttcttcctaaactgattctcttgactgaccatattcactttcatggaagtcattactcacttctgcattcttcaaaggcactgactacccagacaaatttctactgaataaatcccaggatagtcttcctggctatggagtggttagagtaaagaacaatgctaaagtacagtgtcaagaggcaagtagaggagacaagatccaggtgtctgcactcggcaaggtgtcagcaaggcagaaacagagcccaagatgtttccatagacttttgttgacttcaagtcaggccagctgtggtttccaaaagaaattaaagggttgaaagatttcattaaaaatattttaataaaacacaagaatttcaagacttagaattgcttagaagaatgtaagttacacttatgttgctctctatgctcccaagccagagtaaggaaaaataacagaaccctcaatgggc

SEQ ID NO: 4468 - DNA, 1400 bp, mus musculus
tatttgtgaatttcacatcatgcaccctaaggctactcatttgctcatcccctcacacccaccctccaccattcctatttccccaacaaaaagaaaacagtaattataaaccagaaagaactctccccccatctctctctttctcccccccccccacatgtgagctgcagtgtgtcacagtgtgtcacatagttcactccaccttcgcccaaatagctttccttgcagatgttcactggagtgagtcattgttctggtttgggagcctctggcttctgctgtactatcagtactggatcctcacaaggattactcttctggatatcctgctgttgccccttgtcatggagatactgaagctttggataaacaggaacagacctttcatgagctgcagaagattataggtggggtagatgttggggtaggcaaattcagagccctagtccttggcctgggtagaagctgagctgatcaaactgccatctctcctgttcccctcacaccaggaccaacattattgtactgctgaagtgaggtactgcaatttctctccctagcactgtagccactgaagggtggcaccagatctcccattctcacaccctcagggaagctcaccagcatgcaaacggtagcatggtcagaggagcaagaaggtatgtcttccatccaatgctaagtgtagaagattggaacagccagtgctctggagtgctgcaaatgagtgtcatagccagttctatatcttcactatcatacctagctctcttatactgcacaggcaaggagtaaggccaactcttccaagtgtggtgactggcaaggggtcaagccaaatctccaaccaaaagagatgggctagctcagcataatacttagacatcaacattgcctcaggaagcagcccagaccaggggtatccatatgacctttggtggtaaaatgtaccatggaccccaatgcacaccttggctacaatagaacaaatgatctggacatggatcctggtggcagaatggacctcaatgtcatgatggcttcaggtggtagcacaagtcactgagatttattggacactggcatcatcactggccccggatatcaacatggtctaaggttgccgttcaaaccagtgatgttggatgccctttgaagaacatgagccatagacatcagcacacaccctgaatgaggtaagaccaaggacccagacatggcctttagaggtaacctgggtctgaacataaccacggcctcaggtggtcatacagcttcctcctatctacctgttcatcatactagtcttctttattggagtcaaaatttttgtataatcaggctttggtggttagcttttacctatcattatgctacaactgccaatcacctacaattga

SEQ ID NO: 4469 - DNA, 1000 bp, mus musculus
gtgtgtctgtaaccacagtaataagtgggcagagaatgttggcacttaccaaattctgtctcctcttttgttgagcagtgggtgtaggggaaagtgggaatgggagaaaacccacatccagccagagttccagtgctcagggagggtggacccggaggactgctgcacactttccaagtgggagggtgggtttctggctgtgggaagccattggacaccagcttggggggggggggagaaggaggggcagtcctagcaacagttctcagtcacaggcatcccaaacacccacagaagagctgagaacagaatgggagccccaggggccgaaagtagaagagggcagggagagagggggcactgggtggtttccatgcagcagagagttcctcgcctggtccatggctggaagacaggaaggcctttaagagagaggttagacactgcttgttaggggaaagcctgtcccagcgttaaagtacagcaggccttgatggtcagagacagtctatggttttagagcttcattgtagaaaggcagggagaaagagagaaggtagaaagatggagagagactggcagtggccacgtggaaagaggggtgagagagggagggacagagagaagaaggtctagaggggagagtaggaaatgtgacagcttaaagagagtgaggagaggccaagcagctcattttatagtgggctagactatcttgctattgacaggtaactgtgcggtggagcatacctggctattgtcaggtaactatggggacagagtctagccagaattccagaagcttgggacattgtctgcatgacttatagttacagaattatggagttgggggctctgtggtgtcaggcacctgtctctgggaacgtggttcgctgtttcttcccaaatagagttttctactgggttgccagaacaagtctcattcaaccaaaataggctgcctttcacgtctccacattcttttagcaagatatctact

SEQ ID NO: 4470 - DNA, 1000 bp, mus musculus
tcttgttttcctgcaattctttaaggaatttttgtgcttcctctgtaacttcttctacctgttttgtagtgttctcctgtatttctttaagtgagttattaaagtccttcttgatgtcctctaccatcatgatgagataagcttttaaatctgggtctatcttgtcgggtgttgtggggtggccaggactgtgtggggtgggaatgctgtgttctgatgatggtgagtgatcttggtttctgttagtaagatccttgtgtttgcctttcgccatctggtaatctctggagttagttgttatagttgtttctggttagagcttgttcctcaggtgattatgttagcctctatcagcagacctgggaaacttgatctctcctgagtttcagtggtcagagtactatctgcaggcaagctctcctcttgcagggaaggtgcccagatatctggtgttcgaacttgccttatgacagaagttgtgttccattcaccagaggtcctaagatcccgtggagagtcctctgaggaccttgggggtgtccacagactctgtgcccaaggtgcccaggtgctggtgccaactggaagggccttgtaaccctggtcaggcctgcttttctgcttccccaattaatgctgtctcaagtcccgtgagattgtattggagcagcagttgtgttccactcaccagaggttttaagatccagtggagagtcctatggggtacttgggggtgtccgcagactcagcacccaaggtcttggtgccgatcagaagggaccctcactcttctttctaacttgtttctgttctaggtttgcagtccccctcacacctacaaataactgggttctgctggataggacaagtggcgcccaatgggaggccgaggttcagaccttttaccttaggtggagattatggagtttgactcccccagagaagttcgtcatgacccaaagaagaaataagtagtggaggaccgctctcacagctcata

SEQ ID NO: 4471 - DNA, 1000 bp, mus musculus
atgtaaatatagtcctgactctgcggggcagtgagcaagggttggggtgggtggggataaagggagtgggagaaaacacacaccctgccagagttccggtgctctgggcaggcatatagggaagaactgctgcactcttccatatgacccatgtgggtgcctggctgtgtgaagccactaaatcactcagtgggtggtggacaaggcacagttctaggtaccaggttctcagccttgggcatctcatgctggacaccatgacgagctgagaacagaatgaaggccctgcgggtggctcagtcatccctggggctggagggaggagagggcagggagaaagggagtcgctgagtggttcccatgtgagcatgagtccttggtctggtcaggggctggagtgcaggaagaccttcaggcgggagggtagaccccgctccttaggggaaaccctatctcatctcatctttcaatcaagacacaaggcaggccttgatgatcagagacagtctatggttttagagctttattgtggaaagcagggggaaagagagaagggagagagaggggggggtgcatggccatggagagaggggggggaagagagagaaggagggctagagcagagagtaagaaaggtgagagcttaaagagagtgaggaggggccaagcagccccttttatagtgggctgggctatcaggtaactgtggggaggagcatacctggatatagtcaggtagctgtgagggtgcagtctagccagaattccagaagcttgggacattgtttatgtgacttatagtcacagaatcatggaattgggggctctgtggtgtcaggcacctgactctggaaacatggcttgcttttctgtcccttgtagagttttctactgggtcactggagcaagcctcattcaaccaaaataggctgcctatcagcgccccacattctccttaaggaaactgctgttttcaatagatggagatcattacacaaat

SEQ ID NO: 4472 - DNA, 1400 bp, mus musculus
ctttccaccggagtctcaaggttttctgcgtggagacgtctaatgtagcaggtcttcttctcttgagtaggccttctggagctgctttttcgctcgctgtctcactcactggagcaccttgagcctagagaacaaaggctgggaaagcagcatgtcagcactaggtacaaaggctatttttaccagtggaggggggccccctctagagtaatttataggggggtcagtctaaactgtccaggggtgtttctatccctgaagagcataaagggtaggagagctatctaatcatagcaccagtctccgctgtcaatttggtaaggatcccttaatggttctattaattttttttttacctgtcctgagctttggggcctgcgtgcacaatgtaacttttaaccgatctctaatatcttggccagtccctgatttacctgggcaacaaaggcaggtccattaccttgggaagatttcttttagaaattctacctcatcatagcacagtccttgaagcttttgactatttcttctgccaagtcagagtcctgtaacatagcagtcaaaggacctaaccacacctttgaatttcttggcccccaggccaagtcaaatactgtccataacttgatagtgctcagcgacgtatctaaagctggtctctctgatgtcataataatctttagggctccttgactgccaggatcactgctccttgggcctcctgattggcggttagatctgccacctgaatttttttagccacagtatcttaggtctttttctgcagatgtcaacagccctctttgtatattgccccgtacagtggcaaaagcatacctgttgtcagtgtagacttttctttgtcatttatagagcttgtcttaaagtcacaagttcagctttctgggcctacgtccctcaggaaggctgctggcctagatcacttgctttctgttcaccaccatactgctgtccccgccttctgcttacctttaaccttgaggctactgtcctcagaccaaggctgatctgatccttcagatcatttcttctgccagaatgtcagcgcagtgatgagtaggtgcagtctcacgcagtgggacagcaggtggaatgaagcgaagatcactcatttagacaacaaaaagctctgatgtgtcacaggagcgttggtaatgctttcaagagtgtgggatgccactacagttatttgctgtcccagagtgagcttatcagcatccttgacaagcagattatggcagcaatagctttcaggcaagaaaaccacccgctggcaacagggtgtaacttcttggataggtaagtcactggccttttttaaagtcccaaagtctgagtaaggactcctctggtgacccctgctctctcttttacataaa

SEQ ID NO: 4473 - DNA, 1600 bp, mus musculus
tttgctcatttaaaccaaacaaaattcttaatttttctagctgtaatttcaaaagaggagcaccttgtcacctgatgaatccaatttttgtaggaaaaacagccatctgttcccttaccatagaactttgagaagctgctggtccctataagaacagcatttataatcagtgtctagcagggcttctctagccacactagattcctaactacaggtgcagggtttcaaagaccaattaatactgtttattttattttatttttttattaccaaattatctccagatagtcggagagtactgcttttctcaaaacccattttctcacatctcaggtgtaaactatctctagtcagggtataaagcacctatgagaattacctttgtttctgtagattttcacatagctctaaacacgtacacaaaaacacatagaacagaaaccaacaaatccagacacactcgaccctttcttgtcctccacaagcaggcaaaagaattagacgatgttggagggggaagcttccgcttcaacagaactcggtccctctgaccgatctccggagacagccaggcgtccctgactctccctacctcccagggcgtcccccagggccacagcctgtggtcctcttagcacgtctgccgaccacagtcctccggtccttacggcccaaaaggacagctgcaaatacagacgcgcgcatttcagaaaaccccatcaccccatcgtctacaaacaccgtcgtccacttttacctagacaaccaaaaccagagaatctcacttgtttctcactttgccaggtgtaaaaccaaagcacgaggaggtgggactcgaacccacgatctcgtaaccctgaaaccaaagcacgaggtgggactggaacccacgatctcacaacccgaaaaccaaggcacgaggtgggactcgaacccacgatcttgtaaccctgaaaccaagacacaaattcaataaactcagatggatccaaactcagactttgccgtgcttcagaaacataggacaagacacaaacaacccaacataacaagcacatgttctaatgttcgttttagaaaacagacactcaaaacagatacaccggccggcacacacacaagaggggatccccatacctccaagtcggttctcgggtgtgaggggtggtcgcgtttcccggccaacgcaccaaatgaaagacccacaacgtgaggactcccccacgttctgactcaggagaggcgacaccccaaaatcaccaacgagaaaacggtcttgttgtaaattgcaagaggatttttattcaagagcgctctcgggcccacggtcatacaccacgcaggggtagaggactgtggcgccctgagtagctgggtaagggggtatttaaaggaagaaactgaaactcaaggaagtggggagggctttgttggaagataccaaagataccagttaagagtcacaaggaagtgtaaagttacaagagtcacaaggaatagctggtaattgttaactctcaagacagcttctaagagcccctaacaatagcacatttgcattgcaggttctggtaatggccagggtgactttctttgaatg

SEQ ID NO: 4474 - DNA, 1200 bp, mus musculus
taataaacctgcatggctagcctagcagttcttttaggctggactcaataaatcaatagtaaattcaattttatcatctcacatataaaaattctctcactatagacacttatatgctaagtttcatgtttttaaaatatacagttgtttgttgggaactaatgagggttaggggaaagaggagggagggaggctagcccacgtccagccagagttcctcctgtgctcttggcaggcggacatgggagggctgccagaggctgtccacttggcccgggtgggcatctaagccattgaccccacttgacagggggtggacaaggggcatccccctaccagggaccctgaggtgataccctcggcccatatgagaaagagggctaagcgagagaggttcacatgtaggtgagggtctttagtctaggtcttgactggagcacaggaaggccttccattaggagattagaaatggctcattagagcagagcctatcccatcttccaagcacagcagaccttgatgaacagagacagtctatggttttagagctttattgttagaaaagcagggagaaaggagagagggagagagagagagagagagagagagagagagagagagagagagagagagagagagagagagagaccggctatggccaagaggagagaagcgggaaaaggagaggaaaagaagaaaggctagagtgtaagaaagagagtgtaagagggagagagagtaagaaagtgagaggatagaagatgagtgaagagagtagaggtaagagagcgaggtggggccaaccagccactcttatggtgggatgttatctttactgttgctaggtaactgggtaggagtgtagcctgaaggtcagaagcttgggacattgtctatgtgactgctagacacacttctcctgtggggctgtgggggcggtaacttcgacaggagccttgaaaccaggagacatgagggaacatgccatgtaggtgaattatcaccactccagggttcagacttcagctcaactggagacaagacggtctgtacatagaccaatgccccacagttgtttatgtctgatattcatttattaatatttggttaaagtatatggtaactaacattgcaggtgcatataaaaacaaaaaagtagttatagaacagagcaaagggagcttgcattagagagcttga

SEQ ID NO: 4475 - DNA, 1000 bp, mus musculus
gctttgaaactcctttttcacaacagcacacttcctttttctaaccaatctagcttagattaagtcactagctatattgagcccatttcttttaattaaaattaaaagactgccatctctttacgagtgttcttttgctgtaaaagagacatcgtgaccacagcagctctctgagcatttaattgaggtctgcttacagtttcggatgtttaatccattattatcactccagaagcatgtcaggacacatgtagacatggaagcttggatttcaacatctagatccagagacagcagcaaagagagactttgaacctagagggagcttttgaaacttcaaagtccaccagtagagattcacttcctccaagagcatacctctgaatagtggaatagtgccactgcctggcgactgagcattcaaatctatgtgcttgtaggcatccactcttattaaaaccaccacaccatccattagatgtgaagagaaatctaatgctatcttcaagtacagatttcattagttactcaagaagaaaaacacaaataatgtgtgttttaagctataaacattggggatactcacagccaaccattagactgagcatggggtccccagtgcggtccccaagagagaagttagaaaagggactgaaggagctgaaggggtttgcaaccccataggaaaaccaacaatatcaaccaaccagacccgatcccccctacccagagctcccaggagccaccaaccaaagagtacacatggagggacccatggctctagctgcatatttagcagaggatggccttgttagtcatcaatgggaggagaggccgttggtcctgtgaaggctcagatgcacctggaattcgagggcagtgaggtgagagtgggtgggtgggttgaggagtaccctcattagaagcaatgggagggaatatggggtagggaatttcgggagaggtgtgataccgtgaaaggggataatatttaaaatat

SEQ ID NO: 4476 - DNA, 1000 bp, mus musculus
tcctgtgctactcccagctactctgccccagcagccgtgccgaccagttcttatctcctggagactctcagattcagagcttcaacatctctccagccagcacagtttgttcccactcgcgagtctctaccgtgccagctccatgtgtcaaatcccccatgacctttgtggtgcacatctgacaaacccatgcttagccaccatacctttctttcttgaactcagatgaactgtatgaaggaaaacacaacacaaacttacttcagaaacaacagtactcaatcgctgggcacaaaaactaaaatcctaacttgtcagccttattgaatctaaatcatccagtgacgaatcctgatagatccaccagtgaaaccgggagacatagctacaccttgtcctcatccaatcctagtctcaaaggatcctctctctcctgcttcctctcttcctctgtccaacccagatgtcctgcattctcacccagtgactggctccttcattcattaggggatggttcagaagaagtcacctgagcaactgactcattccttgttcactacccctcccaaaaaatcagaattagcatcaaaatacaagaaaccccagggctatcaacaacaccatttccaggtttctccctccccagaaaccctctatttcatctaccctccccagtttctatgagggtgtttggccacccacccagtcacccactcccacctctcctccctggcattaccctacactgggacatcaagcattcacaggaacaaggacttctcctcccattgatgtccaaaaaggccatcctctactacataggcagctggagccatgggtccctccataggtactccttggttggtgcttaaatccctgggaggtctgggaggggcaggggcggggagagtctggttgcttgatgttgtcctttttagggggttgcaagtcctttcagctccttcattcctttctttactcctctataggggacctcatg

SEQ ID NO: 4477 - DNA, 1000 bp, mus musculus
atttctgaacatgaacttcatcatctctgaaatggttttaatgataaaatcatatctgactgcactcatggtgcttataaatttcatcatatcattatttacatgataatgcaatatgggaaattaataatgcacatgcaaaacagtgtaaattaatcttttgtaattaatccattaaatatgtataactaatacacatttagaaatgtactgttggttatcaaacaattttatagattgatcaatgtctaattatatatatatatattttttgcttatttatttatttatttattttaaactccagattttattcccctcccggtccacccttcgactcttccacatcctctccgtgcacctctgtctccatgaggatgtccccaccccccattccccaccccatgaatcctctaaacttcctggagccatcagcctcttgaggattaggcgcatcttctctgaataaacccagacctggcagtcctctgctgtgtatgtgttggggcctcatatcagctggtgtatgctgtctctttggtggtccagtagtttgagagacctcgggggtccagaataattgagattactggtcctcctatagggttgccctcctcctcagcttctttcagcctttgctaattcaacaacaggagtcagctgcttctgtccactgattgggtgcaaatatctgcatctgactcagctgcttgttgggtctttcagaggacaaacatgataggtccctttttgtgagcactccatactctcagtaatagtgtcaggtcttaagttcaacaaaggtgagattaatgtaaacctaaccatatggatagaatatatgcatattttgcttgtagtctgataaaatttggctataactaggaataacaaaaacttcatatgttaagaacatttaagggttggatttcttatgttgattctggtgtatctacaaaacagaagtattttgatcatcatcttacacacacacacacac

SEQ ID NO: 4478 - DNA, 1400 bp, mus musculus
caagaaggaagaccaaagtgtggatactttgttccactttagaatggggaacaaaatacccatggtgggagttacagaaacaaagttctaagctgagaaggaaggaaggaccatccggagagtgccccaccaggagatccatcccataaacagccaccaaaaccagacactattgcatatgccagcaagattttgccgacatgaccctgctatagctttctcttgtgaggctatgccagagcctggcaaatacagaagtggatgctgacagtcttctattggatggaacataggttcccccaatggaggagctagagaaaatacccaaggagctgaaggagtctgcaaccttataggagggacaacaatatgaactaaccagtacctccagagctcgttgctctagctgcatatgtagcagaagatgacctagtcgggcatcaatgggagaaaaggcccttggtcttgagaacattatatgccactgtgcaggggaatgccagggccaggaagtgggagtgggtgggttggggaacagggcaggggagggtataggggacttttgggatagaatttgaaatgtaaatgaagaaaatatctaataaaaataaaatgaaaaaatatggttgatcaagaaaaacagaacaatattgtcatgcatttatttatttatttttgcttccttccacctgttatgttggcattcatacctgtaagggatcaggaaaggggaatagaaatgtaaggaaaaaatgggacattagggaaaacagcctgccacgcactctcaaaaagtgacacaaagaaaccatagagaagttctgttttatctacaaagtatcttgtgcagctctctcaaacagcctttactgggatcctcttgttggcactgaaggcaaacatcaccacgttgagtcaaataattcccgtacctcttagattctgtttttgtagtggtgcttcagattgaggtccgcacgtgttccctctactacttcctaccccaacctacattatgaatgggaaacgtgatgaatgaaaatgctgaacgaaagagaactggtctgcagaacagtgcccagtacactgacggtgctgcaacctgaaggctgaatgaagctggatgtgggaagtggtggacaaaggaaccggcgcagaagcaggtgcgaagcatatctcttactccaggaagctcttgatgctcccatttgtaagaagaattacttagtcttaatcagcacaaaacacattcattaacacaaatgaaactgcaatgtgggtgaaatattttttcagacaatgtttttgccagttaagtgaagaaatgataccattctctcctttaaaaaattccagacttggccttcgtgcttcacagagcagtactgacagccttcttt

SEQ ID NO: 4479 - DNA, 1200 bp, mus musculus
cttatcaactgtggatataacaatctaattgaagtcaatatatactatgaaattaaggtgtctttatcatgcatattatactatacattaaaattctggttttaaaatttatttaaacttttttttacagtccagattttatttccatcccagtccatcctctgactgttccatataccatacctgccccctgccatctccacaaggatgtccccactccccacccctgacctcaccagacctcctcactccctggggtctccagacccttgagggttaagtgcatcttctctgactgaatccaaaccttagagtcctctgctgtatacctgtttgggacttcatattagctggtatatgctacctggttggtgactcagtgattgagagatctcggggtccaggttagttgagactgctggtcctcctacagggtcacccttctcctcagcttcttctatcatttcctaattcaattgcaggggtcagaagtttctttccattggttgggtgcaaatatctgcatctaactctttcagctgcttgtggaggacaatcgtgagcacaccataaactcagtaatagtgtcagaccttgggacctccccttgaactggatcccaatttgggtctgttgctagacctccttttcctcggaaccttctgcattattgttcctgcagttctttcaaacaagaacaattatggattagagcttttgactgtggaatggcgaccctatccctcatttgatgccccgtctttgtgctggaggtgggctctacaaggtccctcttcccattgtagggcatttcattttaggcccctcccttagagtcctgagagttccctacctcccaggtctctggtacattctgtaatctacccacctcctacctcctgaggttgcatgtttccattctttctgctggccctcagtgtttaagtcctattccctctgccctcatacacccaatacctgattatcttcccctcttcccctccctccttccaaccttcccacctcttgtgattgcttttttctctcttccaagtggaattgaggagtcctcacttgggctttttaacttgttaaacttttttgagttctgtggattctgtaccttttatctatctatctatctatctatctatctacctacctatctatctatttatttttttgctaatatccacgtgt

SEQ ID NO: 4480 - DNA, 1200 bp, mus musculus
atgtctgtcaccctcaatagacagaagaataaaaggaaacatttcctgcagaaaataataaatcaaaacattctagttaaggaaaatggtatacagtttgtggttagttgtattttgctatggaattttgagagttgaatttctagttttagggatatatctgattgttttggggaaaatatcagatatttaaaatgagagaataatattaggtgagagacatcacaagtgtcataattattaaaggaacacaactatagtaagacttcggtttgggaaggacattgaatgtattttgtggtcatcatcatggttttaagaggcatgaccatgaaagacatgacttctctagagtcttatttatatatccatgtatcttatatttttggttgtgagcctagcctttaatggctgagccatctccccatccgtatttctccatttctcaactgcaaatatttatgtgtaggaaatttttggcatcaattatattaatttattatttaacaatcagagaagaaatgctaagaagaaaacatctaagagcagcagatagatacatcatcgaatcaggtgctttaaaacacccaacggaaatgccaggagcaaccaaataagagcaagcaaaagtaaaattaccaaactgtgtgtttaaaatagtcaccagaaattgcctggtaaatcaactctgaaacagttggactggcagatctccaggaacagcggagtattctctccgcagacaagtctcctccagcatgttcctcctgaggcagttttgtacaatgggatcaaaatagtaacatggggctggagagatggcccagtgattaaatgcacttggggctttcaaagggtactagggtttggaccccagtactcacagggtaactcctgggatcgtatgctctcctctgacctcctgcactagacataaagagtgcacttataaagaggtggtggggaatagcaacctcttttgagaaatttcccctttttccttcaagctcacattgtttctaaggctctatttgctttttgattgattgattgattgattgattgattgtctattccttgttaaagagccagggagcaaccccacccccagaacagagtgttttcaaagacactggaattaaacatgtttttctctcagaatttacttaccagtatgcttaaagagcacaggacaatttg

SEQ ID NO: 4481 - DNA, 1200 bp, mus musculus
atcttaatatgccagtcattttagggttcatagtcaataatgctgggtaggtcaactaattacatttctcacttggcaatttgtttagaatcttctaatacaatgaaagctagtcctcggggaggaaggtttaaggtcagttctaggttaaatcctccaagtcctgtatacaaagtatattgtcttcagcaatgggatagtggctcagtctgtaaaagccctaagtgtccaggttagttgactctgttggctatcctgtggagctcctctggatattccctctgcagccctcaatccttcccccatctcttccataagactccctgagctctagacaatgttcagctgaggggctctgcatctgtttcagccagctgcaggatggaacctctcaaagaacagttatgctcctgtcttcaagcataacagtatcattaatagtgttagggataagtgcttacctttgggatgagtctaaagctgggccagttattactaagcccaacaaaatctcttctccatcttttctcctgcatttcttgtagacagaacaaattttgggatcaaagtttggcaggtgattgctgtctttacccttccactaggggtcctgcctgtctatgggaagtggccatttgaagttccatatcccccaactctcgggatctcatctagagtcacctctctaaactccctggaacctcccccatcccaagtctctggcatgtcctaacaatgcctcttgacaccccttaagtcctccaccccaccagctattgatttccattcatcctcctggccctctgaccctttgtctgttctcacacctgatcctaaacttccaattcccatcgtcatctcttctctcacccaagtgcatctttccatctgtctcctttgaacattttatttccccttctaagtgaaactcaaccatcctcacttgggcctttccttttccttagcttcttttggtctgggttgtagtgtgagtgtcctgtagtttatggctaatattcacttattagtgtgtagatactatacctgtattttgagtctttacaggagattttcagtttcatgatgtccatttatcaattattgatcttagtgtctgagtaactggcgttatgttcaggaagttgtatcctgtgcttatctgtacaaggctatcccccactctttcttctcttagatttt

SEQ ID NO: 4482 - DNA, 1000 bp, mus musculus
tgcaaaagaactaactgaatatatctttccttgcctgtagctataaatcttcaacccaattatgtcccagcaatgaaaacacaacacaattaatgtgaacacatgctgtgaacctagattgggcagatctactgctgaaagaacctagtggggaaacccccactcaattcttgattcggcgcacacccaagaatcatgaacagacgaccaacttgatgtaagaacacaaggtagtttaatggcggagctccgggcctacacgtatctcccacaggagacagaggtgttgaccacatggtggagccataatggtggagctccggttcgaaacgtatctcacacaggagacagtggtttcgaccccgacgcttggaagctaggggtttttatagaaaaggggtggggctgggggaggaattagcacggtttcacatgattggtccatgtaaacatcaacagatgtttcagtcaaaagataggagctgtataacatcacacccttaaaaaagtccatgccttaccatacttctacagtgatgttttaagatgaagtattgcaatacatcaagttttatttcctttcactgctacactaccatcttccacatctatgagaccccttagaacttgcagtttctccaggccacgtgcttctgctctgcttttcattgtcttcctcttcctctgagtcctcttcctcttccactttctccatctattctctccccacctccctctccaccttccctttatttgaccaatcatcagctctcctttattttacaaattaaggtaggaatcaggtttacaggaaatcacctgagtgctgactcattccttattcagagcccttcaaaggagaatagaattaacataaaaaataattagccccagggctatcatgagtcttgctaatcattactctcattaatatctattaattatcaaataaaccaaaaagaaattaaattagagatatcagtactatctctacagaagt

SEQ ID NO: 4483 - DNA, 1200 bp, mus musculus
ggagagatagggacagaaagaaggaaaaaaactacacaaatgaataagtagcaataaaaagaaaacctaaaataatatgagaagaattttcattttatttatttatttacattctagtcattgccctcctttctaggtccccctcatttttcctcccccttgcctccaagagactgctttcccccatcagtcctctccctctttgtgggacctcaagtctctcaaggattaagcccatcttctcccactgaggacagaccaggcagaccgctgctataaatgtgccaggggcctcagaccacctggcccatggatgctactagttggtggctcagtctctgggaactctctggggtctgggttagttgagactgctggtcttcctatggtgttgctctccccttcagttccttcaatcctttccctaattcaaccataggggttcccacattcagcctaattgttgggtataagtatttgcagcatctttcccaatcagctgctggtaggacctctcagaggaaaggaatgccaagctagatggatcccaagtatggccagtcattggaccacctttttttctgtctcttctccacttttatctctgcagtttttttaggcaagaacaattctgggtcagaaattttgactgtgggttggtaaccctgtccctccacttgaggccctatctatctactggaggtggactcttccagttctccctctctccaatgttgggcattttggctaaggtcatcttcaatgaatcctgagagtgtctcacctcctgggtgtctggtactctctatagggtggtcccacctcatttttaatagctgaatagtatttcattgtgtaaatgacccacatcttctctatccattctttggttgagagacatattggttgtttccagcttctggctattaccaaaaagcctgctgtgaacaagatggagctcatgtccttgtggcatgctgaggcaacttttgggtagatacccaggagtggtatagatgggtcttcaggtaaaactatttccaattttctgaggagccaccagatagattttcatagtggttgtaccagtttgcaatcccagcagcagtggaggagtgacccatgtgctgtcacttgggtttttgatcttcgtcactctgattagtgtgagatggaatctcagggtcattttgatttgca

SEQ ID NO: 4484 - DNA, 1000 bp, mus musculus
gcagttccaatagagtctttcaatgcaggtaacctgaaaccagaagcagcctctaaatgctcttatatcagccattagcagccaagtcaactatattgagaaaaattatatccagtaacttttagaatccccagctgttccttctaaaggtagttttaaagtttaatagcttgtcaatgtgatttttatcttctattggcatactgttttattataacaaatgaatctatgttataaatatttataacatttgcaaataaagagatccataacaacttaaacctaatatttatttatgaaattatttccatgtattttgttagcttatacaatatttatttactcggtagagaatgcagttttatttcccatgtcaagagcgatatggaaaagtaatatcacacgtctctgctgaagaaagtttctgtttaagtagaaaataataaactctagaagcagaatgattatgatagcgcacttactttgaacaatagaaatgctataaatatttacagcatccacatattttaatactctttcaacagtgtctttgagaagcctctatttacctcccacttggaagtctcataatattttctgctgcttgtcttctgcaatacctattagcacatttatttagtaaggacaacaaaatcagggatagaataaatcaacaactaaccccaggcatggcccgggggtgccttttttgatattacacagtggttgtcatgtacatagaacatccaacaaacgatcgaaagagtaagcaactctcagattgtggtgtcttgggaggaaggtcatggtgtgaatgtagcattctctccttacagcatctagatgcctggatggaactcagttcatcaagcttaaaaagtgtaatttcatgctgaggtctctcatcagcctttaacagagctttaagaaaataaagtttgaaactcaagaaaaatgaagactgaagtgtggacactatgcccctccttagaagtgggaa

SEQ ID NO: 4485 - DNA, 1000 bp, mus musculus
agaggaggcggttgccttggcaaccgtatctgatagcagaaaatatggccgacaggtacacagaaagatccagggagcaaagcctccaggctgctgctgctgtcagtgttatgcactcaggacgcattaacaaacgccaaggtttacactgacacctaatttatgaccggggaaaatttctgagtagcatttatctagttccaatcaatgcagtttataatttggtaccgtgaggcaatcgctgagcatgaaatctgacttccagcataaacaagcaaccaccacaaatgactgtcaaggtagacccgaaacatagaaaggtagctttgaggcaagatcgattcgcacgttcattgattcccacccacgtgtatgcttactcagattccccagtcacactccattctctgttcttttacagggatgcaacttttaaggcaagttatcaaactgggcagaggattcattactttgatttataaaaggatttgtcatttatgttcatatctactttttaaagagtaagtgttgctcaatgttgcctgagccctcagtcctgcccagcatcccccttgggggccagtgggtaagaaggtgcagaatctatgtctcagatgagaaaacagcaggaggctcgttcactaagtctcagggcgtgccctttataccctctaccctcttcccattggttccaagcaagggtgtcctccaggtagcaggtcctgattggctgtcactgtctacatcaccaatctcaggtaggcttcattttggtcctcatggggaagtttctttcctctgtggctatgctgccccacttgctgtttacctacattcacggggaagtgagcaccaccttggcagcagtgccttctgttcctcctacatctcaaccgtctatgtgtactcagaaccttgttctaatcctgaaccctacttcaacaatctaacacataacggcatatgttaataatggatccttgacgacaaagggtgagag

SEQ ID NO: 4486 - DNA, 1400 bp, mus musculus
gagacactgtctagcccacactggggagcaaagatgtatgtctgttattttctatcacacgttcaggttctaaagcagtttaagaaggctgagttctgaatgctacaggcttgaggctgtttgaaagccatacacaataggaaccagtaaagtgtagttgaggttaagtcagacctcatcagacatctagttagacattatgatcactacacacacacacacacacacacacacacacacacacattttgctacattcttttcccaatttaagaatgatttgtttctcaggtaggaaaaaaatcttaaagtgattttgacacgtcagttgtataattatacacacacacacatcatttttgcctcactttttgtaatgacctgcaccctggttgtctgtgtcctaaaggagtttgagccgataggagaggccgccatgcctatctgcatggtgaatttagtaaaaattgcacttaggtgaatatgttctaggctttggcctctgtctgcgacagtcattcactacttggacttcataaaataaaggattcttactttgtgctaatacaaaaccatgaccaaaaccaacacagagaagaatttatttgggcttaccgttccacagggagagtccataacaacagggcgggcatgaccacatatgaccagtgcaggaagctggtggatcctactgtatcagcacacaagaagcagagggggctggtcagaagtgggacaaggctatacactctcaaaactagatctcagggatggacttgcaccagcgaggttccatatcctaaaagtcacatcacctctccaggcagtacccaggtgagaaccaaatgtcaaacacgtgagcctgggcggggagggggtcatttctcattcaaaccactccaccaagacgtgggacacagacaaccggccaccttcctggtgagtgcacaggggtcctccagcccgagaggtttgtgcctcaggccccagcgggagcctccttggctccaggactcctcggagggcaggctgcacgggtgacagtgtggaatacagaggccagccatttctgggacaggcgagagctacagagcttctgaggcggcgccatcttcggctccagacaaccggccaccttcctggtcgaagcaacacagcttcggggaaagatcctgttttgggccttcatcttcagccaggaggaggtccaaacaccagataactgtgcaccttccctgaaagaggagagcttgcctgcagagacttctctgaccactgaaactcagagaagagagctagtctcccacatctgctgatagagggtaacaaaatcaacagaggaacaatctctaaacaaagacaactataacaactaactccagagattgccagatggcgaaa

SEQ ID NO: 4487 - DNA, 1200 bp, mus musculus
gttcacagacctcctgagggagcatggccatgatatgcagaacatgaaagaacatctgggtatagacaaacagggtttcctgagtaagatccccttcttgtccttgggcccagggacccactgactgcatcaacctgactgcatccaggacactggtcagactgttacagaggagtgtgaccacatggctccaactgtccaaaggaagccagttacaacagctctggctgcagagaaactggaacactctcaaagaaagaacagagagctgaagcaaaaggcttcaggttgagcaggggaacaaactgaatatactctagactgtaagggacatgaagaagctctttctccaatagcttcctggtcagctgctgaaggtactgccattcctgggggctacaccaaggcatgacttgtaccagggccaccagaaagcccttgctaaacagtctgacctcctcgggattgcccacatccatcagcagaagggaaagcatctggtcagagatactgctggagactgaacagcactccatccaggcgagaaggcccgtgccaggcccatacccttcgtggacctgtgaggtccactgggcctcagagagtttacagatctcaaaaagggtagctggcacctcacacttgaagtggccttcaaagaagttcttcagtctcaggcccacagtccaatctagctggtctaatttgcggtggagccaggacagggacttggcccaggtgtctggggagaaggtttctgtgttggctagcacgatctcacagaggagttccagaatgtgggtcacaagatccttgctgtccagcgtgaggtagcgcttctcccgggggagctgccagaacttgctgaagctgtccaggagctggcacaagctgaagagcagagggaatggggagcagctctgcagccaatactcttccaggcctgcattggcttcgagggtctggatgaagagcttcagactcaggcctacctcctccatgtccaacatcaagaaaggcaggacagactccttgagcacctcatctggctccagaagagcagccacaggatcggcctcctttcttataccatctatgactatctgtccagggtggtaccactgcctatagggtggtccctccaatatcaatcactgatcaagaaaatttactacaggcttacttccaggctaatctggt

SEQ ID NO: 4488 - DNA, 1200 bp, mus musculus
ctgtagctaatgctcgcatctatggttcaagatttctttcctagggtttctatctctagcgttgcctcactttgggttttctttattgtgtctacttccctttttaggtctagtatggttttgttcatttccatcacctgtttggatgtgttttcctgtttatctttaaggacttccacctctttggttgtattttcctgtttttctttaaggacttgtaactctttagcagtgttctcctgtgttcttctgtatttctttaagtgagttattaaagtccttcttgatgtcctctaccatcatcatgagatatgcttttaaatccgggtctagcttttcgggtgtgttggggcacccaggtctggctgaggtggaagtgctgggttctgataatggtgagtggtcttggtttctgttagtaagattcttacatttgcctttcaccacctcgtaatctctgaagttagttgttatagttgtctctggttagagattgttcctcttgtgattctgttagcctctatcagcagacctggaagactagatctctcctgaatttcagtggttagagcactctctgcagacaatctctcctcttgcagggaaggtggaagatatctggcattcggaactgcctcctggcagaagatgaaggcccgaaacagggcttgtcccggaatctgtgtagcttctgtagtccacactctcacctgtgcagagtagtcttggcgttatccgggaaccaagatgtctcccccagatgctgtggcaaagccttcccgggcgggccagacacctctcctctggcaggaaggtgcctggatgtctggagcccaaaacaggatctgccccagaagctctgtggcttttgcctgtcccagaagctgttagtctctgcagtccacactctgacctgtgcagaccagtcttggcagctacaaactctttataagcatctttactgaagaaagtcactaaaatacttaagtattgaaatttcaatcctcatctatttgtcatgtacacttgattatagaaaactttaatttatttaattagtaaataacaatttgagctgatcattctatcccctaaatcaatgtcttttttttaacatgggtttttttttaattaggtattttcttcatttacgtttccaatgctatcccaaaagtcccccataccctgccccccactccc

SEQ ID NO: 4489 - DNA, 1600 bp, mus musculus
caacaacaacaacaacaaaccaagataggtacacctttagcaaaactaaccaaaaggcacagagacagtatacaaattaacaaaatcagaaaggaaaagggaggcaaaacaacagaaactgaagaaattcaaacagttattaggcctgacttcacaatcctatacttcacaaaactggaaaatctaagtgaaatggatgaatttctagacatataccacaaaccaaagttaaatcaagatcaggctaagtatctaaacagtcccataacacccaaggaaatagaagcagtcattaaaagtttccaaacaaaaacaaaaacaaaaacaaaacaaaacaaaacaaaacaaaaacccttccggttggcaccagcactgggtcaccttgggtgcagaatcagtggacacccccacaattcccagaggactctccatccgatcttaggatcactggtgagtgaaacacaacttctgttccaatccaatctcatgggacctgagacagcattagggaagcagaaaaccggcctgaccaggggcacaagtcccttccagtcaggaacagcaccaggtcacctagggcggacacccccatggtccctagagcactctccatgcgatcttaggatcactggtgagcagaacacaacatcagttccaatccaattgtgatgggcccatgacagcagaaacaaggacaccagagcccttcctgaccagaggctcaggttacttttgatcagttctggtttaccttggtttcaaacagaccagacagctccaaggtccacaaaggagataccacttccaggcactgtaacatgctcaggatcttaggacacaggatcctgggaaaacaggagctaggtcacaccagtatttcagggtctcagagcaagcttgactgccaaaaactctgacacacccagaatctcaggttcacaggaacccacaatcagaggatcacagagaaagctggactctgaggagtcctgaatcaactgggattataggaaggtcaagctccaatctgatatattgagggcagcaagcacttgagataatcagatggcaggaggcaagcataagtacagaagcaatagaaaccaaggttacttgtcatcatcagaaccaaactattccaccatagcaagtcctggatacaccatcacaccagaaaagcaagatgtggatctaaagacacttctcatgatgatgatggaggactttaagaaggaaatacagtttcctgggcatatacccagaagatgttccaactggtaataaggacacatgctccactatgttcacagaagcctcatttataatagccagaagctagaaagaacccagatgtccctcaacagagaaatggatacagaaaatgtggtatatttacacaatcgagtactactcagctattaaaaacaataaatttatgaaattcttgggcaaatggatgtatctggaggatatcatcctgagtgaggtaacccaatcacaaaataagtcacttgatatgcactcactgataagtggatattagcccagaaacctagaatacccaagatacaacatcgaaaacacaagaaaattaagaagg

SEQ ID NO: 4490 - DNA, 1000 bp, mus musculus
gaaataaaaacatttatttaagtgagtgaaagcaaaggggcacacacctaacctgcaccactcgggctggatgggtatcttctatgaattgtctggcgagcacaagtcccagggtttcatccccaacatctatataaaagcttgtcatgagtacaaatgcttgtaactccagcattggaggacagagacagaaagattttgagagctcactgatcagaaaacctattcaaactggtgagcttcaggtgtgtgatagacactgggtcgaaagaagatgacataaagtgttagagcaggatatctcatgttctcctctggattcgttgtgtacacatatacctgtacatatgcacaaactactctctctctctctctctccctctctctctctctctctcatatgcacacacataaacaaatttaaaaaattaagagaaagttatctatagtcttttattttcaaaacctacttttaataaaggttcttaaatggtttaaccttccttctagtctaccacccagcagaggtagtggtaaggaaaggttaatagagaaaagaagggtgtggacctgtttagaaatagttctttgtagcaaatccaatctacactgtcaggatatgagcagttcagttcacatgtgtccagaggtagattaatccactcgaaaaaaaaaacaccattcagcaatcagcaacagtagttcaatgtagaagaaaccttgtggctcttccaattggcctgtagaaacagcaagagggctctggaacaccaccagacagtctttggtgacatttttctctatgaagtcacaacaatggtgaccagcaaagagtggcaagacaaaccaataccacaaagtgttgtcagagaagggcaacttcagcaaagcccaatgatgaccagcaaaaaatagcaaggtgaaccaatgccatacagtgtcatccactgtctgttgtattgcatttatgctctttccagacatcacgtgttctctcaag

SEQ ID NO: 4491 - DNA, 1400 bp, mus musculus
tcaaagtagctagtaattttggtttttccagttactgccaatgaacttatatttcaatggattcattttaatgctaaatatttaactaattctagtaaagcattttgtcataaaggcagatctaaaaattttagttaatgaaacccttgattttattcgaagagtcaatgtgatgtagccttttcactggtgtttataggtagagataaaggagagatggaatatttcaagatggaacatagactttacctgatcaagttttggatggaacctcatcctagtaagttcacctatatcatctgaaacagcagtcacagaacataatctatacaatggtgcgactgagaactcacacatttgtatgattttaaacaatgactatgactatatggatctcccaggtctctaaaatgtcatgggttataatatctgctcatagtctgttacactactagaagagagagaacagccataatggaaggaagatagttcattatgggcatgcactgcctgaccaatacagaggtagatgctcacagccaataacaggactgatcacaggaaccccaatggagtagttaggggaaggactgaaggagctgaacgggattgcaaccccataggaagaacaacaatatcaactaaagggacgtcctcagattcctagggacaaaaccaccaaccaaagagtacacatggagggacccatggctctagttgcatatgtagctgagaacagccttatttggcaaccatgggaggagaaacccttggtcctgtgaaggcttgatgccccagtgtaggggaatgatagggtggtgaggcaggaatgggtaggtgggtaggtaagcaggggttgggggatgggataggaaagagtgtttgaggaggggaaaccgggaagggggccaacacttggaatgtaaatacattacataaccaagaaaaatattttgaaatgaaaatatctgaacctttgcaattcccttgctttcaggccactctaaaggtactaaatgtctgtgatgctccaccctgtgatagactgcaaagactaatgccaaataagaatgactgaaccatataagaacataagccaaaatgaaccttttatattcataagttaacttaagctttttttttaatgctattttgttgttgttgttgttgtttttaaagtgatgggaaagagaaagtgtgtaccatgctgttttgtaaatataatgttaattttgctgaatttcactcttcttgtgatatttttgtcattaatatttaaacttcttttatgttgctataaaaacaaattgtagctattacatttgtatcaaaggaagttttaattactaatagattttttaaattcaaacccaaatatgcttgataccaaataatgctca

SEQ ID NO: 4492 - DNA, 1200 bp, mus musculus
tacatgtaaaataaatagtttttaatatgaatgacaataaggctcttgctcagtcaaaaaacaaaggaagaaatgttctgtgtgatctggatggggatcatcctggaaactcatgtcccttaaacagtttctttatttgatatatggaatctaaataacgatgcaatacacaactctaaatgaggaaataatagtaacagtatctcaacctctcccataaatgaatgtgcagatttatttttaaaaattattttatttatttataccccaaatgttgtgcctgcccccagaccccattcccagagttcatcaccctatcccacctcccctatgcctctgagagggtgctccccccaggccatacccctttcctggaacatcaagtctctataggattagacacatcctctcccactgaggccagacaaggcagtcctgtgttacacatgtgcagagggccttggaccagcccatgaatgctctttggttggtggcttagattctggaagctcccaggagtctgcattaactgacacatttggccatcctatggggttgccatccccttcagctccttcaatccttcctccaactcttccatatgggtccctgacctcagtccaacacctgactgtgtgtatctgcatctggctcagtcagctgttgctagagcctctcagaggacagctatgctaggctcctgtttgcaagcacaacagcacctgtaatagtgtcagggtttggtacctgctcatgggatggatcccaaggtgtgccagtcactggatagtctttccttcagtctctgctcttttaaaattatgtttttacaggcaagtcttaaaattcatattttgaaattttagtcaacatcagcattacagatcatgtttttaaaggtagctacacacttaggcaataaatgggaacttagcccttttttacccggtcaccatgggtccaacaatggctttgtggccatttcgttttttattatattccatagtagaattaatcatgtcacctctaagatttctagtgaaagttacaagattggcaaatgtcaggggaatttcagggaaaaaacaaagtagtctcttaactcatataaattatacttgaggaatattgtgctctgtctaaagtaagaattttactgttgtatttaagaagataaaattgatggaattgtgaagccat

SEQ ID NO: 4493 - DNA, 1000 bp, mus musculus
cccatgctatactccacagacttaaagaaaggaaggcccaaggaaaggatgcttgaattccacttagaacaggaacaaaatagtcatgtgaggcagaggaaggagaaggaatggggagcagaatatgagggcacgatcaggtgtgggaagagacaagagagaggcccagaaagccaggagaataaatggaaatagttgctgagtgttgagaggtggggtgggtaatccataggcagttcctgagacctgactcggggagacccctggagttcatgtgggcaaatttagcagggatacctaacagtggggacatggaacctggacaggttacctcctgtggccaggcagggtccccagtggaggaataaggctaacaatgtacccataaaactttggatccaaaatttgtcctgtctaaaagaaaggcagggacaaagatggagcaaagactgaagaaattgccaaccaataactgccccaacttgagaccaattccatgcacaagcacccactctagacactattcatggtactccattgtgcttacagacaggaccctagcataactgtcctctgagaggctctacccagcaactaactgaaacagatgcagatactctcagccaaacattggatgactggaggacccttttggaagagctgggggaaggactgaaggccttaaaggggatgggaactccataggaagaccaacagtgtcaactaacctggacctctgggagctctcagagactgagccaccaataaatgagcatacaatggctagacatagaccccaggcacataggtagcagagggctgccttgtcctgtctcaatgagagaggatgcacctaatcctgcaaagatttgatgtgccagagtgggggaatatcccaggggttcctaccctctcagaagtgatgggaatgggggatttgggaaggactctctgatgggggctgggaacgggtacaatgtttgggatgtgattaattaaa

SEQ ID NO: 4494 - DNA, 1800 bp, mus musculus
acaaccttagccatcaatgagatgcaaattaaaaacactgaggttttattgcacctcactcagaatgcttagatcccaaaccaaatgaccacagatgtttgcacaaatctctgtaaaagtgaacaatggttcactgcctgtaggaatgcaaactagtgaagccattgtggatcccaactagatcttgatctatcacatacctagttagaccactctcaggtgtataaacaagggacttctgtagatatagtgttcattcatgttcattgctgctcaattcacaatagataagaagtgaaaatagcctaaaactctgtaactgatgaatgattaagaaaattgtcatacatttacacaatggaatattgatctgctgttaagaagaactatgaagttcacaggtaaatagatgaacatggaaacaaccatgttgagtgaggtaaattaaacccataaaaataagcatcacatattttttttttctcattggttgttattagcttcgaatcttcaaatacctgtgttttctttggaataccaataaatatcagagttatgggatgctggagaagaaaagcactcgtcaatctcaagcagctgcgaaacctgcaaactgcagtaacagccagcctaacaaaacatcgacattgcccactggtgcaatagtggcatgcgtggcgtggagtaaccaaccactttttttttttttttttttttttttttctggttcaaagacatattttattgtgacataatcataaatattcatgtaaccatggtggtacaaataataacaataagtgtctttctttgtgtggaaagaagagtcttctaactatggatgctggaagctctaagaaaaacattagtaagtcaactacgtgctcatctggcacagtcttgggtcccctctgggcacctggaggaaagtccttcggttctcgtgccttctgctccccgagtgtgtgctagtttgacagacactaaattacagggcacaaagcaactcctccttccctttttaaataatcattttacttaacattgcgacccattcccagactgtatttgtttgtttttttttttttttttttttccattttttattaggtatttcgctcatttacatttgcaatgctataccaaaagtcccccatagccacccaccccctctcccctacccacccactccccttttatggccctggcgttcccctgtactggggcatataaagtttgcgtgtccaatgggcctctctttccagtgatggccgactaggccatcttttgatgcatatgcagctagagtcaagagctccggggtactggttagttcataatgttgttccacctatagggttgcagatccctttagcttctttggtactttctctagctccttcattgggggccatgtgatccatccaatagccgactgtgagcatccacttctatgtttgctaggcccaggcatactctgacaagagacagctatatcagggtcctttcagcataatcttgctagtgtatgcaatggtgtcagcatttggaagctgattatgggatggatccccggatatggtagtgtctacatggtccatccttttatctcaactccaaactttgtctctgtaactccttccaagggtgttttgctcccacttctaaggaggggcatagtgttcacacttcagtcttcatttttcttgagtttcatgtgtttaggaaattgtatcttatatcttgggtatcttaggttttgggctaatatccacttatcagtgagtacatattgtgtga

SEQ ID NO: 4495 - DNA, 1200 bp, mus musculus
actttatgtgactagggaaggctttctgcaggcacagaggtgggctctctgtctcgcctggctgtgcttggataacaccagggatcccacagcttatgcttcccagtgcactaggacaggagagcacaaggatgctggtcatccggcagccgatgggcttgctgaggcgtcctcatttgcgtggaactgccgatgtttcgttttgtctccagcagtaaccttagttcagtggtgtgcatgccatacaaggaaatctcaaacgcctgcagtgaggaatgacaaatcacacggaatcacctgtgagagtggttgtatgtacacgggtgtcaaagcaaaatgcaggcaaccattacatcgtggtctccagctcagagtttctgctctgaacatgtacttaaccctcagtattgacccagacatttacttgctagggctgccatagggagcaggcactaactgggtgggttaaaaatagatattttctgtttgtgagtgtgaccttatatatgtaaaatggaatttttgaagatagaaacaagagtcttgagatgagaccattgtgaagaactcacatgggcgctaagtccaaaaatgagaggcctcctgagacatagaggaaggaagcaaagtacttagaggagaaggccgtgcaaagacactgatgcaatgcagcctccctctggaaaagctgccagactctagctagagttgaagaaatgttcttctgtggatgtcaggggcatacagctctccctctatcttggtttctgactcaaagctcccagaagggtgaaatctgtgtctgactttgaaacactaacctgctcaagtcatttgatgaaacagtcacaggaaaccaatgcagaaggaatggaagagccccgtgcacagtgtccctgtgtctcaggatctgctcatctgccaactggagcactaccttggagtccctcagtcctctccacctctgcgttagatagtttatctgaacacagctgtttgctgctgatcctgcgaacagcttcccaggtgatagtttcccttcaggcttcattcagtattctgaactcacccacttggtatttaggaaaatacttacctcagcttgaccttagcaacttgccagtcaacagttgtttcctaaacttgacttaactaatagaattgtgtcaggccaatcaaatatcattgaaccttctgact

SEQ ID NO: 4496 - DNA, 1200 bp, mus musculus
attacactgaaatcagttaggttcagcaccccttcttaacctacagacgtcagccaatggtttccaggtttttgcctcattgttgcagaagtcatttctgatggctccctgggagggtctcacacagggcttgatttatttggttctacttgaagtaaggcctgatgaccaggatgttcctagagtcaaaggaagcaagggttagtctagcacagtggttatcaactagtggggtgtggtcctttgggcgatcaaacaactggttcaaaggggttgcatgtcagatattccgcttatcagatatttacatttatgatcaacagtagcaacactacagttatgaagtaacaatgaactacgtttatgtttgggggtctccacaacatgagaaagtatattaaagggtcccagcattaggaaggttctagcataacagcatggtcaaacagaactcaggcaggacgcagcctctccccatgagctcctcggtggtgtggatgtcttatggatgtgttgccaggctttcctttttcagattttcacagctttgaccaaaccctccgaccacagtgactgaatgcttccaaggcattccttgccttccttgttatgtgagtcttcaccccgagccgtccatcttcactgtgttttgctgcaataccaaagtagtcaaatcccaggcttatttacaaatggcattcttcagcatcatgtgtccttccagagaagcccatgccttgagaatgctgtggtcattgccaagcaggacaactgagggtcaaaacaacaacccgcagagcataaaggttctgcttgggtgcagcccgtcacacctgctggcacaagcgaatcacaaggtgaagtctgaacgagggaggaggtaaaggagtgtagcagtcttacaggacgagagaccagaattcccagtgataacagatatgacactactctgtcttggacaaactattaatttccctgtaggcaacaactgtcactatcttgatttaaaacaccctcaaatccctgcagactatgctatcctgtagttttctgaacgcagtctatacccagtcaccttgacatagacctgcaaacaccacaccagcagcaacaacccaagttaactttggaggaaagtggcacagtgaatgtccccatgtgacaaagctaatgatgttaggaggcacgctctagccccgc

SEQ ID NO: 4497 - DNA, 1000 bp, mus musculus
tgtttgtttgtttttgttttgtttgtttgtttttgttgttgttttcttggatattttatttatttacatttcaaatgctatctgctttccagtttcctatctggaaccctcctatcccataccaccttcccctgcttctgtggggcacttccacctcactgtcctggcattcccctacactggggaattgagctgtcacaggaccaagagcctctcctcctatagatgccaaacaatgccatcctctgctacatatgcagctggagccattggtctttctgtcccatccaccacgaccagcaggaaagacgcaacaccacgttctccttctttaagcaggtttattcaggaacacttcacattgcaatgaaggaacaggaatctcctgaacaaccccagggcacaccttaaataccctactgactcctcccaatcaccccagtcacataacggcagtccattggttcacagcaaatgaggacacctcaggcaagctgacgaggtatggtgtctgtgcagtgcaggcagctgggatgtggctaagtcagtggtaatgaggaagtcaggcgcaggtcataagacctggcagccatactgggcgccattttggagcggcggccgcacccgctcatcacatctcccccttatttatcattttggcagagagaatacctgtcttaggttgccccctgcgataatgctccttacccgtcattgggaggacagacagcaatggtctgatcactgttttaggttggtaacacctccagggagtcttacccgtcattgactacttctctagcatgccaagccacacttgagaagattgtcccagctctagggctgcaaaagcctgaatcaacagtacctgcgcaagggtatgccttttttgcaccacagggccattactcctgtggcaacacagatgattgccagccctcctatgccagcccattccttgaggtgcgatattgctgtgatgatgtgaacaatggactgt

SEQ ID NO: 4498 - DNA, 1000 bp, mus musculus
tattatcttcatgagataggatttttaggtcagcttggtgattttcagttgtgttgttgtattcagggcttgctgtggtgggagaactgggttctgatgatgcctgcatatattggcttctgttgcttatggtcttgtggttgcctttcgccatctggatatccttggtgtttgttggtctgggtgattgtctggaatctgcctcttttatccctgggttacttcaggtctcctggttggcctgtagccttggctgtagcagaccacctgtttgaccttccaactgggagctcttcacagggacagagaagctgctgatctgttgccctgctgcagtagatctcctgtgaggccttcagactgttgggtcttcagtgaagcagtcaagctgttgtccaactgctctgagtgcagtgggtcctctagggtgggtcaggatatggtgtcttcacggaagcagaccagctaggagtctgtcctagcagaaaggactgggcagaaggggcagaagggatggaaaggaagtggtattcaggagagtgggggctttggtgggtgatgggtcccaagtccactgggctctgagccacagttctgggactctgagggaggaagtcttaccaactgctctcagtgcaatggatcctgagcagaccagctaagagtctggcccagtagagggaaccaggtagaatcccttatttgtcttttgatcaggcaaattcacttcaatctagagtctgaggacataccaatagagggggcacatttatgtgttctgcttaccttaattctatccttctccactttcaagccatactggcctggctggggttacactgtaccagcctcattccttagactgccttgcaatcagtttccttctgctgagcactttcccttattcctcttgtacctactagaggtatgctaatgtatgcttcacagagaacacacatttcagagcactaggctctgcattctccttcctactgtcttg

SEQ ID NO: 4499 - DNA, 1000 bp, mus musculus
aagcaaagtaaagtatgcagtagagcacagccaggcctgttctgtgcgaaccagtcaaatcccattccacttaaatattatgcaatctctcaagctttctcttttgctaaaaaatacacttaaaatgagaaaaggtgaaaggagtgtgtttctttctggggttacaaacccatttctgattacaaagaaagctgcaaggggagttttgtttgtctgagctcaattctatagatgacagacgctaagattttaacatcaaaatatctaatcaccaaattttcttcattaacagtctcagcctgggataatctttcctttagcagaaacatgggcaactgggaagaagttctgtgagacaaaaaggtgaaagccagggagacttgtgtttaacagggcgccgccgtgcatggttctgtctctgttcactgcattactgagagtgagctttactgtagtaagtgtcctccaaggaacctcccttccagggcagttccaaggactcagatttcagggttttaaaaggcaacgtggcttgggggaaccaaaggcttaaattcaggtattagctcattgttaggagtttgttatttcttagccctagtttcctcattagacaatgaagagattaaaactagtttttccaagaagttgctgggagacttagccagctgggccatcaagagcaccgagacattgctagagctgaacagacatcatgtgttcttataactggcagtgcctgctcgactgtgttagatttctgatgctgctgtaatgaaacaccacaagcccaatggttttaacaacacaaagttgttcttttacagttgtagagggcaaaagtcaaaaagaggtgtgtcttctggaatgcccagggaaatttcatgtccttgccttcattttccttgccagcacagtaattattatgcacagtattattatacatggctatattccttatttttatgcaactagcagcacaaccttatattttcattgt

SEQ ID NO: 4500 - DNA, 1000 bp, mus musculus
taggacaggcgggagccacagatcctctaaggcagtgtccttttcgggccccagacatccagtcaccctcccggctagaggacaggtgtctgccctgtccaggaaccctttgcctcaagagcggcaggtgccatcttggttccgggactccgccaaacttaggaacttagtctgcacaggcgagagtgcacaccacagaagctgacagcttctgggacaggcaggagccacagctcctctgaggcagtgcccttttcaggctccagacatccggccatcctcccagccagaggacaggtgtccgcctggctcgggagccctttgcctcaggaggggtgggagccatcttggttctgggactccaccgaacataggaacttagtctgcacaggtaagagtgtgcaccacagaagctgacagcttctgtgacctgacaaagcaacacagcttctgggaaaggtcctgttttgggccttcatcttcggccaggaggaggtccaaacaccagatatctttgcaccttccctgtaagaggagagcttgccagcagagagtgctctgaccactgaaactcagaggaaaagagcctgtctcccaggtctgctgatagctggtaacagaatcaccagaagaacaatatctaaacagagacaactataacaactaactccagagattagcaaatggcgaaaggtaaatgtaagaatcttactaacagaaatcaagaccactcaccatcatcagaacccagcactcccaattcccctagtccagggcaccccaacacacctgaaaagctagacccggatttaaaagcatatctcatgatgatggtagaggacatcaagaaggactttaataacgcacttaaagaaatacaggagaacactgctaaagagttacaagtccttaaagaaaaacaggaaaacacatccaaacaggtgatggaaatgaacaaaaccatactaggcctaacaagggaagtagacacaataaagaa

SEQ ID NO: 4501 - DNA, 1200 bp, mus musculus
tgataaccgccagttgtgccagcaccatttgttgaaaatgctgtcttttctttaaggggtttttatgttttctctttaagggcttctacccgtttgcttgtgttttcctgtatttctttaagggagttatttatgtccttcttaaagtcttctatcatcatcatgagaagtgaagaagtgattttagattggattcttgctttttcagtgtgatggtgtatccagaacttgctatggggggagatttggattctgatgatgccaagtaaccttggtttctgttgcttatgttcttacgcttgcctctgccatctggttatttctagtgctacctgccctcaatatatctgactggagcctgtccttcctgtaatcccagttgtgtcagaactcctcagagttaagctgtctttgtgatcctgagatcctgggtgtatcagagttcctaggagtcaagctgcctctgggaccctgagatctatccgggtgtgaccaagtccctgggatcctgtattcctgtgttctgtgatcctgtgatcctgtgatcctgtgcgtgtcatctttgatgacacctgggagtggagattcctctgggtgatgtgggactagctgcatagtttgtgcccaaggtctgctcagggcaccggcccagaccagaacgaactcgtgtcactggtcaggcagagttcctatgtgcctaggttccgctgatcccatttacttccaatgttgggaaagatgttgtgtcctcctcctctttgatcctatgatcctgggcgtgttagagcgcctaggagtggagcttcctatggctgttatgggactggcttcaggagttcgcacccaaggtctgctcagggaagagcccagaccgcaaggcggctttttaaaattcaaaattcattactcataaagtgattaaggggatgatccatctaaagtgcttgatgctctttcagagggccagggttctgtttccagcacccacattagacagctgtaactacagctctgtgaggtccagtgccttctttcagcatccataggcatgcatgcacacaaataaagaagtgagagtaggtgggttggtaagttgggggagagaggaagagataggagttttcagaggagaaaccaggaaagggagataacatttgaaatgtaaataaagaaaataagctgggcatctttaatcccagc

SEQ ID NO: 4502 - DNA, 1000 bp, mus musculus
gttaacgagctcattctacttcagcccacttgaatagttccttaaaccctaagataattaagtgctgaaatacccataaactgttattttttggttgataaagataagttcttatttagtttcacagaatagtgaaaaacatccttcctaccaacttttcaaattaccatgccatagcttccctgtctctggttgagacaaggtctctcactccatagcccaggttagcctggacgtcagtaaatagcccaggctggtctcaaacgtgagtagtcctcccataaccttccaattgctctgattgcaagcatgagctgccacggtgatcttttctccttttgagacttcctgtccagatgagaagtgaagagaacagtatactgagcctctgtcccatggagcagatggtagtgataggtttttggtaatcttccttgctctctactatgttcccttcaaccaccttcaaaatcccactgttgggctggagagatggctcaggggttaagagcactgactgctcttccagaggtcctgagttcaaatcccgggaaccacatggtggctcaaaaccatctgtaatgggatcggatgcactcttctggtttgtctgaagaccagatagatgaaataaataaatcttaaaaaaaaaaaaaatcccactgtcactgggtgtgcacctttagtcaaagcccttgggaggcagaggccagctgatctctgtgagttcaaggccagcctggtctagagaacaagttccaggacagtcaggactgttacatagagaaaccctgttctcaaaaacaaagcaaagcaaaacaaagcaaaataaatgaacaagccaacaaaacccacaacaaaatgtaaacaagaatcccactgtcaaattattccctctgcttctcacttgaatcattaacactaagaacattttattatataaacttaaaacctatcaacagctaaattagcaatattaaatattgccaagttctcagtc

SEQ ID NO: 4503 - DNA, 1400 bp, mus musculus
aatattatagtattcttaagctatgtctttcatgggaagaagacctaaagatctgcttgaatttatccacccatttggcagtgaatcagtgaagtctaatttttaaaaatgtcttctcatagtatttttctttggtttctagaaaacgaagtccatcagtgtccagggatcaaaatcgaagatacgagcaaagtgaagaaagagaggactactcacagtatgttccttcagatggtacaatgccaagatctccttcggattatgctgatagacgatctcagcgtgagcctcaattttatgaagaacctggtcatttaaattacagggattctaacaggagaggccatagacattccaaagagtatattgtggatgatgaagatgtggagagcagagatgaatatgaaagacaaaggagagaggaggaataccaggcacgctacagaagtgatccaaatctggcccggtatcccgtaaagccacaaccctacgaagaacaaatgcgcatccacgctgaggtgtccagggcacgacatgagagaaggcacagtgatgtttctttggcaaacgctgaactagaagattccaggatttctctgctaaggatggatagaccatcaaggcaaagatctgtatctgaacgtagagctgcaatggaaaaccaacgatcgtattcaatggaaagaactcgagaggctcagggacaaagttcttatccacaaaggacctcaaatcatagtcctcccacccctcggcggagccctataccgcttgatagaccagacatgaggcgcgctgactccctacggaaacagcaccacttagatcccagctctgctgtgaggaaaacgaagcgagaaaaaatggaaaccatgttaaggaatgattctttgagttcagaccagtccgagtcagtgaggccgcccccaccaaggcctcataaatccaagaaaggaggtaaaatgcgccaggtttcactgagcagctcggaggaggagctggcatccacacctgagtatacaagctgtgatgatgtggagctggaaagcgagagtgtgagtgagaaaggtaagcgctcctgccgcaccgcccatggctgaccctgcctgccagggcttgctttccctcataaatggctcagcgaacacttaatagctgcttccgcttgtagttcaagaattctaaaagtgttggccatggtagaaaaattctatattgcaagacatttttatatccttgtataaaaacaaacaatgctttaaagattgcttttttgcttttttactgagggtttctacatccttagatgtcatagcatagttacacatacttaatagttctagttttgaaaataacaattttacatttctctgaaaaactaggaatgcgtttgaaataga

SEQ ID NO: 4504 - DNA, 1400 bp, mus musculus
gttagaaataaatacagaaacctttcactcttatgtttttctatctcctcttaaatatttttgtagttgtgttgaaaataaaaaaataaatattgtatatcttgaactttcaatatctaaactgatttagaaaacaaaatttgattgtatttatccatatttttacttaccatgtttcctattcctttctaatattaaggcttcttgtcttttcatttctctgtgtccttagctagtcttcctttagccattcttttagagttcgcctgctggttcacacctacttagcctccttttctttgagaatgttgttcactcttgagagataatttcatcgtatttataacctaggctaacttctttattattaattttattttcttacagtccagttgttacccgcctcctggtccaccctcccacagttcctcatcccattcttcctccccctgtctccaagaggtagtcctcaccctcaactacccagtaccccctccagacctccccactccctggggactctccagggttaggctcttctctcactgaggccagacctggcagtcctctgctatatgtatcggggcactcatatcagctgctgtatgctgcctggttggtggctcagtgtctgggagatctcaggggtccaggttagttgagatgctgatcttcctatggtcttcctcagctttttccaggctttttacaattcaaccacaggggtccccggcttctacccactggtttgacagtaaaaaacttctgttgtgtggctccctgtatcctcccaagttctgatgcaacatttgctgtcattcagtgtaattcttttctatttcctgtactttttggtgtgttataatatttagttttcatcttttagttttgttaagatatatatttgttgggttgtgcattcttctagtttaaacgtatgtaacatcttgactgtagacttccatctttttagcataagactttttctgctctaaccttctaggactttttcagcagggtcattcaagagttaatattaaatcgtgactactactgtctccatactgctaattgtgataagttaaacatctttctatgcttgatgatattttatttaattttcaaaatgacattagcttttactatgttaatcaatgcttttcagtgtcaggcacgttgtactctctcacccccttttttcatcaatagggtgtttttctttgttttcaaatagtttaaagtgctaactactaaatttagagagtacaggccttacttctggtaatcatgtagtttgaaatcagggaagagagaggctgtgaactgaatggattctcttaccttcatggtttttgatgtataggcttaactatttacgttctttagccaagaaacatata

SEQ ID NO: 4505 - DNA, 1000 bp, mus musculus
atttctttagtgacaagcgtaatgatcattattattggctacttatacgctgtgcagcagagctagtatttgtcacacctaagcttgcggagacattcagatgtaacatgggaatacacaaggagcacaggtcacgcaacaaaaatgtcgttgctttgatggaggtttgaggtgccttactcatgtttgccgattgcgtgtttgcttttggcaaaatggaggcagttcagaaaaggaggaagatatgggtgagcctctactgtgtatcagatgctctgagatacggccataccagatgctacattgggtttttatattctattaacatcagataggcacttctgggtaacaatcacaaatacctgattatccagactccagtttactctttatcctgcatagctgatcgtgaaatattgtacacaagagggcttggaagggcaagccactggaaacgataaaaccacatcccgagcgtatgcgttctggaggattacctgaaattcaaggtgactctgggtgactcttgtgtgacaaaacattttctgggacggcgctcacacatctactcacccaagacagggaacccaaacagagcaaactactgatcccaccgaagtccgacttgatgaaccaataaggtttactggggttgcttagcagagcatgggtgaaggattgtgtacaggaaggagcagaaaggactcaaagaaagctacatcacaatagtctaccccaggatggttgagagctcacagagttgggaacctagagcacactgcacagcctgcacgcggctcatgaggttggactttgccctttccaggttcctcagttgttctaaaatgttttcaagcaccatggctggttccagctttctctaggcaggcagcctggtcttagccgcccgcagcagctcattttctttgagactcttcttctttgcagctcagttcaagaaggactctcagcttctattgtttactctgacaggtagagg

SEQ ID NO: 4506 - DNA, 1000 bp, mus musculus
aatgggtacaagtctctgtccatttgactctgattgacacgatttcagaagcaatgtgtaggagcccccttttatattctctgtggccaacaaaacatgggcaatgtaaaaaaaaggcattgctctagtgactcagtacttgcaaggcctagacagtatccaggcagttacatccattcttctttcccaagaggcactgggacgggtgctgatgcaggggcatgggagctgcaggggaatactaaacaggagctaatactggtatcttcaagccatgagggaatcatcaaggaaaagtaggttttagcaggatagacacctggcctttctctcctgcactctgtcttctaatgtggtgttgtttccactggctgctcacaaccagaaatcagaagtgagtggccagatggcccaaagtacaggaggaaagaaaggaaagtttgttgagtccagcaagaaaggtcacatggaaaagatccagcttgtggaaacttctaagtttctctatcctaaccaacaggattctcgttataccagcctgctcacatatgtggcattagttcaatatttattcacatgaagacaatcatactggaaattgaataaaagggatggccagggtctgatctatccaagcagatagtgtgagcctcctgctttctaaactgtatcttttttttttttttttttgtctatattggcgtaacttggagatggcttgaacgggagggaacagaccagcagccaggctggcagactgagaggcaggttggttcaaggctatcagtatgtgtagggcatcaagcctacttgtatatgtagactggaaatcatccttctctgatctccagaggataattggttggtgtgtttattatggtcttgcatgccacctggaagtgaggcacagaagattgggacactgcttttgtaattgagcttctgaacacttctcttgtcaccttgaccttgtctcacaccttcatgcttcatgtgtgga

SEQ ID NO: 4507 - DNA, 1200 bp, mus musculus
ctaaaattctttagtaaaatacctctcagagtgggcgtctttactgctcagttgctaactgaaagaacttcaggttaagttaacatttgcttcaaccagattaaaagctttcagatagattccttatgccatttactcatctatctaaccccctctgcttctgctctgttgccatctgccaggtcatacttctgctcctaaaaggaaactcaccctgaccttgccttccaggcaaagctcacttcatttcagttggtgcctaagtatgtttatccatcccaggttgtcagtgcaaacctcatctccatctaaaccatgccaccaggttgaagacctactagatcatgggttactactagctaccagcaaaacagtatccagcaaatcaacagataggccattttagtaattaaaaatcatagtgaacttgtggtaagtcctaatgtaagtgaaataactaaatagaaactaatgacagtagcctaggggaaagcatgagggttgttgttttgttttgttttgttcttgacaaattgtatggtgactaaacaaaacaataagagtttattgtcctgactcatcagtcagccttgttgaccttcccctcttaactgctgcttaaaacatcttcctttctcactttacaccagacaggatctagggcggacctttttctccaaagtttcctctggactttctcctcctggagaagtcaggcttctgctagcagccctgacaagtcctgactcctgcgttccccctgcagcttctctgagactggtgctcccgaaggtttgctttctgtgtctaccaggcaagcttgctttactccctcaatgactccccttaagcacagaactctcaaagataacctcccactgtttctccagattcagaacaggaggtgctgttaggtcaggctgtgacatggagtgttgtctggcaggtcagagcaggttcctggtagcagagaagcccactgtggcaaatttctgagcaaaggactcttgccttccttccagcaactaaaaggattcaaaagaccgcagttcctctttccatccactttcccgaagttggtccagagcggggcacacaaggcacctgtttccaaaaacctgccatgggtattgtaccccttgtctttattcatgtgcatagaccatagagggaagagcaaagtaagatgatttctttttc

SEQ ID NO: 4508 - DNA, 1000 bp, mus musculus
tcccaagttcatatactctagttagtgctgcccacatgcacaggggtgtgaaccaactattgaggcacaagcaacccaccaatggaaagattaaacaatgccatgaatggaaacccagagagcaacaggagcatattacaaagggcagattccaaagatgaaaatgggcataagggaacccacaaggcatagtgaataccatgagaagggcatgccattcaatcaatagaagtgagcacctcaaggagtcacttctattccttgctcagaaaagaaagcagaagaagaaaggaaagagaggtgttgttgaaatgacacaaagacatgttgaaagaagggacattttagggagactattaaatgtggctaggactgggaggaaaagatacccactaaaagaaaaagataccttgttctctcttgtcatcctccagttttaaccaggacatccaatgacagagagtagagggcccacatggtgaatggtaaaaaattcaactttgaggagaaagccaacagaatctccactctaaatgctttgcccagattcacacagccagtgaaaggcagtgccaactgtttgtcaactgctctctcctgctctaaaaagcatatggcttccactgtgttttgtttgattttaaccaatgaagactcaagatccagatgctggggtgaaagcctggtagttcagagagtcagaaaagcacccagctgaccttcctcgacagtgtacttccccagaagaagctctccttctccacactgtctcaaaagccttcaaactagatgtcttcccctttacttcttgtgtgtctctttatccgttctcctgacttcctcttactcttgacgtgatttccccctacgttcactccctgacaacttgttgctgctctgccccttgacctatggttaattttatttaaccctgttttatttaattctgtttacaataaatagaaaactcttagattaaaggtgtatgcttggcctgagt

SEQ ID NO: 4509 - DNA, 1200 bp, mus musculus
cttccggtagtactatgtccagttttctgaggaaccgccagactgatttccagagtggttgtacaagcctgcactcccaccaacaatggaggagtgttcctctttctccacatcctcgtcagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatgggtgcctctttcttaaaccatctcctgcaaaagggttcaagctggcatttactcgtaagattcatatcggatattcttagtgatttgctttcacagtgctgggaggtgttctgtatgctactggaggagaaaagtagccatcagtctgacccagatgtggaccccgagagctctattaatgcccatttgtggaatagccacatggctgtcatggaagcaatcagtcactttctggttgtgtttaatgtcatctccacaagttgcagctcatacctggcactgttatcagtgcagaggactgtaagcagacaaatcatgggctcttgggagaacctactgctattgttcttctaaatggttcaagtactaaattgactcctaatggtttactgttatacccacagaaccacacatttctcgtatcactctttattctctctgtttctatggattaaccttttctagattccccatgtattttgtttcctgcctgacttaatttaattaatatgttgcactgcgaatataatcatgttgtcactttccaaggttgaataatattctggtgtgtgtgtctgtgtgtgtgtgtaatttatgctttcacacattcattgatggacacttaggttgattctgtatcttgatttgtggatgctgctgcagtgaacaaggggcatagacatttttaataaactaattttatttcctttgagcactcaagtagtggtattaatatgatatgtatttctattcctgttcttaactgtttgagaaactttcatactgttttttttcatagactttgtgctgtttacattg

SEQ ID NO: 4510 - DNA, 1600 bp, mus musculus
gttgtgaaaatcaggcccctaaataattcttgatttcataaaaactgtaattaaaattatttccaaattcctatttttagcattgtatgaattatcctttggggtactggtatttaatacagtaaaaaagatagaatacatgctgtaacccaatcaatattacttataacatataatacagaaaatacagtacactaagcttagattttctgcataatttattcaagtgaaatttcttaatagaactgagttaatattgtcaaactctctgtataaggcatatgccccagaacaggggaacgccagggccaaaaagggggagtgggcgggtaggggagtgggggtgggtgggtatggggggcttttggtatagcattggaaatgtaaatgagctaaatacctaataaaaaatggaaaggaaaaaacaaacaaacaaacaaaaaaaaacttccataagtccttgatgacatttacatcatcaaaggatatctgtttctcttcctgtttctgtactgggttctctctcaaatggtcagaatcttttttttaaattaattaacattttttacactccatattttattccccacccccattcaccctgttccacattccatacctcctcctcaccctccaccctccacatgggtgtccccaacctccacctcatgtgacatctaaactcccttggggcctccagtctcttgagggttaggtacatcacctctgaatgaacacagacctggcagtcctctattgtatgtatgttggtgacctcatatcagctggtatatgctgcctatttggtggtccagtgtttgagaggtcttgggggtccagattaattgagactgctgcagtatcgcccttttcctcagcttctttcagccttccctgattcaacaacaggggtcagctgcttctgtccattagttgggtgcaaatatctgcatctgactctttcagctgcttgttgggtctttcagagggcagtcatgatagatccctttttgtgatggctccatagcctctgtaatagcgtcaggccttgggacctccccttgagctggataccactttaggtctgtcgttggaccttcttttcctcaggctcctctccatttccttccctgtacttctttcagacaggaacaattatgggtcagagttgtgactgtaggatggcaacccaacacctctctttttttttccattttttattaggtatttagctcatttacatttccaatgctataccaaaagtcccccgtagccacccacccccactcccctacccacccactccccctttttggccctggcgttcccctgtactggggcatataaagtttgcatgtccaatgggcctctctttccagtgatggcgactaggccatcttttgatacatatacagctagagtcaagagctccggggtactggttagttcataatgttgttccacctatagggttgcagatccctttagctccttgggtactttctctagctcctccattgggaaccctgtgatccatccattagctaactgtgagcatccacttctgtgtttgctaggccctggcatagtctcacaagag

SEQ ID NO: 4511 - DNA, 1000 bp, mus musculus
tacctccccacacttctccaggtctccccattccctggggcctcaagtatcttaagggttaagtgtgtcttctctcattgaggccaggctacagagtcctctgctgccttggacaagctagtgtatgctggctggttggtggttcagtgtctgagagatctcagcatggggtccaggcttgttgaaaatgctggccttcctatgatgtgacccttctcctcaacttcttccagcctttccttaattcaaccacaggagtccctgcttctgtctcagtcaactgcttgctaagcctctcagagggcagccacactaggctcttttctataagtacaatcaagccttggagcctccccttgagatgggtcccaatttgagtgtcactggacctcctttctgtcagtttcttctctattcttgtacctgcagttcttttagacagaaacaattctgagttatagtttttgactgttgcatggcaactccatcactccacttgatgctactggagaattctactggattctaaaagttccctcttcccactgttgggcatttcatctaaagtctctccctttacgttttaagattctctcacctcccaggtctctggtacattctagagggtccctcatctcccaccttctgaagttgcatatttccaatacttttgctggccctcagggcttcactcctgccccccaataccagatcatgttttactttttcccctgccccctctccctggtcacacccagttccctccctccctttaatcttaccagcatctgccccctacctgtctttgtaactggctttcagggctgcctcttacccagcttctaggcaagagtaaatttaggacctttgttttgtggctgttcctctttctcgggctcccaggaaagctttatagaaccgtaagttctcaggatagagcatgaccatgccatcagactcagagtgacaggaatattctactccacttctgaaccatcta

SEQ ID NO: 4512 - DNA, 1200 bp, mus musculus
atgaaatggctcccatatagtttatatagttgacttctttttttttttttttcccagttggtgaaacttttggggaggggtaatgtcttagttagggttttacagctgtgaacagacaccatgaccaaggcaagtcttataaaaaacaacatttaattggggctggcttacaggttcagaggttcagtacattatcatcaaggtgggagcatggcagtatccaggcaggcatggcgcaggaggagctgagagttctatgtcttcatccaaaggctgctagtggaattctgacttccaagcaactagggtaaggatcttatacccacagccacagtgacacacccattccaaccaggtcacacctattccaacaaggtcacaccttcagatggtgccactccctggtccaaggatatacaaatcatcacattccactacctggtcaccatagacttgttcaaaaacataagtctatgggggccatacttaaacatagcataatgcaaaatgcatttagtccaaagtcctcatagtctatagcagttgaaagaatgttaaaagtccaaagttcaaggtctcttctgagattcattcaacttaattaactttaatccccaaagcaaggcaggaaaccagctgggcagactccaaactctgcatctccatggctgttgtcaaagcggtcttcagatctccactcctttttcatctttgttgactgcaacaaactgctttctcctgggctgtttccactccctgttagcagctttcctcagcatgtatcccatggctctggcatctttaacatctttgagtctccaaggcatttttaatgttacaacttcttctttcagtgtctgggattccacttgatcttttggactccttctaagggctggcgtcacttttccagctctgcccttatagcactctaagctcagattgatccactccactatggctgctgttcttggtgatcatcccatggtacagacaactccaatacactggggtgttccactccaactaggcttcaccaatagcctctcataggctcttttcagggtgccaagcctcaaatcctttgcatgaccccttcaatactgggccatcaactacagctgaggcttcaccttctccaatgcccttccctggcctctcacagtgctaagcctcagcttctctccatgatcccttcat

SEQ ID NO: 4513 - DNA, 1200 bp, mus musculus
atacatgtcaaaaagaatcactactaaaaacaatagacaaaataacatgtgtgttttggaaatacagactttttgaagggggaactcataaatgcatttgcttatttgcaaaaagaatctctgggagcatggaatgcgctcgtataatggggctactttgctgtgcgtgggggtgcacacctttaatctcagtgctcaggagacagaggctggtggatctctgagtttgaggaaggcctggtccatagaatgagttttccaacagctagggctaaacgaagagaccctgtctcaaaagagatttccccatcttcccccaaaggttgtgttattatcttgttggagtgcttctttggagtaggatgactaataacagaaatcatcagacaacatgctatgtatcttttaataaaaaaatacattttgaaccatgtgtattgctgtttcaaatattaaaaatgacatgtaattacaataaaaagtaaacaatgaaaattacattcttattacataatcacttaagttttaattacttaagcaaagtgtaattgcacttctctcttttgtaatttaatgagctatatcatttcccatctaagtgaaaacttgatggaaactagggcagttacttattcattctttattgtagcacacacacacatcaaactaaatctaatagaacactacttaaactgtggaatgaatgaattatatttacattatagtttatgctggcaagcagcccctgaattcatttcacaaacatgattctatcaaattactttgctcttgaatcaacaacattaattcctcatcctgttgtgtgtgctgtttttatttatttattttaaagtttccactcattgctttgttctatttctgaggctgttgtttctttgatggcatagttttactggatagcatctccccactagttgttatacacagagctgtggaagtgagctctattccattggtttctgttcagtcatacattacagaatctgttacccattgtggtgccacattcagtgctcactaatatccttgtttgtgagttcacctttcctccacaaaacaaaatatctaaatacctttggctaaactcttgtgactagttaatgtgaccatttgagttggagccaatgaaatggtagagcaatattgaggcttttcaaagacccgctatagaaacatctt

SEQ ID NO: 4514 - DNA, 1200 bp, mus musculus
cacaatggagagaggcagaactggcgatttgaaggtagtgaggaacagcctgatgtgagtagccggtgataccacctgggatcatggtggggtcctagcttgtgatgcccctgggggccatgtctgatccatggcctgaaacaccagatctaccagataagccaggcagacatcgctggtctgacctgctgcttagagatagataaaagtctgagggatatgcagaactgacctcacctgggcatcgagggagagctggccctggggacgagagagcaggagggctgaccctgcccctccccagctacagtacttcggagaactgctcttctcattgtgggagatgctggtgagctccagccccatccccagatacaagaataggagaactggccctatgtggatgagggagagaagccctcctcccctcttgcccctcaccacctgtggcaagtgggagacctggtttggagagctggctttgccccttaccacctacacaacttgggaaagcagaccctgtaccttgcctaggcagcatagaggagaaggagagtgtgggagagctggcccatatcttgtctggtaagcagtggcatcactgagagaatgataccctcccctccctttggccctaaccaccaatgtccatcaagaaagttgtccctgacaggttaggagagcaggagagctggccctgcctttccctcaccttctacagcacttgggagagagagcaagccctgagattcacctaagcagcacaataggactgaccctgattagtggaggtatgggtgagccggtcctgaggatatgagaataggagagctggcccctgcaacttgtctgctatgtgctatgtagtgacatgggtgagagggggtggggggagagctcctcttttttgccccttgcaccaatggcagaaggtcatcagaactgaagagctggcactgcgtagcagggattgctggtgagccagccctgtgttccatgacagtgggaaaactggtgggctgagcagctcagatacctctcaggcccagatccagggtttgaaattggccaaccccaatatctaccccattgatgaacttctagagtacatgaagaggccggccctacagacccaaaacaacaggttctccatgacacaaggcaacaataggatcctagccgatttctagtgaggttcca

SEQ ID NO: 4515 - DNA, 1000 bp, mus musculus
ggattgtaattttacttaccatttttttagctttatttctagtggatattgttggtattctccagttcttccttgccaaacagtgcactcaacgtttaaaagctccaagtgttggttaataacagacattggccccctctttcacaattgtaactataaaaatcattacacattgttattatcactcttacaataaagggaaaataattgactgattctggagaatcaccttgaggtagtaagatctctgccatgtaattcactttccaagacttttcctgagttcagaatgaagcttatctgaaaacattaggcatgctctgcgttccttctctccctcagaagaacagaaggaaggtgtccttctgttgcgggaaatattttaaaaagagatccagctcgttcccgtgcttgtgcctgcctctctctgccccagtggtctggcccaccttctcttatctcgaggtgactttccacccagagccacccagctcattaggttcccactggcagatcattaccatgccaggcccatgcttcaaatcccccacagcctttgtggtgcacctcaggcagacccatgctttgccactgtacctttctctctttagcccagatgagctgctgtgtgaaggacaatacaacacagacttagttcagaaacaatggtaactcaatctctgggcacaacaactaaaacctaatcttgtaaacctatttttttattagatattaaatttgattcctcctgtagcaaattcttgcagatgcgtcatgataccgagaaactctagctgctacatcttacccttatgctatcccctttccagagggacctaattctctcctgcttcctctcttcctccatccaacctggaagtcccgcctacatgcccagtgattggatcctttattctctaggggattggttcataagaaaccacctgagcacatgactcattccttattccagacagcctctctcgggagtgcagaatta

SEQ ID NO: 4516 - DNA, 1000 bp, mus musculus
taagatctaggatgcagctcatgggttatctagctctgggtttgagctacagcatggcaatcgtccagctctggtgccgaaagtctgtgatactagcatccagaagttgggggcaggaggatcagaaagttaaggtcatacttgcctacacagcaagtctgagcccagcttagtgtacatggacactgactcaaacaataattgtccattaaaagaaaagaatcatcggatacattgactgcaaaaagcaagcaatatatgctgtatttcattcagtggatctgatctgaaagtcctttgcaaagtcctttttcttcttataaaagccttttggctaaggaaagtaggcagaataatagaaaaattacttttatgtaagttgtaatgaaagaattgagttaggcagtaagattaaggaatgaagtcatatacaaagagctaagatttatagtaagaacaggcattccccaaatgtatccacttggaatcaccaatactgtgctgacaatcagtatgcatcttctgaggacctgagagatgcaaggaggctggggacgtaacttgtctgccaagtacagggtcccccacactgcaaccaaagccaaaggaaaggactccctatgaaatcttcttactacacataaacaaacaaacaacccccccccaaaacccctgtccctacagctaatcaacattttaaagctaatgtttatcttccacaatacacagttaaatcagtggcaacttcagcctgcaggccaaatctagttctgagtgcttataaaaataaagtattattgaaacactttcaccctgctcatctgcatggagtggggtggcttactaggaacaacggcagggcggcagcaaaggctgtctgcccagcaaagttgaaaatattcactaattggtttttcacaaaatttgatgccatgaggaagtaaacagatgcttctgaaacaattggggatatttccatgttctataccattatgttaat

SEQ ID NO: 4517 - DNA, 1000 bp, mus musculus; identical to SEQ ID NO: 4516

SEQ ID NO: 4518 - DNA, 1000 bp, mus musculus
atgtcccagtcccacttgggaaggagaagaaagcaaccatgagtgtggaaggagggagggaggaaactgggatggaaagtggactgggggtgggctggggtggggtggggtgggggagatgggaacctgatctgttattgggtgagggaaaaggactgaagccccgagattcagcagcaagaatggaaatatgccaccttggaaaataggaagttgggagaatgcacaagcgaccttggagctgagagactttcaggactgaaatgaagagacattagatgaaatgtctgaaagtaggaagagggaacttatagagtccacttccagcaagaagacagggcatcaagtgagggagggtgttagtatcccacagtcacaactctgacccataattgttcctgtctgagagaactatagggatggaaatgaagaggagcctgaggaaaagaagtttcagtgacaggcccaaagtgggattcacttaaggggaggttccaagcctgacactattactgaggctatggagtgctcacaaaaagggacctagcatgacctcaatccagaagacccaacaagcagttgaaagaatcaggtatagatatttgcacccaaccaatgaacagaagcacctgacccctgttgttgaattagggaaggctgaaagaagctgaggagaagggtgatcctgtaggaggaccagcagtctcaattaatctggacccccaatatctctcaaacactggaccaccaaccaggcagcatacaccagctgttatgaggcccccccacatgtatactgcagaggactgcggggtctgggttcagtcagaaaagatgcacgtaaccctcaaaggactggaggtcccagggagtttagaggtctggttgggtgggtggtggggggagaagacatccttgtggagacaggggtatggggaagaggtatgtgatgtggaacagtccgagggtggatagggagtgttggagaataaaatctgga

SEQ ID NO: 4519 - DNA, 1200 bp, mus musculus
cctgataaacagcttcagtgcagtagctggatataaaattaactcaaacaaatctgtggcttttctctacacaaaggataaacatgctgagaaagaaattagtaaaacaatacccttcataatagtcacacatagtataaaatactttgttgtgactctgacttaggaagtgaaagatctgtatgataagaacttcaagtctctgaagaaagaaatcaaagaatatttcagaagatggaaatatctcccatgctcatggattggcaggattaatatagtaaattggctatctttccaaaaacaatctacagattcaatgcaatacctatcaaaatttcaactcaattcttcatagatttagaatgagcaaattaaaattcattgggaataacaaaaccccaggacagctaaaactattgtcaacaataaaagaacttctgggggaatcaccattcctgacctcaagctgtagtacagagcaattgtgataaaaactgcatggtagtggtacggtgacagacaggtagatcaatggaatagaattgaagatccggaaatgaacccaaacacctatggtcatttgatctttgacaagggagctaaaaccatccagtggaaaaaagacagcttttccaacaaatggtgctgtcacaactggcagtcatcatgtagaagaatgtgaattgatccattcttatctccttgtacaaatgctcacagctacctgttggacaaagcacagcttccccaatgaaggttctagagaaagtacccaaggagctgaaggggtttgcatgcccataggaggagcaacaccatgaactaaccagtatccccagaactccatgggaccaccaatcaaaggaaacacatgatgggactcatggctctagctgcatatgcagcagagagtggcctagttggtcatcagagggaggagaggcctatgatcctgtgaacgttctatgtcccagtatagaggaatgtcaaggccaagaagtgggattgtgtgggttcagaagcatggggaggcatggaggagattagggatatttggaggagaaactaggaaaagggacaatatttgaaatataaatagagaaaatatctaataaaaaaagaaattgtttaaaaaaaaaaaaaaggaaagactgtaaggaccagtaggtaccttactccagagaagcagccttttccaga

SEQ ID NO: 4520 - DNA, 1200 bp, mus musculus
gcatgcagatagccatacacattctaacaatagggtttcaagtttatggaaaacatgcccaggtaatgagagtgaatcattctttgtaatcttgcagaagttgctgatggtttgatgtggctgattcaaataatattttaatatttcagcttgggtctggatccatgataattgatggcaatggtagatcactgcaaataagctggcaaatttttcatgtacctattttctttttttatcttttcttttattggatattttctttatttacatttcaaatgttatcccatttccatgcctctcctcaggaaaccccctatcccatccctcctgcctgtatgagggtgctcccctacccaactacccacacccgccttcctgccctggcattcccctgcactggggcattgaatacccttaggctcaagggctgcttctcccactaatgtccaacaaggccatcgtctgccacaaatatggctggagccataggtctttccatgtgtattcttttttttttttttttttttttttttggtggtccagtccacggaagctccacagggtctggcctgttgacactgttgttccccccatgggcctgaaaaccccctcagctccttcagtcccttctccaactcctccatcagggaccccacattcagtccaatggtttgctgagagcatctgcctctgtatttgtcaggctctgacttagcctctcaggagacagctatatctggatcctgtcagcaagcactcctagcaaccacaataatgtctggattaagctactgtatgtaggatggatacccagctgggacagtctctagatggcctttccttcagtctctgctccacagtttgtttccatatttcctcctgtgagtattttgttctcccttctaagaagcactgaagtatccacactttggtcttccttcttcttgagcttaatatggtctgtgaactctatcttggatattccaaacttttgggctagtatagacttatcagtgagtgcataacctgtgtgttcttttgtgactgggttacctcactcaggatgatatttttaagttccatcaatttacctaagtatatcatgaagtcattatttttaatagctgagtagtattctattgtgtaaattaccacgtcttctgtaaccattcctctgttgagggacatctgggttgt

SEQ ID NO: 4521 - DNA, 1000 bp, mus musculus
cgaattactccacattttattacacctcaaaagatagaattatgtaaagatcatttgaaaacattgaatgatttccagaagttgttggtagatataaattggatttgtccatatatgaggctattaaattttgaattaatccctctttttgatatattgaagggtgatccacagctttcgtcacctcgtgctctcacccctgtgtcagagtccatcccgtgagaaagtgagccttcacaatctctctaacagtccaaatggcctcatgctaagagcttgttatcacccccttcctccctattcccttcctggcacttgaggctgtaaaagctgaattatagtcccctcttccctatctcttcctgaactcccatgccatccaaggacatgagttacacctgagaccagcctgacacccaaggctgtcaaggaggaatgatgttccagagataagatgcagagtgtccgctgcctggctcctgactttgtcccccatgtcagcagatgcccacttctttgttctttgtataattctccctcgacccctcccatattccccatgatgtatgctttaaaaaaaaggcacctcagcataataaacgagacctcgataggtacccttcctggtctcctcttcctctttttcttccttccatctccttccaggtttgcggtccccctcacacccacgaataactgaattccacgggatgggataagtggcacccgacatgagggcgaggtccagatcataattcctaattggtggaggttccagagaagttcgttgcgaccccaagaatttagaagtagtgaaggacaccttctgctgctcacggaagagcgagaagtccttgttgagttgagtcatctccacttcagcttatgggaaataagctatctaaagaggcagccttcatcaaaggcttaaagatagctctcagggaaagaggagtacaagttaaaaagaaagattagatagactttttattttcataga

SEQ ID NO: 4522 - DNA, 1200 bp, mus musculus
ggttttgatgtcttcttggatttggtttgcaagtattttattgagtatctttgcattgatattcataagtaagtttggtctgtagttctcttttttggttgggtccttgtgtagtttagctttcaaagtaattggggatccataaaatgagttaaatagtattctttatggttctactttatggaatagtttgtggaatattggtatcatgtcttcttgaaagtctggtataattctacactaagtccacctggccatgggctcttttggttgatccctcagttggaatgtcccacacatggtctgctacagcaagggcctcagtcctaccacccagtcacaaaagaggcagaatccagagagagtcacccacaccatcaaactccagggatatccagatggtaaatggcaagcacaagaccataagcaacagaagccaatataaataggcatcgtcagaatctacttctcctgccacagcaagccctgaataaacaaacacacctgaaaatcaggaatctatcctaaaatcctatatcatgaaggtaatagtaatattgatatccttgatatcaataactcactgaaagaaatacaagaaaacaaaggtaaacaggtgaagaaattgaataaagtattacaagccctaaaaatggaagtagaaacaataaagaaaacacaaatggaggcaaacctggaaatgaaaacctagaaaaggggtcaggaattacaaatgtaagtaacaccaacagaatacatgagatagaagagagaatctcaggaatagagattattatagaagagattaacacaacagtcaaagaaaattcaaaatatagaaaacaagcatcaggaaattcaggacacaataaggagaccaaatctaagaacaatcagaacagaggagaaggaagatgcccagctcaaagaaccagaaaatgtcttcatcaaaattatagaagaaaacttccccaacctaaagaaagagatagccataaaggtacaagaaacctatagaacaccaaataaatgggactagaaaagaaaatcttctgtcacaaaataataaaaaaaaaaaaaccactgaatgcacaggacaaaagaatattaaaagctgcaagggaaaggtctaagtaacatatatagccagacctatcagaattacatgagacttctccctagagacaatgaaagccagaa

SEQ ID NO: 4523 - DNA, 1000 bp, mus musculus
aatatccaatatatgtaaaaaaacctcaagaaattagacatcaataactcaaatggaccaattaaaaatggtttacagagaaatctctagtggctgagaagcacctaaagaaatcttcaaagtatgcaatggtgtcagcgtttggaggctgattatgggatggatccccgggtatggcggtcctaggtggtccatcctttcatctcagctccaaactttgtctctgtaactccttccatcagtgttttgttcccaattctaagagagagcaaagtatccacactttggtcttcattcttcatgagtttcatgagttttgcaaattgtatcttgtatcttgggtattctaagtttctgtgctaatatccacttatcagtgagtacatatcatgtgagttctttgtgattgggttacctcactcaggatgatgccctccaggtccatccatttgcctaggaatttcatgaattcattgttactaatagttgagtagtactccatcatgtaaaagtactacattttctgtatccattcctctgttgaggggcatctgggttctttccagcttctggctattataaataaggctgctatgaacatagtggagcatgtgtccttcttatcggttggaacatcttctggatatgtgcccagagttgtcttttgtgaggctatacagaggcctagcaaacacagaagtggatactcacagtcagctattgggtggatcacagggcccccaatggaggagctagagaaagtaccaaagaagctaaaggggtctgcaaccctataggtggaacaaccatatgaactaaccagtaccccctagagcttgtgtctctagctgcatatgtatcagaagatggcctagttggccatcatttgaaagagaggcccattggtcttgcaaactttatatgcctcagtacaggggaatgtcagggccaagaaatgggagtgggtgggtaggggagcagggtagggggagggtatagg

SEQ ID NO: 4524 - DNA, 1400 bp, mus musculus
gctgtacatagtacctgccaatgatgagggtttgctgccccgaccagtcaacaatctggtgggtgatgcaagagtctgtgatgtcatagatggctctgatacacagagatttgtcccaggatacattcccaccaaaactcctgatgatgaaggccaatgcttcagggggcacctctcggttcaggaagaaattcaggccttcaaagagtttcttgtgcttttcttgtgcctccagctctttcctccgatctccctcctgtgctgtcacctccccatcagtagagaattcatcagcctcagcctcctctatagtaggcaccactactcgggccaggctggcactgagggcagccagtttctccatagagctctcagagtccaatgcatatgtgttctcgctgatctttgtctctgcttggacttgatattcaagctttggtgggtagtgaaggttgagtgactggtagagacagaagttgacaaagcccagaagtgtggtataaaactcagtgaaggtggccaggaccctgtagtccacatcttttggatgatcatgggagaaagcatagggtgcaatccatacaatgggctgacccagcacctcagcctgataataaatgcctttaatggacaggaagaccttgcgcagggctcgggcagtgatgacgtagtgcaggaactccacagtgagccgggggcggcacaactgaaaggtctgcacgtgacacttgccagtccgaaggaaggtggagaagaggaagcacattgacagggcatcatcgaggtcctgcagagcatcgataaatgtcaggtaccgctccttgacaatgtggtcaagtttgcagcagggtttattgtccttcaggcgctccatagcattccattcgctctttccatgggctttgctgagcttcggaacaaacaccttgtactctcggaacttgttgacgatgggctcatggaggaggaatttaatgtctttgataaggtaaaatgtccaggctgctgtggaacccttgttaactttcttcttatgcttgggttcgtgaggataaatacctttcaggatgcacagccacctgaagtcaggcaggctcagctgcagcttcttcctggccttgtttcgggtgatataattgttggcagagcctagttcatacttcttcttttccagacctcccatagctccaggttgagaaactcaaggcagcgcaggacagccgatgtcattgttctaactgctgataaatactccattgtgtaaatgtacccttcaattgagggacatctaggttgtttacagtttctgactattatgaataaagctccaaggaacatgggtgaaaaactgtagctgtggtaggataagtttggtatatgcctaagagatatatagctga

SEQ ID NO: 4525 - DNA, 1400 bp, mus musculus
ttttttttttacattttgaattttctttaacagttgtcaatgtcttttatggcatcttgtacacctgagattctctcttgtatctcttgtattctgttggtaatgcttacaactgtaattcctgacctctttcctagattttccatttccaggtttgcctccatttgtgttttctttattgtttctacttccatttttcagttttggatcattttattcaatttctttacctgtttacctgtgttttcacatatttcttccagtgagttagtgatatacaccttaaaggactctattatattcttgagatagggttttaggatcgatttctgagtttcaggtttgttggtgtattcaggttttgctgtggtggcagaactatattctgatgatgcccatgcattttgacttctgttgctttcggacttgtgcttgcctttggccatctggatatccctcatgtttgttgatctgagtgagtttctggagtctgagtcttttgaccctgggttacttcaggtctcctggtaggcctgtgaccctggctttagcagacactggtggacccttacaattgggttctcttcacaggggcagagaagctgctgatctgttgccctggctgcagtagatctcctttgaggtcttcagacttttcgttctttaatggaacagtcaagctgttgtccaactgctctgaatggagtggattctcaactactcaacttctctgagtgcagtactcctctatgatggttctggatgtggtgtcctcataggagcagacctactaggagtctgccccagcaatgaagactgggatgaagtggtagaaggtacaaaagggaagcagtactctgaaggtaagggttttggtgtgtgttgtgtcccaagtataccaggttcccagcagtagctccaggattggaggctgggggtggtgctttttaccaaatgctctgagtgcagtgggtcctctaggatgggtctggaaatgatatcttcatgggagcagaccaactaggagtcttccccaacagaagggaccaggtggacaatggtcattgttaaaatgacccaaacctccacatttacaacattctttattccctcatttctgtcaaagcaatgcttgcactgtggtcccttgtaaagcagcagccatagccataccttgattgtatgggggtccgaattctgtacaaagatcaatttattcagttaagtctgtctttgctttgtatggccggataaccattcagctggctgcataggcattctcataagccaattgtataacaaaaggagctcctgcctggggttctcaaaaattctgtcagctgcttttagcagtgtatccacaaattctggaaatggttcattgagaccttatttgatcc

SEQ ID NO: 4526 - DNA, 1200 bp, mus musculus
agtcactgatatttgtataagatctatatgtgaaaccctataaaagctcacaaactacactttagtgacctttgctatgaaattatgggaattattgtgacagatgtggttatcacaaccactagttaaagtactacacaattttataactttatagatcatctcttttgcatgatacaatcttgcattataatttatagaatacacatacacacatatacaccacacacacatacacacacatgtatatatacacacacacacacatatatatacacacacacacacacacacacacacatataataacctttatgaagacattagttacctagttaacctagtgttcatacatcatatgaaaaatttgagagacaaccggccaccttcctggtgagagcacaggggtccacccagcccgagaggtttctgcctcaggctccagcgggagccaccttggttcaaggactccgcagagggcaggctgcacaggagagggtgtggaatacagaggccagcagtttcttgcacaggcgagagccagagagcttctgaggcggcaccatttcggctccagacaaccggccaccttcctggccaaagcaacacagcttctgggaaaaaatctgttttgggccttcatcttcagccaggaggaggtccaaacaccagataactgtgcaccttccctgaaagaggagagcttgcctgcagagactgctctgaccactggaactcagaggagagagctagtctcctacgtctgctgctagagggtaacaaaatcaccagaggaacaatatctaaacaaagacaaccataacaactaactccagagattgccagatggcgaaaggtaaacttaagaatcctactaacagaaaccaggaccactcaccatcatcagaacccagaacacccacttcgcccagtccagggcaccctaacacacctgaaaaggtagaactggatttaaaagcttatctcatgatgatggtagaggacataaagaaggaatttaattactcacttaaagaaatacaggagaacactgctaaagagttacaagcccttaaagaaaaacaggaaaacacaaccaatcagatagaagtccttatagaaaaacaggaaaacacatccaaacaggtgatggaaatgaacaaaaccatactagacctaaaaagggaagtagacacaata

SEQ ID NO: 4527 - DNA, 1000 bp, mus musculus
ccgcatttagagtttttttgtgtcactaatgtatattatcacatcttttttaatattgatactttgcctgggagaaagaacaaaaatccctggtacatgggaggcactgagtaccctatgtagttgaccttagctgagttagtgaagattcctatcagtggagaatacagaaactgaagtggctacctcctatagccaggtggaacttgcagtggagagggggagcataaacaccccctcaaaaccgtcaactcaatatgtgtccttgcctacaagatgcatagacataaagatgaggcagatattgaaggaagagccaaacaatgagacccatcccatatgacataatgatctcagctatgctagcagacagaaacttagcataactgtctccagagaggcttcatccagcagcataaccaaatatcagggaatgttatggggtgggcgacagaagttcgtcaactggagggggtcaaatacatcacaagaagacttttagattcaatgaacctgaacccatgatggctcacagagattgaacttctaaccaaagagcatgcaagggatgagcctacaccccaaacaagcatatgtgtagtttggccttcgtgcgaatcccctagaaattgaagagggggcctctgacaccacctatttggacctcagtgggagaggttgtacttatacctgctagaaataaatggctcaggatttcttaggaccaaggtggagctttcccttccctaaggagaagggaaaggtataatgggggatggatttgtaagagtttgactaagaggataggagtgagagggactgtgatgggaatgtaaattaaaaataaattgttgaaaaaagtgatttaggtgaatcctaaatatttaaaccagtatgttaaatggaaagcaagaaattaatagtctgattcattataaaacctttttttttcagctttgataaattttacagtacaagttagcaatctcgttggactgat

SEQ ID NO: 4528 - DNA, 1000 bp, mus musculus
ggacgaattgggggtcaggatcaggtatgggaggagatgaggcagatggacagcgggtcaggaatataatcagtgttgtttaggaatgggggatgtggaactgaggctagccatcataaagtctcagactccaggaaaacatgaggctcccaggacccactgggactgacattagctgaaatacccaacaaaggggagagagaatctgcaaagaccatgtttagaggttaggcatggcccaaaggggctacacacccatttctaaaaatttaacccgtaattgctcctgtctaaaggaaatacagagacaaagagtggagcagagactgaaggaaaggtcatgcagtgactgccccacctggggatccatcccatatgcagacaccaaactcagacactattgctgatgccaagaagtacttgctgacaagaacctgatatagatgtctcctgagagaccctgccagagccttaccaatacagaggtggatgcttgcagccaaccattatactgaacacaggggccttaatggaggagttaggggaaggaataaagaagctggaggagtttgcaaccccataggaagaacagcaatatcaaccaaccagaaccccccatcccccagagattccagagactaaaccactaagcaaagggcacacatggaaggactgatggatctggctgcatatgtagcagaggatgcccttgttggacatcaatgagagaagtggcccttggtcctgagaaggctcaaagccccagtgtaggggatgccagcacagggaatcaggactcggtgggttggtgagcatggggaaaggagatgggataggggtttttcagaggggaaaccaggaaagggaatacaatttgaaatgaggtggggaggaggtatgggatgtggagcagtaggagagtggatgggggggggtgaagagaatagaatatagagtgtaagaaataaattaaaaataaaatacaatttaaaaattgaaa

SEQ ID NO: 4529 - DNA, 1000 bp, mus musculus
attcattggctttttaaaattaatatatttttgcactctatattccatttcttacccctgccccatccaccctctgactgctccactgactgctcccttctccccaacacccttatttccacttcaatgcccccacccccaccccacctgacctctaatttcctcttgagggttaggtgcatcatctctgaatgaacatagacctcaactctatgtgtgttaggggcctcatatcagctggtgtatgttgtctgcttagtccagatcttgggggtccagattaactgagactgctgctcctcctacagaatcacccctctcctcagcttctttctgccttccctaattcaacaacagaggtcagctgcttctgtctgctggttgggtgcaaatatctgcatctgactttttcagctgcttgttgggtattttcaaaagatagtcatgatagctccctttttgtcagtactccatagcctcattaatagtgtgaggcttttggaactccccttgagctggattcaactttgggcctgtcgctgtaacatcttttccttaggctcctctctatttccatccctcatagaagcaggtggaagggggataggataggagggttccaggaggtgggaaaaaccaggaaaagggatagcacttgaaatgtaaataaagaaaatatctatctatcttccccctggaccttgagaagggggtttttgttgtttgtttgtttgtttgttttaagacatcccttttatggcttagtgttacaagactcaacatagtgaccatacatattagccacagatataaagtagaaagtaagctgttatgtaggagggttagataccagtagaaaggggaaagaatacacatattaatggatggagagtgaagtgagatttaaatgggagaataaaacagggaaggggtgagatgagaggggcaagggaggtcatatagggaggagcagttaaaactaaggactatttaaaatcca

SEQ ID NO: 4530 - DNA, 1000 bp, mus musculus
aaaagacaattttacaaataataattaattttcttctctaatagcatgtattatatctcccaagactatgaacacttgtaagtagcggtgaagcttctagccaagtaaaaccaaacctttgtttaaaattcctaattttaaattttgtattattccaaaaatgctattttattttccaaaaattgttggaggagagagacagtaggaaagccctgaggtccaagagaatgaatggaggtatgcagcttcagggagtgggagatggggctgaccctctagaaagccacagaaacctgagagtgagagttattaaccaacagtcaaaaatgtttgacccagaattattactgtctaaaagaactaccgtgacaaaaatgaaagagactgaagaaaagttgatcaagttacaagcctgacttgggatccaagtcatggtgggaagaggcactccaaggcctgaaactattactgatgccatgatgtgcttacagatgggaatctagcatggctgtcctctaagaggcagtaccagcatctgctgagagaaacacagatacttagacccaaccattggattgatgtcagggactcctagggttaaaataggtgagggactgaagaagttgattgggagggtgacctcataagaaaaccagcagtctcaactaacctccctggatactcccagagactgatccactaaccaagcaacttacataggctgctccgaggctgctgcacatacacaacagaagactgcctggtctagccccagtgggataagattcacctaatcctgaagagacttgagtccttagggaaggggaggcctgctaggggaggggaggaggtgaccatcctatgggaagcaaggaagagaaggaatgtgatgaaaaactgtggtaatgggaaccaggatgggagcaatggctgaaatgtaaatacatataataattttaaatattaaacagtaatgtttttactaagatgattaaattaa

SEQ ID NO: 4531 - DNA, 1200 bp, mus musculus
ctgagttcaataagtttcattagaagctataaatagaagttggaaggaggagaataaaacattaaagaaattagatattagactattaaaatattcagttcatagaataaaaagatgctcagttgaagcatcttctgagtatatgcctaggagtggtatagctgggtcctctggtagtactatgtccaattttctgaggaactaacaaactgattttcagagtggttgtaccagcttgcaatcccaccagcaatggaggggtgctcttcattctccacattctcaccagcatctgctataacctgagcttttgatcttagtcattctgactggtgtgaggtaaagtctcacagttgttttgatttgcatttctttaatgactatagaatgtcttagaaaggggaataaactacccatgggaagagatagggagataaagtgtggaacagagactgaaggaaagaccattcagagactgccccacttggggatacatcccatatacagtcaccaaatccagacactagtgtgcataccaataagtgattgctgacaggaacctgatatagctgccccctgagaagctctgccagtgcctgacaaatactgaaatggatgctttcaaccaaccattggactgagcacagggtccccaatggaggagttagagaaagggtctgaaggagctgaaggagctgaaggagcttccagccccatagaaggaacaacaatatgaaccaaccagtaccccagagctcccagagactaaactaccaaccaaagagcacacatggagggacctatgactccagttgcatatgtcgcagaggatggatttgttggacatcaatgggaggagagacccttggtcctgaggagactcgatgccccagtgtagggaagtgccaggacagggaagcaggagtggttgtgttggtgagcagagttaggggtgtaagataggcatttttgatggaaaatctggaaagcagataatatacaaaacttacataaagaaaatatctaataggaaaaaaaggaaggcagagggaaaggaataaattagttttcaaaggtaattgctaacatcttcaataattgcatgggcacatataatcacatattatttcaaggagacagtggccagaaaggatttgccaaaagaaaaatggaagaagggaaaaattgatgtacagtatg

SEQ ID NO: 4532 - DNA, 1000 bp, mus musculus
tggatgttttgagttaggatctttttgctgttttgtattttctttgattgttgtggtgatgttctctatggaatcttctgcacctgagattctcccttccatctcctgcattctgttgctgatgttcgtatctatggttccagatttctttcctaggttttctatctccagagttgcctcactttgggttttcattattgtgtctacttcccttttcatgtcttggatggttttattcaattccatcacctgtttggtcgtgttttcctgcaattctttaaggaatttttgtgtttcctctttaaggtcttctacctgtttagctgtgttctcctgtatttctttaagtgagttattaaagcttttcttgatgtcctctaccatcatcatgagatatgcttttaaatccgggtcttgctttttggggtgtgttggggtgcccaggactaggtggggtgggagtgctgtgttctgatgatggtgagtggtcttgatttctgttagtaggatacttacgtttgcctttagccatctggtaaactctgaatctagttgttatagttgtctctggttagagcttgttcctcaggtgactctgttagcctctatcagcagacctgggagactagctctctcctcagcttcagtggtcagagtattctcagcaggccagctctcctcttgaagggaaggtgcccatatatctggtgtttgaacctgtctcctggcagaggttgtgttccactcatcagatttcttaagatcccgtggagggtcctgtgaggaccttgggggtgtgtggaaactctgcatggaaggaacccccccggtgctggagtgtaccagaagggacttgtgcccctgatcaggctgggttatctgcatccctagttaatgcagtctcaggtcccgcaagattggattagagcagacgctgtgttccactcaccagaggtgttagtatcaaagctttctattgttaatgctattgtggacatct

SEQ ID NO: 4533 - DNA, 1000 bp, mus musculus
aacaaaagtctatattttctagccagatatgaaataccaaatttaaataaaaatcaggtaaactttctaaacaatcctataccctgtaaggtggagcaatggcctatgcacagacagcctgttctccagggggttcttaggccttgaatccccatgggacctggtgggtagtaatttccacctacatgggacagaaggcatttgaacatgtctgctggacccctggctcccgtcgaagttaccacccccacttcccccacaggagacgtatgtagctatgtagcatagacaatgtcccaatcttcttgaattctggctagactcctccccacagttacttagcaacagcaagatagcctagtccactataagaggggttgcttggctccaccttgctctctctgaccttttacctctattactctctagccttccttccctctctctcttcccccttctcttcacgtggccatggccagtctctgcctctctctttctaccttctctctttcttcctgcctttctacaataaagctctaaaactatagatcatctctgatcatgaaggcccaccatacttgaatgatgggatagacttactcctaatgagctgtgtctaacctcacgccagaaggccttcctaagctgcatcagcggactggattaaggacttttgcctgcatggaaccacccagtgactcccacccccaacctcccttctgttctgctctgtggccaagtgccacaccggggcccctattctgttctcagctcctccgccagcatgggatgccagaggctgaaaccttgtacctggggctgctccttgtccactacccaccctatgaggtcagtggcctaacacagcgagatgcccacctggggcctcctggaaagcatccagatgtccttcagagtctgccctcccagaatacctgaatgctggctggacacaggttctctcccactgccctctttccccaacagccatgcatggccc

SEQ ID NO: 4534 - DNA, 1200 bp, mus musculus
acctaaaaaggcatgcatacactgatactagccaaaaagtacagaacaccaatacaaggtaaataagaaggaagatcaagtgaggatgcttcagtcccacttaaaatagagaataaaataattatgggaggcagagagaaggaggaacctgagtgggagagggtaaagggtgggagaattgagggagagtatcaggtttggggagagacagtagggagaaccagaggttccagaaaaggaatagaaatacacagatgtaaggggtggtggggtatccggaaagtgggaatctctaagaagtcccagagacctgggacagaggaggatctaaggagtcaaaccgggtgaccaggtagacaaaacaaccagatgtggggatctggaacttgaagagacaacatcctatagctagaaaggttcctcagtagagtgatggaaatagcataccttctacagagcttttgacagaaaattggtcctatctaaaggaaatgcacggacaaagatggagcaaagactgaaggagtggcagatgagtgacctacccaactggacatccatttcaaggtcaggcactaatccatggcagtattagtaatactatgttgaccttgcaggaaggagcctagcatagctgtcctctgagagactctacctagaagctgactgatacagatgcagattcccacagggaaacactggaaagaggtcaggaatccatatgaaagagttaggaaaagggttgaaagctctcgggagatgatcgcaattcacaggaagaccaactgtgtcaactaacctggaacactgggagcttcaagagactgacttaacaaccaaagaacatacaatggctgatctgaagccctggccatttacactgccaggagctgccttgtctagcctcagttggagagaaaacacctagtcctgcaaagactgatacatctgggtaggggataggaagtggggcactatctcagaaatgaagggaagaggaaaggaaccatatgaggggacacagtgaaggggtcagcatttggaatgtaattacataaatgaatttaacaaaagaaaagacaccattcttttggaatatttttctaatacaaattcaagtaaaagagaacagcagtagaaatttatcacacagatctcacaccatggagtctgaaagcctcagaggactctgtgaataga

SEQ ID NO: 4535 - DNA, 1000 bp, mus musculus
aaatttaaatgtgttacctagttactttctttcctcctttctctctttctgtcttccttccttccttccttccttccttccttccttccttccttccttccctccctccctccctccctccctccctccctccctttctcctttctctctctctctctctctctttctttctttctttctttctttctttctttctttctttctttctttctcttccttccttctttccttccttccttcctccctccccccctctccccctctctctctctctagcttttttttaattcttggtgaattttaaatcatgcaacccagtcccaatcatctaacaatgtctttgtttttgcatcctgcctttgcaacctcccttccaaaagaaaatcaaaaacaaaaacaaaaaataaacaaaatatgaataacattttatcataaaagctataatgtttcactgtgtatctcactgtatatacttttgtccacacacctttagcagaaaaagttcattgtcatgagtcattgttctggattgagggttctggattatattctggtacactaatgatactggatcctcatggtgatctctataggatttcttgttgtaacactatatcatggaaatcatccagatttggatctgcaagaatactcctttcactcattccagcagttcacagatgaggtggatgttggggtaggccaactcagaaccctggatttctgcttaggtgatagcgggcttggtcatcctgccagcttccctgtaccaagaccatgaggatgatctctctagcactgacctggataactcaatcagtgccatagccaccaaggctcagggacagctttccctctcaaatacccctggagtagcttagctgcaaccacacctccagagccagcactactgtgctatccaggcaaggttcaggacactttctcctgagagtttcctctaataaggaacagagccagttctcctgctatcatgactctg

SEQ ID NO: 4536 - DNA, 1200 bp, mus musculus
tttcagtttctgtatactgaaacaagatttaataaataaagaacaagaagagagtgccaatagtgaagtacttcatggaatgaaaagaatcaaaggttgggaaggattcttccttctggccaatatcaagaaattcatacttcttgacttatatattgcaaagacagaccttatttctctttcctgtcttgtaagttcaagggtgaaaacgccaagaagctttgcacaaaaaagaaaaagcatgtagccaaaaaggatgacagtgctgatactggagctagtgccccgagcggcctaataaagccaaaaaaggtgactggacttttaaaagcccaaggaagagcccccattgcagccaaaaccctggcctggttagagaaattggcagatactatgtattccagaaaagccttgtactaaagggaatacttagctgttaatccaagtttgaaaagaataagaaaaagaaggttctcattactgtcataaaactagttggtggcatcaagaatggtggtgcccagttggtgaagattcaaaaaatgcctaggcattaccctactgaagacgtgcctcggaagctgctgagccatggcaaaaaaccttgggtcaatatgagagagggcttcatggcagtataactcctgagactgtactgatcatcttcacctggtgccacaggggcaagacagtagtttttctgaagcagctgggcagtggtttgctacttgagactggatctcttgccatcaaccaagttcctctgggcagaacacaccagatatttgccattgccacctctacaaaagttgataccagcaaggttaaaatccccaaacacttcaagaagaagtagctgttcaagcccaggcaccaggatggtaatatctttaacctggaggagaaataatgagattacagagcagcacaaggctgatcaaagaatactgtgggttggcagattttaagttccagggcttcccaagatctcagttctcctgacaaacaggatgtatcctcacaaactgattattctaaatcggtaacaacctaattaaacaacttcataagttcaaatgattttcacttgagaaaattaagtgtattttttgaaacatattttaattgtttttattttttctttttaattgttgtaacaacatttgttttcttaccatatcttatatttggtttgaaaat

SEQ ID NO: 4537 - DNA, 1000 bp, mus musculus
acttcacatttcatgtttaaattgctagcataaatctattcaaaaatatattgctggtcaaaaaaagatacaatgacaggtaaaataaggtcttttttaaaattttatttaatgtatttttttacactccagattttatttccctccaagtccaccctctggctgttcccaataccatacttccttcccaacccccttctccatgaggaagttcctaactccccacacccccatccccaccccaccagacctgcccactccctgaggcctccagtcttttgagggttaagtgcatcttctctagctgatccccgacctggcagtcctctgccatatatgtcttgggaacctcatatcagctggcgtgtgctgcctggttggtggttcaaggtctgagagatctccatgtacatgttaattgagactgctggtcctcttcctcagcttcttccagcttttccctaactcagccacaagggtcagctgcttctgtccattggttgggtgcaaatatttgcatctgactctttcagctgtttgttgcatctttcagagggaaatcatgataggtcactttttgtgagcatcctatagcctcagtaatagtgtcaggtcttggggcctccccttgagctggattcaactttaggcctgtcactggacctctttttcctcaggcaactctccatttccattcctgcagtactttgggacaggaactattacggatcagatttttgacttttttttttttttttttttgagactgtgttgtttgctgaggatgctcacaactttagaacctagtatgatgtcctctgttatagtatgtgagaacacataaagcaaaacaggaggtccccctgtgataaccttaaaaatgctgggcttaaggtacttggttcttcctgaggaagaccctgaaaaaggagacctgaagaaaatcattacaggcaacagtcatactaggcatactttaatgagatataaaactcattac

SEQ ID NO: 4538 - DNA, 1000 bp, mus musculus
agatcaagaaagcagccaactccacatattaaatggagtacatcaaatagggatgtacaccacctcattagttggtggtgggattgaaaatgatatacccactgtgcaaattcttaaaattgtgcatataattcctaaaatctactaatctactatgtaatccaactgaaccagtccttgggatatgactaaaggacttaacatcctatttccaaaacacttgttcagccatgttcattgctgaacccatactcctcaaaggcaaccaagaagtcatctcaattctgaagccctattccccaaatgcaagggcacccacattcataagagaagcattactataatttaagccacacatcaaaccccacacattaatactgaaagaattcaacaccccaccctcactaatgaacagatgatgtagaaaaatctaaaaataagaaataatgaaactagctgaattatgattcaaatggacctaacaaaaatctacagaagattctaccctagcacaaaagattataactacttctcggcacttcatgacaagttcttcaaaactgatgatgcacaagctcacaaagcaagcctcaacacatataagaagattgaaatagccacttgcaccttaacagattaccacaaattaaagctggacttcaacaacagaaacagcagaaagcctacaatctcgtagaaacagaaaaactctatactcaatcaccattgaagtaaaaaaaaaagtaaagatatcaaaaatattctgaaattcagtgaaaacgaaaacacaacatttgggttggagagatggctctgtcgttaagagcactgactgattttacagaggtcattagttcaattcctagcaaccacatggtggctcacaaccatctgtaatggggatctgacaccctcttctggtgtgcctgaagacaaaagtgtgcacacatacatgaaataaataaatcttaaaacaacaacaacaacaaaactactctaa

SEQ ID NO: 4539 - DNA, 1400 bp, mus musculus
atagtgtaatgactataggatttgaaaggtatatttaagagtttgaggatactgatgggagcaatgtaattgatagtgaagattctccattaatattacaatataaacatttaggcaaccacagatcaaaagaattgaaaactaagataagtattcaccttgctggcttcacagtacttaatttttactcttattattttatttttattaagaaattttatgcataatgaacattacagattgggttacatcataattttctcatttggttgatctgtagcataacttctataaagagtatatttgtaagctgtccacccagaaagccattgccggaacatctgcaggagacatcttgtttcccagatcctgctaagactagtctgcacaagtgagagtgtggactacagaagctagcagcttctgggtgaggcaggagccacagagcttctaaagcagaccccattactggctccagacatccaggcaccttccctgccagagaagaggggtccaccccgcccaggaaggctttgtcagagtatgcatgggagccatctcccttcccggatcccgccaagactagtctgcacaggtgagagtgtggactacagaagctaacagcttctgggaccggcccagtttcgggccttcatcttctgccaggaggcaaatcagaacaacagatattggtgcactttctctgcaagaggagagcttgcctgcagagagtgctccaaccactgaaactcaggagagagctagtctcccagatctgctggtagaggctaacagaatcatgaaaggaaaatctctaaccagagacaactataaaaagtgactccagtggttaccagatggtgaaaggcagacatagaatcttactaatagaaaccaagaccattcaccatcatcagagcccagcactcccacctcagatagtcctgggcacctcaacacgcccaaaaggctagacctgcatttaaaggcatatttcatgatgatggtagaggagatcaagaatgactttaataaatcacttaaagaaatacaggagaacattgctaaagagttacaagtccttaaagaaaaagaggaaaacacatccaaacagatgatggaaatgaacaaaaacatactagatctaaaaagggtaatggacacaataaagaaaaaccaaagtgagacagagctggatatagaaacactaggaaaaaaatctggaaccctagataagagcattagcaacagaatgcaagggatggaagagagaacatcaggtatagaagattccatagagaacatcggaaaaacaatcaaagacaaggaaaatgcaaaaagatcctaactcaaaacaaccagcaaatccaggacacaatgagaagaccaaacctatgaat

SEQ ID NO: 4540 - DNA, 1200 bp, mus musculus
ttgtgtccatgttccctatggaatctcttgcacctgagattctctcttccatctcttgtattctgttgctgatggtcgtatctatggttccttatttctttcctagggttactttcctcgggttactagagtttggttctgatggtgccaagtaaccttggtttctgttgcttctgttcttatgcttgcctcctgccatatgattatctcatgtgcttgatgccctcagtatatctgattggagcctatccttcctgtgatcctgtgcttccatgatcctgtgatgctgagattctgggtgtgtcagagttcttggcagtcaagcttcctctgagaccctgagatcttggtgtgaccaagctcctgggatgctggtatcctggaatcctaagatcctgggagtgttacagcccctagaagtggtacctccctggggactgacaggctgtctgctgtgtttgaaaccaaggtagaccaccaaaggccagaagtaaccagagcctctggttgggcaggtttcctgtgtccctgttcctgctgggaaaggcccctcatggttgttttgtaacagatgttgtgtctgactccccagtgatcttaaaatcctgggcatgctagagtgcttgcagtgtgaagaatcctctggggaccatgggacctcccactgagtttgtgcccaaggtggcccagggctagagccaactagaacaaaccccaggtgttggtcaggcaggtttcctgtgtctctgttcctgctggcacaggcccctcctggttgtttgggaacagatgtttacattctactcaccagtgatcttgagatcctgggtgtactagggcgcctgaggcatggagagtcctctggggactgtgggactgtctactgagctcctgcccaaggtagccaggggctggcctacaagatcttgtatatttgttttttaatggctcaaagaaaataaattcttgaatatttaattagaactaaactcctagttgtataatttatattgtgttaatagggcaagctcagttccttcagttttagaagtatatttttgcagatatatttttaaagagcacacatttccacaataatttaattggagtcaacttttgtaactcagtaccatctggaaataaaatataatggagatactttctgttttatcaccatggcactttctaccagaaaatagc

SEQ ID NO: 4541 - DNA, 1400 bp, mus musculus
agagtaagtcaaatttgcaaattttcaattacttcttttcacccaagtattctaatgttcagtttaagtatgattaccggtagaattacagatgcaaatatggtacacacaaagataatgatgatacaatattgcaaatacatgcatttaaaactcccatataaatgttgcttttatttaaagatgtaattgtctcctccgaggattactgctaaataaacatactctttctagctctttctgaactctatctggttggttcaattcagctgttctggcacaaactcctctccaagctgactgattcagtatggtttccctcagcttctcactgaattgctctgcttggccttaaactaactctaccaatttgttctaatcttctggctcccgcttattctactagtctgcactgaacttcaggaattcactaatgaattcaactctactgcactgtactcactgactgactcccaactcacttaactcccaatcaattctctcttcttattctgcttttaaatagttcctgcgagagatgggcctatcctatctctgtctcattttgccatatttttctctgatttgtcactttgcccctcaactatgagtttggacttatggctccaactgcatatttaacagaggatggccctgtcaggcatcaatgggaggagaggcccttgatcctatgaaagctcaatgtcatagtgtaggagaatgccagtgtggggaggcaggagtgagtgggtgagtgggtaggtggatggctgagtgggtgggtgggtgtgggaataccaccatagaagcagggggaacaggatgggatgggggtttatggtggggctgggaaagtgtataacatttgaaatgaaaataaagaaaatatcccccccaaaaagaaagaaaattttgcaattaaagatgtatacaaagggactctctgtattccagctagtggaatttaaggtgtgtagtgtgtctgtattgcagctggataacacagacttagctctttggatgtgattctttgccagagaagccatgctgttggattaaaattcctctacctgccagccaacaaaaaattttctgcctttatagtttctttccttatgcagaggtagactaccaagagaatattttacatatcacaaaaagttacagcacacaatgaatagaacacaaagaggctcttcttaaatcattctgatgagcagtgcagttctgtattttactttttatttcacaatgagtatgatttggtatttgaataaggttcaataatctcctaaaatttattcattaatttattttttgaatcaggtagttttgtatataagaatactcttatcttaactttgatgagtttgatcacagtatttaagaaaaataaaaac

SEQ ID NO: 4542 - DNA, 1000 bp, mus musculus
ttactaggcctacatacttcattcatattttgcagtaatggactcccacttcaacaagaaagagatggaaagcaagtagttaaaagaacacacatggtttgtactcactgataagtagatattagccccaaacctcataatacccacaatacaccccacaaactatatgaagcttaagaagaaggaagaccaaaatgtagattctttgatcttacataaaagggggaacaaaataatcacaggagatagagggaagggaggacctgagagaaaatgaagagggggagttataaaggagaggagtaagatcagatatggaaagggacaggagagaaggacagagggtcaggaaattggatagaaatatgtagcagtcgggaaaggggaactgggggtaaccactagaaagtcccaggtgctagggaagcaagggactcccaggacctaagggaatgatattagttgacatatccaagaaatgggagagccccacccatctcaaaaattttaacacagagctgttcctgtctaaggtaaatgcagggccaaaaataattacgcagagactgaaggaaaagccatccacagactgccttcctagggatccatcctatctgaagacaccaaaactccaccctattgctgattctaagaggtgcttgctgacaagagcctggtatggctgtccactgagatgtcctgccagcactcgcctgactaatagagatgcaggtacagccaaccatctgactgagcccagggaccctaaaggaagagctaggggaaggactgaaggagctgaagggaattgtaaccccatagaaagaacaatataaactaaccagaccgaccagagctcccagggactaaaccaccaaccaaagagtatatatagagggatctatggctccagaaacatatgaccttatctagaatcagtgggagggagggtccttggtcatgtggtggcttgatgccccagcataggttgatgctacaa

SEQ ID NO: 4543 - DNA, 1200 bp, mus musculus
gatttctggctttaaaattttcaggatagcaatgtgacaatcaatagacctccctctcaccccaccccccataaaaacgtgaataataaaaatatcccaagaaagaatataggaatctcattcagagggggaaactagtcattggaggtggatggaaagagggcactaggttagagaggaagcaatcatttgtagggagagagggtacaggagagggctgggagtgagtatagaaattggtgagagcatctctcctgtctagctggaggcctgggttgggggttttatacacaaagtctatggggttgaaagtagctgagattacttccagaggtggatatagaaactatctcctgtagccaggcaggacttccagaggaaggaggggataccaatccactcacaatacctttaacacaaacttgtcctgtctataatctgtgcagggataaagaaagactgagcaaagactgagggaaaaatccaaccaatgactgcctcaacttgagacccattcctagtgagagagccaacccctgacactattaatgttactctgctattcatacagacaggagcctagcataactgtgtcctgagaggcttcatccagcaacagatggaggcagatgcagagacacacagccaaacattagggaaatcttgtggaagagttggggatagaaatgaacaagctggaatggtcaagagcactacaagaagacctacagtcaactaacctgggaccatggaggctcacagagcctgggccaccaaccagggagcatgtagttgttggacctagtccctgcacatttgtagcaaatgtgccatttggtcttcatatgggttccctaaggagtggagtgtggtttgtctagatttctgtttgttgccattgtccttgactagactgtctggttgagcctcagtgggaaaggatttacctattcttgttgatactaaatgtcccagagggtggtaccaaaggggggggggtattcccttctctgaggagagcaggaggagacagtggggagagagaagagtgatgatgggacttgaaagaggaaggaggaggaaatggaataaaaatggaatgaattattgtaaacaaagtttctgtcagatagtcaatttttattctgaagttctgcctttctaagtgacctgctcttttactctttaaatttcttatac

SEQ ID NO: 4544 - DNA, 1000 bp, mus musculus
gctcctcccctataccactctaactgccaaaactacatttcccgcctttgtaactgtcacataggttgtctccagaccctcaataggaccctctccatattacactaattttaggcaaaatgtctgaatcaaatgccactaatctatgagcagagaaacccatcattttttccccacaaaactcctgagcataaaaactcaccaattctgaacaggaacatgtacacacacacacatacacacacacacacacacacacacacacacacacacacacacacacacacacacacactggaaatttctactctggaatcctcggccctcacaagaattgctattataaaggctggacctgctcagttcctggctgttatcttgtagcagaggcagccatctctgaatttgtcccccttattctggaccctcccaataaatcctttttatgagtttgttgcctggtgtgactcattagacaaaggcaagaacagaagaatggaagaagcaaaggagtggagcaggactcctcagctcagcctgggatatcttctcatgggagctaaaacacctctgttgaggaggtttccctctcagagctgcgtggttcctgggcatccatgtcttaggatacccttcaaatgcagtatgctcttccttcagagctatatgactgaacttcctagtctctagatacatttccatccaagtaggaagtccaacagcatgtgtatacacttgtagtagtcttgtattcatcctacccgtaagacatgtttaggttcaggttgtccaatatattttcagacttgtaaatcttctaaaattttttttcatttcaggatgtagccataactttgaattcttctctttccatgtaagctggatctcataagttatataataagcgattctggaaaaaaaataagtttgtggggtgcatgtttatgtgtgtggggggggtaagtggtatatgtgcatcacgagaatatgtttgagaatg

SEQ ID NO: 4545 - DNA, 1200 bp, mus musculus
ttaaaattttctgtttgtgattgttttctttccaaatttacatggaaaataagacgttaagttatcaggaaatggcgatgacacttaaaactgtcatagttttacaccctacctggggttcttgacatctacataaagaaagtgaagaaggattttgtagttcaacttggaaaataagcaatcctcccaaagaggaattactaaagtgccattgcttctattccagcagtatgtaatacgttaattctaaaaaaaattataagcaacaaaaggcaacatcctgaacccccattcttagttgaaaaagtttagtttttgtggccttggatgatgcttggtcacctgaagccctgaatttgtctttgtcctctcttttctgaattagcaagctttagtagtgtttataaaaagtgcattagttctattgacttaaaaatgaaggagaaatgaaggccaatttcagcatttctttcagtattgcccatttgttatatgcatcactgattttgttgttgttgttctgtttgtttttttttgttttgtatttgtttttgtttttgtttttgttttggggttttggtttttggttttttgtttttgggttttgggttttgggtttggggtttttttgtttcttgttttttgttttttgtttttgttttttttttgttttttgttttttttttttgtttgtttttgttttgttttgttttgttttttgttttcgagacagggtttctgtgtagccctggctgtcctggaactcactctgtagaccaggctagccttgaactcagaaatttgcctggcgctgcctcccaagagctgggattaagggcgtgtgtcatcactatctggctacatcactggttttaagctgaaaaaaaaggtcatgtagaatataaatatggtatggagctaaataaaaatgtttattaattttagttcttttgttttctttagaatcctggaaggtattagcaaggtgaagtttctttatatcatcatctcatttgaagatttaatataagttatacatattctattacaggagaacatgcaattgaattacattaaatacaaatcactagattgtctcctttaaggtgaataaaaactctcccttaaagaacaaatttaaaaatataataggctccttagaggagacacagaacacaattgagttttaaaaatggagaa

SEQ ID NO: 4546 - DNA, 1000 bp, mus musculus
ggaaaaggtagacgggatcaggtgtagagagagctgagcagagtaaatggaaatcagcagttggggacaaaggaaacatcgctctaagacctggcatggggaggctccagagagtctatgatggtgagtctagttgagacccctagcagtgggggatatggaacctgaagtggccagctcctgtagtcaggcatgggtaagaacaacacatccatgagaccttcaacctcaaatttgttctgcctacaaaaagtgcaaggacaaagatgtcctagatatctttgtgagaatagccaaccaatgactggcccaacatgatgcatatcctattggcaagaatcaataaatgacactatgaaagacactgttatacatgcagacaagcacctatcataactgtcttctgagaggttccaccctgcagctgaagtaaacaaaaggagatagccatagctaaacaatagatggagcttggagaattttgtggaagagttgggggaaggttttaagtacatggaggtgtgtgtgtgtgtgtggggggggggagataggaattctataagatgactaacagaatcaaataacctgaatcctttgaggttcccagagatggtaccactagccaaagagcataaatgggctggacctaagtaagtcccaacacacatgcaccagatggatagcttggttttcatgtgggtaccccaacaactagagcaagagctaaccttgactcagttgccttcctgtgcattctgttctgctaactgggcttccttgtcagtgggtcagtgggacaggatgtgcctagtcctgcagtgactaagtgtgccagagtaggttgagaaaggggtctggtaagggctgagtgaggaggggaaaagatcagggtgtaaaatgaataaataaatgaataaatagatagatagatagatagatagatagatagatagatagatagatagatagatagatagatagacagatagacagacagata

SEQ ID NO: 4547 - DNA, 1400 bp, mus musculus
ttggattagaggaaaatgaatgaccacaaaatcaatcaatcaggtatgaatgatatgttaatgctgcactgggcacatgtgcaagagaaagttcatattaaagccaagatatttatgtattgtactacaatcataatgataaatccaccatattaattataaatcaaaatactgtttgtaacacatgcccaagaatcccttgatacattatcattattcttactgctaaatagtttattttctcctttcttcatgatactgccttgagatcatcatcatcactattctgtattcccaagggaacagtttcttttcttctaaatcttgtttctaaaatccccaatggcaattttgtagagaatcatttaaatgaagttgtgtaggagtgggggatagggaactgggggtagccactaaaaagtcccagatgccaaggcccgaagaggttcccaggatccaaaagggatgacattagctgaaatacccaacaaggatacagaacctctagagacaatatgccgtggataggcacagctgccggttgagtgatgggccacccacccatctcaaaaatattaatctagaattgctcccatcaaaagaaaatgcaggggacaaagagtggagcagagacttaaggaaagggcatccagagactgccccacctagggatccatcccatctgcagacaccaaacacagacactattgctgatccctagaagtgcttgctgataggactctggtctaggtgtctcctgagagactctgccagaacctaaccaattcaaatgcagatgctcatagacaaccatcagactgagcatgcagacaccaatggaagagttaggggaaggactaaaggggctgaaggggtttgcaaccctataagaagaataacaatatcaatcaaccagaccaacttcccccaaagctcccaggaactaaaccatcaaccaaagagtatacatggagggactcatggctccacctgcatatggaacacaggattgctttatctggcatcaattcgaggggagtcccttggtcctttggaggctcaatcactcagtgtagggtaatgctagggcactgagatgggagtgggtgagtggttggggagcactctcataggggcagagtgcggaggaataaaggtttaggaggggaaattgagaaaaggataacatttgaaatgtaaataaataaaataagcaagaaaaaaactgaaaataaataaaggcattaaagcattaaatataacgaggtttcacagatatatcttttgatgaatgttgtggattcttgataagtttttcttttttttttctttttttttaattaggtattttcctcatttacattttcaatgctatcccaaaggtcgcccatacccacccc

SEQ ID NO: 4548 - DNA, 1200 bp, mus musculus
ttgattggttttctctatggtgccagttttgagagcattgagtaattcctgatgcccttccttaaatacaactttaaacttggctaacatggcatgtctttcagctttgcacactaaataggaatatacaattagcacctattttatttgtctatattaaaagaaacacctgcatcatgtttacaacactgcctacaaattaggcataggataaaaaataaaaataaaagtgaaatgaaatagagagagtagatatttcattgttcataattttcacattttaaagctcaaatcaatttatttatttatttttattattttatttatttacattctagtcattgccctcagcccccatcccacacttcctcatcccattcctccttcctcttgcctctgagatggtgctcccctaaccaggcctccatcatccttaggacattaagtctctcaaggattaagcacatctcccactgaagcctgaccaagcagacctctgctacatttgtgccaggggattcaaaccagccattgtatgctcctggttggtgcctcagtctctgggagctccctggggtctaggttagttgacactgttggtcttcctgtggggtagctctccccttcagcttcttcaattctttccctaactcaacagtaggaatctgcaacttcagttcaatggttgggtgcaaatatctgcttctgtcttagtcagctgctggtagggcccactgagtacagccatgccaagctcctgtctgtaagcacatcgtagtaccagtaaaagcatcagtccttagtgtcccaccccccatatagatcccaagttggtctgatcattggaagcctttctttcagtctcctctccatttttgtccctgctgttcctttagacatcaacagttctgagtcagaaattttgactgtgggatagtaaccctgtccttccacttgaggccctatctatctactacaggtggactcttccagtgcctgctccctaacatgggcaattttggctcggtcaccctcattgagtccttagagtctctcaccttcagggtctctgatttaaaagcattaactcttcaatagagtccttgagagaaaccatcttctttgggtggtctatgacactcacttcaacaatgtgtatttattttctcctatatgtttgattatctctcttctctgggt

SEQ ID NO: 4549 - DNA, 1600 bp, mus musculus
ttttagaattgaaaactctactgtgttttatatgagaagtaagaaagcacttgctgagatgcatatttcattcactttttttcttttgtaacatcatttcattctttgtactagacaaagcattctattttctatttttagttaaaatgcacagttattatttttcattattttaaactggcataaataaaagctacattttctcagaacataactgaaaaacttatccgtggcttttcattcactcctgtgagtgagaaaaagcaattcataaaaattttgcagaagtaccacaaggagatatttcactttcttagaaatattttaaataatgtttctgttcatgtcttcctcatttttaaaggagttctaatttttgttaatcatacatttaataaaagtagaatttcatcacttctttccttctttcttcccccagcctcatgattactcttattttgataatcacatacctatatacttatatgtgcacaaatatataaatacaaccttctgagtcagatttgtttgtgtgaatatagtttgggtgctgatcctttgaattagacaacaaataatggcttaaccatcatgtggggcccaaaaattggaacaggaacaatcccaaaagttgttgcataaacatggtgtatgctcttctagctgggctgccttgtctggactcattgatagaggtgcctaacctcacagcgacttgaaacgccagggtggggagatatgcaggggggacctctcccaactcagaagtgggaggggtgaccaggaggaagataatgattgggatgtaaagtggataattaaaaaataaatattaaataagaaattaaactatgagcactattgtttactattgctttatcaagatggaataagatatacacatacacacacaatcatgtgcatgcatacatgaataaacaaatgcacatgcacttatctgcacacacacattcatgtgcacatagtcactcaggcacaatcaaagacacatatgcaatacactcattgtacccacaaattaatgtaaaatacatatatggacatgcacacgtacatatacatacataggccctcctttgaacaaagagaggtcttgattattgactttcatgaccattggatactttcacataatatttttaaccaaggaaatgctaactgaaaatcttatctccggagttctgaagatactatagtttttctttacatactagcctttatcccagaaagtttcaggatattttacatctggcaaaattgcttagcttagttccatttacctttctgactaccaatcctgccgttttttcctattacattatatatcaggattgctccacaaatattagtggatgactcctatgaggctcaaaatcatcctgaatggcaattaaaataattctgcaccattagcaaaaagctggattataagaattcttttacaggacaatgaaaatagtcctacttggtgaattttatagaacaagggtgcagccagcacaaattcttaataatactatcaaaaccatgtctgctaagagattctgaatccagtcaatttgattatgtagatcagttc

SEQ ID NO: 4550 - DNA, 1000 bp, mus musculus
gtcttggtttctgtcagtaagcttcttacatctgcctttcaccatctggtaatctctggagtcagttgttatagttgtctctggttagtgtttgttcctctggtgattctgttatcctctatcagcagacctgggagactagctccctcctgagtttcagtggttagagcactgtctgcaggcaagctctcctcttgcagggaagctgcacagatatctggccttcagaccttcctggtggcctgtcccagaagttgttagcctctgtagtccacactctcacctgtgcagaccagtctcagagggatctgggaaccaagatggctcccccaggtgctttggcaaagtcctcccgggcgaggtggacacctctcctctgtcagggaaggtgcctggatgtctgatgcctgaaacagggtctgactcagaagttctgtggctcttgcctgtcccagaagctgttagcttctgtactccacactctcacctgtgcagactagtcttggcgggatccgggaaacaagatgactcccccaggtgctccagccaggatggccgtttttactatgttaattctgccaatccatgagcatgagagatctctccagctgacccctgttgttgaattggagaaggatgaaagaagctgaggagaagggtgatcctataggaggaccagcagtctcaattaatctggatgcctgagatctctcaaagatggaaccactaaacagacagcatacaccagattatatgaggcccccaacacacatatagtagagggctgctgggtcagtgttcattcagagatgatgcacctaaccttcaaaatactggaggccccaggtagtttagaggtcaggtggcataggggactagggacatccacatggagacagggcagttgggaagaggtataggatatggaatttaaatttttaattaaaatttattaagcaaatttcttttcttgatagtatcagatgaatattgatagact

SEQ ID NO: 4551 - DNA, 1200 bp, mus musculus
gctttaaaattctcaacagagagtcttatcatacctaatttaatatatgaaccttttagcatgaaatattcttacaccacatagagaaaatttcacaaaagtgacagtgaggaaagaggctatccaacaaggacagagcagtatatccttaatgggttgctactctttttttgaaaaactcaacacaataaaccaaacctctcatttgattgcaagaatttgagcagtgcctaagctttcagcacaaagagcaactggaagaggaaaatagacgttttggcactgattgtgtgtcagtattttaaccatattggatatgggccaagagagtatatttccgttataattcagtaaggtaaaatgtcaggtccactgcaacccttcctgatctgactcatcttcagataaaatagtataaaaaagtcaagtggatattttgcactttaaagtttaactcatagtcatatgcattccaatgacaagaatcgtaactatggagtagtaaaatgtaacttcaacaacaggatttctattttgacaaaatcacatttgaaaatcccccaatcttatgtccttccctatatacaatttttatcctatttctcagaggcagaattcttgagaagatgacttccattgttatttctatattcccacttgtcatttattacacccaattacacttgcgtcattatgcattgagtaagctctcacaaattcaccatcaggaagaaatactgccttctgttccactcgagccccagggtaccttgccagctgagtcgccctacacccgcaagggcccacacaggattccccacgggatcctaagacctctggtgagcagaacacagcattccaatccaatcacgcggaacctgagactgcagtaaatagggaagcagactaccgaggcctgacctggggcacagccccttccgctccactcgagccccggggtaccttgccagtggagtcgcccgacacccgcaagagcccacacaggattccacaagggatcctaagacctctagtgagtggaacacaacttctgccaggagtccggttcgaacaccagatatctgggtaccttccctgcaagaagagagcttgcctgcagagaatactctgcccactgaaactaaggagagagctaccctctcaggtctgcttatagaggctaacagagtcacctgaaga

SEQ ID NO: 4552 - DNA, 1200 bp, mus musculus
gaagacactggtcatgcttttatatgagaatgaaccatactatcaagccagaaagaatcacaggaaaccacttgcaatataacaagactgttgaaagtagtatgttgcaataaatctgagattagaggcagttgcttaggagcaaaggctaccatgtacaattctatcactatgcctgcactaacaagttataaatgttagtaaattggaaatataaatgcaactgctatacagagaaccatgcatgctatctagtctattgttttcgcatatgtgtcttagtgagggtttctattcctgcacaaatatcatgaccacaaagcaaattggggagacaacttttctacactgctgtttaccaccaaacggaatcaggactagaactcaagcaggtcaggaatcaggagctgatgcagaggccatggagggatgtttcttactggcttgcttcccctggcttgctcagcttgctttcttatagaacccaagactaccagcctagagatggtaccacccacaaggggccctaccccttggtcactaattgagaaaatgccttacagctggatctcatagaggcatttccccaactgaagctcctttctctgtgataactccagtctgcatcaagttgacacacaaaaccagccagtacaatatttttgctttttttgttgttgttttatttttgttttgtttttcaagtcaggatttctctgtacagccctggctgtcctggaactcactctgtagtccaggctgaccttgaactcaaaaatctgcctacctctgcctcccaagtcctggctgaccttatagtattttgttgaaaagtctgcaagaacactgtgatctgtccttctttcttgtcctcattgtttgcttgatccgtctctttagctttattgtatgcatgtattatggcctgagttatattttgtcacaatgcattcacttacgtattcatgtgatatgcattcaatgtgatggtagctgatttcaaaacatgtcaaaagtatgcccttcactgtatagattatatagtgagttctagatgaatttcagacatttgcaatttttctccagaaaaaaaaatataattataataataaaataaagccttgtattttatgaggagacaaatttcattgattaggattttcactctaatgaataacctaataacttttgaagagccca

SEQ ID NO: 4553 - DNA, 1000 bp, mus musculus
tgatcaccaagattgattaacaagccttcatcacagctgagagcaaagacaaataggtagttgcctaccttggactgcatatgtgaactgcacaagcccctaagagctactttctgctcctttggccttcatacatacaaaatatcactgcatcaatacagattatttaatttcaccacacaatacattaggctaagtttacaaaatatatgtttggaattaattattttaaataaggaaaccttcctacccgtaacagcgactgggattcatccttggtcttgctctctccggaggcaggatactgctgggtaagagatgcagacttctcgctgccagcaggagccccttgcaggaagcccttggtatctactgccaagccatacataggtcgtgccaggtgggcagcttcaacattggggctgtccctcagagtctttgtctgctcttgggagctggacacaggcgtcaagacccctaagcttgcttgagtgtaggatggactaccccgtaggatgtctgcccctctccaagccacaccacgaaggtcatcagttgaactctcagtccagattttatctttcagcccttccttgtcatcaagtttctctctcttgactatgctctcgggaactgtttctcccattttagagtctgggtttagcagactgtagaccttgaggtcaattttgggctcttctttgatggtgggtatggcatggccaccctcttcgccattagcagtagtgatttcctgttcctggcagtgaactgtgttgaagtgctccaatagtgactgagtgtcagcagctgtgaaactgcactgacgacatttatagcagctgtgtgctctcctggaaggaagaaaagagtcaatgggaagtcagaattttgaaaggaatgctctgtgctcaaatagtcctcatgcacctgacttctctcatgcaatgaggtagaagttgaaagaaatgcaatattgtcaacactcggaaattaaaat

SEQ ID NO: 4554 - DNA, 1400 bp, mus musculus
tagagtggagtagcaatgagatacatccatcttttctatagggcctaaaagctatgtgtctggccttgggagctgacactgaacatgaaaatatgaattcacatttcatcacgaatcactttttttctcctcctggaaatcacaagagaaaacacaaacctgtacatcataggttccgtttagtaaagcaggccgtgaagagctgatatcctgcagcacgccagaaagcacagaacggttgaccttctggaagtctttggaatggctgaactgcaccatgttatgaagggccaagattttgctgtccagctcagcatcctgcctggtgcgattatgcagtcctaagtgatactttcggaagtgcttaatcagatctgtggggtcattgccatagtaaccgtatccacagatattgcatttaaagtcctgaagctctggagacagaggtgccgggtctgggttgtcattcaccagtaagtcacctttgggtttactcagtctgacacccccatctgaaggcacttgtgggttttttgaggccacggaaactggactcaaaccttgacaattggcttgaccactctgcactggccctgtttcctcagtggcctttggtgacattttatgctcttcctttgtctccaatgaatcccctgatggggtgcaggccatatcttgagggtcatctgcctctgctctttgaggagacttcaagggctcgcagactcccccagcagctggagatgagaaagccaacatatttctgtctgttacctcatcatgtgggaaggagacaaggctccctcccttactggggctttcataattgaagccagccttctcactcaggcctgagatttgcaagtccttcttaccgctggaagatggctcttggccatgcgtgctgtgttcctccttcgagttcaactctgcaacatcactctgatctgtattttctgacatctgatctgcagacaattctttgttcttcccagataccttgctctctgtagctgttggctccagggtttgaccctcgccttcactagcaacgtttctcagaggggggttctttttccggaccatatctgtgaacacatagggaaaataaaggcacatggttattggaagattatgcacaggtaacccaatctaggatatattacagtctattcaaggtcttccaaggtgcacaataaaatagttcctctgggggcagggagggagattgcttcaaatacgaaaacaaaaggaggcaatcagacaaaagcaaatctttgatatttgaaacagtttaatgtaaaagctggctggtatatttttttaaggtaggctatgaatattaaaaatctcatagccataatcttaatcattgccacccatgttatttttgactaatt

SEQ ID NO: 4555 - DNA, 1200 bp, mus musculus
aaatagaacatacatctggcctgtctacagtaagggccttgtgttgtcttacacggtacaattctgcttttctccaggagaaaaatctagtcaactagttcaaaggagtgagaaaatatgtttgtaaattgtgcttgtgactgacattgtgaacccctggcatgctaaaacctctgaaagttcagtgacaaaattccaagatgtgtgatggctgctgaggcaaacagggtgaaattatgcaggggaaaatgcacttcgtttcttccaaaatgcatggtgcaaagaggaagggagcacagatcgtgagaaacctgtatcaggccttttcagttgaggtaagtgctaagtcattatcaatattctagggatttactgcaggtgggaaaatgtgcatcagtttgcaaagaacatgttaggatctgctgaccagttccacaataactcaatgtgctaggtcaaagcaatggagggaagggagttgccggatttcagcagattttgaggccctgggctctgtattgtttttttttttttttttttaaagcttgctgaagcaggaatatcctaaacagcatcctgtgtgagtcaggtccccggctacaagtgatgccgccacgttaccacatagttgtggttctccatgctgtttgcttgagtgggcaatattttcttttccattctgtttgtggtctccatacttgtgactatcagtctcttgtctgccttctttgagcttggggttttctattttctgtagtttgtagtaccttaaccttctttaactggttggtagccactgtttagctttagttctacccatctgttggagctttctagcttttctaacccactgttgccttggggccaggttgtagctctttcccgtaatgattagatgctgtaggtatcaattttaaaaagttttaagtaagcaatctctccaacaaaatgcactttaatcttctaagaacctgtaagaaatggagctcaaccctaaggacaacttacagtgaagttgtgcattaagatttatggaaaacatgtgctgactttctcagtaagtgcttcttgcatgcctcgagttaagtcccatgctagctcacgaaagaagtgtagtcaagagttcttactgatctcaagcaatgtcttacactagaattaacacaacatgtgctttctttctctagtccagtttactag

SEQ ID NO: 4556 - DNA, 1200 bp, mus musculus
tgagttctcctagtatgctttcattctcttgatttcactgtgcttttattctctgtctaatttccagagtctttgttaggttccaactgagaatgcaaaacacaaaggggataggtttggcattaaacaagaaaggttctgttatctcagaagcatttgccatatggactcttaatagaggcagacacgggaatgctttcttagaagactccagaatgtttccagagacacaggcatgcaaattaaaacttctgcagccaccggattgatttactgtatgcatttgccagaggttttaccagaatactctgcaatatgaattataaagtgttttttaatagctagaacaagtaggacattatgagcctcgttgttttgtgttatatacaccaaaaagagtaaaatagaggcaaatagatgtgttttttatgtacagtaatttatgtcccttgtacccccttgcattgatttaattgcacaacatagttggaaacaggagagagggctttaaactaaagaacataattccaaaaagagatggagactagtgacactccctccccccaaccccggcctgaggtacttcagtagcattctgggttggcacaatgatgcaaaaggtcagagattcatagagctctcacggttgattctgaatctggtgtgtctgaggctggcaggtttcctatgcactgtgagatggcagtgcggcatcctgagttgccaaagtcagcagtggcttctggactggtattacagacaagaagaggagcaaggcatccgtggatgctccaaagtatgtcgaggctttaatggaacattgccgtgtgatgagtcccaggaagttaattgaatcacagttcgaaaaatgtctaccccagcatctgttgggcctgagaaccaagcagatagtcagctgatcagaggggaaagggtgacttctcttgctgttctcacccacctgcctggcatcccctattgatatctcatactccaagctgtcacctgcacgatcacttatacacaaggatttggagtttgccatgtaacttgcttattccctgagtattcatgggatatcataaactaacatttgttgatcggcaaaaatgttgggtagtgaattatggattttgcaagtttgaataagcaattaatttataactcaatgtacttgaaaatctgtgtatacatcatatc

SEQ ID NO: 4557 - DNA, 1200 bp, mus musculus
tgtacttctttgttgcagggggcatagttttgtctattccatcttctccagaaacaagtggaaaattagagcccattctgagtccactgggggaacatattacatgttttcatatctgtatgtagggttatggaatcctgcatccactctgccacagggttcagcctctcagggaggcaggatgtcttgggatgttgaccgtggttaccctacgctgttgctgggagagtgttgtgtcataaggaagccctgggacaccactccagggttggggaagtgcagtctgaggtgcaggatcactggagctgattcggggtccctaggcctttgtcaaagccagggccatctggttctcaggttctccgacacccaggctccaatgggagcctcagaacagctaagaatggagtagggggccccgcaggctgtatctaccctgtggctaggggtaaaggggaagctctggctgttcccaagtggggagttcttggctcagtgaggggtagtcttggtatcagccatgtctggaagcacagagaggccttctaccagagattagatggcagctctacaggtgaaggccttctccatggctccccgcatcggatcccattgaaaagaggcagttcatggttttaaggcatttattgtcatggtgaaaagtggatgaataaaactgtaccccacttctcaggatggacctgagattaaatacccttttcagagaggagtatctgggaaggagagtttattggctaagtcctccaggcctttaggtacctcattaaaatggagatctgtcttgagcctatgtgaccacaggtcacatcctctacctgtggagtggcttgggggcattgccctttaaggactggaggccacaaatctggggtctggtgccctacctacctcccttcagggtcaccgtggtttctagccttagctcaactgagaacaagtctacctttcacagtcccacatctgtatataacaatgataaagaaaacaaactgtaacaagtctggttatttgaaatgtgacaagaaggaaattctagcactgtgtatgtaggcattcttttttcctttcttttccctttggtgtggaccaggattctgatcccagagttttaggactgaagaattaacatctaagtctctactttgatgactctgaagaattagtctcatcaggagacaa

SEQ ID NO: 4558 - DNA, 1200 bp, mus musculus
agttgtatgctgctcaagggagctgaagctatgaactgccaaatattctcaacataccgtcagttcatgggtctcaatgtgatgtcctctccccagggctaaaagcctgttcttccaacctcattatcctgcacatgcgtgctattggaaaattcaggttcttgtggctggattaaaaactgaagagaagaaaggggcgtggcgtatgtgggaaacatgctccctgccaagtcttccagcccagcctgccctatgggaccattaccacacacaacgtaggcactgaggacgtagctccaaagtagtaagaagtctacactagaatacttagcacaactcactcagcttaagatatctggccactgatgtgagttagctttgcttcccaaccacagagtggactgctgtcatgtcagacccacctactgtcgcatcaggtggggaagacacttagcagtgaggcatgaacaggcatttagggatacaggcagagagccctctatggcataccagagaaaaacccttccttccagactgatagtcacgaatgccattttcttgttcgttgagtgtaaatctttttctttctacccagaagctccagcgcccagctgaacatccctactttcccatgagcggagcaagccgaaaagattgacgtagcttttgcaaacatgatcagcttaggcgctcaccaccatcagcaaatggaacatgaagttaattgcttcaccagtggaagagtcgcttcgctggcgttcttcatgggcagaccttggtctgcttcatgcactgtgaggctcagcagaaattaccggcacttacatgtcaggaggacttgtttctgggagaaatttttctcggtgtgccattaataatttatgaataggccaatacataaaaccacactgtacaaggcactatgtaagcagcataaacagaacgaaactggtcaataaaaggaaaaggaaaagaaaatattgaaatcaaagtaggtaatatgtgaaatatagacattatcttgtatgtattataaataatcagaaaataaagaaaaatcatgtaggattacgcaaccacaagtagcacgtgaactctttttttttgttttgttttgttttgttatctgcttgctgtatagcagatgggacctggggatgttaatctagctaaaaagatttttaaaattagtgtttatgg

SEQ ID NO: 4559 - DNA, 1400 bp, mus musculus
gtatgtacatgtgatgcaattttgaatgatttaaagtgcatgatattttcaaaagtttatacttaatactgagcgcaaaattctaagtgaattacactgtagtccgtgagaccactctctatactactgaattttctgccatccttgagatttaccccattaataaataaaagcagccatcaaacgatgtagtcaaatttgatggtaagtttggaagtaggaaagagaccaggaatgaagattcatagcagcagcagaggacatgaaacacgttagcatagaaaggctctgagattagagttcggtgttaattacagagctttgttactttgccttagaaaagaacatgagagtttagtttaagcttcatgacaatatttgtgtttgggtaaaactaatagaacagatttcagtagagtcctaagtggactaattttgataaagtaccaggaccagccactgttagcatatgcacaatgtacgtatacagacagaagcaaagtcaatagataattttatattatagacgtttgtactatgtccatgcaaggcttcacaacaagcaaaacattgagggtcattagagcctctctcaacagaacatggagaattgttttagaaagtctcattgtatttcaagggcaggagctctgttagtgtgatggcaaatcgtgtccaggcatcgaaccacatccatgctgtgggaaactttgcatctacaaacaagaattaagtgaggttcgcttaggtaggcagtagtacagtgttttcatttctgaggccagtgatttcggagactgaccttagctcgcatatgccatgccagatttgtgtgggacgacttcggtttgattctccgagtttctttccctgatcaccaaacacagtgtagtgacctgatgaattgtgagcggctttctaatgcaagatttctgatttgtctctgctctagaattctaaagagtcttgtcttctgtgacgacaaagcagtattgcaaaagcctggattttgactcatagtaaggccaagttcaagtgtgcagaacacggtcttgtagcctgctcatctgtcataagaggttacgttattgtttatcacaagtttacattctgttttcaaagagctatttcctgcatggagattgggtttcttattccttttgaatctaaggatggctatgcggtcttaccttttaagacttaatgtggataaaaagaatatatgtgcctttaaaaatgaacattctatatttgtcatatctctttcctattatgttaaccatagatatgacttaccatcagcttttgtcctggatgtaacaaaattttaagattgttaatggtcacatatatcatggcaagaattaaatctgttctgagtcaatgtaaatttgttacca

SEQ ID NO: 4560 - DNA, 1000 bp, mus musculus
attccacagctgccacaacttgggactttctatcagtccatgctggtagttttatgccaagttgacacaagctagagttgttttggaagaggagacctctattgaaactatatcttcagtaaactgagtacattttcttaatgggagactgatctgggatggcccagttcactgtgggtgatgccacccctggtctggtgatgctgagtgctatgagaaagcaagctgagaaatccatatggagcaagccagttaatagcagtcctccatggcctctgcatcagctcctccctccatgttccttccctgcttgagttctggccctgaattcctttgatgatgtactgtgctttgaattgcacactgaaataaagccgttccaccccaaattgtttggggctgttgtgttttaccaaggcaatagaaacccaaactaagacacagactatgataaataaatgtttccagtatctcataacagtgccctaaataacaatcagttacctaataaaaacacaaactctcatttaactcaaatgatagtaaacgagactgtcagaaatttttaaagagaatgaagctaaggaatattgacttgaggaaattttctattagaatgatcacctaagacacaaatggtagcacaagccagcaattcctgcactcaagaaactaagaaaagaaggtcacatgttcaaggtcagcctgggctatgtatcaagtttatgatcaatttggagttaaatagtgagtcccctgcctcataaaaccagagctggcgatggaattcagtggcaaagcacttgcctagcatgtgtaatgccctgcaagccatctccagctgtaaaggtagcttttatttgcctgatttaattgtctccaagacttactgcctccatctgataacctaagactagtcctggaagcttctagctttcatacaatctaatctaagcctagaatgtttttcagcctctgaaagttgctgctcaatacactc

SEQ ID NO: 4561 - DNA, 1200 bp, mus musculus
cccttccccatccttccctcctctacatctctgacaagggtaaggtcccctctgggtactacccagacagctcaagtccctgcagaactaggtacattctctcccactaaggccagccaagacagcccagtttggggaacaggatccacagactgtcaaaagatctaagataagcccctgctccagttgtttgggacccacatggaaaccaagctgcacatctgctccatatgagcacaggacctgggtccagcccttgtaagttctttggttggtggttcagtctctgggagcacccaaaggtgcaggttagttgactctgttggtcttcttgtggagtccctatcccatctgagttcatcagtccttccaactcttccacaagacttcccaagttctgtctaatgtttggctttgggtctctgcatctgtttcagtcatctgtgtggagcctctcagaggacagttacactaggctcctgtctgcaagcataataagagtatcattaagagtatcagggattggctcttgcttatgggatgaatctcaagttgggccagtaatttgtgggccattccctcagtccctacaacatctttgtccctatacttcttgtaggcaggacaaactttgggttgaaggttctgtggttgggttggtgtttttatccctccattgcaagtcttcctgactacaggaggtagccacttcaggttccaaatcctccactgctaggagcctcaactagagtcaccctcataaattccctagagcccccatcccagatctctggcatgtcctagagatgccagccccccttcccccttatgatttctattctctcttggccctctctccctacctctggtcctcccccttccacttcccatcccttttcccacccaggtcttcctccatccaactctgatgacaatttgattcccattctgagtgaggttcaagcatcctctctgggcccctccttgttacttagcttctttgggtctgtatattgtagcactggtgggaaggcaaacttatccaaccactctggaaatcaatttgacaatttttcagaaaactggggatagttctacctcaagacccagctatatcaactcctgcatatataaccaaaagatgctccatcagaccacaaggacacttgctcaactttgttcatagcagttttattcata

SEQ ID NO: 4562 - DNA, 1000 bp, mus musculus
gaggtgggacacgggagttttggctgcacttactcaatgccaggcaggttggctatgtgaaactgtgggacaccgttccggggttagaggagtgcaatcccggggaccactggagttggctcaggcatccctgggccttcagggaggctgggaccatctggttctcaggctcttgaggacccaggtatcgctgggagccttgaaagagctgagattggagtgcccccccgcccccactcctggagggctggatctagcctggtgccaaagggaaaaagaagggagagctctggctgggtcccttggggagggtccttggcttattcagcgggtcttggcttgatggaggccatggctaggagtgccgagaggccttctgtgggagactaggtggccagctctttaggcaaaggcctgttccattgctccccatggcggatccctatgaaaaaagacactccgtgtttttaaggcatttattgtcatggtggagagagtggcaatgagtaaaatcgtaccccactttctcagggtgggcctgaggttaaataccttttgcagggatgagtttctgggaaggggagtttattggctaagcctccaggcctttaggtgcctcattattaaaatggagatatgtcttgaggctacgtgatctgtggtcatgtcctccacctgtggaggggattggggtgttgcccttatgtgactgatggctacaaacctatggaaagctgtggcctggtgtcaggagcctagtgtccaagagagtggaaaaatacctaccatccctgaagggttgctgggatttcaagcctgtgctcggccagaaccaagcttcctttcacagccctccagtctctcattagcctggagctccttatatagtctagagagttatccctatctctgccacaccaggtcaagcattacaataaatactaaatccccaagcctaacttttatgcatgtgttctgggtctgtcactgaggttctccc

SEQ ID NO: 4563 - DNA, 1000 bp, mus musculus
tatctggtgtttgaacctgcctcctggcagaagttgtgatcccctcacagaggtcttaagatcctgtggagggtcctgtgtataccttacaaatgtctgcagactccatgcccaaggtactcctgtgctggtgtggacaggaagggacttgtgcccgtgatcaagcagggttttctgcttccctaattaatgcagtctcaggtccctcgtgattggattggagcagcagctgtgttccactcaccagaggccttaagatccagtggcagctgggtagctggcgggtgtcagctgactccaccccctagctacccaggtgatggccagacaccggaagggccctttgtgatttctttattgtttctacttccatttttagaccatggatggttttgttcaattccttctcctttttggttgtgttttcctgtaattctttaagggatttttctgtttcctctttaagggcttctagctgtttatctttttctcctgtatttatttaagggagttatttatgcccttcttaaatttctctatcatcatcatgatatgtgattttaaatccaaatcttgctttctggtgtgttggggtatccaggacttgctgttgtggtagaaccgggttctgatgatgccatgtagccttggtttctgttggtaaagttctttcacttgccttttgccatctggttatttctggtgttagttggtcttgctgtctctggcttgagcttttccctcctgtggacctgtaagcctgtgtcagcactcctgggagaccagctctcccatggcaggacccatgcacagagggctgatgaacagccccagctcctgggtgtagacggacgccagaaggaccctgtcccagctgctcctgagccctgtgttctcctggctggtcccaccttagacagtcaccggatttaaaaaaaaaaaaaaaaacaaaaacctgcatctccttatctggcttccttaatttgccctcatgagtctt

SEQ ID NO: 4564 - DNA, 1200 bp, mus musculus
gactaattacatggtcaattttggagaagctaccatgagctgctaagaagaaagtatattcttttgctttaggataaaatgttctataaatagctgttagattcatttggttcataacttctgttagtttcactacatggctcacgtgtttacaacacatccaggattgttgctgtccatacctgagaacagagaagcccatgtagatatagttaggtgattgcattctcaaggaaaaatttacatgaaatatttgagtatgagatccaacacagaataaagttctcgatgcaaggtctcaatgaaaaacattcttcagctgagccaagaacaggggcaagaggtgttcgatgatgttgtctttgcccagaatgggagagaggcccatgatgactgaaaccagtgctgacttgacatgttggttggcatctgacacaagctccttgatgcagggcaagatttgggtcatgatcacattctcccggcagtcagctgagagattttcacagacctctttgaccttgtgggaggctgtggccctcacctcagcctcattgtccttcatcaccaagcacatgctgctcacagttcttcgtatggctggggagccagtcgtcaatgtctgcttcaatgtggccaaatcactacagaagataggacccattcttgataacagcaccctacagagtgaagtcaagcccatcctggagcagctgactcaggaccaggatgtggatgtcaagtactttgtccagaaggctctgactgttctctctcttgcctgatgcaagaagaagcagcattgccggcctctggtgtctaccctccaacacctacaaagttactggggggggggggcaaatgactgtcacttcctgtgcatactctgaacccaggctcctcccccagcatggttccattcctcctctctgtagcttgggaagacttctctgtccagttcccaaggggctagagcagtacaagttgttgcaggacagcagcctgaaaagaagggctggttgttcctgcccatattggaagagatgggagcatcctaggtcactggcttttgctgctgtaatagagacccctcccccatctatttaccaccacccttttctaaccccaaccatgtttttttgtgtgtcaattgtgtcatccatttttatattattcccttccctactctacatggagaaa

SEQ ID NO: 4565 - DNA, 1200 bp, mus musculus
tgtaattacatcttttatatgtccatttaacttgtcttgtatatttgcacagtgcaaaaacttttggactgtatggttgttatgatagccctcctatcagctgtggtgggtcctgaacattcaggttagtataatgtcaaattaaagaaaagtgacccttcctttgcctgatgctatcaagctccaactttatttttgaatagctgctaatatttcacctgtgtgacagtgttacttatcatatggacagagtctaaaatcatctggagggtagaactctagccatgcctgtcaggaactgttgattagctaaattgatgtagaaatagccatattaattgcaggtggggctgagccctgggcagaggagcctggacgatatgaaatgaacaagcaagctcagcagaagtttttattctttgttctcttctttctgactgtagatgcatgtggccagggacttctctgcagttacagactacaccaagatctgagagtcagaaacaacatgcacatctgcatctcctttaagatcttctaccagggcatttcatcacactaggataagcagctaagaccacccagatactgaagttcagcaaaagatgatacttagagagctggaactttatgtacttcatttgggctgtgtgtatactttaaaaattactaaatgacatttacccccatttgaaaatagaaggagactaccagggatctgcttcatggatactttaagagttaactaaggaatctcattaggaatagtcagtcttcagaaaatactcactccattactgctgtttctggacgatttatacgtaatgcttggcttgctcaagaaaggctatatgggtaagcttgtgttctgttcagaaacatattttagtcacagattccaacaccctgtccaatactgaatcacagaaagatagttttgtttggttttagcttaaacccccgtgagtcaccataatattttttgagaaacagtaagaattctactttcagagaaagcattagccccttgagaaggctgaaaaattatattgtgacgtttgtgttttaactatttttaatggttccaattatctttctaaaatttagctatggcatattatgaaaataatttcatccaactttgctaaggtattttataataaaagttctttctagaaaatttttcgtgctgaaaaaaac

SEQ ID NO: 4566 - DNA, 1000 bp, mus musculus
tacttccctttttaggtctagtattgttttgttcatttccatcacctgtttggatgtgttttcctctttttctctaaggacttctacctgtttgattgtgttttcctgtttttctttaaggacttgtaactctttagcagtgttctcctgtatttctttaagtgagttattaaattccttcttgatgtcctctaccatcatcatgcgatatgcttttaaatgtgggtctagtttttcgggtgtgttggggtgccctggactgggcaaagtgggagtgctgggttctgatgatggtgagtggtcttggttcctgttagtaagattcctatgtttaccttttgccatctgttaatctctgtagttagttgttatagttgactctgtttagagattgttcttctggtgattctgttactgtctatcagcagacctgggagacagactctctcctctgagtttcagtgctcagagcactctctgctggcaagctctcctcttacagggaaggtgtgcagatatcttgtgtttggacctcctcctggccgaagatgaaggcccaaaacaggaccttttgcagaagctgtgttgctttggcaggtaccagaagctgtcagcttctgttgtgcactctctcatctgtgcagactaagttcctaagttcggtggaatcctggaaccaaggtggtgcccgctgctcctgaggctgtgggcttccgagccttattaactcgataatatctcaataagaactgaatgtatcatcaaagatatagttcaatatcagtgtcaaagtagagagatccttggaatgtgtacatcaaatgtaaaccataacaatgtcactgttagcaggactaagtggtgacaatgagctggcctttattccatcccaattatctttattcttgatctaatgaccaaccatactttttcttcccattgaagattttccttatatctacaataatattaaaaatgtttttgtttaaaaatatttttc

SEQ ID NO: 4567 - DNA, 1000 bp, mus musculus
tggagcttaacaactggaaattgtttcagctaagtatgacttctggtgtcactaaggttcatttgtgactctgcttaagcctctaggccacaaacagtaagtctagattatgatacatttttattcttgatatccctcatgttgcaacatgctggccttaaccactttggcttggtaggattttggaagagcaagcaaaagtgggcaaagctgctgaagcctgggctggcacaccttcatgctttctgtcgtgggctggatccaagagtagggctcttaagtcctaaagcctactattaaggatatggatagagggaaatgcaactaagactgcttaagtaatcagtcttcagcaaagaaaggaataagtgaagcaggtgagactgatttaggatctttcttttatctaatgaatgatgtgtactctattatagatttctatcctggagggggtttaccaacatgaggatatactccaacctttatatttggtagagtcatcatgaataaaatgaacaaggatcctttaagcaaagagatgcgtccacagccagacaccatcaggtgaggcgttcagagaccagagccatgactaagaagaaagaggccatgactttaagtgagtcaggaggggcagggagggaaatccagtgacctaagtggatgaataggccaagctctttccttaactgtgactaatgatttgatagatgaagaaatgtgcttcagttggcaggtcaccacctcacccttgtgtgccaggtttcactccatgaagccagaaaggaggttccctgggatttttgcaaatggaaaggaatgatttatgttctcacatgagcacttgcaaacaaggactggggaactactttccaagtcgtattcttcctgtatgagaaactcagtgggtgtttccagtgcagtgtgtgccttgatccattctcttccttggatattgctgctctagtcattcggtaacattatttatcgtaccagaaat

SEQ ID NO: 4568 - DNA, 1000 bp, mus musculus
gtttttgtaaattaatttatttttttatacttcacattccattccccatccccccatctaccctccaactgttccacatcccatactccctacccaccccctgtttccacgtggatgcccccaaactctgccccacctaacctctaaactccctggggcctccagtcccttgagggttaggtgcatcatctctgaatgaatacagacccagaagtcctctactgtatgtgtgttgagggcctcatatcagctggtgcatgctgcctggttggtggtccagtgtttcagagatctcaggggtccagattaattgagactgctagtcctcctacaggattgcccttctcctcagcttctttcagccttccctaattcaacaacagacgtcagctgcttctgtccattagttgggtgcaagcacccactctttcagctgcttgttgggtctgtcagagggcagtcatgataggtcccttttggtgagcactccagcaggaagacaaggcatcaagtgaggaatggggttgacctgtaattgttcctgtctgaaaaaattacagggattgaaatggagaggagccttaggaaaaaaagttccaaggacaggcccaaagtgggatccagctcaaggggaggtcccaaggcttgacattattactgaggctataagttccctcaccctactgttgggcgtttcatctaaggtttctccctatgattcctgagagtctctttccttccaggtctctggtgcatcctgtttcctgaggttatttgtttccactctttctgttggccttcggggcttcagtcctttttctacacccaataccagatcagtttcccctcttccccatactcccagctccccactatgattgctttcttctctctccaaagtgggactgaggaatccttgcttgggcactttagcttgttgaccgttttgagttctgtggactatatcttggatattctgtactttttttggggggggggc

SEQ ID NO: 4569 - DNA, 1200 bp, mus musculus
aatttataaattacctgatttataaatcctgattgctgccccccataattccctcacacacagtcccttgcataattctcttcggcctctaccctgagaggatcgaggctccacctgggtatccccatattctgtcacaccaaagtctctgcaggtctaggcaaatcctctcccactgaggccagaaaaagcaccccaattaggggaacatattccagatagacaacagctttagggatagccccacttcagttgttggggactaacatgtaaaccaagctgcatatctgctatatgtgtgcaggaaggctatatatgggctgcatatgtgcaggaagtccagactgtgtaagttccttggttggtggttcagtctcagagaggccccaagggtccaggacagttcacccttctggtcttcctgtgaagttctcatccattttggggcccacaattcgtcccccaaatcttccatgagtctcttagcactattgaatgtttggctgtgggtctctgcatttgtttcagtcagctaatgggtggagcctctcagaggacagtaattctaggctcctgtatgcaaacataacagggtatccttaatagtgtcatggattgatgcttgcccatggaatgggtctcaggttgggccatttattggttggccattctctcagtctctgctccattccccatccctgcatttcctgtagattggataaatttagggtcaaaaattttgtgggtgggtggtgtccttattgtaacattgaagttcctgtcaggctacaggaggtggcctcttcatcttccatatccccacttctgtaagtctcaggtaaggccacccccattgattcctgtgagcctttcccatcccaggtctctggaaagcccctgagatgccaccttcccccaatacccaccattctcctggccctctggccctatctcctgtctctccacacacctgatcctgaaacccctattcccttccccatcacttcttctacccagtttcattcctccatgtgtatcctatgacaattctattcccccttctaagtgagattcaagaatcctcatttgggccttccttcttgtttagtttccctgggtctgtggagtgtagcctaggtatcttgtactttatgtctaatattcacttataagtgagtacatactgtggatgtgctttgg

SEQ ID NO: 4570 - DNA, 1000 bp, mus musculus
ctggttgagtttcagagaaaagatatacacaccacagctaatgagactctttccctcactgacagtcatgcccccgagcacatagacgctccggtgcaaggtgacagctgaggccttgtacaaccgtatgggaagcttggctaggctctgccactggccagtctgtccactgtagagcaagacatccctggtggtctgctggttgtccttccgtcccccaaggaggaggaggaagtcttggtaggagctccttgggggcatgcgccataggagtttacaatcctgggcactgggaccatacaaagagaagatctgtttcctggccatctccaggatggcctggcaagcaggcgaggactggaggagggcgtcattggcaatgaagtgatggaagaaggctgggtggatgtactgcaggcggacctgctgcagcagttcctgcatgtgcctccaccgggcttgaaggtcatgcttcacccaagccatgagggcctcgaacaccttttcctcctcaccacagagcctgtcatctcccaggtagtccctcagctccatggcgcagagctccttcaggtcagctgatgctgccacctctgggaagtaagtcagggccacctccttcgctttcttcttaaggctgtcacagcttaagatttctgcgagtctgactaggcccaggcaattgctgggggccagctggctctggaggtatgaggagcaggcctcaaacacccggggatactgcagcatggcagcagcctccatcagtgggaggacgttggcagctgagatatgaacctctcccgtatacacatacgtaatgacctgctccagagttgtggaactgatgcctttcatctgcactttggcctctctgctctcccggaagtggctgcagaacatggccttgaagtaggggctgctggaggccagcacactgcggtgacaagggacctcccaggccccggagcagatgctcacatcagtcaggatcttgctt

SEQ ID NO: 4571 - DNA, 1400 bp, mus musculus
gccttcattctcatcgtctcggtctcttatgcctatagtatggttctaggcatcttattgcagtgtctgacaccttagtacaggactgggcatctgatgtatgcttgggaatgtttgatgaatcatgataacagctttgtgaggtctcctaagaaacagattgtaaccaaagctggatgtgtggtcatgatatggacacagagatgccttcgctctggtgggtggcagaacatgggggtgggggttcatgtgttgcttctgtctgtctgatctcacatctaggtggcaagcctttgtggtaaaggcatccttctcagaacgctgctttgcagctcattctcttttgtgttttgaaaatggatctgaagctaattgtatcagcaggtcacacaccaatgattgtacagcaccatttccctgagctgtttttgtcactaactgagggctgccagctcattccttcgcctctctagggagcttctgccagggctaaacattgggaaggagaagaggcagagagaggcaatttgtagctgggcgacttcagagttgaaggcagtctggctcctgaagggtggtgggcttttcggttttgagttgtgcttttctttgccccatctcagcatggacttgcgtggggaggttgttacggaagtcctgtctgaggacacagtaataagtgggccaagaagtatgacaatgtcatcaggcacggagacgggctatacagagacctgcctggttggagggtacaatctgatcgtcactgaaggaaggggcatggccagagctgagtgcaaggccgttggccagcctggggtgcagtcacagttagtctgttcagcatttcctccaaggtgctattgcacagcatcagttgcgacactgtgctggtgtcctctatagatgttttctgctcatgtggcatggactggcatccatatcagactcagaggtctcattctgcaaaaaaaaaaaggaacttaaattgtagcaggcgggacttcagtttcagatggaaatggtttggggcccctgggtccgtggggctctaacaagagataccaggctgattccatgcttcctgttgattttccagttctccctgagggacccgctctgttgaaccagcatcagatcacacattcctgtgaaacgccacaaagggaggctgggtgtccacaggctcaggctcctgagtcacatgcctccagatcaaagccagcctctcagtggctcagttttgccatctgtacactgggcacaatggcagcatcagctgcagttgggagtagaataatacttaattgacagctagctggccaaaagaagagtactcactattgggtgacaatgacgaccacgacgacgacaatgatgataaattttatatagtatat

SEQ ID NO: 4572 - DNA, 1000 bp, mus musculus
acttgggcagatgccaagaggacaaatgagccctattagtgaaagtgttggagatccagagtgagagagtgatagcgggacagagtgcttagggaggagccctgagtggtggagaagaaggtggcttgggaaattccctacatgccacacagcagcccttgttgactgctatagagttggaaacatacagtgatttccaggaccttggagccttcctgtcacttttttttttttttttcctgtaacactgggaattctccaagctatctcggccccttcatcttctagtgacttccagaaagtctatcctcattagggaatctgctgtggaatttggaggctgtttctctgggtaatgtgagttatctagacagtggaagtcacaaagggccgtggaacagagggcccgttcccacccgcagggttaatgctcactggggatgctgcttgtttgtcttggaccaatgccttttgaagaaataaatgaaagagaacctaaggctgtgagaagctgtgctgctcacgttcaatagaagctctactcttggacttgggtccaggaggtcaagccctgcccttctatttcagatctctgtggaggcctctctgggcactatatttcagcagttcttaggcaggtggcacagtgcagatggttcctgcaaaacctgttactcagcattagggcttccctgtggtgttcattccaggctatatttttggggtggggatgggggaggggatcacttctagaatcctgcaacaagtatctatatacacagtagaatgtgtccccaggagtctggcatgcagaggacacatttgcggtcttcctaggtgtggccacgtggctttccacgtagggtcatcagctgagtttcttctctctgagatcagggaacttcttgggtgggcaggaatgggtggaacacatctgtgtacctgtgaccatcagcagggtctgctacctgatcctggtcaggatatgactacgtggact

SEQ ID NO: 4573 - DNA, 1000 bp, mus musculus
agaggggaggcagaaatatggaggtcttcctagcaggctgctcagggcagctcagcttgccccagagggtttatagaagaaggaagataggtgagggaatgggagcttacctgcatgattcaggagtctgttggaggtggagggtaggaagtgggaggatggggtccccctgggatggcaggctattcagggcagcctggcttggcccagacagttcatcaagcaggcctcaatcataaaaaagcctcttttttgctttttttttaccataattttcagactataatactcataaccctgtgacaataaaatgttacaacctctccaaagctttctcctaatcacccagatgataagaattttatccttgaaccttatgctttgtttatacctgtaatttgaaataattctattgtaaccatataaacactatatgacatatagttgtctttacccactaataccttcctgaatgggaaagagaaacaggaaggaagtgacaattttccctggaagattgtggagtgctgcaattaaatataaccagcagagcctgcatctgttagggactccaatataaatttcagcttattcatttgtacaaggcctatgcatcagctctggatgtggctcctgccattttctacttctttcttttcttttttttttgaaaatgataaatcagactcatcacagtattcaattaatttcacacagttggttcctcagggggtttgttcccaatgtcctctagctgatgatcaatcatgctcctttggccgtccctaaggccagaggcagcaggtccatgacatgctccaggttgtcgaacagaatgtgttcccttctaagcaggaaaggttccagtgacctttgatggcatttgagagaagtcatttgctctggcttttctgaggccatattgatctctgcccaggattcaattttagacaaacaggcgacataatttatgtaaactgggcaggtaattaaactctcc

SEQ ID NO: 4574 - DNA, 1200 bp, mus musculus
aagattgagacaaggttggaagtgtcatccaagtccttgtttgaagtatgtctaagtctctctattttagcctggacttttatgcaagtcaatatatattcttctttgtctttgtcagagttaagattttctgtcaattgcaagtgttaagagtttaaactgatgatttgaaaaggtaatagtgggaatatgattaacaataagacatgagcatgggagagctggccctgaaacttgtatgttctgcagtggcatgggtgaggaagagatgccatccccttatcccttatcacccacagcaggcacaagagctgtccctgatgtcaagaaaattggaaatctggtcctgctcctcaccagctgcagcatttgggagtgtgagtccggtaccttgcatgggtatcagagtagagctagctatgctggtatgggcataaaagaaagaacaggagagctggctctttccctttttgactgtggtattaggtgacctagcttgagttgtactgaagagtttgccatgggggtgtgggtgcagaggagctgtcaggctgaccagcttagataccacccaggtcaagatccagggatttgatttaggctactccaacatgtgcccatctataaactgctggaccacataaaggggccagttttacaaatcttcatgaacactgcaacaacagcatatctgagaatagtccaggtgagggtgatattgttagtgcagtagaagctagaggcctagaaccagacaatgattcagtgcaaggaatatttgccaattaagtcgtgtggacaaaaccaagtccttgtttgaagtatgtctaagtctctctattttagcctggatttttatgcaagtcaataaatactcttccttgtctttgtcagagttagattttctgtctatagtgtgacacaccatgacacactatagcttctatgaggagattttttttttctttttcttttgggagggaaggttgcaaaggaggaaattgggtatggaggaacagggagatgagtcggattggggtacatgatgtgaaatttacaatgaatcaataacaggttaaataaaacataattctgagtacaactaatcccactaggctctcattaagcagcagccactacggtggttttgttttttgagcttttctgaattctattctctttcatcataatgtttgatct

SEQ ID NO: 4575 - DNA, 1000 bp, mus musculus
cagccttaaaggaaaagaaattctacaacatgcaataatttgataaatcttgaggatgccgaacttatatgtcagtcaagacctcacacacacatgattctacctatgaattatctcaaacactccgtgacccagagagtgaacagtgctctcccagagaaagctctgtagagagggagagagaagggcatttttaggcaatcaccttagtgtttcctgtgcacagaggagggaactacagatctgcaaggaaggtttggatctattctctgttgagggcagagcacatgctatgtattttacctcaatattaaatattatagataacattttccacacatatagtcatacatctatttagttcggtgttccaggctctgaatagatataaaaatctgtatatgaccactcctggtaacatttaagctgtctctagaataattaaaatgctattgtgttagtaactgtttttaagttgctacgaaaaaagtacctgacataaatgacttaatggaggagagactaattttgacacaggggttcagaagggcagtcgcttgagccctgtgcattctgacagcatcatctgtgctgggaactgaactggggtcctttggaggagcatcaagtgctcttggctgctgaaccatctctccagcccctattttccttttttaccatacatatatgtgtgttgtgtgtgcatgtatgcatgtatgtaggcacatttgggtgttcaagggcacatatttctatgaatgctcatccacatgtgagcatgtggagcctttggttggcactgagtgacttggtcaatcactctccaccttctatattgaggcaaagtctcttgctgaccctggagctccccactgctgctagtctggctaatcagcttgccccagaggtctcctatctatacctcctgcatactgagattacaggctggcacctttcccactgggttctatatgggttcctaggaatagaagtctgatcc

SEQ ID NO: 4576 - DNA, 1400 bp, mus musculus
atgcttcctgatttctttcttaatgtttctatctccagagttgtctcactttgggttttcttcattgtttctacttccatttttagatcttgtatggttttgttcaattccatcacctgtttggttgtgttttcctgtaaatccttaagggatttttgtgtttcctctttaaggacttttacttgtttagcagtgttttcttgtaattctttaaggacttctacctgtttagtcatgttctcctgtatttctttaagtgagttattaatgcccttcctaaaatcttctaccagtatcacgagatacgattttaaatctgaatcttgttttctggtctcttggggtatccaggacttgctgtggtgggcatactgggttctgatgatgctgagtggtcttggtttttgttagtaagattcttacatttgcctttcaccatctggtactctctggtcttagatgttctagctgtctctgggtggagcttgttccccctgtgaatttgttagcctttgtcagcactcccaggagtccaactttctcctgagtcccaatgttcagaatgctctcttcaggcaagctttcctcttgcagggaaggtgcacagaagtctagagttcagatccacatcctggctcaagatgaaggcccaaagttaccctgtccaagaagctctgttgcttctgcggcctgagtgctgtcctgtgcagtcaggtctctgagagtctcaggatacaaggtgggactctcacctgagttccagtgtcagagccctgtctggaggccaactctccttagtgatcctaagttcctgggtgtgctagggtgcctgaggtgtggagagtcctctgggtaccttgggaccatctgctgagttcttgtccaaagtggtgtgggttggtgcctacctgaacgaaccccagcttctggtcgggtgagtttcctgagtctctcttcctgctggcacaagcccctcccagttgttttggaacagatgttgtgttccactcaccagtgatcccaagatcctgggtgtgatagggtacctgaggtgtggagagtcctctggggaccttgggactgtcctccaagttcgcacccaagatggagttgggggctaacacagactggaacaaaccccaactgctccacattttccttattcattgaaaaattgatggagagccaggttggtttcatatccttgctgttgtgaatataagagcaataagccgttttatctttgaggtaggatgcatagtcttttggacatgtgaccacgagtagttgggtcatgtggtagtcatattttcagttaattaaaaaactaaaaataacagttaatcaaattgaatgtaggacccccccacaggaataatttacatagaatgacatggctg

SEQ ID NO: 4577 - DNA, 1000 bp, mus musculus
cttcctgctgcccgaagattcagatgtagaactctcagttacctctccagtaccatgtctgcctgtatgctgtcatgtttccctcatgatgatagtggaccaaacctctgaactgtatggcaacttcaattaaatgttttactcatgagactgtgggacaatggaccatgcaaggaaacttgatatagttgagtgggtccagagtccttggcacccaggtacccatctgagatggcaggcggcttcctgctccttactagattcctggcctggaacacgtgccacacttccctcaaaggaaacatgacctgtggtcacctagcccagatcagagttctccatgctaacctagaggccctgagggtttaggaaataagcttcccttcctggaaattctttcctgcaaaagttatttaatatctggtccaccctgagaaggtggtttgcacccatttcccatgatgagcagtcaataaacagtttagaactaaggactgtctctttcatcaagaaccaccatggggagcatggagaaagacttcaataccaagctgtagcctaagtttcctgcagaaagcttccctccattcccagacaactgcaaccaagctaaggacttttgctgatgagctgaggcagagttctcatcttctctgaccctgggctttttgccatcctcagcccctgtggctttcagctccacttccaactcttcacggcccaggggtgcctagatacccaagggtttgggagcccctgacctgacttcatagttcttgactccttggtgaggtaactcagtggtgactgggtatccagaagcttgggaacctcagcttcagcatcccacatcttagactgtgtttacccagcccctgggaagacttggggcttccctaaagcccagcacccaatggcagcagtgcagggtaaacactgtcaatttttgcttctccagcgggtcctctgcaccccagcagcagggtggaatgcaggccct

SEQ ID NO: 4578 - DNA, 1000 bp, mus musculus
tacacatgatatatatccttacatgtgttccttccgtttcattacatctttctttttcttcctttttgcccataatttatttttcttattcactttacatcacaaccacagccctcattccctcctttcctcccagtcctgcccttacaaatcacctccattacccattctccttctcctcagagaaggggaaggcccccttggataccatttgaccctgggacatctagtcctagcaagactaagcaacttctctaccactgaagcccaaccaggcagtccaggtaggggaaggggatccaatggcagacaagcaagtcagagacagcccctgttccaattgttagatgactcacatgaagaccaagctgtgcatctgttccaaatatgtagaacagcctctgcatgttcttttgttggtggttttgtctctgtgaaccaccataggcccaggttcattgactctgtaggtattcttgtagtgtccttgacccctctagcttgctcattctatccccaactctttcacaagattccacagtctcctcctgatatttggctgtcgatctctgcatctgtttttatccactgctagatgaagcctctcagaaaacagttatgctaggttcctgcctgcaggcatagcagagtatcattaatagtgtcatgggttggctctctgccacgggacaggtctcaagttgggccaatcattggttggctgctccatcaatctctgttccatctttatccctgcacatcttgtaggaagaacaaattttgggttgaaggttttgtgggtgggttaatcctcccctccttccactgtgtcctttctgactacagggggtggccacttcagtctctatatcccccactggtaggaatctcagctaggacaacccctataggctcctcccttgtagcctcatcccaggactccaggtagttttagacatggcccccttgattttcattctcattcctggacctctgtcat

SEQ ID NO: 4579 - DNA, 1000 bp, mus musculus
ctgtgattcatagtggactctaacacaaatgtgtttaccagctccctgtctgcatctctaactttttatttaagtaaacatccgtggagcaaacatcacctgccaggattattgttggtaattttacatgaatttcctcatgagtcacttgaacaaaagcttaattctgagaacttgcttgtaagaggtctctcttagcaacagattgttggagtgagcattttactcaaattgctctagcagcgcttttcctttcaatgttgatcttagtttattattctcacatcaacttacctcttagaaagtaaagatattaatgggaggagtgtggctgtggtcatcaagaccaaggagtagttgtatccgccttcagaaagagtcctcgacagcttctgggacgggcagaagcacagagccgctgaggcagcaccctgtgcgggccgcagacagccggccaccgtccggaccagaggacaggtgtccgcctggcttgggaggcggcctcagcctcagcagcagcggtcgccatcttggttccggagctcagcggaacttaggaaattagtctgaacaggttagagggtgcgccagagaaccggacagcttctgggaagggcagaagcacagagccgctgaggcagcacccttggcgggccgcagacagccagccaccgtccagaccagaggacaggtgtccgcctggcttgggaggcggcctcagcctcaggagcagcggtcgccatttggttccaggactccctggaacttaggaattttgtctgcacaggtgagagtctgcaccacagaagctgacagcttctgggaactgccaaagcaacacagcttctgagagaggccctgttttgggccttcttcttcgaccaggaggaggtccaaaaacaagatatctgtgcaccttccctgtaagagagcttaccagcagagagtgctctgagcactgaaactcagaggagagaatctgtctcccaggtctgccgag

SEQ ID NO: 4580 - DNA, 1000 bp, mus musculus
gcttcattttaccaccagatttttaaaactcatagttaaatgctttaatgtaaaagcaaagcaagtcgggtagggttgaatatactttcacttcgaaataagcctggtacccagcaagcactgactgagagctatgaaatgtggactcctgtgggtaggaattcactcatctactgacggccatcaagtatatcagctcttgtacatctctcaggctcctcttgcttcaacaggacctcagcaggatgtgctttctcccttcagcctccacaggacaaggctttctgtggtctgggtcaccagtgactattaccctcagcccagttctgtgagtgctgccttgtgagatctgagtggcaagatcatcttgagggtgcgctctggggaaagagggagagtctagaagagcacacagcaggactggcttcttagaaatgtgtagggagaaaggaaggaagggacagtactagaaggcatgagtagagaaattggtgtggggatggtatatgtctcttgcccctgagctcaggtggcagtgacatccagtcatggaccctgtgaatatacatgagctcgtttgaacaaaggtaagccaacattaggtaatttggacaagggtagaagatacctaaggaagaggttttgtttttttttttttttctgtctttcaaactctgctcagtttggcttcttttctcatcccttccacctaaactcagtagcttacaccctggaaacttgatgtttccaaactgcactagcctgttttccagctttgttcaccctgcagctcctgtcagtgccccatgcccagaatctgttcagcgggaccatttcataccccagggctgatgtgtgattgctagtctgattccatgtacttcctcctgtgacgttagtgaactaccgtctctcttactcacagtctcctacccacctccgcattgtattcttttggaaaactcaacttaaataaaacacaattgctcctctactgtca

SEQ ID NO: 4581 - DNA, 1200 bp, mus musculus
attgacccatactcagtcacaaaacaagtctcaagacatccaagaaaattcaaataaccccctgtatcttatcagactaccatggactaaagctggacttaaaaaacaacagaaacaaaagagtgcctacaaacttatggaactgaacagctttgttcttatgaccactgggtcagggaagaaataaggagagaaattaatgattttgtaaaattcaatgaaagtgagtacataccatacccaaacctatagaaaacaagggcagcagtgctaagagttcatagcactaagtgcctttgtaacaggacagttatatatataaagcatagttggaaaagtgtttctctctgccttccttctctgattttaaacaaagttaatagatcactaattaaactatataattaactttaaagttcagccttcaattcatatctgctattataattattaatattaaaattgatattaatattagatatcctgagttccagtctagttagctgtttgaagtgcagtaagtcttcctcattatagaaaacaattctattgtattaaattttaatttggagcccacttcctcctttaatatcatagtgactaaaaacaaatgaacatttgagcagcactgtggctggagctgagacaccccataagaggtcataatagcagtgagaactatttacttctctctgtctctgaaatgaaggactggtaatgcagagttcagggattttcctcataaacacagccagtaaagtaaggactaggatatgttgtcctgctcttcgtgactccaaggccctccatcctcccttgactttggagatacttcccatcttcggtgatgctaactaagctatgagcccaggataaatgctctggtgcaagataatatttctgcctttgtcctgctctatttagaaggttgagaatccaccagccagaatcagaagtgtgatagccatgtctcacaatgctgctcatgccaatttatgggtttttgtcaacttagctagcagttatcatacttaacagggatagtgtagagatttagtttgcttctcatgaatcaaatgtctcctattgatccatgtcttaactattgctaccatcctgaattggccaaatgtttgtgagaacctttaggacatcctttgaattttgtttatggaactaaattagattagctagaaatgt

SEQ ID NO: 4582 - DNA, 1200 bp, mus musculus
tattagtcacaggtttgagttcctgtccagctattctatttgttattttaaaatattcaagatatgctgagaattaaataagaaattcacagactcacttagctcctggaaatagctagctagagagcccaaagtaagtagagggatgtttccactgtgaaatgatgatgaatgggaaatccttagaaatgttgtctacctctgtggccagagtaaagtgtatctggggatattctgaggtcaagagcctcctttatgtggtattgggcaaatttctttggtttgttcctccctaactaaataagagagtgataggttcacagagtttcataagaaggagagcagcacctgcttgtaaagaatttatcccagttttcagctcaaggcaatggcagtgtctggatccaaaattatttcataagcaccaatttcatttgctcccattacttctcgatgctgaaagtgacatcacaccgtctcactggtgaagctatgaagccccacctcctcatcaggggccaggaaaggcagatggcttcttgacacctgcagagatttcagagtagctgtcagtgaactcaggcagtggcacttgcaaacggggtccacatctcttcagaagggagagcttcttctctgcccttcagtgctgtcatcttgtggtagcatgcatctgggtacagcatcaactggattatctagatgaactaaaaacaattaagatgtattagggcaggtgcaaagagatacttctgcacttggatgtcccttcaacatggccactggggacaccgagctgcccagttgactttctgcttgagttcatggactttactctcaccacacctgctcactctctgtcttgacactggcccctttggctcttcctaagatggttcttgccatgtcatagctcaagtcaacaacttcccatcattcaggcagtgatgaaactgggaaccttaaggtaatgaaactgaagcaatattatgtaccatgtttcacccaaaggttttaaattcctatagaatcttctttcctcttctcaccatctgtagtcttctagatgaatctactttccctctctttgatgtacaatctagttacacacaattcttaaatcctcaacaaaggtaagcatgttcttgccttagggcctttatacttgttcttttttttttaaatatacttacaatataa

SEQ ID NO: 4583 - DNA, 1000 bp, mus musculus
aagactgccatatccagggatccatcccataatcagcttccaaatgctgacaccattgcatacactagcaagattttgctgaaaggaccctggtatagctgtctcttgtgagactatgctggggcctagcaaacccagaagtggatgctcagtcaactattggatggatcacagggcccccagtggaggagctagagaaagtacccaaggagctaaagggatctgcaaccctataggtggaacaacattatgaactaaccagtaccctagagctcttgactctagatgcatatgtatcaaaagatggcctagttggccatcactagaaagagaggcccattggacttgcaaaatttatatgccccagtacaggggcacacaagggccaaaaagtgggagtgggtgggtaggggagtggggggggagtgtattggggacttttgcgatagcattggaaatgtaaatgaggaaaatacctaataaaaaattaataataaaaaaaactgtatggtacaggtatagtgacagacaagtagaccagtggaatagaattgaatacccagaaatgaacccacacacctatggtcacttgatctttgacaaggcggctaaaaccaaccagtggaaaaaagacagcattttcatcaaatggtgctggcacaactggcagttaacatgtagaagaacgcaaattgatccattcctatctccttgtactaaggtcaaatctaagtggatcaaggaactccacataaaaccagagacactgaaacttatagaggagaaagtgggtaaaacccttgaagttatgggcacaggggaaaacttcctgaatagaacaaatagcttgtgctgtaagattgagaattgacaaatcggacctcataaaattgcaaagcttctgtaagccaaaggacaccatcaataagacaaaaaggccaccaacagactgggaaaggatctttacctaccctaaatcagataggggactaatatctat

SEQ ID NO: 4584 - DNA, 1000 bp, mus musculus
tgatattgaccttaggctagaaaaaaataacttctaaatcaagttcgtaagtattctaaaagtaaagaaataagctaacaacctccattgctgtaaattatatataatacctaacctaaaataaaataaaatggagaacacatagacgtcttgctttcattactgttcctgtgataaactcctctatccaaggcatacaatgaaaagaaggtttagcttggtacaggataaaatccatcacaaaagacacattagggcaagaggcctgaaatagccatatcacacccatagcttcttcatggtactgctcaggtgatttttttttaactcttttgcagttcagaacccagcaaatggtgacttacacatgcaggctgagtcttcctgaataaattaaagtatgtaagagaaagacttagaacacatgacaacaggcctcagccttctcaactactgtgtgtgtgtgtgtgtgtgtgtgtgtgtgtgtgtgcgcgcgcgcacgtgcatctgtgtctgtctgtgtctgtgtgatctcttggaagtgtcctttttctcttatgagagaagaagggagaatgaatcagaggagaaagaaggtagagagtgatgtgaggaacagagagaggccactgaattaaggatgtatcacatgatgtaagaacctattttcaataataaaacaaaaaggaaatctcaagcactagtaaactatatcaagtaaataattaggaagtcattgtataggtgaataatgaaaagatagttttttataattggataatttcacacctaaaatgtgtaaacaatgaacttaactttaaaagaatgaacaatgcatgaacaggcaaatctatgccttcacatagggaacttcctacatgacaataggtgtttaaaaatatgattaactttgattgatattattaagttaaatttgatctgtgagctgatgaaataaatcatacttggggagcagtcttctcctatcctatgtgataaa

SEQ ID NO: 4585 - DNA, 1200 bp, mus musculus
aataaaattaaaattgtaaaaactattacaactatttgagttctgtggactgtatcttgggtatactctaccttttttgcaactaatatccacttattattgagcacataccatgcatgtcctttggggtctgagttacctcactcaggatgatattttctagttctgtacatttgcctgcaaaactcaggatgtcctcattcttaatagctcaatagtattccttgaaccacattttccgtatctattattctgtcatgggacatctaggttgtttccagcttctggctatcacaaataaggccactatgagcagagtgaaaatcttttgggtatattcccatgtgtggtattgctgggtcttcaggaagatctatttccaattttctgaggaacttccagattgatttccagagtggttataccagtttgcaaccccaccagcaatggaggagtattcctttttctccacatcctctccaacatgtgttgtcacctgactcaaaaagctcaacaagctgaagtgcccaagtgaggacacctcagtcccacttgggagaaagaagaaagcaatcacaagtggggatggagggagggacctgggaacaaaagtggatagggtggggcagagtttgagggtagagaagaggggaacctgatctggtattgggtgagggaaaagtactgaagccctgaggatcagcagaaagaatgtaaacaggcaacatcagaaaataggaggttggagccccacaacccccacgagaggttgcaccagaggcatggaagttgagggaatatcaggactcaaagagaggcaacttatagggaattggttgggggtctagtccctgggtgcactgggttgtccagtcagcctatgctgttcttcctatgggtgtgcagtgcaggcagatgtcattgtgactatgccacaccacccagtactgttgcagtgccagatttccacactccctcccactatttataggctcattaacgttctgtggcagatatcacttccactgtcattagcactaacttgaggctacccctctttctgagctgtgatattggaaaacacaaccctaatagaatcattgtaaaaatatcttggtcactcacaaagaaaattagcagtacacttaaaatcaagggggttaaaatacagacaatggctcactcagtatcacagtatac

SEQ ID NO: 4586 - DNA, 1000 bp, mus musculus
tgttctgctctgtggctggcttctctgttttctgtttccccctattctggcgtaagatccatgcagtagggcctctgcctggtccatactcacagtctgtgcctgacccacagtgggtgcacaaagaacatttgtggaccagacttgtgttgctcccgcctgttttaaatgacaggcttgtttgctaatgcccagggcctcccttgggcagatttcatgtccttgaaatgctgaggactgagcctatatcaccaagcttttctcaaaacatgggcttgaatgctgataggaaggccagggcctaggcctgtgtggtggctttggctttgggtaagttcctctgtgcctgaggacctgcagatgagccaatggccgctctatgccagaccactgaatggtggcactcaggatcagagtagcttctggtcctgcctgggcaaaggatgttgctgggtcgctgatgggtcactgttgggaaccacgggaaccatgggaactcctggcagccctgacacagaaatgtcttgtgtcctggaaggaggcctgattgggtctgaagcgaggccttcatgtggtaacatttggaattgggaattaacttttgtagccctgggcccttaatgccctccctcactgatgacgggcatcagagcatcttgaactgtctacctggtctctgcccacgtcacaccaggtactcagcttagcctgcttttcctcagagtccagagtctccagctgcacccggatttgcaccttgcccacctgagtgccagcacagacttgaacgagggccgagcccgccgccgagcctggcagcagactctcaactgcaagattcagcacatcactctacagctgctcgttggcatcttcaggtatcacagatctgggagtggctactgagttcatttcccagcctttcctcatgacaagtgcagcagggtctgctctgaccctgcccaacaccctcccagtcttcaatatctctctctcctat

SEQ ID NO: 4587 - DNA, 1000 bp, mus musculus
aaccactggctgggacactgtgcggggctggctctgctctcttccaggggcccctgcctactagtcaccacagccctccctggtctcctgactgaagcccccacaccttcccaaacagagcatgagcacacgctggactggtggggaggagtcaggtgcagctgccctcccaatggtgtctggcatgtgaggtcactacacactgtcccaagaacaaagaaatactagccctgctctctggagtgaccatacccctaccaccacaacatcgcctggatgtaggctgggcaggagtcagtactcagtactcaagaagagactcagccaacagtcacccagccacctgtgagttcaggggctggaagataaaaacctaggccaaggtaggagttgcctcaccacatggttcctgaagcagaacagacagggcttgcctctgggatccaaagtgacaggcagacccctccaaagttagctaggcaagggtggagggagcacatccacaagaccaacacaaaggcaatgcagccggcactgctgagttgtggagactggactccgagagctcctacttccccctgagagaagcccaggacctaagagaaactccagagctcgaagactctgtcctcaagttcacgtgctgaaactcttgctaaaagtcttgggtgagagtgagagactaaagacgtagagggattgacagttcttttgtatgtgaacagtttgtgatgggaacaggaggacctgagaatcgaggaatgggaaggtgacagggtcaggacagaaggagtccctaggcactaagggctcggggagaacctaaaggcctcaatatttaaggcaaggctcctgaataccaatagtccccataccttttcctttgatgagaccataagctggctggaaggaagatgccccaatttaggagagccacgcctaacagtcagagcaaacacataggtcttccaccaaaatggcttgggcacaacatgtggac

SEQ ID NO: 4588 - DNA, 1600 bp, mus musculus
ttttttttttcgtttttttctgagatatggtttctctagccctagctgacttgtaagccagggtgaccttgaacgcagaaatctgcctgaggttaaaggtgtgttccacaagtgccccagctctactctaattctcttttaaaaaatgtgtgtgtgtatgtatgtatatatgtatatatagtagtaatattaatccattaatatctctttttcctaaaattcatgtctgtctgtctctgtctctttctctctctctctttccttctttattaaatttattcttttcatacatagtttcttagtgtaagcatccctgactgtcttgaagacactttgtaggcctcaatcctgtaagagccttcctctgcttttcaaatgctggcatgaatgttgtacctcactatgaccggctgagattctcaccttttcttttctccccccccccctttctttttatgattctagctttggccaggcagtggtggtggttgtggtggcagagggaggtggatcactgtaactttgcagctagcttagtcttcagtctgagttacaggaaaggagttccaagaatactggttatatttttcatttattatgcattttaattaaaatttaattacaccaaaagaatttagactgaccaattcagagtctgctatttcaaagcataaggaaaaagtaggagaaaaacgtgaggctgtttgtggatggtcgaggctgctttagggagcctcctcaccattctgcacttgcaaaccgggccactagaacccggtgaagggagaaaccaaagcgacctgaaacaataggtcacatgaaggccagccacctccatcttgttgtgcaggagttcagttagcagacaagatggctgccatccacatgtcacctttcatcttggtgaggtcaatgtgcagccgagtgacaggacaaggaagtagacatgcagacaacagacatgcaggcgaaccacctcccttctgtgtttggataaaagacatacaacaatttttattttttacagtaagccttaaaaagcactctgacagccactcagatatctaccttctatgtcctgttttattttgttaagaacacatctgtctttcttccagttttgttgacatcagttggtttttaagttgagatactaaaaggatactcccaagggacattgccccattgtaaatttacaaatgcatttgcaatcctatgaggactagttatatcatgtttggcgtattcacgaccttgttattgtttcaagtggacgtgagatattatttgtgtcaacttgacaaagggtggattgtagtggctattcctggttgtcaacttgactatatcgggaatgaactaccatccacaattggaagactcacatgtgaccctgatcttgaggagatataagtttctgacctggattttggcatggagatcttgaggcatagtgacttgaatcccaggactgaggcaaggagatctctgagttcaaggtcatctgggacaaaaaaaagtcccagatccaggcatggtggcccacatctttaaccaggaccacaccatgtgttggagacctatataaggacattggaag

SEQ ID NO: 4589 - DNA, 1200 bp, mus musculus
cacatgtgaagactgcaagatcccagatacttatgtgtgaatgatgatggcataataagttggaattctgactcttccctgtgttggctacatgcctccattggcgggattagcaagccacaacaaaataacattccaggaagtacagatctgaaaaccatagagagggcacctacccagcaggggctataaagttgaaacaaggatttccacacaaccctcacctggcagcttctataactgataaatcatcatgaaaagtctccagtaagcagtggttgcaactgaggataaaggacaaatgtggaggttgatggaaggaccatcacagcaaggtctgcaggagaactgaatccaggctgaacatgaccagtgcatgacatggtccaggtgctgcctcctgtgagcactgctgcattgcagacatcttccttgcaaaagaaaataaacactttgaaactgaaagcagtacacagaaacttggtattttcaaaattagtagggcagatggaaaggtagagattcttctttactttgcttctgtgagaatcttcaagacattagggagtgactcacttctaaggcatggacaaaagagcatccagatgtctgggctacatgccacctggcatggatggcccaaacttgtctctaaggcatgttgaatccagacatgatagctcagaattgtaatcacagaacttggaagactgaggcaggaggatttttatgggttcaatcccaatctgggctacatggggatttctagtctatcctggggttagagtgagaccctgtctcaaataacaaacaaaatgaaaatcaaaactgtgggctggaaactaggcttggtggataaagtgcttgtgtgcaaaatcatgaaagacccagttccccttgctagagtgcatcaaacatgggcatgggtggtggcctaattgtatttctgtgattaggagacaaagatggagatccctcaggtaagcgccctggctagaccagttcaacctgcaaggttggggttcagcatgtgaccttcctcagtaaataaaatacttgtcacagagatgcccatcaacttctgggtcccaaacacttgtacctcttgagtgcatgtacatccacacatgtgtacacatgtgcccttacacacagtgagctggggaagcagctcagtcagtaaagtgctggccacatgga

SEQ ID NO: 4590 - DNA, 1200 bp, mus musculus
tacccgctaagatagaaagcaggaacttacagtgtctttcagttcttagctccacttaacactgattggtagacccgcctttgacagcataggaccagagctcgggggtgcccatggagtcctctctgctcagaggaggcggtgggtctgaagaagtagggagttactgaaacacactctgatgttttgattgtgattgtgctaaatcctgctatcaagggaaaatgaaaagctggatgtggtggcactaacctgtaatcccagtagtcaggaggctaaggcccgaggatcgcaagttcagttagcctgggacaggtagtaaacttgaggtcagctttggctgtacagcagactatgtctgggaaagcctgggacaggtagtaaatttgtcagcctaggctaaacaattgcctgtgtctggaagaaacaaacaaagcaaaacaaacccctcaaatgacacagggttagttcattcattacagtagaaaatgtgtcagacattacactcatagcagggaatgtgccagaatgcttccatgaagctatagcctagtggtgtcacaggttggttgggagtcctgtggattgattctcccagcagtaagctctggattcacattttcctgacatgtaagttactctgggctagttatcgacatgcacctcagtttctttatctttaagatgaagataacagccaggtatggtgatacatacctgtaatcataccacttgagaggagacaggaggatcggggaattcaaggccagtgttggctatgtaggtagtttgaggtcagcttgggtgacatggttctggggagggactaatggttcgtaacttgtgtggaacactcagaataaggcccaatcaggatgagtcacccgttttctgcttaggttcagtaattggacagctgtgtactagagacctgggcatgtcgcataaataatgatggattgagatggaggctcagcgaggcctgcctgtcttctcaggtcttattttgatccctaagtaaagtcattttctctgttaggtgttgagtagatccctttctcgaacagaagtcttaagaaagacctgtagtcagccagggtggctacagacttacacagaaaggtagggagaagtagagttaaaacaaagtgcttttcttctttttttggtggggggaggacggggctggtgacgctggga

SEQ ID NO: 4591 - DNA, 1000 bp, mus musculus
ctttaagatttatttataggagtattcttgctgtcttcacaccttaagagggcatcagatcccattacagatggttgtgagccaccatgtggttgctgggaattgaactcaggacctctggaagatcagtcagtgctcttaaccactgagccatctctccagcccactacttcatttcagatcttggtttcattcacagatgtgaaaaaggaaggctgaggatataaattgtttgcttagctgcacaggataagtgacagtggtggtgctgagcctgggttgatctgcagtcaccaccattgctgggacactccttaagtataccgttcatggaccacacagcaagcttgctgggcttcatgcagagtgccagaacacagtgtggcctggcctccctccaggcactggtgctagggaacagccctggagtgccatcatctgtctgccccgggggttatggataatgaccttggctcagagtatgaactctgagttgcctagtccagtccgcacatacttgggaggggtgcattgaatgggtaaaggtactctgcatgaagctgagtacctaagtttgatccctggaaccctcataggaggtggagaaaacgactcccttgggctatgctcagaccttctcacgcacaccaatgacacatgcaccggtaaatgtgaaaaatatatgtaaatacaaagagcaaaggtgtgccacagccaccacctggcccgaaggaggatttgtatcctgtagcttagagatcttttcttgtgtgcgcatgcattcatccatgtgtgtgaacatacgtgtgtgggaatcagagaacagcacgggtgctagttcctgccttctaccttaagactgtctctgcctgtctcaccaccacctcacctctgtctctcacacagctctacctctcctgtgagtgctggtggaagccaaagctgttaagtcccctgaagctggggttacaagcatttgtgagccacctgccctacatgg

SEQ ID NO: 4592 - DNA, 1000 bp, mus musculus
tgggagacgacaatcagaaatggcgcctcgcaaggggaaggaaaagaaggaagagcaggtcatcagcctgggacctcaggtggctgagggagagaatgtgtttggtgtctgccacatctttgcatccttcaatgacacctttgtccatgttaccgatctttctggcaagaaaaccatctgccgagtgactggcagaatgaaggtaaaggctgacagagatgagtcctctctgtatgcagccatgttggctgcccaggatgtggcccagaggtgcaaggagctgggcatcaccgccgtgcacatcaaactccgggccacaggaggaaacaggaccaagacccctggacctggagcccagtcagccctcagagctcttgcttgctctgggatgaagattgggcggattgaggatgtcacccccattccctctgatagcactcgaagaaaggggggtcgtcgtggtcgccgtctgtgaacaggacttctcattattttctgttaataaattgctttgtgtaagctaaaaataaaaaataaaaaataaataaaatgatggtatgtaataggtcaattatcaatatttggtaataaccaaataaattgctgtattgaacaaggaacatacacttagtcaggtttttaagacacaatttttgttataggttttctaaaaatatacgaatatattttacaattctttattaataccacagtggttctaataggacattgaaactgtgttttgaggtgaaagccacctcaaccttggccgtctaccctcggcttttctctcaggtagaagaggctgaaggcagcccaatttattgtaggccagaaaacctactccgggtcttagtgagaacaatatggctactctggtcgggacatgtggaggctcatggggcaaaggtgaacgcggccctctcctgagtttgctgtaaagctgcccgccttttggtggcttcttgtaccactatagctcagggaaactgtgtgtctc

SEQ ID NO: 4593 - DNA, 1000 bp, mus musculus
agctgatttctctaaacgcttttcttacatgattttgctcttattcaacaagctttaaatgttggggattgactccagcaccggggatccttgcccggggagtctccggacacccccaaagacatccacaggatcccccacgggatcttaagacccctggtgagtggaacacagtgtctgctccaatccaatcgtgtgggacctgagactgaattaactagggaagcagataagccggcctgatcaggggcacaaatcccttccagtccagtctagcaccggggttccttgcactcagagtttctgaacactcccaaggttctcacaggaccctccacgggatcttaagacctctagtgagtggaaaaaaacttctaccaggaggcaggttcgaacaccaaatatctgggcaccttccctgcaagaggagagcttgccagcagagagtactcgaaccactgaaactaaggagggaactagtctcccaggtctgctgatagaggctaacataatcacctaaggaacaagctctaaccagagaaaactatggtaatggatcacagtcctgaagtggccttgcaccatgaggggtacagtaacctcccagggatgaaagtctaaccaacactagccaacctctgcccacaagattctcagatcatttctcagcttcccaggctgagtttgagaaatcttgtgttttatgtcttgctgcctgatcaactggatgaccacagacctgtagtgaagatggcacatgctccagctgccttccccactgcccctcactaatcaacagagcctttagctgccttcgcaccactacctttcacttttcaatagtggctttacctgccttcccaccactggcccacactcgtcctcaaggattccagcttccctccctgactggccttcttttgcccttaggggcttcatcctctttccctcaactgcaggagacagtcttccactgatctctcacacacagaagccattg

SEQ ID NO: 4594 - DNA, 1600 bp, mus musculus
tgctctgctattgcaatagaaacataaaaattatagttaagcttgtaatggaccattagctcaagtttacaatttaatcacaagttcaagattttaagtcactcacatttgtaaatgaaatcaagaaaaaaaatcaaggaagtggagattattgcaagatttacaaacgattaatgaaactatggaaccgcagttgccattccaaaaaataggtataaagttattgtagatttaaaagattatttttatactattcttttgcatcttcaagattgtaaaaggtttgtatttaatgtacttgtaactgtaggtgacccacgaagcaatacatattattggaaaatttttacctcaaggaatggctaagagtcctatattaggttaaaattttggtgctgcttcattacaagaagttaggactttgtatccttctgtgtatattattccttatatggatgatattttgttagctggttttctaaaggagttcttcatgattttgctcttatacaacaagctttaaaatcttggggattagttgttgctacagaaaagattcataaacaatatccatttcaatatttgggacattagctatatcctaaatgtttgtattttttcctcagaatgctgaaggagcatgggaactgcccgagcgattgttgagacatgctgatgctgggaaaaagaatgatgctgactgtgtatgagcttgccaaatcccctgacaatggtgatagggaagctatattagacgtatgtccctgacccacctttacctgcccatatccatgactggacaacctgcctcaagctttcagaccttttggacagagaacatgagactgtagaaactgccttcaaaaagttaatcgaatagagaagttataatgaccccctctctttcctttaatgtgaccagttattctgactcaatcacggcctagtctggaaatcaattccatatttggggaaaaaaaagtaacagtcttcatttggaaggctttttctgatcatttgcaaagacatatttgaaaactgacagctgccttgtatgaagtgacatttgtagtagataaaattgggacattatcttgattttgagcaaatattactgggtgtgttaaggctcctaattcttttttttttttttttttttggttagtcatgttaaatttacattagtttctgctatggtagttaatgtaagttgcatttaatgtacactttctaattgtgttagtgtattgaaatctagtgttgctgtcatggtgggctctcaacgagcctctgttctatttcctataagtatgacaagaccttggtattctgaaaaaaaaaaaaagcttacagatactggaagaagaagtcaggctttaagcagaagcaagagtttagtgggtttgattgttgccagtataacagttttgattatattgatagctagcatcattacttctgcaatctctttgacacaagaagtgaaggcagctaaatttttaaatgatttagcaaaccatgttactaatgctctgagtattcaaaaagatttagatagacctttggaacaacggattgatgctccttatgatcctattca

SEQ ID NO: 4595 - DNA, 1000 bp, mus musculus
ctatgcacagggggtacagacagatggcacggcctataggcctgccacttagagcaggaacccactgatgggttggggaaggagcgaatgcagagaccctgtgtcaagagtggtctttctccatccctttctctggccagcaggtccccagagagcacagaattcctcccaccagggtcccagtggccactgagtctccgtgtggcacgctgaccctcggagcctaacattcgtgttggtttctacaggagcagaggagggttaggcactcaggccactagacaatgggtgctgggttctttgctacaatatgcaaacaaagaaatcaacgtgtttgatggaggcaaactgtttgaaaaagggaaacaacgagttcccgtctgcctcagggcctccccgccttcatagacaacacatggagaccccacacctcacacacagacacatgtcctcatccttatgctcacccacatgctagcacatgtacagtctcacaaagcagcacacctcctccccaccagcatctgtacagtcccgcatcagcgcccaggctctcacactccccgaagctggcgtgtcacacgtgaccgcatgccgggacccccccaggccagcattcattcacacttacccacacacccaaaaagggcagggagaacaaaggaggtggaagaaaagtgttacccatgaggagccgccgtttcacccgcttgtccacatcagctactgacgtggcattgaactgagagcgctcaattgcagcctcatccttctctagaacacaagtaagggacaaacacggagccagtggttaatgagagcccacttcccgcggcccaagacagtcagcctcttggcgtggcgcacacaaagccaacacagcatgccgggccagcgcggtgccctcgccaagggctcatcccaggaacttccaggcaggtgtgctcagggtaaaacagagtagcagcaagggtgggaggggcggcatgcagacgaagaa

SEQ ID NO: 4596 - DNA, 1000 bp, mus musculus
cctggcctctcatgggcccctctcttgtgcctttatcccagacagatcaattcccacgggccacaaggccagatgccaccttgccttgtggtagggcctggaataggttacatagctactctggctctgttttcctgtgcagagactagaaggctttgacagacagctctgagctttcaggggaaatgttgcatgtccgagcggccctcccgctctgcttttgtgtggtctgactatggtgtctgtcactcccatactgctgtgttgtactggcccactgttcttgtctctcagtgtcttctgtccaccacgcctgctgcctacagtctgacctgccacagttgctgattgcacagtgcagtgaggagaggagggctgggccctggtgcgcagcaggtgccttctcagcctgggttagctctgtgcagcctaccatgtaggtggagctgaagcggagctgtggccagctgccttcacatactgtgttggggccaggtcacaggggtgtggtgggctccagtgccaaccacagctgcagcagctctctgagcagctcacctcttgtggcccatgctgctgtaatactgacagcagccacagggtggcagtgtgcaccaagcagttccttcgctcttgagcttcttgctaattggccctttagcgagtgttctttacagctcaggacccctcagctgcaatgagttaaatccaagaagcatgtttcaaagataaattgagaacatacccttcaggaagaagaagtctgctgtgctgaagtggggaagaccctggcccgggtttgcctggcagctgtttgccattgtgatggtggcaggcaggtgttggctgtgggtagtgaaggctgtccagggtcagccttgaacatagagataccttccctagtgtggtttgccttgcagctttgttggcaagagtggaatttgaaaacatttgagggaaatgacctcaattttatcatgtttctaaaattaggcagttg

SEQ ID NO: 4597 - DNA, 1000 bp, mus musculus
ccccagtgatgttgtgttcagaatctgagtactacagctatcacccaggccccaggccctgaccacccatgaccccaagccaaagccatgcttatctctgttgtggggctagctgacctcatgagacacctgctctgaaagtcctcaggcctgggcagcagtgctgccacaccccaccgccaacatcctaccggagtagggcagagatgacagctgctcagctgggaccagacccggccacccccaaagccaagcctttgttatgtcacctcccttgccaccatccttctctctcctgatgggacagcctgcctgagtcacctccaggtatgtaagacaaaggaactaaaggatagatttagattcatttcctgacctcaggctgaaagctcttctccccatcaccgataagctttctttcctttgaccagaccacagaaacttgaaaagccatccaactttccccttttgccttggccactaggaaactcaagcgacgacctgtcttttctggcttctcctctagacacatatgtgctaccacacgccatatgtggcttttaagtcctccttggcgaacaggaaggacagcaaatagccaggtcaccagtggtcggaccgcagcagcagtgataaagagtacagtccacccaggctgctctcgcaaacacttaccaggcggatgagctctggaaggtcatcaggggtgggctgtgcgtgtctccccgcagtgtgtgcacagcctggggggcttgcggcagggtaccagggggaggctgcggctgtggggccggctgtcctggccgaggggctcgagcagggttcccccaccgccgggggtcctgtttcatccaccgtccctggatcccccaccgagtgaggtaaaccttgcaaatatcgtagttcatggcggaataatagagcagatccaggaccagcagcgtgagcacgaagaagccgtaaatccacactcccagaagcgccgtgtagttgctgggga

SEQ ID NO: 4598 - DNA, 1200 bp, mus musculus
tatatatatgaaattaagtttctttgtatatatgcatgagagttcagaagaggttttgtaccccctggagctagagttatatagtgttgtgagccattcagtgtaggtgctaggaatcgaacatggatccctcttaaccactgagccatctctccagtccccatgaaattatattgaaatactgcttaataggaacaaagcaggatccgatcagagcttgaagacattcatcataccactgtcctgtagcagatcacaggctcattggcctctcagggtccctttgagcagcagctttttagccatgggccaaatggtgtgaacacccttgctctcccatggctaatgtcccagtggctggcagacaccctgtgggcctggagcctacagggagaaaaagtatgcatggattcaaaggaactttatgaatattacaggcccagccagcattgtgaccccacccaacctggcaggctgacctagcccggggaggggcccagcggtaagcaaagggtgacaagcctttcagaagccatatttgcatataggcctttggagggacatggttgcaatgctgtggctgccgtggggatgagagtgaggtgctgactgcctgtggaggtctgtaatgtccccttcccaagttaaaaacaggttcgcttagggagaagtctgtgggtgatgtgttgacagatggcatgcacgggtatctggattctatgttgcaggatgtccaaggacccgacttgaagggacttggggctgctactcctggagagggggacctacccttgtaatcttcaaatgtcccaggaataaaccattgctttttttctccctagggtccccgtcagggatctaagaaggaaggatggaaggagagaaggctcaattttatttcaggccttttctagggcctttgagcccttgttagacaaatggtagtagaagaggaaacccaagctccccacaaggaccgcagctggccttgtcccagacctgccaatccccaaagctacactggctgcttccctccccttccaagctgtgtgtgacagaagggatgtagtgagctcactgtcaccttatccctagtgactggaagcaacccagagtgaccaggtggaaggggatggttaccttggtgattaaagcgtctgcctcgggctaccactgtagccttgacattcccaaggaccc

SEQ ID NO: 4599 - DNA, 1000 bp, mus musculus
cctttctccccatttctcatcctgggactctaaagatcagattccgcctgtccgtccacctccccacgaactcccgggactcggggaacaagctgtgcgatctagaccagctcaacgagggcacccggaggaaagctcaacccagacccgcagccttgaacttcagtcctggccggtgcgcggggctgggagcaggagggagtgcgcgccaaggcgcacccttcccaccgactgttctcccccgtcgggtgaccttgggcagtcccttcacctaacccgcctcagtttaccaacggatgcccgggccccgaggcactaaatgggcatcgaggagagctgccccgggcctcttaggccccgccctcccccgcagcagccaatcagacactgccgtccagggggtgtgtctcgccctgagccggggcccgggcctagggggcggagtttccggggcggtcacctcgccgcgggaccccgcaggggacgtccgaggggcggcgcgtgtcgtgggggcgcggctggcacgggcgcgcgtaggcggtgccgggccggggccccggacgctacggtcccacgacaggggtgacgggggcggaggcagccgcttacgcccctcctggcgcctcctcctgggcgcgcttggccctgcggacccgcaggcggagtgcagcctcaggtgcccaggggctggagggcacgcgcgagggcggggagccaggcgtcccctgtcccgggacagtgaggtgggtggacagggaggggaggggctcggtggcgcatgcgcgcggactaggggcgcgggtctggagacccacagccactggagagggcacacgctaggaagggcacacgcgtgcgagttttcagggcccgcggaactgtccgccacttcgagtcccctggagcgccgtgcgccggctccgaacattggtgttcgcagctgttttgggggctggagggttcgtggagtcctggaactggagcgacgctgggtcctctg

SEQ ID NO: 4600 - DNA, 1000 bp, mus musculus; identical to SEQ ID NO: 4599

SEQ ID NO: 4601 - DNA, 1200 bp, mus musculus
tacactcaggctcacagggaatggcagcccaagggctactcctactgctgggtttataatagacccaacctagtgtccatccataaggacaatgactcatcacgggacaaaggcaactcctggacatccagggtggcctgattccagtcctctgtacagatatgtcagggataagagtccctgtaggctgccccattccttagaaaccaggggtagcgatgagcttatatctacccagagacgtgacaatcttaggcttggtggcacaatcccccaagcactgggtgtggagttcaagaaactaaactgccacctaccaagctacagtgactgtaccttctgtaccatgagggtcccctgctacaacctggaccggagcccacaattctccatggtctgagcacatggcaggccacagacagctaacatgggcctcacacattcaacctctctatgggaacatgctggcagcaaaataccaagcagttgccacattcttcaccgagcaatcatctgaaaattagtgccagagaagacttttgggaaagttaagtgaggtgcagacaatctagtcccacactggggacagcccaggctcaggagctgacaacctgccacccacccatcctgacctctagattgctccacagagaaccagatcagctgtcccatgtctaagccttggtatatctaagggagtgtagcatgatggcgtctggcctcactgcggtgctgggagaagtcaggcatagaaggcagactccagcccatgtccgtgcatgtagacattgttccctgctgccactgttaggaacaaggaaacagacatgtgaggagacttccaacctatcactcccaggagaatcccagccagtacccaggctgttaaggctcccccagtaggcatgctctgtgattcaccagtagcaggtccctccttctatagcaagcaagatcttagccaggtttggaatcagtcagcgaggagcactgtggtgagcacctgaaactacacagctccaaatgcactcattcaaacaaagcacccacttctctccatgctcatctggtttccaagacaccgtcacctggtatctccccctacccctaaactcttcccactgtaaatgtcaaggaactaccctctcacaagagccagagaagaaacaccacccccagggagttggtataggagtacca

SEQ ID NO: 4602 - DNA, 1600 bp, mus musculus
tagggttttgttactgtgaagagacaccatgaccaaaacaactctttttttgtttgtttgttttgtttttcaagacagggtttctctctcttttattttttatttttagatttatttattatatgtaagtacactatagctgtcttcagacactccagaagagggagtcagatctcattatggatggttgtgagccaccttgtggttgctgggatttgaactctggacctttggaagaacaatcgggtgctcttacccactgagctatctcaccagcccagggtttctctttatagccctggctgtcctggaactcactttgtgtgaggagcgggtgtggcagcagtcccaagaagtcaccagggactgcagctaagtcttatgacttgcacctgacttcctcatacacctgaaaataagccacaactatcgtgagagctgcgcaggtgcaccaggatactggcgaatccattttggtggagacatgcccctgctgccctgattagctgaagctgcgtgcctggtgaggtgacatggcctgagtggatgagggctaagagtttataagagtgagaggcccaaggagtctaacgcgtgcgcgcgtggcgcaatgaaggtgaagggccccgcccgggggcccgaggtgggatcccgaggcctctccagtctgccgagggcgcaccaccggcccgtctcgcccgccgggccggggaggtggagcacgagcgtacgcgttaggacccgaaagatggtgaactatgcctgggcagggcaaagccagaggaaactctggtggaggtccgtagcggtcctgacatgcaaatcggtcgtccgacctgggtataggggcgaaagactaatcgaaccatctagtagctggttccctccgaagtttccctcaggatagctggcgctctcgctctttcccgacgcacgcagttttatccagtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaacgggcgctccgggatgaaccgaacgctgggttaaggcgccccatgccgacgctcatcagaccccattttgtagatcaggctggcctcgaactcagaaatctgcctgcctctgcctcctgagtgctgggattaaaggaatgtgccaccatgcctggcttccaagacaactcttataaaggacaaaatttaattggggctggcttacaggtttggaggttcagtccattatcatcatggtgggaagcatggcagtatccaggcagacatagtgctggagaaggagctgagagttctgcatcttgatctttttttttttaagatttatttatttatttatttatttatttattatatgtgtgtacactgtagctatcttcagacacaccagaagggggcattggatcccattacagatagttgtgagccaccatgtggttgctgggaattgaactcagaacctctggaagagcaatcagtgctcttagccgctgagccatctctccagcccgat

SEQ ID NO: 4603 - DNA, 1400 bp, mus musculus
tacctttatttctgagacagcgtctcttactgggacctgggtctcaaccagtgagctaggctggatggccagcaagccccagggatttctgtctccccagtgtgtgcaccaccatgcttagattttttagttttattttcttaaaaatttatttatttatatttatattttttggtttttcaagacaaggtttctctgtgtagtcctggctgtcctggaactcactctgtaggccaggctggccttgaactcagaaatccgcctgcctctgcctcccaagtgctgggattaaaggcatgcgccaccacgccctgctaaaattttatttatgtaatgtataagtactccaaaattttatttatttaatgtataagtactctgctacatatacatctgcagggcagaggagggcatcggatccccttatagatggttgtgagccaccatgtggttgctgggaaatgaactcaggacctctggaagagcagccagtgctcttaactgctgagccatctcaccaacccttgtatttttttttaatcatgggttctagggatcagactcaggtctttgtgtttacaagctaagcctttacccaccaagcacccctccagccctgctctcccatatttgactctttcattctgatcaggtttggcctggtttctaagttggaatattcattttcagttctaacttagtagaatgcatagttatcccctgtgctttgtgacatacaccatgtctgaagaattcttgaagggtgttttcaggtcacatggtccaagctggctctctcctgcatccagccctgcagtgtctaggggtgtgtgggtggatatttaaccacccattgtgactaaatcttcatttatagtgttgaccaatttccatggtgtaagttttttaactctgggagacttcaagccatctgggtaaagccaccaatcactgagatgggcagaggtgcgcagtaggttgtgagcatgtccaggtgactctagcgcacttgcgcacttcccccagcagggccctttcttggtatgaactgagtgtggactgcattctagtttgcttcttgtttctgtgacaaaaccctgaccaaaaaccaacgtgggagaggaaacagtttatttgctttacaggtcacagtctatccctgagggagatccagacaggaactcaaggcagggacctggaggtagggattgagacagagaccacgaggaacactgcttcctgggttgcatctcctgacttgctcaaccacctttcttattgagcttaggaccagctttgcccacagagggctgggctcttttctccaccacttatcaatcaagagaatgatcaacggacatgctcacaggccagtcaatagaggccattcctcagttgag

SEQ ID NO: 4604 - DNA, 1200 bp, mus musculus
cctggctctgggcatgccttctggtagttaaggatggactggcttccatgatctcctagactaaggacacctcctggactttcgggtataatgggaggagggctttgggaaagggggccactccatcaagttaatatacacggcaaccaggaaagccccctatccatcaagcgggccagagcaaagcaggcagaagcaatcgataacagagagctgtgcagcgtgctgagtgctgtctgccggcaggaagccattctgggccattcacttaattttaaaacatggctgagggaggtgtcacctcacccctgcctttgcagtgaggcagctgagggattagtgggtaatctaagcacctgccccccagtggtttaacatctctgagaaactcccgggagccctggaatcatgacagcgaggtcccttttcttcatcctgccacttcccccaaggagaaatgtctatgtgtaattcaaaatccacagagatcctccctgggtgtctggagtagagtgggaccaggaagatcccccaggcccccacaggttctttccaatgctctgtgctccatcacaaagtctttaaaaaagacttttaaagactgagacatataaagagctcaaggcagtaacctatacggcaaacatattttcataaagatagctatgtcaggttgggaggttttggtagcttccaacttcagacagagggagaacacacatgcaaaatgaaagaggggctgcctgaagtgcatcccacagaaccaactacctacaagtatcaccacagacactggtttgtgtcagtgtgtataactgtaaaagcatgggcaaatggggactggagagttggcaccgtagttaagagaactggcagctcttccagaggacctgcgttcgattccaagcactcacaaggtgtgatcacaatgcttttgtatttccagccccagaggctccattgctctcttctggcttctgtgggcagcaggcaggcataccgcatcatatgtatttatgggtgagtgatgagttcctggttaagataatttttcaaattgttgaatgccttgattcctgtagaaggctaatgaacacagcagactttaagaaagggtcattccgtgctctgattcacaaccttattaaaggagcaagcccattttctgggctctccttctggaatgtccctggaaagtgt

SEQ ID NO: 4605 - DNA, 1000 bp, mus musculus
tatctatctattcattcttgcccctgtggtcctcagacctttggcctcttgattcagctgcttacggcacatgttcatccagctatctggaaagcacctggatccctcatccaaacatcacccccactccctccttactgtccctcctgcgggtgctactgattttcctcaacctcacccctgctggaagcactgcttactttaagtgtatctcgtctgtgatctgcccctcgggatagaagagaaggccccagggatgtttgcttctgcacgttatgagaggcaggacagactgcagacagtaaagacactctagcgtgtgtctcagaaagaagggaggagcacaatttgatgcactcagacactaggtctctagacaggctggtggtggctgtggtagagctgagctggggacccaggtatcacagacatcttttagactgctggttaggcctccgcagtgccctgcgggcaaagcctggcctgccggctgctgaactcgcccatccgacccgattggctagcctctgggaaagagcgtccccggctcgaagataacattgtccagccaaatcttattaaagggcagacaatgtttaaaaccaatttgaagtccataaacacctcgtcccacgcatccacagccctgaccgcggggccttcccgatctgtcttctcccaggaggagcaacgccgctcctaggaatggcttaatccgattcctctgtggctcccaggcaggcggctcggggagtgtttattttccagacttccagactgtatagaaacagacagcttgtacctgcgccaatgtggtgtctgtattttgggtgaggatagcatgcaagtgtactattttgagggtgcctggccagacttctctccccaagtcccaagcgccaaagctttctgtgcaaggaagtctatagttagtgtcccctccctctccccctctctctccccttatgctaatatttaaaacttgatcctttcaagagaa

SEQ ID NO: 4606 - DNA, 1000 bp, mus musculus
actgcggtgtttgattataaatatgagacaattctgtgtgattgctaaacagggcaaacgagcaaacagacggggcagagacacagctgggaggagaatgtccccggaggagaatgtgctgaggagaactgggaggtgcggctttaaactggaccagagcttcttaaagagactcttcctcgtatcatcccccgtgagaacgtcttggagaatacagggacaaatggtacggcaaggagtaagaagaagaagggttgtggaatatggggaggggtacacaagatacatgacatacatgcctgaaaatggacctatatgtaataagaagaaagaaaacaaaagtcagatgttcattcccacctgaccagaggtctcgatgccgctgcagttcttatggagtatacttatacaagttcttagactgtatcaaggactcctgagaaactgcctggttccaggataagaccagagaggctcagatagtcctgagcagaatgagtgctttccccaggtctgaagccggggaacacaggatctgccaggagggggcgctcataggccacatcgggctcagtgggaacccaacaagggacactagtgatgggtcctaaggtagcaaataaaatgtatttgagaacacagcgtaagaaagaaataaaaactctcaagaaaaaaaaaggtacaaaacactaagaaaagagacacagcggatgaaaggctggggcacatgcagaaagggctgtttgcagagatgcttctgctctggtataaacagatacttctgaagcaaagtcccctgtgaggtctcagagagacacagtggagaggcttatatgaagcactctagacatcctgtgagctgtgcaggagggtcatctgctggatgccactgccaccccaccgctccagtgagaagaggcacaccatctcggcataagaggtaatctatcccgctgcacacctgaggccagtggggaatatctagataggctctgactga

SEQ ID NO: 4607 - DNA, 1000 bp, mus musculus
acattacaaaataatatcaaatttgagcaatgcctatctaccaataggggctctactgaagatgctcaaagcaaaacttcattgtgaagaggttaattgcactcatgaagatattaaaaataattaatccctgagcactaaaacaaaagagaaaaattcacaaaaataaaataataagaatcaataaacactgttcattcataactctcaatatggacagtttcaatatttcattaaaaatgacacagaccaacacattgaattaaaaaaaaatctatctttctgctacatccaagaaatacatcttaaaatcaaggatagtaatcacctcagagtaaaaagatggaaaaggtaccccaagataattaacccaagaaacaagcaagataattaacccaagataattaacccaagaaacaagcaagtgtagctgctttaacatttgagaaattaaacttaaaaccaagacttatccaaaggaaaacaaaagagatgggaaaggacagtgcatctcatcaaaggaaaacaataaagaatattgcaatcctaaacatctatgcaccatacacaacggtaaccaagtccataaaagaaacaccactacagctaaaaatcacatatcatggcgagtgacttcaacaccttactcttgccaatcgataggtcatacagagagaaaccaaatagagaaatgttggaactatatgatgtcgtaaatcaaatggactcagcagatatttatagaacattccatccaaacataaaagaatttaccttcttcttagcacctcactgaactgtctacaaaactgtctccatgtactcagaaccagaacaagtctcaaaagatacaagagaagtaaatgacaccctacagcccatctgaccaccaggaactatatctgaatatcaacaaccatagaaacagcagaaagctttaaaattcatagaaactgaacaattcattatggaataataataaaaaatagagcaaacaaaa

SEQ ID NO: 4608 - DNA, 1000 bp, mus musculus
ctaggggtgagccttgaggccttggagccctactctatctcctgttaagtccctggacctgactgtggatgcagtgtggccacctggcctcctcctcctgtcatgatatcatctctgcctgctgccgtatcttccccaccataatgatatcctccctttaaactgtaaaccagcagaatacactgtaaataccccacactctgaaaattggaacttgttgggatttccccacagcaacaaggaatgtaaccaaagcattattaagatctggaagaaatacatttataaaaattgataatgcaatgtactagataaaattcaatatctcttcatgatttttaaatccacttaagatataaaaggactattaaaaatacataacaaacataagatttagcataagccgattaaagtgtgttacgagccagcaagaacaaatgaagcataaacgatattttacttctcaatgggaaaagtcctaaccagtacaccaaaaacaagaaaacatttttgtaatttagaaagaaaaaatcatttattattaaagatgataaaatcacaaattttgtaagataaaaattgtgctacaaacacataatcatattagtactcttctttctaatcgtcttttcttcgccgtcccaagcgtgtttgtgggtgtcgtacaggtaaacaccaagcggactctctttcgtgacctcactgggtttggttggcttccttgactggattgtgagatcggatctcccagcggagcccagcctagtgtctaactcttgctaattctcaggtttcacacttccaagtgccaggatcatacgtttgtaacacggggccctggtgttgttttgtttttaaaacaggctctgatcaggggcaccttgcatttccatggccttgaacgcagagtcctcctccacagtcccaggagtctaagcatgcagcccgccacgcctagcaatagtattgggattagagtttagcaaggatgcttcctttt

SEQ ID NO: 4609 - DNA, 1000 bp, mus musculus
tgtgtattcaatgcaatacttgatccagtacaagcacttgaaggttagaatgtttactcttgttgcatacaattaagtagtaatgtagaaggcaggaataaggacagtaatttgtcctccccctcatccctggccaccagtgacaggcagaggagatggccctgaggtcatcaaagcacaagggcttgccctccctccctctcacctgctgcagccctagggaaagcaggctctgcacctcacctgggcagcatagaagagcttaccctggatgtaagggttgtggatgagccagccccacgtgagaaagtaggagagttgtccctgcctctctcccctctcttttggcctctctactggcaactggtgagagagttggccccaatagcagtcataagatcaggtgagctgtgcctagtccttgcctgccgtagcactcaggagagcaggccctgaacctcatctggcagcatagtagagctgatcctgtatagtaggggtatggacgaggaggcctgaagggtacaagcatgaaagagctgctccctgtcacttgtctgccatgcagtggcttgagtaggggagagatgtcccaacatgccctgctccttggcaccaatggcaggcagaagagctggccccaagaacatcaaagcaggaaaagtggccctgtccctcccctgttataacactagggagagcaggccctgcaactcacctgggtggtacagtagagctggccctagatttgggaagtgtagggaagttgtcccaaggatgatagtgtggaagagctggccctgcctcttgtctgcttggctgtgacacagacaaggcacagaaacagccttccctctccttgtcccttgccatctgtcttagtcagggtttctattcctgcacaaacatcatgaccaagaagcaagttggggaggaaagggtttattcggcttacacttccatactgctgttcatcaccaaggaagtcaggactggaact

SEQ ID NO: 4610 - DNA, 1000 bp, mus musculus
tatctaagctgcatacccagacattgaattatgttttaccattctgtaactggttttaatggaggcatgtattcaaactttacttataacagtaaatattcttaaacttctttcgattttagttcattgggaatcctgggattcagaaatgtggattgaaagtaatctcttctctcgcgcaccttcctgatgccacagagacattgtccctgcaaggagcagttgactcagtcctccacaccttacagatgtatccagatgaccaaggttggtaaagatagagcttggaaccactgcttattgtcttagtcagggtttctattcctgcacaaaacatcaggaccaagaaacaagttggagagaaaagggtttgttcagcttacacttccacattgatggtcatcaccaaaagaaatcaggacaggaactcacacagggcaggaacctggaggcaggagctaaggcagaggccatggaggaatgctacttactaactcacttcccctggcttgctcagctagctttcttatagaacccaggactaccagcccagagatggtatcacccacaatgccccactcccctccccccatcccaaattgtgaaaatgtcttacagctggatctcatggaggcatttcctcaaaggaggctcctttctctgtgatacctccagcttgtgtcaagttgacacacagaaccagccggtacacaatttactggatttgttttttattccttccttctgctttaaggttaaaagaataaccactgttaatttttctcttttattttagaaattcagtgtctgggcttacaccttatgggatgcttgatgacaaagaagaatttctgcatagggacagggcacctcctggcaaaaattctggcttccactttgcagcgctttaaagatgttgctgaggtgcagactacagtaagtgcactcgagagacttgggagcttacacagtctcccactattctcgcaactcccgttgt

SEQ ID NO: 4611 - DNA, 1000 bp, mus musculus
agagaagaaatgaaggagagaagagaataaggaagagactagaaggacagagctggcagctgagctggcactgagaatggagtgaggcagagcactgagtaaggtcatcggtctcctccttgtcactccttctaacctgggtaccaggcatcccttcataagctctgagataccaggcaatctcctgttggcaaggccaggtgatagatgttggtctaatcagtgggagattcttcacaggttgggcaggaactgctgctcacagcctgggtagaccttccttatgcccactgtgccttcctagaacctatatctatatcccctacagactctggctccaaccagactctaccttgctaaagaatgtactgttttaattcagagtttctatcccactatcagaaggtgtcctgctggccatcttttgggctacagcgccatgatagtctgtgtgttcccaagacagtgttcgcagatggtctgggtgagccaagccaccacctgaacagagctctccttaaaaaatagcatcacaaaaggttttctggttcctctcctcctgatacggttgcctgcagcttgtatctcgctcattctctgctcctttaaatgtgtacttaaatgggggtctggagagatggtgcagcaggaaagagcactgactgttcttccagaggacccaggtccatcccccagcccatacatgctatttcacaattacccataactccaaaaccaggagatccacatctaccttcggacctctgtggacaccaagtgtatatgtagtgtatggacatgcaagttaaacacacacacacaaaattaactaattaatggccattactgaaagctacagtattttctatctgtcttaagtatatcttgagtctcttcactaagtgttgggagaactctccaacaatctcagtcaaacaggacccaacattctgctgcttacaggaaacccatctcagagaaaaagacagacactacctaa

SEQ ID NO: 4612 - DNA, 1000 bp, mus musculus
cttctttcccttcacctgttcactcaatccagttagtactttcagtgtggacatggatgtagggccttccactggcgtatggacagcttacagggggtagggcacatccctgagggaaacagactccccctcagccagcagccagcagctaataggttctctgctggtgtggggacttgggaaggatttctttatgttcccaggccagcctgtttgtgatgctcatgacacataagttcttgtgatgcctgtaaatagctccttgtgttttcctctcagcaccactgttgccagcactcctggccttataatcaacatagctaccttatgctgtctctgtggtaaacaaacaggtcacagaaggggatcccttgggactaggaccctccagggagctacagtgttatatttaagagaaggcctttatgtaggcaagagggtgcagcactggggaagacagtcctactgctagaggcaggtgagcctggctaatgccaggacatcaggtaagttgattgaaatctgattgttaaactggggccgatggtgggacctgggagtcagaggttttaatggcaaagcagcatctcaaacagtgctggaaaagagaaagagaggttggaaaagtcagtttcctaattttcttcccatctggcctttcggaggatcacttgctgcctgctgaattgaagggaggcagagcgcatgcttgcttgagccttattctcaaatagttgaggttttaggtggacacagagagagccattgctttctgtgtaacagtgtatttatctagtttgcttcacggggacaataaggtgctttcagagtgattgcttcagaagatagattttagagctctgttagttggccagccttggtctctggcatcagaaggaatgacacagctcatgagcactgtgattctcaggctgaggcagagtgtggtaattgagtagattggcagccctgtcagctgcctggggcctataggcagtag

SEQ ID NO: 4613 - DNA, 1000 bp, mus musculus
tgctcactggctgtctgtcctgacagagactctgctccggatatcagatattgtttcatgcctctgacacatcaggcacctctcactggcaccagtgaacccctgcactgccactcaaccttgtacccatccagccatttctgtggctcatctctgaaattccttcagagggaggatcccaagcccccccagctgccagtctggccatctcacatgtgttagagaacggtcactatgtgtccaggaatggtcatatgaatgcatgaggggactgagcagcctcacaccttatcccttgtcactaaggacttgactaaagatattagcaaatagaggcgcagacgacttatcctgtgcaccgacgggaattggaccgaggaagtaggacccagagattcatgctgaagttgtattttataagaactgtttttaactattgtgtgagcttttgtgtcttttttcttgttggtttgtgtgtgtgtgtgtgtgtgtgtgtgtgtgtgtgttttgacacagggttttctgtagtccaggctgaccttgaactcacaatgaagctgtgatgatttgtctatgctcagcccagggagtggcactatcagaaggtatggccctgttggataaagtgtgtcactgtggatgtgagctataagaccctcatcctagctgcctagaagtaagtattccactagcagcctacagatgaagatgtagaactctcagctcctcctgcaccatgcctgcctggatgctgccatgttcccaccttgataataatgaactgaacgtctgaacctgtaagccagccccagcaaaatgttgcccttataagagttgccttggtcatggtgtctggtcactgcagtaaaccctaactaagacagaagtcaagggtgacggtgacgttgaattcctgctcctccagctcccaagcttggggcttacagagcaagagcctcctggtatttatatacacgtatttgtggccaaaagaaattgc

SEQ ID NO: 4614 - DNA, 1000 bp, mus musculus
gggggtcggaggaggcaaggagtgcggaaggagcggagagcaaggtggagggaggcgctccatgaggatcggagaggcgggtcccaggggtgagcctggagatggggggaggatcatcgggggcacaggctcagggtcagtgcagttggcttccggtggagggctgataggtgtctcgaggatgggggcagccaacggtgactcggggtcactgtcccctttggcaccaaaggggtactctaactcccccaaaggagacaaggctggaggggctgcagctgggataatgggtgagagtggaggaggaagaggatctggggaggagagaagaagaggctctgagattagatgtgccataacgtgttcagactgcccccagaggaacagaacactaataccgccttacctggtggcatcagctgaggtgacaagactggctcccccgacagggacaagggcagctcctcgggaagtggggatagaggtggttccccaggctcagacagggctggctctccaagcatggggggtaaaggtggttccccacttggggaaaacaaggacagctccttaggtgcagagctctggcttggttcctcaggaggctctgcaggctgaggaggtccatttagttcctcaggctgtggggacaggcatggctcctcaggcatgggggacaggcagggctcctcagaatgaggagacaggtgcaactgctgaggctgaggggacaggtgtggctcctcaggctgaggggacaggtgtggctcctgaggcacaggggacaggtgtggctcctcaggctgagaagacgggcctggttctacaagcacaggggacaggcatggctcctcagactgtggggacagcggcagctcctcaggctggggacagagtcggggctcctcaggctgaggagacaagtatggttcctcgggctgagggcagagtctcagctcctcaggcagtggcgacagcggtgactcctccatcggcaagg

SEQ ID NO: 4615 - DNA, 1800 bp, mus musculus
gcagaggccatggaggggtactgctcttagcttgctcctcatggcttgctcaggccgttttctcataaaacctaggaccaacagcccatcaaccatcagttaagaaaatgctctataggcttgcccactggccaatctagttgggaaattttctcaactaaggttccctcttccaaaatgactataacttgtgccaaattgacacaaaactagccagcacaccaattaaatatgtctactttaaaacatacagcccaaagatatagatgttctgtcagattcctcttagaatgcataaaagaaaaatttggatgtccaagaacctcttgaattagaaataataataatttaaaagggtttgttttattttatgtgtaggtctgagtgtatgtaactatatacacatccatacaggtgattgtggagccagaggagcgtacagacagatccccaaaactggagttacgggcagttttgagctgctctttatcggtgctagagaccaaccctggatcctctgcaagagcagtttcagcccatggaaaacttcgttacagtacatgtctgtaagcacaggcagccaaagtggtagcagggatagttactaaagagacagacagtagagggttgaaacaatttaatcacagaagaataagcaatagtataaaatcattaacagcgcaaccagtggctgctgctctccaaatctcagctcatcctctcctaccctccccctccctgcataccattaaataagcagcagggtatgtagttgtccctgccactagcaggtgataggaaggggacatgtagctaggagctatgttgatcctgggtagtgttccatcaggtgaaatattacttcctcctccaaaagaacaattttcaagtcctggagctgagtctggtgacagcacttatttaagtgatcaggaacccagagtctcaagagccatgggacgaggtcacagatggtctggagacagcttaattcaagatgcagccagggctggacttgaggtgggctcagaagtgaccagacaatgactagtaatccagaattgtgccccaaccgagtcaatgaaactcatttatatgcacaatacacatgtataatcacacacaaaaaccacacaaacacagagccaataaccttactgaaaggaccagagggcattaaatacaaaacggcagagtttctttaaaacacaaaaatatttctttgattctcctcagtgccttgcagtccctctagtcacaggagtgtagatgtggggaggccctaaaatgtaggttgccagtggctttacaagtcccctgctcttcagccaagtggctgcctcccatgtagccgttcatgcagttggcaccattgctagagctgctgccagagaggttgtttttgtgggttgtctcatcttcttcctctgagctgctctctacatcactgcggtcatccttagacacctgagggggacaggaccaaatgcagtacacacgctacgtttcatactcacggggcaggtggatctcagagcctaggaaagcccactcgtgtacctgtttctaggactcacggggcagatgagtctcagagcctaggaaagcccactcgtgtacctgtttctaggttcggtgacactgacttaaatgcttctgtgtcactggctgtgattgtgaacagagtttgcctgcttcctgttttgctttcatttatgccattctataccagaaaggctgctgtgatgccacactgagtccatgtttagttgtgaggaaaactccagcacttcttccctc

SEQ ID NO: 4616 - DNA, 1200 bp, mus musculus
tagcagtgttcttagaactcaattaatggtttaccctgctgcattaatgagctacaaggctcactaatcagtggacttttaagtgtcactaatttacttatctgtgtgtgtgaggggagatgataggcaggcagacagacagacagacagacagggacgggtggatgggcatgcccatgccacggctgaatgcggaggtcagaggtcaaccctgtgagacactgtcttcccctctactgcctcttcctaggctcacatctaggccttcaagcttggacaaccacacagctagcactttacccactgggccgtcttggtggccccaccttgcgacgtgcatgttgagcatagctcatcatctgcactaatgaacctccacgcccctttcttcccctcagccacccctagctcccaggttccagcgtgaggcttggcactcacccaagggtaagtcagtgtggcgacgtgcagcacgggcttccccgggtccctgctcacctgtaagctctgcaggacattcaggaagtcattcatccccgttaggtgctccacatcctggaagacagcgacgagcagggtggggatgatggcgatagaccgggtcaggatcactcgggcaaagcgcgaccattttaggttcaggaatccctggaaggaagcatggaagctggtgactgaatgtgacagagagagagatgcctggggaagtcaggaaccctcagaagcgtggggctagacactccaagctgtgcaagctccctctatttcaccccagcacacacctccatgacaaactggccagaataggttccagtcatggtggagctctgaccggcagccaggatccccactgcccagatgtagagagctgcaggcccgaagtaacatccaagcacaacaccctgggagaaggagggagagacaggcttgtcagtgacctgcttaggtaacacccagagcagcagccctctgcagcacctccctctgcttgggaacacccgcacaccaagtatcatgctgggcactgcacaaaggggcgctgactctggtcagacctgggggcttctgacctcactctgctggtgccctgcatccctcagcccagccctccctcctctctgtgctcacactcaggaggcagagctcacacttcccaaaacaagctcctcgatgctcctttctgggaaatggagggaggca

SEQ ID NO: 4617 - DNA, 1200 bp, mus musculus; identical to SEQ ID NO: 4616

SEQ ID NO: 4618 - DNA, 1000 bp, mus musculus
tgactcatgccagctgcccaggctccagatgcatctctctgtcatgcccaccgctgaacaagcccctgctactgccctcgcctctcctacccaccttagatgtgctgtgccaatcaatcccacactggccgacacccttttatgtggcggtgttgtcttagagggccctcagcacagggatgccctgattcaagcatgggcaccttttctgccaggcgaccatagtagtgagacccctacagcatgacccttacactgcctccccactctggccccctgcacctctcctgtggaactccccataccgtgtcaatgtacacgagatgccaggccagtgattcaaactgcatgatatacctcccccggcagcccactgagctactcacctagttcttagatgtggaaacaggtcaaaagttaagcaatttgactgctcatggtctgcaggcgacagagctaggatgcaaagcacagtcgtgtttcagcgagttttctaggccccaaagacctttgagggctgagcacttcgctttggtcacatctgcaccggcttcgctaaagacgacatttctactatgctgcacactgtcccctatgcttagcacaactgggaaggtggtggcacacatggataagaactgaggaggaagctgtcttttcttaccatttgtgcatgtgggtgtttttttctgcaccacttgtagtactggagaaggccaggagagggcatcagatcccctggaactggagtttcacgtgattaatgcgaaatcttgggtgcttgggatcaaacaccatcttcaagaagaacagccagtgcttttgacttctgagccatctctctggccccaggaggctgatgactggtgggggccagctgagtaaaccttccataggggtccctggatcatgtttgtcctatgctcttggccaaggggaagtcagtagattcaatggccccggtcctgacgatgcccgttagaagccttcatttccttcc

SEQ ID NO: 4619 - DNA, 1000 bp, mus musculus
gggtacccccctaacctgacactttaggtctctgtgaggctaggtgcttcctttcccactgaggccagacaaggcagtccagctagaagagcacatcccatgtacagacaacagcttttggggtagaccttgctccagttattcagggcccatatgtagaacaagctgcacatctgctacatatgtgcagggaggcctaggtccagcctgtgtatgttctttacttggtggttccatctctgagagccccaagggtccaggttagttgactctgttggtcttccccatggagttcctatcccctttgggggcctgaaatccttcctcctcttcttccacaagagtccccaagttccatccactgtttggcatgagtgtctgtgatgtgctatgcgccaggctgagaggtcaccagtccctttgggagctcacgttcaaggagatcagctgcttactgtagtgtgacaccatgattcatgacattgtttgtaactttttggccatgggaggcatgcagcactgctcttagcactctgagaggcaggactttgcctgctgtgttgcatagtgggggctttcagcatctgtccaatccaagcagacaatgctgcatattctgtagcatagagcaacacccagcagagcccagtatggtgtttgaatctgccagtttgtaactcatgggcattggatcgattcagggggcatacatattttagctcgtgccttaactcctggaatcaccactccccatccctgccttgaatcacttgtaccaaaccagcattctttccaatccttgccagaaccctgcagggcttgaggaaaaaaccgacattgctgtggaaccatttctccttggctccctagctttaagcaggcagtgtgcttttttttttttaatccagaaatctaaaatcaactttgttacaattaagtttttgccacatgttggttcgccaatatgtcattgtaagtgcttaatctcagtcatgggttt

SEQ ID NO: 4620 - DNA, 1000 bp, mus musculus
cactctctagtccatgactgagcacaggaaaagaaatgccatgatttgctttttcttcacttattttaggaggtattggccatcagacaagaaaaaagcctataaaaagatgattcctgatcttggcaatggatgtgtccaacagaaattgggggggggggggccgcgggtaatagtaggagaggggagggagacaaagagcaaacacattatctatgaaaatgtcatgataaacatattattttgtgcagtagctaaaaatgtaattatttgttaagttacatagagaagtacaggaaaagcctggagatttggagacctagctcccaacacttccgtttctgctcacgtagcaccctatgaatgcgctgtggtagctgtggtcgaggaagccagcgtccacctacactcactcccacagaactcaaggactctactggagtcggtcctaccgcgcaaattaacatgccaatcctcgtgcccaactataggtgcccagcgctcacatctgcgagtcagtggggattatgctgggacttgtactggcctcgcttgattcgctcaggtttggttaaagagctgcgggcactcatcccgtgcatcagccatttattgtcctgtgtgaaagcaactctctccaagcttaagcttggtcagcattggtgaaccaaaatattcattaattgtcacgtgtaaaattaaaaacaaatagcatacttaaatgagtcttgggagctatccaaaggggtggggggaggaagcagatttatgcttgagcaagttcctggcgggatctccactgcggcgactcctctgagagagcccgctcattcccaggctatagaagtactaaaacttcctaatattcgagcgaaaactgttctttacagtgccaactcagaattctgtcttcatgaccaaaaatcccacgaagtgaaaagcaaactgaggattgtgcgcttggaaaatggctcgtggattcactccaccctgatgtttt

SEQ ID NO: 4621 - DNA, 1200 bp, mus musculus
gcctaacacttgcttatcaagtcagagacttggttgatttcacaagctggaggtttgaacttgagtaagacatttataaaaacacagacggggcaatgtcctccccagcccaggtgccactaggcacagcataagagactaagaattcaacaggggaaaggctggacactcagggtttgggagtataagcccccacttctggctcagggggttgagaagcaggataaacaaaatgaacttggaaaagaattggaaacccagcaatttgccttctacagggatggggctcgggaaggaggtagggacagggcatttcacatcactaacctaacgtgggaaactgcaagggaccatcttcaactggccttaagagtaagaccaaatggctgatgggagaatccacaggagggcgaaaagggagcatggctgggaggaggcaacaagccccttcctttctgggcacaggaaggcagccaaggcacaaggtccaggcagtgacctcacaaggacagcacagtttttgcagcttagaaatcacccacctgtccccacccctactcattctgctcagcactggcaggtgtggggccactctctgggtccgagggagtggatggctctgcagcctggggccttgccttttcttctgtgtctccttccttggaggcagcactagcctctgcccccttggcctggggctcttggctctcagggttggcagcggccttcccttcttgggcagtgcccttgttgctgcagacgctcatctccccctgctcctgctcttcttctgttgtccaggaggctgaggaatcacccccaccctccttccgatttctgttgaaggacaggccactcaatttgaaaggcttcttgaaagagaatttcttcttcttcttgggggtctccttgggggcgacctcccccttggcctcagcttcctggctagggggcgctggctcgatggcatcaccagtagccccagctgcctcatctgttccgttcacggatggtgactccccttcacccttggggggttaagtctccattgcttctcacgtggccattctcctgtccgttggccttcgctggggaagcacccgctgcctcctcggcggtcacgtcgccccccccctccccgccccacaccttcttcttaccattagggatactcaccctcaagtgtgtgaatgtacgtga

SEQ ID NO: 4622 - DNA, 1000 bp, mus musculus
ttcatctgcttcaggctatgatctgctcctcattttaactggtctttccctcccatatatcatcatgccaaggtcagctgctattagggcattcttcattcagaaatgtcaaaagtatatagggtacatagagtcacactgacctctgaagacttattttgaaggtgtatgctgttatgcatagctgcatcctgcagaccaaaaaaaaaaaaagttacatggccaagccttatctatagagccaggcaaggatattttgcctctgtgatggtcacatgaatattgcttttataattctgtcttcctgagtagctaaagtcaaaatcactcttctagaaagctaaactgcataaaaagccgtgtcatataaaatgcaaaattaatgataagcatgtgtatctaatgtataatacaataaaaatgtaattggtaaatattgattttaaatgtaatactgcgtatggatttgtgaaaaccacaatcatggattttcaaaacaatgagagtaataatacatttgatcaatcgttgagacattcttaatatgaatgttttcaccttgttcttggaattacagtttccaaggctctatgccatgatcagtcaggaagttattttggggatatggtcagacagcacctccaaacaggaacaagcatcagaaacagctttctcaccccaagtcagaaagcaaagaaaagggaaaacagataactattggagttctagaagttccttcatgaaaagccttcaaagtctaaaagactcaccactgtgtcccaactctcaaaggtaacactgtttccctgggaagaaaatagcccatgcatgaccccttgtgggcctatagggtacctataaattagaacaggtgaaaccattgaaaatacatgtactttggtagcaactcttccagtgtcttttcatgcatattcagaattctactttataaatctggagtgtcagttggacactgctactttagcctagaatcatggtg

SEQ ID NO: 4623 - DNA, 1200 bp, mus musculus
tgtattctgttggtgatgcttacatctatgactcctgatgtctttcctaggttttccatctccagggttgtttccctttgggatttctttattgtttctatttccagttttagatcctggatgattttgttaatttccttcacctgtttggttgtgttttcctgtatttctttaggggagttatgtgtgtcttctttaatggcttttacctgtttacctgtgttctcctgtgtttctttaagagagttatgtttttcttaaagtcctttatcatcatcatgagatgggaatttagataggaatcttgctatcaagtgtgttgggttattgagggcttgctgcggtgagagagctgggttctgatggtgccaagtagcattggtttctgttgcctgtgttcttgcgcttttcccttgtcatctggttatctctggggttagctgtttttactgtctctgactggagcctgtcccccaccccccaccccccatgagcctgtgatcctggttgtgtcagaactcctgtggtgcctggtgtctctgtgatcatatgatcctgtatatgtccgaagttctgggtatgggtggagtgggcagagatccagagcccagagtctgctctggggttccagtgcatgccggaaggaacgtgtgcctctggttaagtgggggtgcctacattccctggatcctggggtggggcatttaggccaggtattgagggatgggtgagtggggggtctcacctgtgactctggatctgtccgaagtcctggaggacaggctgcctctgggtgtgggtttgttggggaggacggagtacaggctctgttcctggggaggtgcaagccaaaaggactatgtgcctttggctagacaggggtgcctgtgtcccctagggggtgtccccagttaggccaggtattgggggtagtcctggatctgttggaaatcctggggtacaggctgcctctgagtgttgtggcttatattttaaaaaagaaaagaaaagaaaaagactatgaagtttggagaacataaagggtggatctgggaagagttagggataagagttgggagtgttacatgaaagagtaaaatagattgtatacatgtgtaaaattctcaaatgcataataaaatattaatggcctttaaaaaaaacaagctctggaggacctgagtcctgatctaagattga

SEQ ID NO: 4624 - DNA, 1000 bp, mus musculus
ttgttattaaaatgaaaagctgttatataaaagcattttgaacaaaacatttttgttcattattcctttagacttggaatgtgtatgtctatatttactttcttcatgtggatctgtcagaagtctaaggaagaagaacaataagagagcgaagaaaagaaagcccggcacagtggcccacacctgctatctccgcacataggaggctaaatcaggggttgtctgtgaatatgaggcttgcctgggctatgcagtgggactcttttgtctcaaaaaacatgagtaagaaaggggagaaggaaaaagaggaagaggaaggagatagcagggaaatactacttggttttaaaaataataaccaaataaacaccccccccttttttttttcaccaaaataggggaaactgctttctgaaggataatatgttacaaaactctttccaagcttatttagaacaccatcaggttccaatgtgcctcatagaaaaacaagtagatggaggcacttggcacatcaaccttctttgcaccaagtgaagggatgtttgccgtaatacctgcttgctaatggaggaacagcaagtgcagcaaaagagtgagctgcaataggcactccgttcattaggcaaaacctcagaatgttaaatgaggctgtgatgcacagcacatcctactatcataaagatgcggataatacccaaaggacgcactaacagtgcctaaaataatagacacacagaaagcagccatactggaagagtgaacagattgcagggctgacttaccagcgcgaggagccaacagggtattgccaaaagttcttggttggagccatcacactaaaagtaaactacctcagttaactcagcacagatgccaatgtgcccaaggatcccatttggattaggagtgccattttccttattagtataatttctaaagcactataacaaataagcacaaggagccatgctaaattcatgctcttgttagcagtata

SEQ ID NO: 4625 - DNA, 1400 bp, mus musculus
aaactgatactgcattgatttctatttaccattgatttctgtttccacattgtaatatatatcttaaaaattatctgtcatagtctaaactcaatattagtaggtttagacgcaggaagagagcaatcttctacagaaaggagacttcagtatggtcacatgttaaatgagggaagttcttcagatatgctgagtagattgagactacaccaaatgttttctctttttattctcttttagagactctggggaaaagagatcttgtcacacagttgtagcagggcatcctttttcatatgttgagttgattcatacaaggttcaagaaagatggcacacctctgggtaaatatatgaacagtgaattgacagtgtagctgctgatgtccttagctgatgttcaaaaccaggttcttagtctttacaaggtagcctataggctattagttctgcagaaatcctccagtaaccttgactctcaatgaagtttgctttacattcagctggtggttaagtttcatggggatttcctcattaatttgttgctcatttgtatgttttctttccagaaacataaatttagatcatttgctaagttttgtctacatatgttgtatattagatgttaatctgcaaagtgtggtctttttgtaatttttttaaagcctgaaactatatttgttttgaaatgtaattatatcattttcccttttcctttttccctctaactgcttcttctcaaactcacagccaaccattggactgagcacagggtcccgaatggaggagctagagaaaggacccaaggagcagaaggggttgcagccccataagaggaacaacaatatgaaccaaccagtacctcccagagctcccagggactaaaccactaaccaaagagtacacatggaggaaatcatagctccagctgcatatgtagcagagaatggccttgctggacatcaatgggaggagaggtccttggccctgtgaaggcttgatgccccagtgcagggaaatgcaagggcagggaggtcggagtgggtgggttggtgagcaaggggagggaggatgggattagtggattttggaggggaaaccaggaaagggaataacatttgaaatgtaaataaaaaaaaaatctaataaaagagaaggaaaccctctctctctctctctctagctattgttaaatatatattattttaatgatgatcttatggaaggcaattatttaatgaatattttcccctgtttttcctggtttcagatcagattgagatggctgaagctttttcaccgagcagctcctgggttcttagccactctgatgtaaaaacagtcatcattgggctattagtgtaatatattcccttttatcatacactcattctactagat

SEQ ID NO: 4626 - DNA, 1200 bp, mus musculus
catctttaagttagtagcttttatgcagaaacaaaattgacacatatgtcttaagtagataaccgttaatctctcttgtaaattttagatgctgggaatggttttacagtgttccaatgtaagaagaagccataactatgtgttctgtttccgaagggtggatttcatggtttaccctgctatgaacttctaagaatgaatcttggatgagttgctatcatctcttttatagtatttattttgtaacagattgagaagaaaagatttttcccttttgtgaactataaaataaactgaagctccaagaacagttccaagtattgcatcctgaaaggcccttgtaatgattttttgattcaaaagatcacataccccatgtactattcctggaataaccacaaacttgaattctggtttcctctaccaagacagagagcctcccctaaagcgatcctcatttacaatgaaaataaaacaactgaaggtaacgtgccacctgccacctgccaccccatatccagtatacctcaaccaggtacacatgtgagttttaaacaacatagttttaattaaatcgttttaaaattagatcatatgcttctttaattttataaattgttagtgttattacttaattttctaaactctgtagcacattaatctttccattgaagaaaacatcaaatcctagtcatgttcatgttagtaagcattaaaatcatgattatgaactgtttgcaaggtcagacattagcttttatagtttcttggatgctagcaaaggtcacatgactcacaggtcaaaagcacaaagggattattattattggctcaaaaaaaaaaccctttagctttatgtctctatttgtttgccttaaaatctaagccccataggtgacataagtgacctggatgaatgctgtggatcctgggggtttgtatctcaaccaatgagtgttcaaagaaaaacttgcagacctctgtggtcagtagatacacacacacaaaatatcagtacacatgacacatataaacaagataagtttgtctactatactacccattctaagaatataaattctggaaaagatttgttggtgtttgatggatccaatacctaaaaggatgggaaatccatgaaataatctaacaaagtattaaatatttgcctcttcttctattttttgattatggtttttg

SEQ ID NO: 4627 - DNA, 1000 bp, mus musculus
catatgccaaagcaacccaccaaaccccgcagcacagaaaacaaaaggcaacttaccatatttggcacagtggtgactgaagtattcttgatatctgtaggaaaagcaggtaaactattgaccatgctctgtttgctggctaactgggggttcactccagtggctcccatctgctgccctccagtttgactaaagggttgtccaaatggacttgtggtaccagtcattcccatctgaaacaaaaacaggaaccatcaactgtcatgacacaatcatacatgaaaaacagactttagaagtgcttgtctgacccaatgatgccaaggtgtaacctccctgcagttataaatgaaagcttcattgtcaagagttccttagaactgtgaaaggacaagtttcactcaatgacttaatgctacagacagaaggctgatgaagtggcttaaagactagatcatccctgtctgaactaccatcacagtagaagcaacactttttcctcctcaccttggccaaagccctgccctgtcctgcaccagtcctacacagcaaaggctctgagataaagaccatggggaactttttcagctaatatttaattactctataagtgcttttattctctcaggggtcttgatcagatttcaagggggtaatatgatggttggaaacactctgataggtttctttagaaaatttctttctctcccctcccctcacttttctcttctcccattaccaacagccttttccttttggttgtgagactagattttaacagctgagtcagccctctggctcaatttttgttttgttttgtgttttttaagacagaattctctatgtagcactggctttcctagtactcactctgtagatcaggctggcctcaaactcaagggggggcctctgctccctgcccccaaatgctggaattaaaggcatgtgcccaaaatacccagctttctttctttctttttaaactactaaaatatagtct

SEQ ID NO: 4628 - DNA, 1200 bp, mus musculus
tagcaggtaagaagaggaaaaactatcaatttctaggaagtggtttttaaaaaagctactcaggttgttggaatggaacatttatttaatgacaagaatgtgcaatgcccatagatgagaagtcccagtcagcatgcacaaaatatgcattttatgctgggaagtggtggtacatgcctttaattccagtactctcgagagacagtggcaggcagatctttatgaattcaagactagcctggtctatggagtggagtgtggctcaggacagccagctgttacagagaaactctgtctcaaaaacaagacaaacaagcaaacacaaacgcattttgcaacacataatcaccttatctcctccagccgcacaagaagatatcccccacgttgacaatgtcatgcgaggcaaaatgcgtaaggaccaggccaggtggggtcctaccccatagggacccatgcgccctgaattatgctgctgtgaggactacagctggaagagggggctgcatcatcacaggctaaaacccagctggccctacaagacggacacaggttattatttattattaaaagtcttatttatctgtatgtgtctgctgtgagagaaggtgcttgcagagggaaagggtgtcagatcccttggagctggggttataggcagttataagctgcttgatgtgggtgttgggaactgaacacaggtccttcgcaagagcaatgtgtgtccttaagcacttagccatctctccagcctaatacagggatctcaaggaagatacgttaaggctttaattttctgttttgtgctcatccataactccattagtggtttggtttaacgctgtggttaaaaaaggttcacatggagtcatggctggcgtgcctggatgatggctctgacctgctccaagctgcagtgtacaggactgccagcttctgcaggatgcctgctctgttgtgttttccctgggtccaagtggcccgttctacagtcacatccggctgtctgtcatggctctctcctaactgcaaggacatctgtggctcaccttagtggagatgaggaattctctgcttaagttccaagttgattcaaggtcttgcctgggctggcccaggagtgcaggtgacatttttcctttgtatgctcaaagctctcaggaggtcacagtggcagctttttctggctgacctgagaaa

SEQ ID NO: 4629 - DNA, 1000 bp, mus musculus
aagatagaggcctcgtctcatgtcctaggctttataataaagacaaatttgaaaagtaattgataaagactcattccttgtagagcaataaaatttatcgtggcttaactaatctggccccacttgtgcctgctgcctgccttcccaaccatcggatgactaattgataactaattttctcaatttgttctccattacttattgccaccaagaagcgtctaccttagtctgtgaatcacggaaaccccgtgaagtccggtgatgagtcttgccaggattcagcatggcacatgggccagcctttcaggcagccacactggtctcttctcacccacatggctaagactcgaggtgtttagtccctgccaggcacaggcactgtgagggacaatgaacattccacctatatataccatgttatcttaacatggtaacaacagaggttcagagaggccaggggcctttctggaggtcatagagcagtagaacttgtaacttgcctgtctgtcttccaggtctatattttggccactatgttagtcatacccgtacctccccaaactctttcccctaagctgagaaatgtcaacaccaaggaaaccttgccagctatggagtgaaggtgctctatctccagatagcctggtctcataacgctgggtctctctatcctctggtatagagtcacgacaactgatccttctgtggctgcttagccctcagacctgcccacagcactgacctcctgggaaaatatctcctgaacttcctgacacccagctttatgtgtctgttggggcccgaattcagcattcctgagtccagacactgcctgcctacgtgtgcctgctgtgtagtggttcggggtagcgggaggctgagccagggaaaggttcactcattacagattcctgaaccctgctgttcactggcttcttaacaagtgatgctattagtcttacatgttctcaattcttcattttctttgtgtgtgggggag

SEQ ID NO: 4630 - DNA, 1600 bp, mus musculus
gagaagggtgtggtttccctaatttctttctcagcctgtttatcctttgtgtaaagaaaggccattgacttgtttgagtttattttatatccagctacttcaccgaagctgcttatcaggtttaggagttctctggtagaatttttagggtcacttaaatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtacataaaatatttgacatgtgttcatgctatattcatagtaaaagtcaggattttactattttaagcatgtttttcctgaagttgcacatcatgggctacattgatgtacacaaataagcatggttaccatcgacgaatttcttatgataccttgtaaggctctttagaagcctaagcatctataatatggagtagtgatgctgtttgatcaggacagaagctatgaaggtgctgtgagattgaacgaagttatgtttaccatgtgtgtgtaatgtgtgtaggactaaagaggaattggggagcgagcttgcttgtcaggaaacaagagttcaagatcatttctcctggaggagagccagggtcccaggctttagacatcacttcagagaagctgtgagatttgccagctgcccctgcctgtgctgcatgacaagagagtctgccagggagtgatcttcaaacaggagagtccaagggcttaagcagacagagctgaaaacctgggggcttcctgtccctcactttcctttcctgggacaagtgttcagattgcctgctttgatgatcagtcaaatggtgaccttagaagtccctccactccaggcccggtggctgagcacttcagaaagtagtggcatccttaagatagaagcaacttggtgtttcctggtaactgctgtaggtcattaaacctatttccatcaaatttgaaaagggtcgtcttgggccattgtgatggctcagcaggtaaagatacttgccccaagcccgataacttgagtctgaaggcagaaggaaagattcaatttccacaagttcttttctgacctcttcatgcactgtggcattctcacatgtacacacacacacacacacacacacacacacacacacacacaccctactaaataaatgaaaaaattttagagggatgggctcccaatttcctcctcctcctcctcttcttcctccctctcttcttcttcctcctcctcttcctcaattctggctagcctgggtctctgttttaactagaatagcccatttcctttcaggttcaatgtcctcattttcactaaccttttcaggtcaccccatcacacgctgtcccttccttaagctccactgtttttattgtgcagtggtgtgggatgatcatgctctgccaatggccactctcaaagaaatggccttttctaaagagactgttagctaagatcaagggaataggctacaacattaactaaagatatttctctatattcttttaaagttcaaaggatacaggaattc

SEQ ID NO: 4631 - DNA, 1200 bp, mus musculus
ctacctgtttggttgtgttttcctgtttttctttaaggacctgtaactctttagcagtattctcctgtatttctttaagtgagttattaaagtattctcctgtatttctttaagtgagttattaaaatccttcttgatgtcctctaccatcatcatgagatatgcttttaattctgggtctagcttttcgggtgtgttggtgtgcccaggactgggtgagttgggagtgctctgttctgatgatggtgagtggtcttggtttctgttagtaagattcttacgtttgccttctccatctgatattctctggagttagttgttatagttgtctctggttagagcttgttcctctcctgattctgttagcctctatcagcagtactgagagactagctctctcctgagtttcagtggtcagaacagtctctgcaggcaagctctcctcttgcagggaaggtgcccagatatctggccttcggacctgccgcctggcagaagttgtgttccagtcaccagaggtcctaagttcatgtggagagtcctctctgctgactccacgcccaaggtgacccagtgctggcgccaaccggaaggccttgtgactctggtcaggccaagctgtttccctaattaatgctttctcaggtcctgcgtgattggattggaagagaaggtgtgttccactcatcagaggtcctaagatcgtgtggagagtcttctgggtaccttgcgggtgtatgccgactccgcgcccaaggtgacctggtgatggtgctgactggaagggtattattggtgttctgttcagaaagttgtctcctgtgcccatgagtttaagggcaagtttatttaccactttctattctctcaggttcagtgtatctagttttatggtgaagtttttcatacacatagatttgaattctgtgtagggtgataaatatagatcaatgtgcattgttttacatgcatattttacagatatccagtttgacaagcaccattcgttaaaagtgatgtctctcttcttccagtgtttatttcttctggctttgttattttaaaaaatcaggtgtccataggtatgtgaagtttatgtctgagttatcaatttgataatgttgataaatatatctattttttgccaacaacatgtgttttgtattactgtagtttggttgggggttattactatagtac

SEQ ID NO: 4632 - DNA, 1600 bp, mus musculus
cagggctggtggtataagtcactgttaactagctcccctagtgatcattgcaaaagtgcccctgctaagcctgcaatgccctccttgttgaacatgtgtgagtgtttctttttcttaaagcatggttcagatttgaccagcccccacttcctttcaaagctctccatgtaaaatatgaggagttgagggctttggatatggagtcccacagtatgtgagcaagaagaaccttgctcctcacctttcccagtggtgagtatagccctgggcttctgtggtctgagtctggaggctttcacttgtcaagggatgtaggagtttacttactttaaagactatgaagagcagtcctcaccgtgtagtgctcagactggatgcttctctaagccactccctcctggtgttttgccagcacctctggcttctgtttctcacccttttccttggctcctactctgatgccaactcctttttctaaaggggagtttctccagggatttcccccttttgagttctgcattcttcttaagaggactggtatactgtgtttacaatagtctctttattcgtctcttcattttgtctctagcctagacttttcttcctatggtatgttcttgttatttcccagggactgctgcctcaccctgcttacatggaaggcataaccttctcaggaaactcagaactttctggaacatccactgtcttgctgtgcacccaggagctcaggccagagtccttccagccctccagccaggtatccatcctgctgggttacaccacatccattcccaccaggctgccctctttctggcagagacatttcccatagcctcttaattggtcctcctgctgctgttcctgcccgtcttcactccatcacccagctggagtgctctttccacagtgaacatcagctcatgccagtcccctgcctaaaacacttcaataaattctctttattttgaagataaaatcctatctccttcgtagggctctgtggatgttgcgatttgctgtctgccctgcctcaagacccagacacttactctctcagctgccaagatgtggactgctgctacctcagagctgaaatctcttagaaaaataagtcagaatgggtgagagcattatatatagagttccacagtctggaagcaagcagcttgacctctctaggaaggtcactgctacattcaaggctgcaccatcagacaaagacttcaagtagcagtggttcagggtggaggtgggaggaatgccttccatgtctgtttgcttgtttgtttaacttgggatatctttgaacagctgccccagtttgagctcccactctaggaacaacagaggcccttgttgtcccctaactgtaactcatcccctccctctgctctttgttgctatggctgctttctgctcccctttccttacatgtgtggtttctgagaagtctccccagtaaaaacagtgtgtatcttccaaggtcctctaacacaacactggatgctgtagtatagacccattggtcatccgctgccttgtttgtgacaatgtgcataaaacatggaaagtgaagagaggaagtgctctttcacaa

SEQ ID NO: 4633 - DNA, 1800 bp, mus musculus
ctgaagtgtggtgtcaggagagagctcaccacatccaagtttaaagagaaatcaacagtcctgggcagtcctcaggaactacacgaagaacaagttatttgttttggtagttctggggattgaactcaggacctcacacatgctagacaagtactctatcactgagctacaacccaacccagttgccctgttctagccaactctctaataatacatcctcatccttcagttagagcagatcgctgcctagcaaagactggccttgtgtctcgcactaagctttccaaagctacaagatgcacacacacaggcgatgcacacacccacaggtgatgcacacacaggcggtacacacacacacacaggcgatgcaatgctcattgtgtgcttccttcactctccagccacaaagaggatgtgtgcctggcttctcggacgagacgtcctggcatgttgcttgtcaatactccacatgtccctatctgtcacatcacagtgtgacgcctctggaccgtcttgtgaaaagacaagtcccagccgggcaatggtggccacgcctttaatcccagccctcgggaggcagaggcggcggatttctgagttcgaggccagcctggtctagagtgagttccaggacagccagggctgcacagagaaaccctgtctcgaaaaaccaaaaaaaaaaaaaaaaaaaaaaaaaaaggacaagtccatagataattgacctgcctagttttggtattgtcatggccacttaagtccctcccaaaacaagaggtgccactgcatgagtgaaatacatttggtgtatgtgcttggctgaggagccaatggggcgaagctaccatctgtgggattatgactgaacgcctctaagtcagaatcccgcccaggcggaacgatacggcagcgccgaaggagcctcggttggccccggatagccgggtccccgtccgtccccgctcggcggggtccccgcgtcgtccccgcggcggcgcggggtctccccccgccgggcgtcgggaccggggtccggtgcggagagccgttcgtcttgggaaacggggtgcggccggaaagggggccgccctctcgcccgtcacgttgaacgcacgttcgtgtggaacctggcgctaaaccattcgtagacgacctgcttctgggtcggggtttcgtacgtagcagagcagctccctcgctgcgatctaagtgaattctgctaagatggtatggtgtggaaaatatgagtgtacgtgtacatcgctggcactgacgttctcttctgggccaccttagcaagtcttatatctttgagtgtctttgtgtgtgtgtgtgtgtgtgtgtgtgtgtgtgtgtgtgtgtgtgtgtgtgtgtgtgtgtgtgtgtgttggggtgtggggttgagacaaggtttctctgtgtctttgtgtgtgtgtgtgtgtgtgtgtgtgtgtgtgtgtgtgtgtgtgtgtgttggggtgtggggttgagacaaggtttctctgtatagctctggctgtcctggaatgacctctgtagaccaggctgacctccaacttgcagagatcctcctgcctccgcctccgcctctcgattactggattaaagcagtgtgccacttctgcctggcatctttgagtggcttttagcttgcattccatgttgtagtgaaacaaccaaggtgcaacaagaaaaatgagagcaactgtgtctagcaatgctgacaagaaaggtggccctggcttcacctccaactcagataaaataaaaggaaatcctcattcggtccccaaaataaat

SEQ ID NO: 4634 - DNA, 1200 bp, mus musculus
aattaatcctagttgtttctggtcatctttggcttgagacctatcaggaattcccagccaaccttctgaaggaaaggcccacattggtgggccatttgactctgggtgtctggtagttatatgggctgtgcagaacagttgtttgtgaatgggtgggtgggttagcctttgttttcaggggtgatttcatgtgggaaggcttttcttgtccactctgctcctgcaagataaggaccatgcctctttcagaaatgtgggtgcctccacccacccctgctttatctgtgagagggataggaagggctgtctgtgtagccctacaggattagtctgatgtaacagaggattgacactgggaagccttggcaaatgcttcttttcctgtgtgcttgtgagcattgtctctggcctggctgacccttaacagctccacttcttggttgttccagccgggattccctgcaactttcctgatcctcgtgttctcattgtcagcgggatggagccacctgttgagtctgtgtgcctgtggtgacttgtttgctcttggtagttgctgtgatgtcaaagaaagatgtcttcatcccctgctacagtcttgtgtgctcagtgggtagcagtcgttgatataagagaccttgatagggcagtgtggataagcagccttggccttggcctacagcttatataaataatgttcccagtgctgagactggcgcatgcaaggaaacacccaacaactgagctgcagtcccagccaagtctccagctcttcacaccttggttcacataagtgaatgtggtcaccagcctggaaggcagcagaactctgatggtctgggctgagtttgcagggttttgaaatgtcacctttctttgtaaaaggcaagtgccacagtcatatcttcttgttgagtggccagcagtgctgacctcagcacagacagataatgacggccactcagtatgccctgtgaatcctgtgaatgccagtgagtttagagtagtcactgtatgcatgaacacacacacatatacacacactgcacactgaactcatatgtgtgcacacacacagaaagtaaggtctaacaggggatgctcagtatgtggaaagcactctgaatgttggtacctcactagcaggcacttagggttgtgactggctgtctgcctgtgggaaaagccacccagactgga

SEQ ID NO: 4635 - DNA, 1000 bp, mus musculus
gctcaagaggaaggaagaacaaagagtggatgtttcagtcctacttagaagggggaacaatagaatcaagggaagtagagggtgagagggacttggaaggaagagaggaaggggtaaaagaggggcagaatcaggtataggaaatgtacagaaggtcaggaaattgaacagaggtgtgtagcaatggaggatggggaactgggagtagcaaccagaaagtcccagatgccaagaaagcaagagcctctcaggaccccacagggatgacattaactgaaataacccgcaaaaaggaaggagaacctgtcaagaccatatctagaagttaggcatgccccccccccagttgagggatggggccacccacccatctccaaaattttaacccagaattcctcctgtctaaagtaaatacagggacaaggagtgaagcagagactgaaggaaaggccacccaaagactaccccacctaaggatccatcccacatgcagacaccaaacccagacactattgctgatgccaagaagtgcttgctgacagaagcctgatacagctgtctcctgagaggctttgccagatcctgaccaatacagatgcagatgctagcatccaacaaccatctggctgagcacagggcccccagtggaggagttagggaaggactgaaggagctgaagagactttatctggcatcaatgggaggggacacctttgttcatgtgatggcttgatgctccagtgtagaggatgctaggacattgaggctcgagtgggtgggtgggtggtggaacaccctcttagaagtagggtaatgagagatgggatgtgggtttgcataagggaaactgggaaagcagataacatttgaaatgtatacaaataaaatagccaatttaaaaaaaaaaaacaatggataagttctcataccagcaattttaaagtatatttgaaagctctaaaaaaaaaaaaatgaggaggaggaggaggagtcaggaaat

SEQ ID NO: 4636 - DNA, 1200 bp, mus musculus
cagtgatcctctttacccgctacaccatctcccaggctctcacttcagattgtgtctgagtttagcatcaagacctttagagaaaatgcttcactttcaagatgtggctctaacagtggaaatatcagtgggtttggcaggccagggaaggggatatttttagatcaagccctgccaagcgtctgtggccttcagaccctgccagtcacctgccatgctgaacagcaacaagggatttttcatttcctatttgctgccatagcacattaccacatgtttagcagcataaatccacacacatctatgatgtcatatttttggaggccagaaatccaggacaacagagtcacctgtttagagtctcatgagcctgcactcctttggggaagctctagagatggcctgcatctgaggtcattggttgcaggctgagttccctgagtgattgaggctgtaggattaggaccggctggcagctgaagaccagtctcctggtctcctccattctaacaggctgctccattgcttcccatgttctcccagtaaactctgcaacaagagctcaaggactgccactcactccaagcccttcaacctaacctctctggctccagtcccagaacgttctctgctttgggggccttgttttatttttgagagtgtctaaagtcccatgtgtgctaaatcaccactctagcactgacctacaccctagcggacattctctgctttgcaggagctcctgggagtctactgtcccagaagggcaatctcttcaggatctataaccttaaccatactgcaaactgtttgccatggacatacaacttctaggttccagaaattaaaatatgttcatatttggggtacctcttcctatgcctaccacacccaggaaggaggcaaaatgtcagaatagatttgcactgctgctctgtactgtaactgagagtgtggctgttaactgcccgggtccctatgtctgtgtccattgatgaggactgggagatgggacttcagaaccttgtcaccacccagtcttacactttcagcttatataaacctacatgtggaaaagggagacatcaggtcaacagacacgcatgtcactgctgctgctctgtgccacagggtacttggagcacttgagttctctctctgccaccctggagaactctctactagcagaaggaagtagct

SEQ ID NO: 4637 - DNA, 1200 bp, mus musculus
tggccttactggaggtgatatagccttgttggaggcggtgtgtcacaatggatgagatttgaggtttctctgagggcctctctctgcctgcagatcaggatataaagctctcagctactactccaatgtcatgcctgcttgtctcccaccatgatgaccatgatcatgagctaaccctctgaaactataagccagacccccatcaaatgctttgctttatttttaaatttattttgtattattttatgtccactggtgttttgcctgtttgtatgtgtgaggatgtcagatctcagagttacagacagttataagttgctatgtggatgctgggatttgaacctgggtcctctgggagaacagtcagtgcttttaactgctgagccatctcccagccccaaaatgccttgttttataagagttgccttggcatactgtcttttcacagcaatagaacactaagacaggagtcaaacgggcaagaaaatggctgagggctgtagtcacacttgtaagcaggacatgtaccagtgcactgaccccagtacacctctgtggcttcccagagtaacaagaagcctttcgtgctacatctgtaatgaactatgtcaaggacatatagtagtgcaggaggtcagagaatccccaagctgagcaaagcagctcaaaggcaggaagcatgtactttgcgcctctgggcaatgacagccttactgtggctcaggtctagctttggtcctgggacctcacctcaccactaatctgcctctgtctacccttcctacctggcctggggacttgtctttagaaatgtgggtcttgtgatgtgcttgaggtgggataatgggcctggggttacactaaggcacagcaggcaaggactccctggaggtgcccagcatctcagagtcttgtggactagctatttcagttgatccctgctggagttcttgctagctggctgctgagactgaggcctgcaggctacccataaaaggagaaaggaaagtggagctgggaatgcatcccagactccacgcctctcttcctttttgtaccagccagctgtagataacaggagaggggggacaggggcagggaggatcccaagcccaaagcaaatgactccctactttacatcccccaggaagttagcttccagaggttctacacactgtgtggggctagtgcacagttgtc

SEQ ID NO: 4638 - DNA, 1200 bp, mus musculus
tccatctccaggattgtctctctttgtattttctttaatgtttctatttccatttttagatcctggatggttttgtttagttacttcatctgtttgatcgtgtttttctgtatttctttaggagatctgtgtctttcctcttttagggattctacttgtttacctgaattctactgtattttttttttaaagggagttatttatgtccttcttaaagtcctctatcaccttcctgagatgggattttaggtctgaatcttgcttttcaggtatatccagagtttgctttggtgggagaactggattctcatgttggtaagtagtattggtttctgttgcttatgttcttgcacttgcatctcaacatctggttatctctggtgttacctggccttgctgtcatctcttactggagcctgtgatcctgtgatcctgtaagtgtcaagactcctggaggtctagctgcatctgggtatgggctgagtaggtgggaatcagagcataggctctgctcctgggtacagatgcaaactggagggaactgcgtctctggctgggtgaggtttctgtgtcctctgggtcttgtgagtcccagttaggccaggtattgtggtgagggttagtgcctcacctgttgccctggatgtgtcagaactcccggggtcaagctttgtctgggtgtgggcttagtgggagggaatcccaagcatagggtccactgtcaggtgcaggtaacaaaccagaaggaacttgcctctctagctgggcaggctcaaggccaatttcttttcctgatagcttttctgcagttatgtgtataatttccttataagatgaagattagttcaactttgagatactacctaggtgtttgaaattatgaacagggtgatactgatggtcagtaggttagatctgaagaaaagaagttctttcctggtgctttaaatatgtagtttcatgttgtgatggattcctaccttaagtgtcttaagtcagtgttccacattttagatagagttgtataaaatcttttactgcacagattgctttgccatgtgaaaaaccatataatttatttttttgcaaacttaatgtatacttagatttgtttattccaatccaaactgagttatgtttgaggtttctgttttgcttctatcccaggctaatttaaattatcctgacttctcaataagt

SEQ ID NO: 4639 - DNA, 1400 bp, mus musculus
agagggcaccttcactgttttaccctccaaggaccccaatgagaaattgtgaaaggccaaggaggcaagaactaatgtaatgcagaagagagagtttcatttcattcttgaagctcctcattgccacatcatattaatctggctggaatataaaatccaagtcatgaagtcaggagaggaaatattttgtccttttctttttatatcttcccattatacagaggatggtgatgttaggtagcaaagagacgaaggaagtaaagcataaagctgagcagatacaattttgaggtttctgaaaactctggaactctattggagcaggaaggaagcagaggttacagggtattgatggctgtaatgataaatttagactgaaattataaattggggactaaaatcaagattgtgacatttacagacaaatgataaaatgaacgaagaccataaaaattttaatgaaaagtaacatctgaatatttctttaaaggttgaagaaaagaagacagggtatttgtatgcacccaattttagctctttcgagcatagacttgctgccttgagggctactgcacacgttgagccagctcctgctgcctgcactggtggtgcaggtgacatgggtgccatggacaaagctcagaagactgacctggctctcccacttgctttagctcttcaaactgagcacctaaggggccaacaacactttaaccctgagcctgctcctgagcactgctctcatgagaccactgaccctgatcacaatgctgactttgctcttgactcttgtcttcttgctcaaggcaagggtgacaggctcagtattgatcctgaatctgctcctctttgtggcccctgtgacatggaggacccttcaactgaccactccagccaaggcataaacaccaacaccaggcgtgctcctgttcgtggcagaggtgataccactgatcatgataatggcacagatctggcttctacccttcctgttgttgttgattaaggagatggttgatacaccgaattctacaagggtggtctgaggaatctaaccaagaagatttttaccagtaagaaaactgatgatcaggttaagttaccagacaaacaatggtttaaaatagaagatgatttctgttctagaaaactaaattttcttttggtgctaatacttatggttaataaattccatgcttcatatagggctatttaagctttgtctggtaccagaaaaaagtctctgtttcccaataatattgaaaatacaccatataaaaatataaagtcagttatccccaaaaaaccatgattaagtaatgttggttggctcatggttatttcctattctggaatgaggaaatggttgtctttccccatgatttctgagttttcagagt

SEQ ID NO: 4640 - DNA, 1200 bp, mus musculus
tgctaatgaagtacctagaggtccagagtgtttagccaataagcttcccttcccagatattcctccctgaaaaaggtatttaacctcaggcccaccctaagaagtggggtatggttttacacatccattttctgtcatgaccataaactgttaagaaccatggactgcctctttctatcaagatctgccatgaggagccatgaagaaggcctttgcctacagaatcacagcataatctcctatagaaggtctctctgagctctcagccacagctgccaccaagactgcaactgccaagctaaagacaatcatctcttctgggacaagttggagctcccctttccccttgcagcctcaggctagatgcggtccccagcctatgggtcctgatttcattctctgctcttttgtgactcctggcagcacctggatgtccaagaatctgagaacatcctcagctccagccttgtcacaggctcagggacccccgaaccagctcctactttcccacatctgagacggtactttcccaccccttgagaggtgtttcagaggttccctatagcaccaaaactcaccagggcatcagcatgggataaacacagtcaaacttcccctgtctgtgccttgtggtagagtgaacacggacctacaaccctacagtatactattctctaattaagtctatgatcatatgttgagcacgaatcattacactccagtcagaagagttttttttatatagttccaccttttcaggcaggtattgtaaaaaacaatttatagaaagccaccatgaacagtctgggatgaacacactgggatgaccttcctgaaaattttccactgatgagtagctcggcattagaatcatcacggtatcttgctggctcttcatctgggccattgaatctgtccaagtgctcccttacaaagcagcaagtttctcttgtagcctcagagaagttgtgtgtctggttctgattcttctggtcctggtctttttaaatgtactttttaaactgtgctgtggtttctttcctaaagatcattccctgcttaaataagcccgttgatgtttgctaggaaaaatcctcaatgcagcacatggattgcaaaatttactactcagagaaacaaatcttcagttagggtttctcattacgctgatcttctacacaaagaactaagatacagtag

SEQ ID NO: 4641 - DNA, 1000 bp, mus musculus
tcactaaactccaaatataataaactcaaagaaatccaaatctagataaattagaaaatcttgtagacagtatgtcatataaaaaggattgctgctgcttccctgaagacaccacagtctgaggaatcccaggagatctgctgcacttggggcatctaataagaaacttccggaaatcccacagctgacactggaagctcagttttcttgggacccatcaccccccacccccaagatctcccactgcctgaactccaatcccgttctggccagcagcctactaactagtctgctccattgaagacaccaaagctcgaggttctctgcacacaagcagctaggcaactgacacaacagttggaagacctcctgggggctccgtgacatgcagggcaactgactcaagagactgaaagcctccttggagttctgctgcacatgaggaaaaagaaaccatagtcctggagaacagcttcacataggacaacagcttgactgctcctctgaagatacaacagtctgaaggcctcccaggagttctactgcagttaggacatcacatcagcagcttctctgccccagtgaagacccaacagtcagaaggccccagagaaggtctgctacagctagggccacagattgaccaggagaactgaagcaacccagggacaaaagaggcaggcttgagacagattcacccagaccagcaaataccagggataaccagatgttgagaggcaaacacaagaccataagcaacagaagtcaatagacgtgggcatcatcagaacccagttctcccatcacagggagccctgaatacaccaacacacctgaaaatcagaaagctgacctaaaatcttatcttatgaagataatagagccctttaaggaggatataaacaacttcctgaaagaaatgcaggaaaacacaaacaggtgaatgaatgaataaagtggtccaagacctaaaagtggaaagagaaacaataaagaaaac

SEQ ID NO: 4642 - DNA, 1200 bp, mus musculus
caagatcagatgagcaatttaaatagatccatagtccctcatgaaatagaagcagtaattaaaatctcctaaacaaaaacaaaacaaaacaaaacaaacaaacaaacaaaaaaaaccctacagcaagatggattctgtgcagaattctcccagaacttcaaagaagagttaacatcaatattactcaaattaatatgtaaaataaaaaccattatctagaacaataaacacatcctaatttctaccaaggtattgttactctgatatgaaagccatgcaaagacccagcaattaaaaaaattataaactagtgtcctttttacacaatgttcaaaaattcccaacaaaatactcgaattctgaaatccaagagtacatcaaaataatcatctatcatgatcagttaacctcatttcagagatggaagggatagttccacatatgtaaaagaataaacattacctgaaagacaaggcatatgacagactgaaagacaaaattatatgatcatctcattagatggaaaaaaggtctttgaaaaaaattgtggggagcgagtgtggtggtagtcccaagatggcgcccaggactgcagccaagtcttatgacttgcacctgacttcctcatacacctgaaaataagccacgtccatcgtgagagctgcgcaggcgcaccatgacacaagatcaggccatttgactaaggccaatgaactgagattacgcggactgggctgatggggcatggttgaggggttatataagggattgcgattgggagctaagagagattcctatttgcatgttgaaaggttcctgaataatctgctttgagaagaacgctgtgtcgtcgctcttttctgctggttggagacagaagcaacaaaaaatacaacccttcttgataaaaatcatgttctgttgctttcatgctctgtattatatactgaatttttgttttgtatttaatttctactttatttccttattttttgacaatttcatatatagtgctatgattattgtcaccctcaactaacttttgttacttcttcctcttcctctatttcttcccagtaagttttcaagtggctacacatcatagacagtgaagaaaaggaccccacccacaacaattggttcctcttttttccatgatgtaaaagtgaaaaatccaatatgacaaccccatagccagca

SEQ ID NO: 4643 - DNA, 1000 bp, mus musculus
ttacacattaggaaggttgggaacgacagaagtataggaaaagactgttggcatttgctcaggaattatggccaatagttgagcaatgagatctcattaaaataaaatgcttttgcactgctaagaaaatgatcaactgggttggagagatggctcagggcttaagagcactgactgctcttccaaagagttcaaatcccagaaaccacatggctcacaaccatccaaaaggggatctgatgctctcttctggagtgtctgaagacagctacaatgtacttacatgtaataaacaaacaaacaaacagtttttttttttaaagaaaacaatcaactgtgtgaagaggaagctcataaaatgggacagaatttttgctaggtatactgctgcttgaagactaatatttagaatactcttaagaatttagaaagcaggcaaagcagctgaaacaaggtcctacaggcctacatctgcacccaggaggtggggctgttctgcagctctctgtgcaccttccctgccagggaagagcttgattctagggagtgctctgaccctgggactcaggggagatctccagtttctctctagtgactctctaagtctcgtccactcaggagctctcaggctgcagaagcagcagagcagctaggacagggtcatacaggcctacatcagcaaggagaagatgggactgttccacagccctctgtgcactggtcttccctggagacagctggtctcctaggagtgctgctgactgagacttacagactcacaggaggaacaagctccagccagagacagcaagaacatctaacactagagattgcaagatggtgaaaggcaaacacaagaatcttaccaacagaaaccaagactacttggcatcatcagaacccagtactcccaccacaacaattcctgaataccccaagacaccagaaaaacaagattcagatttaaagtcatatctcatgatgctgatagaggatttta

SEQ ID NO: 4644 - DNA, 1000 bp, mus musculus; identical to SEQ ID NO: 4643

SEQ ID NO: 4645 - DNA, 1200 bp, mus musculus
gtgtgaagcagagactgaaggaatgaccagccaagactgccccacctgggaatccatccaatatacagtcaccaaacccatacactattattgatgccaacaagtgcttgctgccaggaacctgatacagctgtccccttgagaggctctgccagtgcctgaaaaatacaggagatgctcacagccatccattggacttagcactgggtccccaatgaaggagctagagaaaggatccaaggagttgaaggggtttgcagccccataagagcaaaaacaatatgaactaaccagtacccccagaggccccaggggctacaccaccaaccaaagaatatacatggtaggactcatgactccagctacttatgcagcagaggatggcctagatattcatcagtgggaggtgaggcccttggttctgtgaaggctctatgcctcagtataggggaattccagggccaggaatcgggagtgggtgggttggtaaacagggctagtggggaggggataagtttcagagggagaccaggaaagaggataacatttgaaatgtaaataaagaaaatatctaataaaatttttaaaaaataaatatttgagatggtagaatacctgggcctggtggaagaagaggtctcttgttctaaggacatgaaaactctactaagtcacaggtgccagtagacaacttcactaagtcacaggtaccatgagaggcatcctaggagagtcacagtagcaggaaccacagcctggcagcctggaacctcccaggtcagagtagctgcaggatagggaaacctgccagaatggaccagagatgtgttctctggggctgcttagaaggacacagctttcaaatttatattgcctaattctttccattgtagagttcccttggtcacttccagtctgcacctatacccacacctatggcagattggcatacctactcccccaccccacatccctgcctgtctcccaggaggtctactctaaccaggggcataggtaagacacacaccccaataaccataccagctggtaccccatagaaacctgcagacatggtatctatccagcccttatggactcccagagtctgaggtctgtacctgcacctataatcaggtagattggcccacccaccactaccaactccaaaattctgtctgtctccaagaaggctgctctaac

SEQ ID NO: 4646 - DNA, 1000 bp, mus musculus
aacacgtccacactctgcctgcaactcacaaggcaatcagtcacgcaggactgaagaggcttgggatggttttaaaagaagcccacaaattcttgaaatgccttccttcaatgcagactaatttttctcctcttgagtgtggattgttctgcgtgactcactgctaatcagtacgacgtagtggaaatgacgcgatatgacttccaaggatgggctttagaaacatttgttattctgccttgctctctccggtggagcatggactcttcgggaagactgctgccacctcagggaggggcccactgataaggaactgagtatctgagccttggaagcagacccaccagcccagtcaagctaattgtcacaaactccctcagaaaagacctgagcccgaaccatgcatccaaaccacctccgaattcctgacccacaaacatttccagataatagaaagtggttacttaagccactaagttgtgtggcattttgttacacagcaatagatggctaattgtttccatagcaaccataacaaaaggtattatgggctcagcttgaatgctagacttgatagagcctgcttcctcatggggtgcgaacccatttgacccccctgtcactcactgctgctgctctcatttagctgactacggtttcccttaacctccctctggtcccaggtgtgccttgggctgcgacaaagcagctgcgtgatttccttgctgttgtccgctgagcgagcccacaggtgagaagggagctgtgcattctgaggggccctgggaaagacagcctggttacagggaaaaatcgccaatgttttccatatcctctacacttagcagcacagatctggagatgcgtgtgtgttagcgcagatgctgtgtctgtgtcacgagctgtgtggcacgtaagattgctgccattttagacaacaatttccagtcactatatgtgcatgccagagatccccacagctgccttttggcagtcagtc

SEQ ID NO: 4647 - DNA, 1000 bp, mus musculus
aggaaggggccctcactgcagctacaggcaccaaaaactctgccctcctagcctctagaactgtaaaaccatgcacatctctcatttgcaagtgacccaggccaaaaggactaagacaaatagtaacttgaacacagaggaaacagcatgactgatacttgcgctgacttctggaataagcagcattcgagctgcctgctgactgaggaagagaaaggaggactttctacaaaagagatcggtgcagaccggtagcctagagtaatgaggcttctctgaagggatagtagtggggaggaagatggaaaccaccagccaatctccatgtctaacacagacgggctcttagataaacccatgttcctgaggctggctattctgtatctgtggtggtggtatggatttaacccagatctcttgccctcatgcatgccaagaaagcttcctacacacacacacacacacacacacacacacacacacacacacacacacacacaagccaaccctattgaaaaactgtcaggctctcagagaccccagaatcccattattatatcatgagagattatgatatcaacaagttcttcatcatggctcagtctcttgatatcaccctttaccatccatcagttttcatctggagaataaaactcacagcaacagagcttcgcactccttgtgagcctgttgcataaacacacattaacactcacagcaactgcttcacgcctgtaagtggaggaccatgccatcaatggcacaggggcgataaggttcttccccctgggatccctttatagagatcccagaggaaacagatcgagacttttgagacctaaattgtgtatgcttccacttaagggggaaaacgttaagagtgggtctgactgtgtagccctgactggcttggaactcaccgtgtaaaccaacctggtcttgaactcacagagatccacttgcctctgtttcctctgtctcctgagagctgggatcaagt

SEQ ID NO: 4648 - DNA, 1200 bp, mus musculus
cttagtatccttttattaaatggacatttaaaacctgtgattaaacatgtatacgcattgtacaaagcctcggcatttaaaaaaccttaagtataatattcattttgagaatgactacttcttatatattcctactaatttacataatgcttgtaaactcagttctattgggccaatgttcaaatctgttagacttttaactgcagtaactagagtttaaaataagtaagagtgtcttctttaaaggataaaacccaggtgtttccatcaacttaaaggcaaaaggacatcacatcaaaaacgtcattctggccacaagatctggactctatccaggtgctcccaactcacatcgcctgagagcaagcacattcacatggccttcaactcttactttcttcccgccccctcttctgcaagactctctgaccgttgcccagattgatagagatgtcccgtttagggatgttccattcaacagccatttgatcttagcactttgagcacttagagtctgcatgtacagctgcccactcaaacaaggaagctcctttagtgtcttccaagagcagcactggtctgtgaatgtaagcataaatctttagaaggcagcttgataacaggtcatttagcaaaacaacaacagtacattccctgccgtggccgatgaactcccaaaacatgggctttgggcaaagttcatagcatgaaacatgaattccctcccacaaggcaagcctcagacactgtcagaaagtggttggttacctcagtaacaaacaaccaggctactatttcaccagtaggcacaccttgcttggcaggttggtattccagcatgtcgggcttgccaaggaataaggacattgatggcgttttctcttctagaggactacaaagccccttccagcatgatgaaagcttcttgtatcaggttctgtatttctggcttttaatgaagttttcgctccattttgaattgatgtttttgcaggaagagagatgtggatctaatttttctgcaggttgatgtccagttttgccttcagtatctgctcaataggttgtcttttcttcttgtgtatgtttttgatacctttgccaaaattaaatgacaagagctgtatagatttatttatgggtgttctaccgtgttgatatacatgtctgtctttgtgtctttttgattatagctctaca

SEQ ID NO: 4649 - DNA, 1400 bp, mus musculus
atagccagaagctggaaataacccagatgtcccacaacagaagaatgaatacaaaaaattggttcatttacacaatggaatactattcagctagtaaggagaggacaacctgggttttgtaggcaaatggatgaatctagaaaatatcatcctgagtgaagtaacttacacccaaaaggacatgcatggtatgtactaactagtaagtggatattagctccccccaaagtaaaaaatacccaggatacagcccacagaactcaacaaggttaacaagctgaagaacccaagggaggacacctcaatctcacttgtgagggagaagaaagcaatcacagaagggggaggaagggagggagggagggagggagggagggagggagggagggagggaggaagggagggagggacctggatgggagaggggaagaagggaacatgatcaggtatccggtaagggaaaaggactgaagccctgaaggccagcagaaagaatggaaacaggcaacattgggaggtaggaggcagaaagaccctccagaatgtaccagagacctgggaggtaagagactctcaggactcaaagagagggaccttaggtaaaaagccctacagtggggagagggaacttgtagagcccacctccagcagaaagacagggcatcaagtgagggatggggctgctatcccacagtcaaaaactctggcccataattgtacctgtctaaaagaactgcagggataaaaatggagaagagcccgagggaaaagaggtccagtgacagtcccaaaatgaaagccagctcaaggggatgccccaaggcctgacactattactgaggttatggaatgctcacaaaaaggggcctatcatgagtgccctccaaaagacccaacaagaagctgaaaaagtcagatgcagacatttacacccaaccaatggacagaagctgctaacccctgtagttcaattagggaaaagctggaagaagctgagaacggagggtgatgctgtaggaagaccaacagtctcagttaacctggacttccaagatctctcagacactggatgaccaaccaggcagcatacaccagctgatatgaggccccccaacacatatacagcagaggactactgggtctgggttcagtcagagatgatgcacctaaccctcaagagactggaggacccagggagtggggaggtctggtggggtgggagtaggggatggaggcatcctcatggatacagggaggggaggaggtatgggatgtggaacagtcagaggatagactgggagggggatcaaatctggattttaaaaaaatgagtaaataaaatttaaaaaatgataaccaatctataacccagtcaagtacctaggatatatattgctata

SEQ ID NO: 4650 - DNA, 1600 bp, mus musculus
cagaatacaaatggtagaagccaaacacagaagcagaaaactaaacaagaaaaccagggtcatttctacacgagcagagtagacatgtctgccaaacccactctagaaaaaggaagacattgaacaaatgtaggccaattaagtgctaagcatttaataaacaataacaaactatcaataggtagtagggataaacacttctgatagttactttttagaaaataattgtgaattgtcacagagagtaagtagtaattaaaagaatattgttcatgaaaattggactgataattagtccgcccagaataggcagagactcttcttgtaggtttattgttacgaaacctttaagatttgtatcataaagaaaaggaatcatgcactcaggtcattttacgaagtaaatttcgacacctttgaaggaataataaagttggtttgtcattttgctatgcatctgatgcccttggccctggggctgcgggaagattgagaaacctaaggcatgtcccaggacggccacaatgagcaaaggtgtgatggagagaccggaaagagggaacacgtggtatagagatggaagagaaaatggagctaggtgagctgtgccgtgtggaaagaggtagagccagagattcaatggtgatggaaataggcagatatgaggagcctgcaggaccacctggagtcatggtgatatgactggtaagcaggggctgcttgcaaggtccatgtctggttccacggcattacaaaagttggtgtctgtgctgtgacctgtgttgccactgaagtccatctggatatcagtggtctgggctactgtctgagaccctgtttatgtctgggggcatgcagacacaggggaccaaactgatctgatggtctgcactgccacctgacgccatgatgacatctaggcgcatgctgctgctagggccatgtctgtatccgtggtcctattggagctgggtttgtgttgacctccaaggcctttgttatattgtggatgtccttggtctatgcagccacttgaggccatgttgatgcccaggccctgtgctgagctggccctgcccctcctttgcaacaagttggctccaccatctctggctgctgcagttaacagagtgtgccccatacctccactgggagggagagggtcagctagctctgaatttatgatcatgggcaagccggctcggcgcctctgcagtggcctaggtgtagaagagatgcctgcctcctccccgtgccacctgttgggggaagattacaagggcagagagaggattcaaacaaatgggccaggaaatgagctggattggggtgaaacatgtgaaatacacaaagaaatatttaaagttaaaattttcttgtttaatatatttcactaagtagcatgctgaaattcaaaatttaaccagaaacatgtttaggatcagtgtcttacgaaaacatttggaacagcaatttttatgtactgttatttaaagcaaatactttcatttctaagatagtctgaactatgcagggcattatttttcaggtacaaacaaataccaactgtgcaagtattatttggagtaatggctgaaac

SEQ ID NO: 4651 - DNA, 1600 bp, mus musculus
tcatgtacttccagatcttccctatccatgtccacaacttctttttgttttctctctttagaaaacaggccaaaatatgcagagacaactgacacacagaaaactcattaaaaccccacaaatagaaaccacaacatgtaagcaagagacctgtaaggtaaaaaataacaataataaaataaaatctcagacaaagcaccatgaaaccaaaaatataccaagatgccattgagtttgtgttgagttggcagttttctgctaggcatggagtctgtccttgagtgtggcttgtataagccagtgaaatttcattgtagacagtaaaattttcctttacaagagattgtcaatggtagatcatgtccattttcccttctcatgctaggaccagtatctttcttggacatgtgcagtctttgggcatgctgtcacaatatctctgagttcatatgtacatcagttctgtaaggcactctttgcttgctgtcttcccatcccactggattttgacatttttctgcctcctcttccctgagctctgagggaagaggtttgatggagacatcccatttagcactggtgttctgaggtctcctctcagtctctgcatattgtccagttgtgagcatttgtattttttccctatctactgtgggaggaagcttctttgatgatgactgagccaacatgtgtgttctattgttaactatatgaccatcccatgatggttataaacaccctcctcaacactgaaggaataaaattcagatgaccctgggtatgtgtttcggaccgtccagcggcttgcaagaaacggggtatggctgaagaggcagactcgagatgaaagagagggaactagatggacgagagaaagaatggagctaagtcaagactttctgatcaaagctcaactttaatgtcagggaacatgccttataaagaagggtgggggcattcccgccaaatcattcttggagcccagctgcaggtgactacatgtaggctctggaacagctaggtagcatcagcggcaggtagcagaacaaatagagtgatccagggaggcaggctccaccccagatgatctcctagtgacaagacaagtgtggctcagcctgctttaggctatggagggaggttacaggtatgtgagagacacattgcactgagtggcctctgagtgaaacagacaaggcactgtctttccaatgggtaaaaaaaagtcagtaaaataaatgatttctgacaaaatggtctaatgatttttgataaagcctttttcctcttatacattgatgtaaaatggcatgaaacctaaaatatatcaagaattttgcaaaatattcactatgtacatgaaggaccaagaatataccaaaatctgtcatgtcaatgaatataattatgctgtaaaaatgacaacatatagccaagaaacattctttactgaaaagtggtggcagtttctctaaaacaaagtgattggtttgttaacacctatgtaaggaagagaaaactcaattgtgcaaatgactcacactcaatatacaccacacaatattggacactggtcttgctgttgctgttgaaaatttat

SEQ ID NO: 4652 - DNA, 1000 bp, mus musculus
caggacccaacattttgctgcttgcagaaaagccacctcagggaaaaagacagacactacctcagagtgaaaggctagaaaacaattttccaagcaaatggtctgaagaaacaagctggagtagccattctaatatcaaataaaattgacttccaacccaaagttataaaaaagacaaggagcagcacttcatactcatcaaaggtaaaatctatcaaaatgaactctcaattctgaatatctatgctccaaatacaagggcagccacattcattaaaggaattttagtaaagctcaaagcacacattgcacatcctactataatagtgggagacttcaacaccccactctcaccaatggacagatattggaaacagaaactaaacagagacacatagacactaacagaagttatgaaacaagtggacttaatagatatctacagaacattttatcctaaaacaaaaggattcttctcagcaccacatggtaccttctcagcaccacatggtaccttctcagcaccacatggtacctcttccaaagttgaccatataattggtcacaaaacagacctccacagatataaaaatattgaaattatcccaggcatcctatcagaacaccacagattaaggctgatcttcaataacagcataaataatagaaagccaacattcacttggaaattgaacaacactctactaaatgattccttggtcaaggatgaaataaagaaattaaagacattttagagtttaatgaaaatgaagccacaacatacccaatcttatgggacacaatgaaagcagtcctaagaggaaaactcatagccctgagtgcctcctaactaaagagagcatacacaagcagtctgacagcacacctagaagctctagaactaaaggaagcaaattcacccaagaggagtagacagcaggaaataatcaaactcagggctgaaatcaaccaatggaaacaaaaaagaactattcaaaga

SEQ ID NO: 4653 - DNA, 1000 bp, mus musculus
ttgttttatagttattttgaataggttcatgctctttactagtataagtagcctagataaattcttcctctttccatagtcttaaaatatttctgcctatatattttattttaaggggtatacagtataattatattaatgcaagctgccacatgaaaagaaaaaaaccacacgtacaatgcatctataactataacttaagttcacaccttcctgtatagctccgggtaattgccaggacgaggtggagatggattatcatgtagcatctgatggctggccttatgctgcaaagtgtgttttcagaaataatttcctgccacattcctgactgcatttgcaggctgagttgatccccttccctgctgttctgtgatctgcccctgggttactaacagccccaacagacagactggctggtgctacctgctgctccgacgcagattaactcactaccagccatatgggctagcaacttcataaattcctctccttttgcttttggctcttaggatagttaatggacagttttctggtggggagaaaaacaacctgatggtgtgcagtgtgggcagtaatcacctgcaccccacacaactgccccttccatctgcctgccttcagcagctgtgtgtgtgaagggaactgatttctgcctttggtcctcctgcgttgtcagccgctggctttgcctgcaggagaaagccaaatgtgtgttctacacttaagatcatttctaagcatgcccattcttaaatacatctcaaactgtttccagaattaaaaagtccgatgtgttctgtcatgtgtattaaaactcctgtttcttttgggttgtgagcctagcctttaacagcagagccagctctcctgcttctttttcttctcaagtgtaagaagaataaacgtcctaagaaactgtgtagacctgaaaacatcatatatggtcttgtaatctgagtcaatggtgactctgggcaacaccttccttatgcattct

SEQ ID NO: 4654 - DNA, 1000 bp, mus musculus
tgtactcactactaagtggatattagctaaaaaaaaaaaaaaaaaaaaaaaaaaagtacagaatacccaagacacaatccacagaactcaaaaaggtcaccaagctgaagtgtccaagtgaggatgcctcagtgagggaggagcagggaaagtagttggggtggaggagaataggaggagaggagaacctgatctattattgggtgagggaaagggactgaagtattgagggccaccagagagaatgaaaacaggaaacctcaggagataggaggtaaccctccagaatgcaccagacctgggaggtgagagactccaggactcaaaggaagggaccttagatgaaatgccggatagtggggagagggaaattatagagctcaccaccagcaggaagacaaggcatcaaatgacggagggggttgccatcccacagtcaaaatgttgacccaaaattgttcctgtctgaaagaactccagagatggaaatggagaggagcctgaggaaaagaaggtccatcgacaggcccaatgtgggatccacctcaaggggtggtcccaaaacctgacactatttctgaggctgtacaagacccaacaagcagctgaaggtgtcagatgcagatacttgcacctcaccaggtgacataaactgctgacccatgtgttctaattagggaaaatctggaagaaactgaggaggacagcattcctgtaggaggaccaacagtctcagttaatctggacccctgagatctctcaaacactggaccaccagacagcatacaccagctgacatgaggccccacacacatacagcagagaacagctgggtctgtgttaaatcagaaatgatacacctaaccctcaagagactggggaccctaggaaatgtagaggtcaggtgggatggggggtgggagttgggggttggggacatggagacataaggcgggggaggaattatgggatgtggaacactcagaggtttgattggggg

SEQ ID NO: 4655 - DNA, 1000 bp, mus musculus
tctggttagagcgtgtttctctcatgattctgttagcctctatcagcaaacctaagagactagctctctcctctgagtttcagtggtcagagcactctctgcaggtaagctctcctcttatagggaaggtgcacagatatctggtgttcggacctgcctcctggcagaatatgaaggcccaaaacagggccatttcctagaagctgtgttgctttggccagtcccagaagctgttagcttctgtagtccacactctcacctgcacagacaagtctcagagggatctgggaaccaagttggtgcccccaggtgctctggcaaagccttcctgggtgtggcggacacctcttctctggcagtggaggtgccgggatgtctggagcctgaaagggttctgcctcaaaagctgtcctctagggaccttgggggttttgcagactctgcgcccaggtgacttggtgctggcacgaccagaagggatttgtgaccctggtcaggctggcttttctgcttccctaattctatgtcaggtcccgtgtgattggtttggaacagaagttgtgttccactcaccggtggtccaaagatggcgtggagaatcctctaggggaccttggcggtgttcactgactccgtgcccctaggcagcttttaacattatcaattggttctgaaattattgtattggcatcttgtgtattgagaatttgttgacatgtaaatctgattggttaactataagcattgagtcttgtttttacttggttactgggtattgtgttatcaaactgtgtgaggatggcagatttatttggttattgagatgtgggaaagagctggcgagaccccatttggacatagtgttgtggcctgcaggtgccagtagtagagctggcacatggcccagtagggccggagagttggtgggttgagagaagcaggagggaggagagttggcaggttcattctttcagagcctaggtaaaccacttgggaataa

SEQ ID NO: 4656 - DNA, 1200 bp, mus musculus
acactactccagtaggaatgatgtcatatgtgttaaggaaaagaaaccagaggtgtaagaaaacaggaaaggctaagtgacaaggtgagcctacaagccagaaagaaaggcctcaccagaaaccagcccagctatacatgcctcccatgctaattacaatgttgatggccctgggttccaaacaagacctcgaagctgtttgtcaacacttagccatttctcagaggccagctctagttcaggcttggtgtcttatgcaatggtgatgtgatctccagacagagaacgtgcacccaagagaaccataatgctgttaccctccttcttctcacattagaatttcgctcacagtcttgaatcaaaatgctagaggaaaccataattatttattagcaattcaatgccgcttacttaatttgctcaaacacatgctgagcacatgctatggccatgttccacaggcagtagaagggatggaaagtaagccttgaccactggcctcatgaagcttataacccagcaaaaagaaagacagtgttggcacatggcttcatgagagatatgtgtgaataacctagggctcagtgagcagaagactcgggctcacattctttacccacgtgggttcagctgccttcaccgctcttcatgtgcctgttgccatgaaccagactcactttttgactaacatttttggacctctggaaagccctaagaggtattgacttggctaaatctctattatgtaatcctactgtgaccattcataattcttaataaatctgctcagtagtttcatactcatttgggtaatctgaagaactccacatatcatgcctttgtcaatgtatccacaccaccaccaccaccagacacctgcccatgaactaggactgcggccagcatcaactggtgcagaggagggagggagaaaaagacgagggacatgtaagcagaaacactgttacttacagacacccctgctggacctgtagccttcagggtggcatcagcaaggctgctttgcagcgtttctgagactgtagccaaagccccagctttgtcccctttcaccagcacatcaaaatgaagtgccttggtgtaggcctcatatccaaatctcacaaagctctcctctgcagatcagagggctttgtccatatgtgacatacaatgatggcaaaggggaaatcatcgtct

SEQ ID NO: 4657 - DNA, 1200 bp, mus musculus; identical to SEQ ID NO: 4656

SEQ ID NO: 4658 - DNA, 1000 bp, mus musculus
agcagcagcagcagcagcagctctaaatcacagtttggtccttccaggcttcctgagatcagttcctgaccaccctgctgtgaatgacacggcgcatgtactaatgtagttggacatagggcttgggaagcacagaaatgcccagtaaattgttcctgacagcatcagcctctactgtgtatcaaatgacccaaacttttttttatggtctcatcttgagttcctgccctgatttccctcagtgatggactgtgatgtggagatgcaaaacaaagaaactcctcccatactaacgtgggttttggtcatttttatcatagcagctaagagcagactaggcagacggacaccggggctcagggttagctaggaggaagttagctgtgtaagcacttcacagtcattgtacagaaagtgttttggagtatgttcttaataagaaaaatactttaaaagttatattttatttcagctatgactgtggtgcttggtatggttataattgtattaatgggtattttatacatataagattatagtatggaatttgcggtaaatatgtgatattcataaaataccatccatggcactggagagctggctcagtgggtaagcacctgctgtgcaagcagaaggacctgagatcagatcccagcactcagtgaaaaactgggtgctgcctgtgcagggctctgtaatctcagggcctgtaggggcagagacaaggatcagtggcccttgctgccagccagcctagctccaggtacagccctgtggcaagagagtaaggtggggagtgacagaacaggagacctgatgctctctcggcctttgtgcaagcatatgcatgcatgcacaggtacacacacacatacttacaaagagctgccattcatgtagctcagtgtctccttccttgtcttcatcatatccttaaataatctgatgggacttttggtgtttgttttttcccaattagaggccattaggtagaatagtt

SEQ ID NO: 4659 - DNA, 1000 bp, mus musculus
caggccaccagagggctatttttgggatacttgccctggccccacctcctctagcagggcagggttggtcagagtacttggtatttctggggatcctgtgcctcttctcctcaggctcactcctgagacaacactgtttagctgtggaactagtgacctatggagtgtgacctcaaaccttctccagaggaggacaggaaacaagagccgtctttctctaggtcaggggctcttgtagctttgccactgagaaacccctaaaatcatgtgcaggtcaaatagagattgggatgggtgatggcttttgcagtaggtaaggcagtggcctttctcctgtggggagcttactctatgggggccaacatcttcctgacaagtgtccaggttatataaccagagtaaccctgaggttgcagggagctgcccccaatatgtaccagcaactgggatcctaaattacccccatgtgactctctggtctcctgacatggcccacaacagttctaaaagctttcctggcttccccgcttgctgtcttagggagccttgctggactctcaaggcaatggagtagtaattaaggctttttgctggggtgtcaaaaatctctgccacttaggaggcccagtcctctgaggaggatcaagctgtggtctgccagctcagcacctgtggatccgagagagagagagagagagagagagagagagagagagagagagagagaagggggccccacctgcaaagataccagagtgagtctttgaaaggcagtttggaaaggatctgaggcactaaggagtaatgcacaagtgagtatttgctgaccatacagggaaccctgggttggtctctaacagcacaagcacgcgcacacttcaagctgaaacctgccctgtgaccacggcaagtggttcagctaggggacctagcttccctgtggacatgatcagtgaacttctgagaatcctgcaaactggttcatctgcagttagccaga

SEQ ID NO: 4660 - DNA, 1000 bp, mus musculus
tattttgtttgttcatagaaaagattttcaccttcacctggcaagtggtgcacttgactcctctgtttcacagcgggcatttcattcctataaaagcctggtgctgcctcaggagttctggtggcaagtcctaaaggaagggaatacaagactattggcatagaatttctcagcccgactgaataagaatatatcttaaaggccaatttcctaatgactacacaggaggcctgtgttgatctgtgctgggctgtgtgtgcacgtgcatgtggagatcggagatagatgtccagtttcttccttcatcactttgcatcctctctattgaggcaaggcttctcagtcaaatccagagcttgctgatgtagctgctctagctagccagcttgttccagggatcctctatctctgcctctcaagggctaggattacaagtagactgccacattacctcacatttatgtgggtgctggggagttgatctacagtattcacgattatatgacaagtatgttactcatggagctatctcctcagccctattttgtgcctttatttagtacattatatcgctctctctatatctgtatctaagatattaatttctatgataaagatattgattgctcttacccccttatgctctcgcctctctcttgcctcttgcccccttactcccaatttccttccccccttcttcatggccatggctggccccccctttttctactttctccttctctctgcctttctctgcatctgtacccttttaactcccctccccattccctgaataaactctattctatactaaaaaaaagatatctatttatctgatatatatctgacatatatgtatatatacatatatatacatacatgtgtgtgtgtatgtatgtgtatatgtgtgtgtatgtatgtgtatgtgtgtgtggtgtgtatgtaataatcaaagaatcacttagggttttgttgatattgttttggttttgttcttgtt

SEQ ID NO: 4661 - DNA, 1200 bp, mus musculus
cccgcctcagcctgcggggcgcgcagagctggctctctcgctccctcccagccaagcagggcgctgaggctaccaccgcgggctacgagccctggagccctcacagacagccgggaagccacacgcacctcagacagctgcgcgggcgcgctctccctcttgcacaggcacacacacacacacacacacacacacacacacacacacacacacacacacacaggcgtgcgcacaggtgtgagggcaagccgcgatgggacagcacgggtgtccctggggaccccagacttagcaccttcctcagacgccactagccgccggccagcccgtgaggcggagggcgcggaggctgcaggctcacaggcgggcgaaggtccagcccggatccggccgcttctcgggtccctctggtcctggtgcctggcgctctccgaggtcctaaccgagcgggcgggtctgtctcaggctccgcccccgccgtgggaggtaggccccgccccagtcggcccgcaccctcctccctcccagactctcgcgccgggggcggggcactctgggcaccaggggggcgggacatcctctcgccaatcacaagctccactgacctaagtcttagggattccaggcaggaaagaagtttggggataggtcagagaaaaagccagtgacaggaggaggggatcatttaggaaagtaggtgatgtatttgattgacagccatactagccagtatgccttggcgccgtgctttgggggctgtaattggtgctacctgttgaaggacgcaagtgtgaatcaatagaatgcttgcaagcttgagaacttgcgctccgggagtcccaggctgcagaaagggttaccttaggtcgtgctctggactgtattgtggacccggcttttggaccgggcttattttgcagccttcccccaccccccagcaccccttgaatctatttctgctcaccagggccaggtgcatctaatagacgatctcgctgccctgctatatgcgttgaacgtagatttgtaaataatccctacaaactgttagttctctccattaagtcatctgtaccaaaatgaattggttttcggtggaaatgttggcttccaaatcttaaggaaatgatttgcctactttatacagcctatggaaatagaccagcgttccccttctccacatagacaaattaaattttt

SEQ ID NO: 4662 - DNA, 1000 bp, mus musculus
cacacacaccccttctcccttaccacacttaccaacacaagactttcgtagccacccaaactgtgggaacttccccagccagccaggaagcaggtcctcctgagtggacacacagtgtcactagttctgctcatcatctccccaggggaacggctcattcccataactgaccacctagctacaaactgagctggagtgactccttggtaaggaatctgtttgatgagcacatcacacggtgcagggaagcctacttactggtttgctgtaaaaggcattcccgtgaagacatgtatcgggtgaagcccaggcaaagtgcagatattccatgccctccctagtgcttgcctctgggaaccagcagcatccagcgctagcccttgggttgtcatggaaacgtcacctgaaaggtgattcaatctctggcactgggtgagcagctcacttcaaagctcacctccctaactagaggctgtgagttaggactgacagtgcctgatctgtgctctactaagaacttctaggtgaccaggcctcatccctaagaggtagccagccatcatacacgtacatagatactatcacttgtgggtttccaggatttgggaagttgtatgtcaaagactgcaaatatatacttaacaatatcacactttaataactccactaaaaactactctcaagaatatactactttgcttagtgaaaactcttgagactttaaagtacaacggggctgaggcttaactcactggctgagtgaatgcctagcttgtactagactctaggctcagcagatggctttgttgtaagtcacacagctgctatgcttcaggctaaaatggaaagcgagaggtttactcctggagtccttggctttcaagactgcactatactgttctttagaccttgtttaagagtagaaccaacttaccaagagtaagtccaactccaaaataaaatgctagcggtttcttccccaccatcctatcggcaggat

SEQ ID NO: 4663 - DNA, 1000 bp, mus musculus
gaagcttaaaagtaagatagggaatttataagaaatgttaaatgtaccatttttacaaatattatctaacatgtgtttagaacaaagtattcaaatctcttaatctctcccactttgtctttcatgaatttgatggcttagagctgtgaccttatggcccttgtaacaggactcaatttcttttcctttatattctgtgtaacaattcttcttttttaattggaaattttatttgtttacatctcaaatgttttctgcaaacccccaatcccatcccccttaccctacttctatgagggtgatccccacccactcccacctcaccaccctagcattactctacactggggcatcaagccttcacaggaccaagagccttgcctcccattgatgcctcttcagttcttttagttccttcccctaactcctccattggagtccctgtgctcagtctgatggttggctacgagtatctgcatttgtattggtcaggatctgccagagcttctcacaaaacagctgtatcagtctcctgtcagcaagcacttcttggcatccaaaatagtggttggtgtctcaatatgggatgggtcctcagatggggcagtctctggatggcctttccttcagtctctgatccactctttttccctgtgttccctttagacaggagtaattctgggttaacattttggagatgggtgggtggccccatctctcaaccaagataccatgcttaacctctgaatatggtctcaacaggttctccctccttgtggtggggtatttcagcttgtcatccctgtgggattctgggaggttcttcttttcgttataagataagcctattgaagaagactatgaggtgagacaccaactactagggaaacagccacagccaccatcatgacctgaattagaattaaaaccaagtatactttttgtaaacacaaaacaaaacaaaacaccttaaaatatttaatatgctctaaattaaaaa

SEQ ID NO: 4664 - DNA, 1200 bp, mus musculus
gaatagtaacaaatacagaaacattgatttttattattaattttaatacaattttagattaacacactgtacactgtactgtctggttttgcatgtcaacttgactcaagctggagttattacagagaaaggagcctcccttgaggaaatgactccatgacatccagctgtaagacattttctcaattcatgatcaagggtaagttggcccattgtaggtggtgccatccctgggctggtagtcctgggttctgtaagaaagcaagctaagcaaactataggaagcaagccagtacataacaaccctccatggcctttgcatcatctcctgcttcctgacctgcctgagttccagttctgacttcttttggtgatgaacagcaatgtgaaagtgtatgctgaataaaccctttcctccccaacttgcttctttttttttttaatattttttttatcacgtattttcctcaattacatttacaatgctatcccaaaagtcccccataccctccccccccccacttccctacccacccattcccattttttggccctggcattccctgtactggggcatataaagttagcatgtccaatgggcctctctttccagtgatggccgactagtgtgggaagccgcaaacgccattacaagatggtgctggctactactggccactgcccatgattatgggtaaacagccaatgtgcgcatgtgcatgagttttttttttttttgccgagtcactgcctggcctgtcacatattaatgatggactggtagcataaccaatcaggtatggacatgtcactcctaggcctatataagcagcaccatttctgggctcagggtctttcgcctacgcagtcaatgctctcccaataaacatgtgcagaaggatcctattgtggtgccgttcttgctggcgagtcgggcgctcacagactaggccatcttttgatacatatgcagctagagtcaagagctccggggtactggttagttcataatgttgttacatctacagggctgtagatctctttagctccttggatacattctctagctcctccattgggggccctgtgcccaacttgcttcttattcaagcagatttgtgcaggaatagaaacactgactaagacacacacaaacagtggctttgttcatgcattcaggaaattgtattatgaaatttt
